United States Patent 10,718,023 (GENETIC POLYMORPHISMS ASSOCIATED WITH LIVER FIBROSIS, METHODS OF DETECTION AND USES THEREOF) - sequence listing, part 2

SEQ ID NO: 5027 - DNA, 100000 bp, Homo sapiens
  misc_feature (19767)..(21153): n is a, c, g, or t
  misc_feature (71906)..(73652): n is a, c, g, or t
ctgaggcaggagaattgcttgaacccaggaggctgaggttgtagtgagccgagatcatgcactgcactccacgcctaggcaacagagtgagactccgtctcaaaaaaaaaaaaaaaaaccactttttaaaaaaataagagctcatggtacctatttgcatccagtacatcattgaagttgtagaaagctgcttagttaaagtgaggttgggtcacttcgaagcagtcctccagtttctaagcaagtaagttttggaggtagaaagaaaatgttctcctttatcctagaggctcgatgtggtatggtgggcccgggtcattgatttgctttgtccttaattggttgctcctacctacagaagtgaaatgggtgttctgatggggggtggtgggtggtgacttgagaaggtccggagcctgaagtgggatgaatgaagagcacagaggctcgttgggaggcgaggataaggggggcagaggccagatcccacaggccaggagaggctggaactaagggcttgggcttgacaccgttacagcaggggcctaacacattctattaggttgatgcaaaagtaattgcggtttttgcattaatgtgttaattgccattaaatgttaatttgcaccaaatacctgtctggaccctcgtgtcctccttgtaaatggtgtggtctgggtgcctccatgttgaaacattcgataaaaaggatgatgtccccatctcaagtgctgggctgtgtgtacatcttccctctgcctctcccccaggcctccaccgctatgtctggctggtttacgagcaggacaggccgctaaagtgtgacagcccatcctcagcaaccgatctggagaccaccgtggcaaattcaaggtggcgtccttcgtaaaaagtatgagctcagggccccggtggctggcacgtgttaccaggccgagtgggatactatgtgcccaaactgtacgagcagctgtctgggaagtagggggttagcttggggaccgaactgtcctggaggccccaagccatgttccccagttcagtgttgcatgtataatagattctcctcttcctgccccccttggcatgggtgagacctgaccagtcagatggtagttgaggtgacttttcctgctgcctggcctttataattttactcactcactctgatttatgttttatcaaatttgaacttcattttggggggtattttggtactgtgatggggtcatcaaattataatctgaaaatagcaacccagaatgtaaaaaagaaaaaactggggggaaaaagaccagtctacagtgatagagcaaagcatcaaagaatctttaaggaaggtttaaaaaaaaaaaaaaaaaaaagattggttgcctctgcctttgtgatcctgagtccagaatggtacacaatgtgttttatggtgatgtcactcacctagacaaccagaggctggcattgaggctaacctccaaacagtgcatctcagatgcctcagtaggcatcagtatgtcactctggtccctttaaagagaatcctggaagaagcaggagggagggtggctttgctgttgttgggacatggcaatctagccggcagcagcgctcgctgacagcttgggaggaaacctgagatctgtgttttttaaattatcgttcttcatgggggtaagaaaagctggtctggagttgctgaatgttgcattaattggctgtttgcttgtagttgaataaaaatagaaacctgaatgaaggaactgagtccccggagttttgttctattgggtataggtttcataagtgtgagaagtcaagtctcagggtgagtctctccgtgaccagcaagtaacagctgggacttgttctaggggccatatggagggtctgtcctctacatgtgccattaacccacagcaggagcaaacagttcagatttgaggtttctaaaaaaaaatcataaaatgtgaggccgagtcttattgcccaaaaagcacctttgcttcaagggtccttttgacccaagaaggatgttctaaagaagatggctgaaaaccttcccccttgggaagtctggcgcggacactgtaacaatgcctaagaagtagcctgcacttcccgttctgagtgttatccacagaggctcagtaccaaagaggtgcgcagggtaggagggtgagaaggtccggtctcatgccatctgatgtaccgaaagaaaggaaaggaggtgtttgaaggtgcaaatactgtgatttggtctctgcgatgcaaaggggggggtcctgaatcaggcctgacaggtgcaatgactagcccttccccatctttcactgcagtacttttttctctgaaaaaacttggaatgttgccttgctggaagcacataaggtagatgtaagttttctttttttctttttttaattttttgagatggagtctcaccctgtcacccaggctggaacgcagtggaataatctcggccaccgcaacctccacctcctgggtgggttcaagtgattctcttgcctcagcctcctgagagctgggattacaggcatgcaccactatgcccagctaattttgtatttttagtagaaaagggttttgccatgttggccaggcggctctcaaactcctgacctcctgaccactttggcccccaaagtgctgggattacaggcatgagccaccatgccaagcctggaagtttttttttttttttttttttttttactttagagttctaaaattcgtttttttacgtaataagattttgtgaacacaagttacaaagaaaacaactgtcagctgggcgccgtggctcacgcctgtaatccagcactttgagaggccgaggtgggtggatgaactgaggtcaggagttcaagaccagctggccaacatggtaaaacaccatccctactaaaaatacaaaaattagctggacatggtgcgggcgcttgtaatcccagctactagggaggctaaggcaggagaatcgcttgagcctggaggcgaggttgcagtgagctgtgatcgcgccattgcacttaagcctgggtgacaagagcaaactctgtctcgaaaaaaaaaaaaactgtcctgttgaccttggaaataaatgtaaagttgggcatggagactcacacctgtaatcccagcactttgtgaggccaaggtggggcagataccagcctgggcaacatggcaaaacccctctctctctaaaaaaatgcaaaaattagcccatgtgtggactcgttcctgtagtcccagctactagggaggctgaggtgggaggatcactgaggtcaggaggtcaaggctgcagtaattccagctacttgggaggtggaggcagaagaatgcttaaacctgggaggtggaggatgcagtgagccaacatcacgccactgcactccaactgggtgacagagcgacactccatctaaaaaaaaaatagaaaaagaaaaacatattaatataacacggaactaaagagaaaaaaaaatacatatatatgagaaggcagtagtcatctaaaaagaagggtgatgccttcaactggtatgtgatgtgaacttccccaagggcggctaggagggggtgacccccattctgaactcaactctggcctcaaggtccagctgataaccaccggcccactgggtcacaaattccagcttcctcatttgaaaaaacatcagggttgcagggggtgtcagcctgccttatttacctcacagcgttgttggaggacaaaatcatcttttttgggataagagttaatgtatgtaaatgactaaacttggcctgattgtcatataagaacaaagtaaaaagtccagtttcctcaggtctgtttcctcactgcagcctccgcctcctgggttcaaggattctcccgcctcagccttcctagtccccctgccttccttactgcctcctcaggcaggactaggaggagtaggacaactctgtccatagcaggtgtttgttaggagcagggacccactccctgcttccgggtaactgccctgggacacatccttgacaaacttgcgcagtgggactttttttgagaccgagtctcattctgttgctcaggctggagtgcagtggtgccatcttggtcactgcagtctccgcctcccgggttcaagcgattctcctgcctcagcctcccgagtagtgggattataggcgcccaccaccacgcccggctgatttttgtatttttagtagagacgggtttcaccatgttggccaggctgatctcaaactcctgacctcagatgatccacccacctgatctcccaaagtgctgggattacagctgtgagccaccgagaccttttctaaagatagccctacaatctcagacatagggccctttcccaaactagctagacatttctcaccacagtggaaatggatgaaagaggctacaggaagcttttctaccctactgaaggtggaatactccttgggtatagatcagacaggtctcgattcagaccccaccctgccactggagtgagcttattcttcatttgtgaaagcctagtgttccatcatgtggcaagcgtaagcacgccatcgacgtatctgtttctctaaccctttccagtattattttcagatgtacctaatatagaaactccatgaacagaggtacttaggaaacacaattatcactgagtgtgatgttacagaaggtttttagttgggattaacccatgttgataattatttatgagtatacctttctgctttagcctacagagtgaacatgactggtcacatttgtctccgatacatgaacatcctgtaggaaacaaagtgatctttaggtcatcatattcttttcttttgaaacagagtttcactgttgttgcccggctggagtgcagtggtgccatcttggctcactgcaacctccgcctcccacgttcaagcattctcctgcctcagcctcccgagtaggtgggattacaggtgcccgccaccacacccagtaatttttgtatttttagtagagatggggtttcaccatgttggccaggctggtcttgaatcctgacctcaggtgatccacccacctcagccttccaaagtgctgggcccaccccacgtatcatactctaaagagcaatttccaggagtgtccaagggagagaacacaagtcatgggtcttagtttctgtttctggttgggccagtaaagccccttcctcgtcccccttttccattttcactagacacagaaaccaaaaaccatagcttcaggctgccaaaagcctagaacaaaacaaacagagtaacaacaaaataaggtgggttggacaagcctgattgatagaggcttaagctttgggatcttactgagattgtcctgactcccaaatcatatccctgaaattttatatttttactatctcattgttttacatgtaaaattattctaataaaagcagaatatgaggggaggggatctaatattacagtggggtcatttcaaatatttggttatagtgccttctccacagctgcttttctttaagggtgcccaatttctctcttcagcaatgcatgcttctatgcacgatggcacgtggggggttttgtgtgtgtgtgtgtgtgtgtgtgtgcgcgcgtgcgcgcgcaatgccttctattctttaggacagaaaggtgcagttgaccacgtgcccacatcgaatggtcaacactatcttcagccccatagaagaacttggaagacagagctttacctgaaaggcttaatggctcttcttggagcgaccgaggctatggagaacagtttcaggagggtggctgtcctctgagttgtgaactggtgaacctagaagggaaacttcctgctacaataacacagcaagcgatgtgatgaacacttttatttacaaatataattaaaagctctgacagttatcatgctttccttggaacctgaaaaatgttttgttttgtttttaaagtgcatgcaaaagaagtaaacctttttttttttcatcattttttattgtaagaaaatacacagtttgaaagtgtgaatatgcaatatttatgaccaagaaatgggacttaggaaggggaagggagataaagaaaaagacaagatgatctgattgagagacagtgttgaactccaaatactgaactggaaaaggagggggtggggaggaacaggaggaggaagtaaaaaaatttgatcagagaaacagttaaaatacatatgaaaataagtaatacctctccttaaattccttctatacacaaaatacacgatttgcaaagcccaatttgtgctactgggattctgtgagctccttaagtgtattcacatcctctcaacagcagaaaatgattatgatacaatcagaatatgctgaagacaagttaaactcttgcagcaggttcttaaaaatcacaagatctcttcaccccacccaccccccgtccccaaaaagtaataatatgtcaccactgatatgtacatcacaattagtttctgtaaaatgtatcaaatttcaatctttaataaaactttgttttttttattcctgatgaataaataccaaaaaaataaataaaataaaataatgcagcagctagttaaggtgtaaggctgcggatattgtgtctcctcccccttggcatttattattattattttttgctttactttcacagattggtggtaatagtgattgcttaaagcaatatacatccactttttttgttgttggtttattggttttgttaaactgtctccaaagttttcactgaaacattttgaatcacatcaatactgtgacgtgtatgtgaatagaagagacggccaggttttggccagcactgaaagttgacacggggggaggagggggcccctgatggagtaagaataaacaggcactagtccgacacgatgtcagtaagagaagagagagagagagtgagagcaacgcccgttaaaatggggaatgtggttttgcagggttgaatttttttctgttttcttttttttttttttttttgtaaatggcaaaaaatttaatccatctgtagtcctccttaggaaaatctaatgtaaccaaattcccaaatcccattctgagctctccatgtcaaaagtttcaatctctcgctcttgcctttccaataggttctttattcttcgctgcgttccttctgaagggcagccagctcctcttcaatctgaaagaagcacgatgcgttcttaatggaaagcatctcctaacaggcacccacgtgcacgcgatacacccataggccacatatgacatgcacacacacataggcacacacatgaagtgcgcgcgcgcgcacacaccacacacacacacacacacacaggaactacgggaggaccgaggaaggctggctgagtccgtgatcaatgcatctaaatcattatatttaaaacttgctcacaagaatatcaatgtttgggtccacctggggctggcaatgccgttctagcaagcccagcggctgggcggatctaggtagtgtcctgtgttaggggatggctcatgagaagctaaaagacactcaagcacaattggatgtgctgctttcccacagagagccaaatgcctcctgggtcattagtaatttagttctagacaggagctgggaaaatagtctgttacgttggtctcagggaactactggaagaaagtgcaataactggttaagcaaataaatgcttaacagctttgagatgccttatgaaatgttttcacttcatattcctcagaatttctaaagcaatgaatatttcagttgggataacatttatgatggcaatatcagcctatcatcattttaatttttttttaaacagccctgctggtgattttctcggtttaaaaatagctgaaaagtcaaatctattgtacatttggcttcctcgtgccattggcagccctgctgtcagctcacagtacctttcaggtgtcacatcaaccaccccagcacccacatcattcctctggctgggaacgttgagggtttcctagcagagcagaagaaagactaggatgtggggtcagacatgcgtgccttggtgtttcggcctgtagaagggggacaatgctacctcacaagggtaccagtagcataaagcagataagtgaaaagtgcccagtttaatcctaactaaggaaggctgcatatatggcagttccctcagccacgcccccttccacccagtgcaccggacccctggtaatgctcccttaccttctgctcaaggtgtgctctgcgcagagaactctctgctctagcttctggagctcacgttcatgttgtgcctctgtttgcatcttgatttgctctggtaggcgttgagcagctccatttcctgctggagctgtagcctcaaggcctgcattctgcttcttgagcctcatctagccgtaactgcggacacagaagacacacacggtctgcacccttgcctacagcccttggtggcctacagcccttggtgactactggaagaggttcctcatttggattgaaattggttgccccctcaaaaacacagatgctctgggtacattcaagttgggaatcaaaaacagtcaagtctgcccaatgggctacaataccaaacacattctttcagtatgatctgaaaccacagcagcaggcgtcaggaaggctacacctgtgggctttggggtaggctcctgggcttgaattacagctacaccatccactttgtgtgtgtcacaccttgcacattacctacctctctagatctcatgtgtttcatcctcaagaaaataacaagaatagtcctattgcctgagattggtgggaggattaaatgaaagaattaatataaaatcctaggccagttctcaatgcattacaagttttcaataaatagtagtggttatcattatttcggtttaactgatcatgtccttatttcaagttctttaaccctaaaatcatttagatatgcttagcctaaaaaattgattccaatttccataaaacttggggaatataccacagtactgttatgcccaagtagtaatgttggcacctattgttggctataaaagttacattgctagccagccaaccaaaactccaaatggttcaaaatctcttccctggctggtggctcacctctgttatctcgcgctttgggaggccagggtgtgaggattgcttgaggcctggcattcaatactagcttggaaatattgtgagacccccatctatacaaagattttttaaaaaattagccaggcatggtgcatgtgcctgtagtcccagctactttgggaggctgaggcagaagaatctcttgaacccggagttcgaggctgcagtgggctatgatcacaccaatgcactccagcttggcagacagaactttgtctcataaaaaaaaaatctcttcctctcagagggtaggtaggcttgacaatttaagaggcataactgctttgaagcagtgcctgaactttgtcttatacaagatacccagatctgcgtggagaatgaaccaagtagaagcgccaacttctcaaagcagagtagaaggtttcgaccatcagcaggacagtgtttaggaatgatgaccctgggttgcaggcttggtttggtcaattttggcaggcccacagtttggctgagaactatgagattagaacccttgaatcagtcatttaccctgagcttatctgtgtttccttattgaccacttttccaagatacttattctcaccttatgtacaatttgtgacaatatacatatcttgattgaaaaattactttttgaaatttatattaaaatagttttagttatttgcatgtatcttcttttagtacttctggagaaactactatagagattaaaggaacaaaataaattacataatcatatttccaaggtaccttctaaaattaatcctaaccaggtttcattaaaacccttaaagaggacagacagttctcatttcccagtaaggaatgaagggataagagacactagacacaatacatagtctttggcaggaaagactcacaggtaaatgccaaaggatttactggctcccaatgagggttgttactgattcctcttgatatgggaggttccttatcagtaaaggcagtgaaagtcctgttcttttctactgtctgcattagttgctgtaagccccagctaagtgggtgagaggttcattctatggtcaattagaccatctaaacatctaaatatctttaaacatttagaacatctccatttccttttgttctggcacgctattattattagcagtaactggtaccattgttctgtaccagctctgacgatggcccagtgctagaaatcagaggatattccagcatttagtttttatcacccaaggtacacacatcaaatccattaaaaagttgttttttcgtggtttttgagacagtctcactcattgcccaggctgagtgcagtgatgtgatctcagctcactgcaacctccttctcccaggtcaagtgattctcctgcctcatcctcccgagtagctgagattacaggtaagtgccaccagcccagctaattttttgtatttttaatagagatggcatttcaccatgttggccaggctggctcaaactcctgaactcaggtgatccgcctgccttggcctcccaaaatactgggattatggtgtgagccaccgtgcccagctccattaaaaagttttataagagtataggtaaatatgctgatctttacagtggcttacactgaagatacgataagaggcaacataatgtagaagcaccaagcatacaggcgcacaggattccccccaagatgggttcaaatcctagctctaccacaattagctatgtgaccttcccccttatccccccaagccagtggttggcacactacagccatgggccaaatctagcctggtgcctggttttgtaaatatatatatatatatttttttgaatggagtctcactctgtcaccaggctagagtgctgtggtgtgatctcagctcactgcaactccgactccctggttgaagcgattctcctgcctcagcctcctgagtagctgggattacggcacgtgccaccatgcctagctaatttttgtatttttagcagagatgaggtttcaccagttggccaggctggtctcgaactcctgacttccggtgatccacccgcctcagcctcccaattgctgggattacaggcatgagccgcttcgcccagccataaataaagttttattggacttgataatactcattaatttatgttttgtctatggctgcatttgtgctacaatggcaaactgagtagctgtgacagagaccctgtggtccacaaagctaattactatctgtccctttaagacaaagtttgccaactcctgtcctaagaaagtagctttacttcagtgaacttcagttcctcacaggtaaattagggtcaaaacagtaactacttcaaaggggtttcacaaaaatgaatgaggtaacacttatgagatgtttaacattgattgtacttgccacatggtaagtagtcgtaaaggatgctgtaatgatcacacacttatcttctccctgtctcagaagaaagggcattctctccttttattcaagggtaatcattgacctgtatttctgatcctgttctctctcatttatttattttttttaagagtcccagtcttgttctgttgctcaggctggagtgcagtgggtgatcatagctcactgcagccttgaactcctgggcttgagtgatcctcctgcttcagctcccaagttactgggactacaggcatgtgccaccatgcctggctaatttttgtatttttgtaaagacagggtcttgctatgttgcctaggctggccaagaattcttggcctcaagtgaccttcccacaaagtgctgggattacaggcgtgagccaccgcgcctggtctctcccatttatataacaaacattcattgaacgcttgttgtatgccacacattgttgcagaggctgagctataaagattaacaagacaaaaaccctatcaacctccatgtgtctatcaacttcttcctctctttgcctttcatctccctctgcaaacctttcctcgcactcattctgatcctaacccctacttctaccgctcacattaaggtgacccatgatagcctggaagtggcctgttacctgccttccagcagcatttggtattgctgactgccccttccttcttgaaatctttgtcttctagataccacaacttcttggtttttgtcttccctctctgactattccctttccagtagtcttacctacctggtccttaaatgtgggtgttcttaagggctttgtcctgggccctcttctcctctaaccgctcttcctaagaatctcatctatttcaaaagcctcaattaccatctacaatgtacaaatgactcccacactaaacctctatttcagactttccttctgaggtccagacagctcctgtagtctaccagagacatcctcctctggatgtttcccaggctctcaggctcccgcagccaatacatcaccttttccttcccacaccccaatctgttccacttccttttttacatataggtaaatacaggtagaccatcatctactgctttatttttgttttttttttagaggagtctcactctgtcacccaggctggagtgcagtggcgtgatctcggctcactgcaactctgctgcctcctgggtccaagcgattctcccgcctcagtctcccaagtagctgggattcacaagtgtgtgccaccaagcccaactgatttttgtatttttagtagagacagggttttccacactggccaggctggtctcgaactcctgacctcaggtgatctgcctgcctcggcctccaaagtgctaggattacaggcatgagccaccatgcctggcccatcatctactgttttgtcaaaccagagactggaagtcatcctgaacactggactctccacatccaacctgtcattagtactctcaattctacctcccaccaaatttagtaacttcccccttcatcccgactgcccttttctagtctggctaccactccctcataccccaggtaaaagtcacttcacaaatcattcctaatatccattcttcccatctcccaggccattctccatgtcaccagagtgatggttaaaaacacaaatctgatgtcacaccctgcttaataccctccagtggcttttcattgtttggataaagacaaaaattcttaacaaagcctgaaagcccctacgtgacccagcctgtttaccctccagtcttgttctcatgttagtcctctcctagttccctacatcccaaacataataatttctgtgaattcttccaaagtgccactgccttcccaatgttcacacgttcctcatgttaggttcctcagcctacatagccattgtgccagggaggcctctcctgactctccagaccggtgagctctcctgctttgcagtctgttggcaccttgctcttgctctgacattacacgggtagacttttccaatgtctgtttcctccatgcttccataaactccataaagacgtgattatgactgtcttatccaccactgtatctccagatgcctggtacatcacgtaggcactcaagaatacttgctggatggatgaatagatgaatgcactagctcccatcctcggcctaagaaatgcatgcttaagcatctcccaactaacagaagtctttcttcaactctctctccttttgtaaagctcttgttctcttttccttcattgatgaggatctgggaaaagcagtctcacttacatctggatttcactttataatccctcattcaatgctctataatgtctcccagtcccacactccactgattgtccgagacaagcaatggacgaatccagtgctaggtccaatgaacactcaaagtttattcttctaattgatctctgcaacatgtgacgctgtcagttagaaactccgctctggctcctgtgacatgctctcttcgggttcccttcctgtgtctctgattattcactttgttctacttctacctcagccctcaaatgttgatgtctaccagactctgtccttagtctttcctctctaagaatacctcccgtccccagcagatctcatccattcctaccagccacagtgcacacatataacaatgaagtctagctttctgcctttaatcttgacatccctcctaactgcaggtttccattatctgtacctctctacctggtcacccacaaaacgcagacaccagtctacaacttagtcaattatccttgcaggcatccaaactcactcttttattgttctagttggtaagataatgacctattctactctgttgtcaaacctctcaaattggtcactaagtatttctattcttgcctcctaaatatttcttaaaaccttccccactcctctccatctccatagcatgttctctcatcacctttttcctgaactattataatggcttcctaacaggtctcttacctatatttgccacatttctgctaatatctttctgtaacacaaatctgatccagtttgctttccttcttaaaacacggttcaacagctctccattgcttacaaaataacattcaactcctggcttctgaggctctgaccctgactatcctcccgctttccctcaacaagcatccatactcttgccatagcaattactcattgtttctcaaatgtgccatcctctttcacgtcttaagtctttgcatatactgtatcctctgtcaggaacaactttttcttttatgcctatttgtaaactattactctttaagactcatctccttgggaaagcttcaccgaattaccaggcagctcccatcccaagctccctttatgacctctccattctgggttcctgcaatcttcctcctgaactttgggctcacaccaaagttctttctgtctccatatattttcctctgtttgaactttgcctatgtaggtcccagtttcaaggaatcggtttatgtcaatgaattccttaaagttcttggctccctctaggaagatttccctagacgagcttagttagtcctacttgttctccctaacccccagtacctcccatttcaaatcactcactttttttttttttttgagacagagcttgctctgtcacccaggctggagtgcagtgatgtgatctcagctcactgcaacctccactcccgggttcaagtgattctcctgcctcagcctcctgagtagctgggactacaggtgctgcccagctaatttttgtacttttggtagagatggggtttcaccatgttggtcagcctgtttcgaactcctgaccttgtgatccacctgcctcggcctcccaaaatgctgggattacagcgtgagccaccgcgcccggccccacttaccatgttttactattactgcttaattatctaccacctggcttgactgacaaattgtctgtctagctcatcctccacctctgagtccagcgagtgctgaacactgatgcttaataaaagtttattgcatgagtgtgtctgtgtatctgtttcctcacttgactgtgggctccctaagggcagggactcttattcatttgtgcctgatatagttgcggggagggcagtcagtaaaatctttgataaatgaacacatggtatcatatgtgtatctatcacatttgccctcaaagtccctatgtgccacaggtctgatgtggcatgtcatccttgagttccatcttataagacactccagcaagtatccacattggcttggctttattaacgtcgtcctttcctcagtcctttgggcagaaaaacatcaatatcctaaatttgtgcagaatcatcttgggaacaacaggctggatcttggattttcttgattcccaaagctctcgagccgtggcaccaaacctaaccacttaccgcttgagaggccatcatttcatttatactctttcatactgctctgccaaaatggcaagttttcttgtctgctcatctttcagtgtctttagattgttttgtgctcattctttggagtaacttccaactggtgattcttgagtgctttatctgtttggtctgtactttgcaagtgtcctgaaactgttttttaatttgcatttccatggctgggtagaaaaagtgacaaaggaaaaataaaggcacatcagtaaatacagaaagcctttaccataatgatataatacaagtgctgagagcgtctgttttttggtgcagtgactcacatgctaatcaataaaaatcaagcagtatgtatgacacagacaaaagttaactctacctgtcttttggttttatattgaatgactataagtaattttgaatttacaaatggggtcaaagaaatatggactgttacaaggggatgacaactctaagcagattgagcgatactatgaagctagcttgttgaaagagtggcaactcttttcatgctttcctagtcagacacttcagtgtctccattgttcattgtttttcccccctttttttttgtttctgtgtttcaccctgttttcaatgagacaggggatagcattatataagccagctctcactgctctggtttatagcaatttctatcaactccataaaggagagtatatggatggtaccttatatcctaacgcatttctactgatttcagcgtaaactgagagagaaaagtgatttagaatttttttccccattaagaggtgtgcttgcatgtagcaatataaaatatgcatttgggcaaagagaaggtagagtatattatttgagcccagaaggcattccatcaggttgccccacagtcatgtgtgcacttcacgaacctctgaggacttatggtgatagaaatcattgcttagcttaggatttgactgaagagacgatagccagtgtgatccaggttggcctcatatctgtggcaacactgacaacgtcctcccgatatatagcaatggcttagtacacagagcttgttaattagcagtcagctaaaattagctgaggcagtgagggctacaggagttcctccacatctctgcatctctagtgcagaagtggtaatgcctggcacttatagattcattcctgatgaccatgacagacatcactaataaatgaactctttcctcctaagcttggatgtggctttagagtctttctcaatacagcagtgctcaagtacctaacaccaatagaacttccttatttcctgggattaaaaccataaactgctattgtccagttttgaagatggcaggtcatgaagtgctcagagaaattccataatggatatgagacaaattgatagataatgtagtataataatagtttccaaaccagcttgcccaacatctcttttcaggagcttaaatatagactctgtgctttgcaactggagattctgatacaatagtgtggggtgcagaaatttgtgattctgaaaagttgctcaggtgactctgacacttcaggagagaaaccactgatctggtccaacactgtccagcagcacaaatcttacctttaagtttttggctgttgccgaagttccatgacatgctttctgtgcagttctctttctcgcctcttatgtactccagctggttttccagttccgtctggtgctgtaaacggatcagatccatgcgtgcttctgtaacgtgtgcagctgcctgtactctagctctcgggtggactcgtcgtgccggttagcatggcatgctccatctccttctgggtcctctttttatttagttcctgcgtccagaacaaaagataaacggagagaggtgaatggagatgaactggaaggaatgcacaactaaggagggagggcaaggaatggcactgctaaccatctcttaattaaacccattagtgtttggagcaggacttaatgagattaaattaacaatctcttcaggtttaggttctgttcctgggtcaccacttacaaaatgggcaacttcacagcaatcactactgtactctctgtaaaatgggttaattctacctgactctctcttacctcacagagctgctgtgaaccttagttaggtgattgctatgcataggtctacataaatgtttcttcagtgaagctagtggtcctacaccctgaggcccataaaaatcatgtgaggaaacttttcaaacataagatgcttgaatctcacaggggaaattcttataactgtctggggtgggagcctgatgtcagtattgggaagagttctccagtggtgccaataagcaatcaagattgagaattaaactgataatatctgcaatgttcttactttctgggaaatactctgtttttgcatgaatcagaggtaggccaattgtctattttttaaatctcagagttcaaggcatgttggggaaaaaaaaacagatgagatctctcccctttctcttctgcattacagtctgtttgatcatttatagatctaatcactctgttcttttccgtctactcatgtctttctttcttccttttctttctttctttctttggtattgaaggaggaaggaaagcaaactagaaaaaaggggaagttgggtgaaatcttttcattcctcaattgaagatatttcctaaatagcactatatatgaagatcagaacaatgtgctctcagtacataaaatatttattaaaccatgacttctgtcctcaactcactgacactccaacagggaagtgcacagacatttattgaagtatatgctctgctcaaagctcactgaatcagatttagatacgtgcccaacctgggtcaatttattttctctactcggaatttggaattgatattcagaaccagtaatctctatgtgtggctggaattaaggcatataaaaaccacatatgtggtagtcatctctgctatgagggctgaggattagagaaagctgggcttcagatcaagaagaaaggaaaagaagaagtgcagggaatatactgatgcctaagttacttactgcttctgagccctccagtagtctagctgtattactgctattcgattttataagacattcctgtatttctatagtaattccctggttttggcttaagctagctgaaataaatttcagttaacatgcaaacaaaaaaatttaattaatacagggacatactttttttttggggggggtgggggaactccacgcgtccatcatccactggaggccatactttatgactatggccaccattttgagtttttgtaacattagatatttggaaatttcatgaactctaccttctagaagattttcccacagaacagcattaagagtccccactcagtcctcaagcatacgtcaatttttggctcaccatactcagacttagtgccaaagcccacaggcctacacttctgtctttgaacatgctcatgaaaaaaaaaaaaagccagaagccaatttgagataaccccactagaccattctatgcaaaagctaatattatttttctgaagtaaagcttagttcagactatttaaagtggcatatatatttagatattttatacttacagatattgtccttggaatgacaaaaaaattttttcattatcaccacttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccgcccaccccaccccgtgtccctccctcacgaactaacacaacaccgacccgttgcgcttgacacggccggcgcaacacgcttatctacttttctcgccgccacactcggtttgtggccccaacacctccccccgcgcttgatcatatactcgtctccccctcgcgttcctccttgtcggtgaggtcccccctcgatttaggcgtaaccaagggatcacaccaccctccccgattggtgtgctttccccgctccgcccacataccacacctacacctttgtagtgggtattcgctcgggcggggacactcgccctgcttcttcgtgcctcttccgcccccgcatcacgttgcctcctccgcgggggcaaccatccagcaccaccagccccctatggatcccctactactaccatctccatactgcgtggatctggtgggcccataacatgggatgcagtatcgacacacgctccaatgtagatgatccttgagacattgcgccaagtgaaagaagccagtcacaacatatattgcctgcttcctctcccacgcatgtctgaaataggcaaacccttcgagacagaaagtagattcatgataaaaagaggttgctgcaatcccagcactttgggaggccgaggcgggtggatcacgaggtcaggagatcgagacatcctggctaacatggtgaaaccccgtctccacttaaaaatacaaaaaaaaaattagcgggcctggtggcgggcacctgtagtcccagctactcggaaggctgaggcaggagaatgggtgaacccgggaggcgtagcttgcagggagccaagatcgcgccactgcactccagcctggggacagagcgagactccgtctcaaaaaaaacagaaaaacaacaacgaaacaaacaaacacccaaagaacgtcaaggaaaggagaaagcttttgagctgtactttatttatacttattattaaatttttgagacggagtttctactttgttgcccaggctggagtgcaatggtgcgacttggcttgctgcaacctccgcctccagggttcaagcaattctcccgcctcagcctcccagtagctgggattacaggtgcccaccaccacgcctggctaatttttgtatttttagtatgatggggtttcaccatgttggccaggctgttctcaaactcctgaccgcaggtgatccaccgcctcggcctttcaaagtgctgggactacaggcgtgagccaccatgccccagcctcagtgtactttaaattagaacaatagagggcctctcttctctgatggcatccactataggagaaatgcaaattatttattttaatagatatcatcgataacatttttatactggcgtggttgaaatatcttgcacacttgggctccctattgattgaagagaaatccttttaatagcacacatctagtactagagtacagtcactaatcattcacttattcattcaacaagtagttattagcacctactatgtgctgggcactgttgtaggaactagggatagaacagtgaacatgtaaccccctcagcgaccttataaggagaaaaaacccaaagtataaatacaatttaaatttgtttaaggaataaaaaataagcccttagagttatctctctcatctcctcccgtgttttccttgttttatttttcttctttacctagaccatcaaatttcttttttacaaagcagtaactgcccgtaggtggcaccaaaggatggagagcccttcccacagacgaaagctctcccaggcaaggaaagccctttaaatgaggactttaattgaggtccaggagtcccaacaccaggcattattcatcccacactttcctaaattgagaaatgcaaactgagcctgagttgctaagagcctgaaactcatgggctcttgacacaaagcaaaacacacaaagcaagcaaacaccttcagagaaatcaagtgcttctcttcctgcttaatgaaatgcttcaagatactgtccacagaatcctacatccgaattacctgtgttataagggactagtctctataacaagctacgcagctattctgatatatatgaaagtttgagaatcaatggaaaagtgctaagggtgtgagtcagttcagctcctctataagtcttatgtatggcttggggcaagtctcttaatctgtatttcagggtaaaatgaggatagcagtacacattgtgaactatcgtagttgtaaagataaaatgaaaaccataagaaagtgcttcagaatacataaatgtcattatttttctctattcagaagggatacatggcatataatatcttaaatctagtttttataaactattagaagagtaagaaaaaatgatactgaaatggcttttctgttacaagttgttcccttcacctttaatttgtacatcgagttgctgaggtgtaagatggtaagctacctttaatatttgagacatgggggaaaaatattcaccttattatgaggccagtgctgtgcctacataataatgtttaatgtgctttccattttaaaagttattccatacatctcattcaatccaaattgccaccctatgaggtgataaactgtaaggatttcccccttttatatgtgttagtaggcatttgggagttgaaggactaaataaagttacacaacttctataaagagaactgaggctaaaactcaggtatttagcttctagcattttccattagaaatgttccaataaatgaggccagacgcggtggctcatgcctatatcccagcactttgggaggctgagacaggtggatcagctgaggtcaggagttcgagatcgcctggccaacgtggttaaaccctgtctctaccaaaaatacaaaattagccaggtgtggggcacatgcctgtaatcccagctacttgggaggctgaggcaggagaatcacttgaactcggaggcggaggttgcagtgagctgagactgcgccattgcattccagcctgggcaacaaggcgaaactccgtctcaaaaaaaaaaaaaaaaagttctaataaatggcatactttcctgtttatactttttcagtctgtgataaaatattttgaagaattctgctctagctagacatgaacaatggttactttatttgtacaaatgacacaatatacacactagagccacatcatgtgacctttagcttatacaaatttaacaaaatgagctgagcaaaaactaaaaaatcagttttatggtacagatcattctgcccacccatgtactcaatgtatgtgtgtgtgtgtgtatataatatatacacacacacacacacatacacacacacacacacacacacacacacacgtatagccctggagggagtgtgggataagatacatgcagcttcctttccctcggtcaatgtccatgtgtttcaagcactctaacttctaatggaagtagtattgacttctttaaaagcagcggtttcactcatgccaaatttttatgctcaggctcactgaggttgagtaaaaacgagaatttaacttttaaatagagatgctgtcagcctatgacatttaatgccttcttagtttcagttttagtttcaacactggtcagaaaatgctgagtgtctgtgtgtgttggtgatagagaaagggctcaacccagtttcagtgatcttcttgttttcactaattaaaaggattgctaatactaatcctttaggcaaagacacaggaaaccaggcattcttgtgctttgttggtgggagtataactcctttagagagcaatttagtgatatttattttaaaaatttagatgtatgcattcttgacccaggaattccacttccgaaaatgtatcccccaaaatacttgtttacatgtaaaatatctatgtacaacaatgttcttatattattaataatactgtaaaacttcaacaaaatgccaccgagaagtgtctcattaaataaatgatattgaggccatacaacaaaatactattaatgaaaaagaatgaagcagagctgtacgtgctggaaggtaaatggaaaaaagagttacaaacagtggagtggacatctgttactttttgtaaggctcagcttccatttttcctgcttcctttataggctcttttttttttttttcctttttttgcaaaatgactcccccttatctggatcagagagagtgttgaataaggcataagcacatgacccaatcaagttctatctctcctggaattttaatctcgaacagaaacgatacaaagacaaaaagtggttggaggaggtacacgaaatggcagtgcctggagaactgcacatgagcccttgctctctgtgtcatggaagttgtttaccagcgtggctcttcatgttttcccgctcagttcttcagctctttacctacctcaatccttccaataaattccttttcagccttaagtcagccagagtttatttctattgcttgaaatcaaataatcctactgatacaaaagtaatctcatttttgtaaagtcatatataataagctgtacatatgtatatagaaaaaaacctagaaatatacatgccaaattaatggagacgtttgagggtagagattgggtggaatgggattgtcgaaaaggtgaagatgggctgatgcggtcaaatggtagaaagttccagttatgcaagacgaataattactggagctctaatgcatcactgcatggtgatgatagttaacaatgttgtattacatgcttgtaatttgctaagagacaagtcctaaattaaatctccctactcaaccccatgcacacatgcacacaaatgtaacatgcggaggtaatggatatgttagttagctttcatgtggtgattatttcacaatgtataatatatcaaaacatcaagttgtataccgtaaatacatacaatttttatatgttgatatccaataaaactgttaaaaagaactttcactacttagctttatgtgtttctgttttcgtctttttcaatgttcttgagttacttttgtaaataaaaaagctttgaacattttcatgaagggggctctggaataagactaaacaaaagaaaatctagacttttaagaaaaatactcttacgagttattttttgctcaactggctagaacctaatactaatgaagtcaccaatatagttttatcatttttagggagtaattatcttctgtaacttttattgacatgaattgtccccttacctcagacttcctccaaatatctattattagaataacaataaatgttacatgaaaagaccccaaatgacttatttccaactggccattagcctttttcattttgattttttgacttctacaaactcaaaatgtgcagtactgaatcagcttgcttgctttccttccttccttccttcttccttccttctctttctttctttctttctatttttttgagacagagtttcactcttgtgcccaggctggagtggaatggcgcgatctcggctcactgcaacctctgcctcccaggttaagtgattctccctcctcagcctcccaagtagctgggattacaggcacccaccaccacattggctaatttttgtatttttagtagagacagggtttcaccatgttggccaggctggtccgaactcctgacctcaggtgacccacctgccttggcctcccaaagtgctgggattacagcgtgagccaccacgcccacccccacccccccccctttttttttaaagacagtctcactcgtcatccaggttggaacgcaatggcatgatctcagcttactgcaagctctgcctcctggttcaagccatcctcccacctcagcctcccgagtagctgggattacaggcgcccaccacccgcctggctaatttttgtagtacagatggggtttcaccatgttggccaggctggtctcgactcctgacctcaagtgatccgcctgcctgagcctcccaaagtgctgggattataggtagagccagcatgcccggcctgagtcagcttcttaccaaaacctctctttaatctcttctcgtttctaccacatcttcatttcccctagtgttaagccctagaaataattttgattccatatcttttctctcatatctttttttttgagacggagtctccctctgtcacccagtctggatgcagtggcgcaatctctgctcactgcaagctccgcctcccgggttcacgccattctccgcctcagcctcccgagtagctgggactacagatgcctgccactgcgcccagccaattttttgaatttttagtagagacggggtttcaccatgttagccaggatggtctccatctcccgcctcgtgatccgcccgcctcggcttcccaaagtgctgggattacaggagtgagccactggcccggcctctctcgtatcttagtatatgtcaagtcctgtttactttaaacttcaaatgtgttttgaatctactgctctgacagccactaccaccagccttgtccatatcctatttccgctactagtctcttctctctaatcctgtgtttctcaagcagtttttttttttcatcattcccctataaggaggctttctaggctttttctcccttaattatccccatcactgaaatataataccacaggtaaactgtgtatctgtttatgcactgtggtcctttgaagctgtaataaacctaggtcaccgcaccccaacaggaacccactttcacccactgggggcgttatcaccccattgagaatctatgttcaaatcattctgtgtattactgtcaatctgggctaatctcttaaagtacaattttagccatatcactgcccttctcaaaaatgtttagcaggctggatgtgtggctcatgcctgtaatctccacactttgggaggctgaggcaggcaggtcacttgagctaagagtttgagaccaacctggacaacatggtaaaacccccacctctactaaaaatataaaattaaccgggcgtggtggtgtgtgcccgtaatcccagctacctggggggctgaagtggaggatcgcttgaacctaggaggtggaggttgcagtgagctgaggttgcgccactgtactcagcctgggcaacagagcgagactctgtctccacaaaaaaatgttcagcagctcacagcctccctcttccaataagacagcatgcagaaagagcctgagcctggcctacatgtgttcatacattttagtttgcttcaccctttttccttctcatttcaatgcagctctctaacaaggtctatcaattcacttttgtattaactgtgctggaagtgcttgtttccctcatgtaggctacactgggcttttctcagactttgatactgttaccactgtgctagatcatttataaagtttctctgcttactccaggtcacaatgattttctgttgaacacagtattctgtattcctctctcagtgaatgccagcatatccatccaacctcccaaattagaaacttggaagtcactttgacttcctcttctgaaattcccatatctatttggtaaggattaactatcagttctgagaagaaatgtcactcagatctaattgcctctatccccacagcctcttccaggctagaactgagaaagagcatcctggctgacctcattgcactttgcttttcatgacttctatctctcttcatactgaagcactaattcttttgtttgtttgtttgtttgtttgagataagtctcacttatcacccaggctggagtgcagtggcacgatcctggctcactgtaacctctgcctcctagctcaagtgattctcctgcctcagtctcctgagtagctgggattataggcgtgcaccacatgcccaggtaatttttgtatttttagtagagacggggtttcaccatgttggccaggttgtctcaaactcctgacctcaagtgatccttctgccttggcctcccaaagtgctgggattcaggcatgagccaccatgcctggctgatgcactaattcttcaaaataaagaaatgtctctcatgtcattaccctgcttaaaaatctctcatggccactgccttcaggctaaaagtcaatgccttgccttaaacaagggtctctacattctgcttccaactaatattgttctgcccgcactctatatacacagaactctggtcacactcatcttttcatcaatagcagagtcatctagccctctcatgattgtatgccaatgatactttatttctatgtctaatatgtcacctaactattgtattgtaattagtctgttacatgtttttttctgctcttagactcatagccatttaaggcagggagtacagcttcttggtatccctggtgtctagcactcactctgagagtactgatgatggaataaatgcacttagttatagagcatcataatgttacttaaatgttttatgggagtcacaaaaatacaagtccttgacaagtaggctgaaaacaaaaattctcgattctattcttttgattcttcattgtgtgatatggcttataacgggagttcaataaaattctattcatgtatttagatggagttgattccttgttctgtgagtgggcttcctcttatcaatagtagttcattccctgactttttttgtatacctactctgtgttagccactgtgctaaaaggcagaaaggctagggatataggaatggaccaggcagacatggtcacaagcctcacatagcaattgtctcctatgtcaatgacaatagttacgagcgtaataaatacctcccgaatgttctctgctccacctcgtgccgcttgatcattattttccgcttgaagaaacgacaatttttgtgtagtacagtctctgttgagtgagaaggtgggcttcctcttcagcctgtgtgtgctgcagttctctttatgtttggagatccgctcttgcttctctttcttgggtgtgctatggtcctattcatttcctaaaaagaacagacaaaaaccaagccagccttactaaatgaaagggacttaacagcttattgcaactgaagattaagttatttggaaagccaatgcagatgtaagcacgaaaagcttagtgttgcacatccttcccccaattttttttatttgctcattaattgagtttaagtgagagggacacttgtgagtttctgtatctttggtttctcactaacagaaattattgttcactcattcactcaacacaaacttaacaagctcctatcatgtgacaggcagtgtcaagatacaggacacaaaggtgagtaaaaggccatgataactgccaccgtgtgtctttatatagaatcaaaaattaaagaaccgcagaaatgaactaaaaattactgtgatcactgcttgaagaggacgtacttggccctagaagaatttaatagaaaatatttaatcttggtagtactaagaaaaattattcagagttaaccagcggaaaaggaaagggaagaatactctcagtaagaaaacagcatgtgcaaaaccctaggggttggagaggaaacatggtgccatcaagggcgaaagaaggtcagaggggctggtgtaacgtaatatgagataagtctggccaggtaggcagaccattgaggctttacaggccaatataaggacactgatctttagtataggagaaatggtttcatgcatgtgagagtgtcataatgagatgcatttgaaaatgattactctggctgcctggggagaacagaatgaaggaggcaagaacatatgaagatagctgggaggctactggaaggtccaggcaagagagatggtagtagcttggacaaaggaagtagtgacaagactgagagagcagacagattccaaagagaagaggtgactatgcaaatgtcactagtttgaattttagaaaaaacattcttcacttgggattatagagtaaacaaaccatctatattttccaaggacaaattcacaatttttccagaacatctgagcaaaggaaacaaagcagtgaatcaggactgtaagatgttaaactgtggtgaaaagaagaagactacttgttaagaaagtacagtatactttctttcttcatttggttagctactcactcagctaaaatctcctttagttgctaacaccattttacttaatgttttgtgatgccgatatcatagactattttatctcttagccaagaatctctgtaaatcaactttcaactatcctgttccagtgaagctgtaagtgaaatcttagatcaacaagagaaagtgttgttttcagagtaagctggagtaagctgggatcacaagaggagcctgggtcattcatctcttcatgccgtgatgtcactacttggttggccattaaccactgactgcagaccccgattcaaatataatcacaaaaatttactccaaaatcaagaataaatatttctggaccatctatcattctgtattagatactcctgttatctatcaaaagtggtgaaatgaaaaaatttttttgtcattccaaggacaatatctgtaagtatataaatatctaaaatatatgccactttaaatagtctgaactaagctttacttcagaaaaagtaatattagctttgcatagaatggtctagtggggttatctcaaattggcttctggcttttttttttttttatgagcatgttcaaagacagaagtgtaggcctgtgggctttggcactcaagtctgagtaggtgagccaaaaattgacgtatgcttgaggactgagtggggactcttaaatgctgttcttgggaaaatcttctagaaggtagagttcatgaaatttccaaatatctcaatgttacaaaactcaaaatggtggccatagtcataaagtatggcctccagtggatgagtggacgcgtgggttagaaataaggaaggtatctatttattttattttacgatttttttttgagacagagtttactctgttgcccaggctggagtgcagtggtgtgatctcggcttactgcaacctctgctcctgtattcaagcaatttgtcctgcctcaacctcctgagtagctgggattacaggcaccgccatcaagctcagctaattttgtatttttatagagatgtcgttttaccatgttggccggctggtcttgaactcctgacctcagttgatccacccaccttggcctcccaaagtgctggattacaggcatgagccaccgtgcccagccaaggaaggtatttagagtggagaaaaacccaaaatttcttaggctatctctgatccagcaacatcatattatgatataaaaattaagccaagccaataactcagagaaaatggaaagaatgtgaaccttctgagttgggctattctcctacacccgggttttctagaccttatggtgtcagagattctacccattcagccagtgtaatcaaatacaattttctgttaggtctaacaattaccagtggcttacctgggcaggacaaaaatccctaggcccaccccaacccccttggtttcacttcctaactaaaaaagaattggagagaaccttgctgagtcctctattgctaacctacaaatcagaatatgagctcaggccagcgtggtggctcacgcctgtaatctcagcactttgggaggctgaggtgaaggattacctgggtcaggagttcaagaccagcctggctaacatggtgaaaccctgtttctactaaaaataaaaaaattagctgggcatggtggtgcacgcctgtaatctcggctacttgggaggctgaacaggagagttgcttgaacccgggaggtggaggttgcagtgagccgagactatgacattgactccagcttgggcaacaagagcgaaactccatctcaaaagaaaaaaaaataaagaatagagctcaaacacatgattttatatatactaaaacaatgcgccatattgaattttattaaccttaatacacttagtaagtctacaaataagaaatactaaggtttatgagaagaaaagtcatggagctgcagacgattcacctgtaagtactggtaaaaggagaactgaagaaatttggctttcagatcaaagtgcagttctttgggaagaactcctaagtccactagtggtcttcaccaaatattccagaatcaatcattcatttaccaaatattcatgtgtacagggcacagggtacagttgtgagcaaacaaaaacatggtctgtgctcttatgatgcttaccagttagtaggtaagtagctcaaataatcattaaacaaatgtataattaaaggctctagttaggaaaccgagacatctgtcttggctgaggcagttagaaaaggcttccttaggaaagtgacatttaattaagatcctaataaccaatcccgcattgcacaaggaggagaagtaggaattaaccgagaaaattgtggtcagggagggcttgggggtagggagaacatcttggtggaagaaacagtagtggaaagaccttggggaagggtggagcttgataaatttgaggaactgaaaggtgaccaggtggctggtgcagcgaagagtgggttgagggtaggggcagcattagtgtgagatgtcatgaacgagtaggctaggaggggactgtgtagggacttctaggattttgacttgtcctaaagcaatgggaagacaatggatttcaaaactatgcagtagaatgaccagatttatggtttaaaagatcactttgactgatgtggaaaatacataggaagaagacaagaatggtttagagtatatcaatggttcttgaaatgtggtccctgaagcagtagcagcagcgtcatctgggagttgttagaaacacaaattttcaaactctaccccagaaaatctagggatagatttttaaatctgaaaatcagtcagataaaaaaataaataaataaataaaataaaatctgaaaatctggggtgggttagcaatctgttttaatagcattttaggtaatttttttttttttgagacaggttttgctcttgtcgcccagactggagtgcagtggtgcgatctcagctcactgcaaccttgcctcttgggttcaggtgattctcctgcctcagcctcctgagtagctgggattacaagacgtgccaccacgcccagctaatttttgtatttttagtagagacgaggtttcaccatgtggccaggctggtctccaactcctgacctcaggtgatctgcctgccttggcctcccaaaggctgggattacaggtgtgagtcactgtgcccggaaagcattttagggtattctaatgtaagtttgagactcactggactagaatattgatcacaatgcaagatgagtgaatgttaagtccaaccattctaatggcaacttggtgagaacaaacattggtatccttacctcttttatttttccttacaaatcttatactgcttcttctgactttctaagaaagttgtcaaatctttctctgctgggccaagatctgttgctggaacttcttctcatctgctgcagctacctttgccgataaaataacaaatacaatgtaggatgaatctattctttacacagaattcagtgatcttattctccagtgcagtaagacagtccatgagtgctaataatgagacatttttgaacaaaattaaaaaataattgtttttctgattttcttgtatcttaaagaaacacaaaaaaaaaaaaccagaaattttcaccattaataaattctgggctgggtgcagtggctcatacctgtaatccagcactttgggagttcgaggcaggcagatcacctgaggtcgggagtttgagaccagctgaccaacatggtgaaacccagtctcgactaaaagtacaaaattagctgggcgtggtcggcatgcctgtaatcccagctactctggaggctgaggcaggagaatcgcttgaacccaggggcagaggttgcagtgagctgagatcacaccactgcactccagcctgggcaacaagagcgaactctgtctcaaaaaaagaaaaaaaagaaaaagaaaaagaaaaatacattctgaatttgggaaaaatatgaaggtgaaccataaacatgctttactgaacacaaaaacattcatggatgaaaggagacctaagaataacatttttttttgagatgaggtctcgctctgtcgctcagctggagtgcagtggctcgagcatagctcactgcagcctaaaaatcccgggatccagcgtcctcctgcctcagcctcctgagctgctgggaccacaggcgtgcagcaccagtcctggcaagtatttttaaaaaatgatcgtagagactgggtcccactttgttgcctagggtcatctaaatgcttggcctcaagctatcctctctcctcagcttcccaaagtgctgagactacagggtgagccaccatgcccggtcagaactaaggatttagttctgatataaatctaataaaggttttacatcatattgttgatagcccaaaggttaagttgtaaaaatgtataaataaccatcctggccagttttattccaagaatcaaactctaactgattaactattccaactatcagatttccagtggtatcaactcaagtgtaattggaacgctaacggcattttgttttctttttttttctgagacagtctccctttgccacacaggctcgagtgcggtggcatgatctcggctactgcaacctccacctcctgcgttcaagtgattctcatgcctcagcctccccagtagctggattacaggcacaagccaccacatccacctaatttttgtatttttagtagagacagggttcaccatgttggccaggctggtgttgaattcttgaactcaaatgatccacctgcctcgcctcccaaagtactgggattacaggcatgagccattttattctcttaggcacctgctgcatccacaacagtcacacatcatgacattttttggggtcctaaatgaataaaacacatacatataaaaggtcatccaataaatactggctcctgaaagtgaccaaatctgtttctggtaccactgggtgaaggatatacgtaagacgagcgacttgggagatagagggggaattatgctcatggctcatggctctttttacgtatctttttcacctgcaacttccatgaaggacaatcttccattatgaacaattctcacaacatatttaccaagtcaaatcccaagaaagaatctactgatttatttaatcaacatcatccttgtctgggcagaggttttcatgccagactgcccacagattgatggctgttgggggaaatctttcttctacaacctgattgttccttccatgggagacagagagagacagagagaccaagagagacagagagcaagctcaattatggaaacccctggaactgtgtccccagtcactgcatgcccagggagcacatgtccaccacatttttaacactatggaagtctcatgggggtggcaggaaaggtgactcagttttagcactgcttggcaggcagatctgcttaattttgttttcctgcagacataaatcacctcttgtacctaactgtatcagtaatagatgatattatggggagggaggagggatagcattaggagatataccaatgtaaatgacgagttaatgggtgcagcacaccaacatggcagatgtatacatatgtacaaacctgcacgttgtgcacatgtaccctagaacttaaagcataatgataataaaaaaaatgatattatgactatctgccttacccttctgttttttttttttttttttcagtcggagcttgttcttgttgcccaggctggaatgcaatggcgtgacctcggctcactgcaatctcccctcccgggttcaagtgattctcttgtctcagcctcccgagtagctgggattacaggcactgccaccatgcccagctaattttttgtatttttagtagagatagggtttcaccatgttgccaggctggtctcaaactcttgacctcaagtgatccacccacctcagcctcccaaagtctgggattacaggcatgagccaccatgcctggctggtttttttttttttttttggagataagtctcgctcttgtcacccaggctggagtgcaatggcacaatctcaactcactgcaactctgcctcccaggttcaagcgattctcctgcctcagccttctgagtagctgggattatagcatctgccaccacgcccagctaatttttgtatttttagtagagacggggtttcaccatttggccaggctggtctcgaattcctgacctcaggcgatccacccacctcggcctcccaagtgctgggattacaggcgtgagccactgtgcctggcctttttttttttgagacagggtccgctctgtcacccaggctagagtgcagtgacacaatctcggctcactgcaacctctgcctctgggctcaagcaatcttcctgcctcagcctcccaattagttgggactataggcatgtccaccacacccagctaacttttgtattttttgtggagacggggttttgccacattgtccggctggtcttgaactcgtgggctcaagagatccacccaccttggcctcccaaagtgctggattataggtgtaagccaccacatctggccttgtctgcttttaaaattagtttagaacgggatggggacgagagatgttccctagaaaatccaaataattgccggactcattatttgcccttttgctcaggggctcatcagctgtaggcagggattatcactactataagagactattgtaaagcagttttcttttgaagaggactgtgggtatggcagatacagtaacagactttgttgtgcacgttctcagaagatggaagcatcttgtttccctttacttgtacccaggccacatcaagggactgatactcagaatatacataagtataatttttttttttttttgagaaggacttcctctgttgcccaggctggagtgtaatggcatgatcttggctcactgcaacctcgccttccaggttcaagcgattctcctgcctcagcctcctgagtagctgggattacaggctgtgccaccatgcccggctaatttttgtatttttagaagagatggagtttcaccatgttgccaggctggtctcgaactcctgacctcaggtgatctgcctgcctcggcctcccaaagtctgggattacaggcgtgagccaccacgcctggcctcagaatatatttgaatggacaagatgtaacatatattttcagttgctattttagctctgaacgacaattttacatagccctataaatctagaaacccaattttgccaccccggaaacaacaattttcctccatcccccactctgcctcttgctaacatcctgccactgaccccaacaggctgggcttggttgtggcatgaagcgtgtgtgcacatactgacctccttttctatgatagccacttgcttcttggccagctttccagctcgatggacgagttgttggcatgcgtctccacctccttctgtagcttgaggcgtgctcgtccatctcagccttcagcttgttctccagggcgatcagctgcttctggtgctgcgccgcatccgcttataacctgacatctgttcccgcaactcgttctcctgctcatgctctggatctgtcgtgtaacctgaattgggttaggaaacagaactcaggtaaccaggttcatggagacaagctttcatgcaaagtagaacggccctgtggcataattttatccatcaccttaccatcaatttacctactgtttagtgaatgctcacccgtagggggcactgtgctagataatactctttatgtattttatccctagtcctcaaaaccatctcattcactcattcatttcttcatgaggtaggtgataacatcttagttttatagttgaagaaattgattcttgaaagaactctttattcaggccgggcacgatggcttacgcctgtaatcccagtactttgggaggcgaggcaggcagaccacttgaggtcaggagttggagaccagcctggccaacatggtaaaacccgtctctactaaaaatacaaaaattagccaggcatggtggtgggcacctgtaatcctgttacttgggaggttgaggcaggagaattgctggaacccgagaggcggaggctgcagtggctaagatcactccactgcactccagcctgggtgacagagactctgtctcaaaaaaaaaaacaacaacaaaaagaaattatttattcagtcaaaatatgtttacatatttttgatatacatcacatatattacatgttcacattaacacagctaataaggactggattgggaatcagcccatctctgtataactccagagccatgttatttctactgcaccaagatttctcaccaaactactgacaacgagcccgataattatctgttgtgggggccgtcctgtgcattgcaggagtttagcagcatccctggcctctacccactagatggcagtagcacctcccaccacatgaaatgaaaagtatctccagatattgccaaatgttcccttgggaacaaaattcctctagttagaactactacactggtttgttttgtatatgtgtgtgtgtgtgtgtgtgtgtatatataatatatatatatatattttttttttttttttaaggatcatgtctctaacagtcatagacttttaaattagtctgaacatgatttatttcctattcctaatatgaagaggtgagtatgaatcaagagatctcttaaatcatgtctcccccatccccttctctacaaaagaaatgttacaaattataatacattcactcactctcctaaagaggacaaagcattgctatgatttttggaggctacttttcttagtaacttttccttaactcattttcaagtgaacatccaacaaattaagcttgtaaatgtacatttcagcacctcttgctcatttctattaaatcttttgtgattttccagtccttccttcaatttatcttctctctttattttcctgatcacttcctccctattttcctattttagaaaaaaaatcttaattccaggattgtaactttagtcttgttcttcataagtgatttggtcactcctatctactgtaaggcccatctccccagcctaacacccaacaagctttacaggaaattttcaagctgctattaattttctgtactattttcagtttatggttaaaatacattttatacaaagaagagtttgtttctctgctctttttagaaggtggcccgcatactaaattgagtccttactaacaagagagtgctgttctgtaactagatagtattacaaagtacaccattaaacattagccaaactttgaaacctttccagttgaaactaacactggtttcatattcatttctcttttctgaaggataatactctttcaagtattaagaataaggcagaggatattttaagaccaaaaaaggatagcatcacccaaaaggcacctaaccctctaagaaaataaatgatctattttattatcagaaaatgtgtttttttaatggacataattcagatgaaaggaggaaaagaagtagtttgaaatatatgtatcaattttacttcttcacgctatatgtttctgaagtacaactttaaggaagaaacaattctaatcaatggaaaggatacatttagtcctttctgaattcaactatttttcagaaaaatatggcagtaaagtatcagggtagggtaatgaattttagatatgttttagctagaaactttttcttattttagcattcctctttaatcagattcccaaagctgaggcatggcacactctaagctatcatgacacatttaaacttggcataagcattggcttacagccaataaaatattctcaggatggtcatttccctaaccaggatgcctaaagataaaagggaaatgagttgtgtcaagaaaattttctatttcattggtgggtgggtgtctgtaaagagggtggctttctacttgtaccagatcacatacaagtgatctggtacaaggatgtggcaaagaaaatttacagagctcaatctgctatcattgtaaccactgaattccaggagagacattttgcttttgaatgcttcccataatgtggataattccttcttaaactcctaatatcacctttcatttgtcacaactaaactttccaagtttcaattgtctttttgggtatatatatagagatactaagctttataattccatgctcaagctggtagatgaatttaaataaaagtataaccagatatttcaattgaaaagtctaacatgaaattacaaaaaatatgatatttacagttatatgtgcctgtgtgtcttaagtgtacactatgattttaagaatacaccttttggtcaataaaataaaaaataatagctgataactttttcatcatatggtttaaaaagtgctttcacatataatttacctctttaatttttagaaggccttgattcctatggttcttgaattgcctgaggaaattcatatcaccaaggcagaaaaagagtactattttctgttataaagtaatagagggaatcaacacccaaaaaagtcaaagctagaggggtggtaagtctaaattacaaattgagtaagtctgaaatgggagaaagttataaagattagtaactgtagtttttacaatggcagtctcaaaaatgtgatcaactaaaagtgggcagaccaccttgctctacccagtggattgtgtggagaaaaacctcatctatctcttactataaattgaccttgggcaaattacttaacctcttaaagtctctcagtttcttaatgtgtaaaagagaggaactaccactgtcttcctcagggtcggaggactttctcatgtgaaagtgcctgcagggtgtctgactcctaggaaatgctcaacacatgctggtttccttccttctgatgcaggctctgcgaagcatgtccctttgccctccacttagtatttctggtgatggagacacaagcacaagtggatccagaagaaggggcacatttaaggaaaaaaaaaaaaactagctgtaccaggttgtggattataaaattatgtataatttctgaatctgaattattacttatttcagtatctagaatatgaaaaataaacaaataataaataatgtgccatgaaaaggaagaccaaactttttttctaaaggttcctatagctgttcaatgctactttatttaattccagcaaattcggccctaaaacaaaccacttcatctgaagtgcagagtgtccctactgtgtacaaaaactgcactagaagggtaataagcaacttcctgaacataaaacaagagcatggtggctgagatgttaccctcttaagagatcaaagccaacttacaagattaataatatgtaggaatcaaatgatgcatatgataaaagtggccacctcagcacttagaacaaatgaaatttatagcagttcttaaaaagaatacagtgagtcacattttggcattagaaacttaacattctattcttagaatacctaaggaaaaactgttttttaaatttttgctaaaagtaatgactgataacagcaattctgcatttataaaagaatatgttacatgaggaattctgaaatgcaaacttataatccaaattctcatgtgatagcaaggctggaggtgacctcattcattcgttcattcattattcaatacacatttattgacagactttgaccatatgggttgggcatgtagattggacacataagtgagaaatggtatcagcaatgaccttagtgagttaagaagccaagaataagtaagagatatgcaatattttgataagcatcctctggtatactgtccaggaagagaacacatttcaagcatttagaaacaggatgaaacagtagcatttactgctgaggctctcatattttatttttaggtatcaaattcattcacgtatccaatttcacaattagctgaattattaggggcattttaaaaactccaaatgaagactctctatgagcttttctatcgaatctggcaaaggaagtaaaagactctatatttgcatgaatagaacaataatacttttctcctacatgcctcttgggaattcccctatcacacccttctccctgacatgtgttctaacataaattcgccttgtaatgcagtcacaggtgaatttgtgttagaacacacattaggaagaggggcagtgagattccttcacaaaaccaaaagctgaactctgatagatacactgctctttatattaatattctatcacagaaacggccaagagccccagacactacaaagttttcagaagaaatgacatagatgtagcaacagctaaaaacaccctcatgaatcactaatataattaaaatatgaggcctccataaaaactcaaggaaggcacatctcaaaggcccaagaagtcagattagtgattcgcagaactatataaacaacttttttccagataacacatgagcccaatatgaacttccttcagaagaaggaaaagaaaggttaaaataaagatgccatgaaatacccttccttttcctattcttcaaaataagggcaataatctctgcccttagaaaattataaaaattatacaattgaataaaaagttacaatgctaaagttttctcaggatttcatctggtatcaaagtttatagccttccttatcctttgttacaaatccaactgtgcagcagtgcataatacaaaaatctcattataaggtgccaaaataataaagacatgtagcaatacagacccaatgcccatgggcttttcatatacttgtcagtaacctcattcaaaagcacaatgttgaaagtgatactaaggggaaaagcacaaagccaggcctcttttaggcttatgttgaagaagtaggctcataaacaaatttaggaagactaatatctttgtcagtttgcaagtaaatttaaaatatgcatttcatcattatttatctagttattgaaaaactaatttctaaattccttttccctgttcacctttggcctctttgtgacttgttagcgcctctactagaagatgttaaagaacgagtaaaaccaaataaatgaataaataaatatagtattgccaccaactatgagaaggcaaggtttcaacaatacttgattttttattatactggactttcactttcccatgatcttgctcttacttttatgcattttagtcattttcatttgagctggggtccataaaacacaacagaattcataatatatttttaaaattaaatattttatgatattccagtgtcctgatttatacactactgttggcttaggctttaaaataatatagtgggtagaattgtagtacttggtaatatacattaaaaatccatacccatagttagattgttcaaaatgggacatggaaccatacaacaccatacctttcccttccattttttttcccctccctaaaagccactagatacaaataccattgaactctgtaaactaccatcaatcccaatcatgactcccaaagcactacatttagagagggcacccacaaaaacaacttattttgtggctaaagcaacagcatatcagctactctgtttgtaactaatataggagcaggggccttttagcaaatcaaaacttcattagagagactggttgcagcgttctctggatgggcactaggaagcctgtacgattcagagggttcctgaggacactgccatagccctgaggtggcatagtagggaagcagcttttatcatccacagagaagaagactggatggctgatatacacacagagtagccctgggtgagttcacagatgcgagcatgagattttctggcatggctgtagtaatctcttgctgggaggtaggagaggtcatgaatatatgattgggaatgagggtgtggcaagagagaaaaaagaacctgtcccagagggggaaagccactggtataatgtctgcttcacatgtaaaaccactgatggtactcggttgctcagagcttgtatcatttccccactcatttcaacatgaacgggtctggataaaggtccaagtctcacaaggtcgatggtaagtagtcatagttctctaaagcaccgtatttcttcttttgtcagatatctggcatgaagacaatgactatttggtaatcttatgatgctttatctagactcaaaagcaatttttaggtgcctaacaatcattagcaaatacatagtggacattttaagatctccattcatagtgtagcattcctttaaaatgaaaaattgctcatcaaagagatcacaagaaactttacataaaggaactttaaagtgggcttatttataagcagtttaaattaaattgcttgctttagacagcagcaggcacagcaatatgtacgtgctttaacttccatttttccttgcattgggtttttaaaggttataatccattataattttcaaagataatcgaagcctttaaaagattgagaaatagaagtagaaatcaggtttaaaaaataggacaagaaaaatgatcatttctggtcggccttggatgatgtcatcataggttctaaatgtaatagccaagcagtgtacactactcttcctgcccatgtgacctctaacattaatttgggcaaaacaactaatatttcaatattttttggctgagaagtgagattcagaagcaaaagattaaagagagtttagagtgccaggatgaaacgatgtgagtgtgtgtgtgtgtgtgtgtgtgagtgtgagcgcgcacgcgcagcgtgggggccgaggggaggaggcatgaaaactaactcttccagcacacaccccttttgtactacaagggcatccagcaatcacatttgcaatagtaaaaatgctgaagaatcctacatctcttttcttccacaatcagccctatcctctcctacaaagcccttcttgctttattgggccaggaaattcttcaggggttaaatggggaagtgcagccactaccattgttgcaataataaatgaatgaaccagaaggaaccagcaatccgtccctgggaaacaagtatcttatttttacaattatatacattatccagcaaccatatattctttaaaattatattttatcttttgtgtgtgtgtatacattatagacacatatgcatctatacaaaaagcagcacagtgccgtgatacatatacatcaataccttaaaaaaatttagcattatttatttcaatgaaaagacaatagcttttaaaaaattggacaggctagcaacttcatctcaaaggccttatattttgcactacagcatatacaaacacacacagacacagacacacacacacacacacacacacacacaacacacacacacaaaggttttttttttttttccatgccatacacaatgctaaaatatctaaatcaggttgctatgccaacagatttttttcctaaaatgaataaaattattaggagaggaaaacattcttgactcctttcctcccatccatgaagccgagacaggctcagggagggcagaggctgccagatggggaggaggggaaggaagggaaggtgggtagaggggtgtttgctaccaaagatgctgatttgatcgtggcaaagcgctctctgttccggtagtggagggcctgctctgaactgactgggtaggccgcggctcaggcctgggatcgccgtggcccgcctcatccttatgaatacatgatcctgcagaaatggataaaaacaaggagaaagtccagctgtgcttttcctcgccggctgcctctctctcacccctctttctgcacaagcactgctgtttgaaagcatagtttagctctctgctagtccccgcagctcccacggtacaaaatgaataagcaaccattgcagccttcagttaggaatgtcagctgatcgctagtgggatgccttctgaatcccggcaggctttttctttacctccagaattacatatatgcaaaagaaaaaaagaatagaaaaataatgcaatgtacagactccttagaacagtttgcttaaaacgctgtaaccagataatcctttaaaaatgtcatgtccatgtctagcaaggaggatgctggtggcttttaacataaagcgagcctccgcctcattcccttgaaagatctgctttctcaatttaattttatttgagactgttcggtaggatcatcgttctgcctagaaccaatgtaggcttgtgctgaactgcctcctatcttgtgctgggaagattcggcagtcactgagggatcctgctttccagtcatgatctacacagttctagcaccttctctctacagcttctgaaaggatttttttttagatttaaacgacaggcgtacaattttaaccaaatgatacgttcacaaattcttcttcaactcagcatggtatggtcaccagagtgagtaaagctggaatttaatgtccttgactgatttaatcaagccatgcttcttgataggcaaagataattaatcttgttctaacgtccagtgaaaaaatagattccctggaaggataataatggatgtttcttaaatgcaactgaaatgacttttaaagggaaaatgctttcaaaggatgatgttcctctctataaagatgaagtagtggtcagtcattagtggctataaccctttagaaaaaaggacgctatagtaatttgtacctcaaaaacatgtcaaccatgggggattttaaaatagtacatgttcagggtggaaaaggagaaattaattcctatttccctagggttttaggaaaaccatttgtgagaagtcagtattgcattttatccataccacttgaaattttttataatggcttttttcttcatcaggaaacaaaaattaaagaagttagaaaatacaaaattttattatagtccaaaatttggggagaaattaaattttacatcagatttttatgtaaaagccaagacccaagattaaattgggctgattttctttttcctttatacatttaaaatgctttgatgtattgggaaggtatctaccattacacctatatggagattgttttaaatttatgtattatagctcaaataatgaagggatctttaataaacttgccatgagggcatatatatcaaattcacgtatattctgcagctgcgctgtccagcaagatagtaccagccacatatgactattttaattaaaaattaaattcaattaaaattaattaaaacaaattaagtgcaaaattgagttcctgagtcataatggctatgtttcaagcacttagtagcatagttagtggtgccatattggtggcttataaaacttgtaagtttttaaaacttataagaaatatttgaaaggtcagttaaaattattctacatgatttctcgcgaaatttgaactccattttacagggaagagcgagaacgtgtgtaattgggattcattcactaggcttaaggtttaaagaggaaggcactgggacctgctaccatttacattactgcatatttgctaataaattatgtacaaaattcaacttaatattacagtgccagaaaagcaagcagctcttaaatgccgtaatcaaaagagatatgctaggtagaggcctgtgattttataggaggccttaacaagtgtagttttggtgaatattaattggctaacttaccaagtacattgatagagggggagacccaaatacatgggcaacagttcagtttcacattgtaataacttgatttataaggataaccatgacactagaatccacattctccacagggcagaccaaaacaaaatttattcatgtacaatatgtgcaattttatttagtctgttttatctctgataaaaattaactccttagaaacaggtttagggctctgcttctccaattaaaagccacaatgtattttctaagtttactaaactgaggaagttgaagtacaccggaaaaattaaaacttgaaatgacattgattttagttgaacatatgtaattaagtaactcaagtatatttttaaaataatgctatttttatagtccaagaataggttcaaaattttaacccactttaaatataataatgctaatagtataattctttcttccccctacatttttttccttttataaaattattcttagttttccagatcattttcaaacagagatcactatcactaaaggtcttcaaatattatacaagagaccacaaaatggaaaaaattttagtctaacagtggatattcatttcaagtgcattgggaaatgaattttaatatcagttccactgcataaaacaggttcaaaactccaaagacagcttatgaagctatttaaaatgggagaatgtaacttgagaagtaagctcaaagaaattaaagtatcaactttactggaatattttctgttggttatactgcccctttaagtaacagtgcctctgtaagagaccacttacctggctcccagagtttctgaactgcacacatcttaagattaacaatggaaagggttatttctatttttatgcagttatgcactagatacagattatttacaaatgataaggctgaatcttcaaagaaggattttagaagattaagaagaataaatctattctactttgccaaggaaaatatatggcatggttataatttatctttaaaacattatcatccaggaaaaaacaaaataactccttgaaataccagttttaagtaaacctacgttaacctggtaaacttaccacgtgttgttttttttttttttttttttttttgagacagtctcgttctgttgcccaggctgggtgtagtggcactatctcggctcactgctacctctccacctcctgggttcatttttgtgctcagcctcctgagtagctgggactacaggtgcgtaccaccatacctggctaattttttgtattttagtagggatgggttttcaccatgttgcccaggctggtctcaaactcctgagccaggcaatctgcctgccttggcctctcaaagtgctaggattacaggcacgagccaccgccccagcccacgacattgtttcatcataaaaaataaatttcttcagattaaaaaggaagcgtcataatgtttcttcaagatctttggtaaaaagaattgaatttctatacaagagtgaacatgtgaagcatgaggcacacaaactttactattataccttagacaaggggctttcctttatttggaagtctttcctttaagtgtctgaccattacacttctgaaatgaaggttcgtgttaggcacttgcctagagtttctttttctaaatatattttcttccctaatagagctgggtctcactatgttgcccaggctggtcttgaactcctgggctcaagcgatccacccaccccgccttccaaagtgctggaattacaggcgtgagccaccgtgcctggctacttgcctacagttctaaatgaacttgactttaacccaggaatcactcctctggactcagttgtgctttggtttacttttatcacagtactcatcacacttacttgtctgcctctgcataaggctgtgggtttttgaaggcagagtaaatgtcgtttgaaaaatcttagtctccctagcacctggcatatgcttgatacttagtaggcattcagtaaatgtttgctgaataaacaaacacaagaatatggtctgaggagattttgagaaaatgacattttcttttggattatttaacagaattcaaattgtatttcataaaaacctgccactctgtactctaaggaagtcgtaaaatagtgacacaacataagcacacctttacacagcggggtgcggggggatgtatctaaaaatggctcttatcggtgatgagaaacctttgtatagactcccacactttctacgctgtggagaagggatcacagacccaccactctcctttgttttgttcatttcaaaattattaaattattgtcgaagcggggtagctatcaaaagctggggctggaggaaggggaggagaagatgaaaaagcatatctaacttggaaggatagttggagagaaaagatgactagcaaaaggctgaggagaaagacgtactacagagaagtgttgtatgactgctctgtttaagaaacattaccttcatatgttaattacttttactttgccaaatgtgagttgaagaggcaaaggacccacccctctattcagcaaaataataggaaaggccactgaagcaagtgaaaattaaactagaacatcctattccctaaggacatttcttttttttttttttttttttttatcccgcaaaggtggtgaaagctgtttttttttaaagaggggatgggaaaagaactaacattgactaacaggaagggtcaaataagctttaggagtcagggtagaatggctttttttccccctccaccagacggagtctttgcttgtcacccaggttgaagtgcactggcaccatcttggctcactgcaacctctgtcctcccaggtttaagcaattctcctgccttagcctccagagtagctgagattacaggcgcgtgccccacgcccagctaatttttgtatttttagtagagacagattttcaccatattggccaggtcgtctcgaactcctgaactcttgatccacccgccttggcctcccaaagtgctgagattaaggtgtgagccaccgtgcctggccagtagaatgacttttttaaacaatagtttctggacacttattctgttttatagaatgaagtgttgtcccattaaaaaaaagaaaaaaatgttcctaaataatccctagaaagggacccttatgactggcgttcaataagcatacctaaaatacactgattcaagaacaatgcttttaatatattaaagtcttatgatctatactaatagaagcagcaacaggcaaagggaattaattttatactttagtaaaataaaaatacaccttttgttaacaaatttaaaagacagactttgctgcttaggatattattaaaatctatttgctatgctctatacacaatgattttaaggagtaggatgaaggctcagaagcaggctagatgacaggaaacaatctggattaaaaatttgtaccggagtcacttgtgaataatcaagaattgagtgtggaattgtgtccttggccatcttcaatttagttcacagaacatttgttgagcgcttctatgtaacagacactgtgctacgtggtaggtgaaaaaaaaggttcctgaagaactaccgtctagagatgtggtgatgttcttgttattgaaaaaagtagtgtggcaacactagccaggggaaaaataagtacctaaagtttattttgtcagaatatgcctttagccttatcaaatcttcttgctcaaaaagaagactggattgggccagtcgcagtgcctcatgcctgtaatcccgcactttgggaggccaaagagggtggatcacgaggtcaggagatcgagaccatcccggcaacacggtgaaaccctgtctctactaaaaatacaaaaaattagccaggcgtggtggcagcgcctgtagtcccagctactcaggaggctgatgcaggagaatggcgtgaacgcaggaggggagcttgcagtgaactgagatcgcgccactgcactccagcctgggcgacagcacgagatccatctcaaaataaataaataaataaataaataaataaataaataaataaataaaaggagtttggattaggatcccctcagggcctgggaaagaccagagtagaggcaaggactggaagtaagtaacctggaattctgatgtcaaaggaaaattttcagtgtcccactttgcatttgggggcttgatctgtggtagaactgtcctgctaaaatcagggcatctttattctggaagagagcagttaagtgcaagtcatgctctcactagctactcatggatttcattttatttattttttaaggtccttctttgaaaaagcaaatttatttcctatctaaaatggtaatctgttcagatctgttttgactaccagtcaaattaatttgactaatttaagatatgtctgcttgtagccgagattgcaccactgcactccagcctgggcaacacagtgagactctgtctccaaaattaaaaaaagaaaagaaaagatatatctgcttgattataacaatcaagggacaaaagctccttctcccatattcatatattttggtatttattaagcacgttcttattgtgttgggtctcatttaactttcatttaactattatttaactttctcaaactgtaaagatagctaagatatttaatccttttgatccattatgttcaatgaaccagtagagtatgatatttaatattggtaattaatttattccctgccttctttttggttttgttggtctattcattcattccacgttatttactgagcatctatgctgcgccaggcactattctaggtattggatttgttattgtccaaagtaaaataaaactaacagaggcagatagaactataaattagtttcctcattctaagtttaatatacaaaattttctgttgagagttaaaaatcctatttatgttcccaagtaaaaagtgttaggaatttgagtaaaccatccaatacaaacttcatgaataatttttattctattgtttttaaagataacatattttaaagctcaggtacaagaactaaatggatttcagaaaagataccatatcttaagttttcatatatattctattttttgagctcacttacatttaaaggtaactcatccaaagttttatttgcaaatgtgttttgattttcttccatcatattcctctatatatttcatgataaaataggaatatataacttaaattcttcctgacctataattttttgtggatcaaatgcaattatcttctacttcagaatataaattttatctgttctcttaagtcatcacacatcagggagagaaaagtattgaaacactcatattatcacaaggtggtctatgacagcatgcaaaaataaaattaaaaatcccattagttctagaccagggtttctttcttgttgattatgccagtagtgtctttcttctaattctggttgcctatctgagaatcctggagcaaaaagatccaactgaattcctctcttttgccccctctactcatagagcccaggggtaatagaaaggaaagtgccagacctgtcagcactcatgatcactccctccaaaagacagcccagcaaaaccttcttttttttttttttttttttttttgagacggagtctcatgtgttgcccaagctggagtgcagtggcgcaatcctggctcactgcaagctccgcctccaggttcacgccattctcctgcctcagcctcccgagtagctgggactacaggtgcctaccccacacccggctaattttttgtatttttagtagagacggggtttcaccatgttagccggatggtctcgatctcctgacctcgtgatccgcccacctcggccattgcgcctggcctcaaaccttcttttttactcttcaaatacatgatcacttgcccatgttgaaaggacaccagctgcaatgctgatctcttggtagatttctgcatctgtctgacatctttgctttcctcaaatgcttccatgtcttcctgataatctgggtcctttgctgtctctctggtcctgaggcactgccacatagcacaccagccatagcttctatggccttccccttttccttgaacatacaaagtctctctgtctcagtgctcttgtacttgttgctttctgactcatccccatctcttacccagctggctagcttctatttgtttttgaaatttctgcttaaatgtcacctcatcaggtagcttttcttactccctgctagagtaagtcctccttttacccgaggcaagtttctttctttttcttcttttttttttttttttttttttttgagtctcactctgttgcccaggctggagtcaatggcgcgatctcggctcactacaacctctgcctcctgggttcaagcaattctcctgctcagcctctcgagtagctgggattacaggcatatgtcaccaggcccggctattttttgatttttagtaaagacggggtttcgccatgttggccaggctggtctcaaactcctgacctaagtgatccacccgcctaggcctcccaaagggctgggattacagatgtgagccaccacgccagccaagaaacatacttttgaaagagcatacttctaaaagggcacaaccaacaggtaactcaggaagacttgaaggtctacagtattaagattattggtttagagaaggacttatcaattcttcaacttatttattgatgatgatggacatcagagtaatgagagagggagatgagaaataggcacagatgtagcctgtgtagtcctttgttactttttgactgtaagaaaacttcacatgccaggtttagtaccacactgcagttgcaaaaaggtaactgaaacatctggaactaagtgacttgaactggattcgctatgattgacaaagctcacctctgtggagggtaccagaaacctactttcttatgcacgacggaggagctggaattgattgtgctttcgtcatcggcatcatgacaagttcggaactgctctcgtccatgacttcctgcatgctgttcacactgtgctctggctgcctgtgctcacggacatgcttggaatggaatggttgctgcccaggctgccatttccctgttcaggctggttccatgttcactgtcctgtaaaaatggggcactgaggtagaaaaaaagactgaagataaagagtcaatccattgacaaaagtgtcaagcacactcattttgcagtgtcaagttgcttttctgccaatctgcaaagacaaactttttatgtactggtccactactcctccaccattttcatacatctcatatttgcttcctatgccttccccagggccattctggacgtgggtcataaggctccaaatgctgccatcccagggctttcccctgtatacacactatcatattatcgtgttgctattcagtaagcaaaatcaagccaggtttgtagggaccttctggaacatcaaggagctagaggaagactgctggccactaaacaggtgagcctaggatatcttcaaatacagcagtggtcacttgaaaaagtagagtggaaagagttttcgatatttgacaagcaatatgctccctctgcaagtcattattgagtaacttcatatctaacagaaatattaattctactttcctggacaggtaattaaagtctgcctccctcaagcgatctatcatgcttatctctgtaatcttattatatatatctgttaaataatactggtattcacattactggcccaaagactactatttgaaaagtggtaaaataatcagaacatataattttccatcacagtgggatatcttttgatataagattgaataataaaattaaatccatttagtacaaataaaccttgttctcaaaaaaccatatggtacacatataactttaataaactgtacttagccatggcaatataaaaaattactgggtaatataaaatggaagataatacattatttttaacagacttattttcccaattaaaggggatcatttctatatatgcaatcaagaattttatagttcaatgcaactttccgagcttcatttttaaaattattgataaaatactttatgtttattttattttctgttaaaaagctaaaatactcctgttcttgttatgtctacgtctgaaatcctgcctctttaactatatccctttcttctatcttcggtgcctctgactctgcctggctccatctctactgcatttaaagatgaagaagcctgccttatatttatggatcttctacatgctgcccactcttacttttccttcttaacccaatttctgaatcttaacataatattttttcctgtctccctcttatcaactcccatgaattatacaactccagtaatctacattcattctacctagtcctgtaaaactgcttttactaaggtcatcaaggattctctaacgaaaacttctatctgtatactggcaagagtttataatgccaggaccttaaactcaaaagcacgaaactgaaatcatcctaaatctactctttctccctggttctttttctctgttcttgtattgacatactcctagccacccaggctccaatgctcagagtcaccttaaactcctcctatctgtcactgtcaatgagaagccatggattatgaaatctacctctacgatgtttctcaaagtgctcccttttccccatttgcatcgacactgaccttattacctcttgcatggactttagccaggatgttgcccattcaaatccatgttacactctgttgctaggataatcttccaaagcacaacacctttctgagtctagaacaccctatgcccatttgtcagaaactacccaatcatgtcctccaggaaaccttcactaatcccaccagcagacttattttctccccatgaggacccctgcaatggggttacacctctgtagcacttttcatattttgccttatataagtttattttatgaatgtctcttgtacaacccttcatgtttcttaaggcggacagcatcaataatttttatcttcaaaagtttttcatagtgcccagtctagaactttttcacatagtgggattctataagtgcctgctaaaataaattgaacctacttcctcatcctcctgtgactcatcaagggtccattccgtgtctcttggaaaagtatttttttcatttttcggtactgtaggtatctagctcacgaactgcatcttttgtcctctgtatgaggtcaatgaggacacgtagtgccggtctcgtcgaacaaagtcatgctgattgagggaggaggaaaaaataaactgataataagaaatgtccttaggtgcaaggtacagatataaaaggaaatagagaatcataaaatagtctatggatattacagaaataacaaaatatgattttcatgtcatgtgtccttccatatttgtaaatctcataaagagatagctatgcttttttcttcttccttaagccccattttgcgatgtgagaattctttttaaaaattgtacatatttaaagtatatggcaacatgttttgatcacatatatatagtgaaatgatttctacagttaagcaaattaacatatctattatctcaatagttacttcttggtggcaaagtaccgaaaatctttagtcttagcaaatttcccagattaatacaatattatcaactatagtcctcatgctgtacactggatctctacacttatttacccacataactaaaactttgtaccatttgactttcatctttccattccccatccctttcaccacctttcattttgtgttttattctttgtttactttccacatgtaagtgacatcgtagctatttttttgtgtgtctggtttatctcacttagcataatgtcttctgggttcacatgattgctgcaaatggcaggcccactttcttaagactatatataaaataaatattataaataacaaatatataataaatatatataataaaatattcagtcatatatattattgagtcttaatatctatatcacatataccataatttcttttatcctttcatccactgatgaacacatggatgtttccttattttggctatagagaaaaatgctgtgatgaacatgggggcacaggttttttatgaggtgctgacttcattttcttcaggtatataaccagcagggggattattggacaaattaacattttgttttttgggttttggaggaacctccatactgttttccataatgcaaccccaatctacattcccaccaacagtatataaggattcccttttctctatacccttccacttattatcgcttatcttttttgataatagccattctaacaggtgtgaggtgatactcattgtggttttcatttccatttccaataattagtgaatgttgagtatcttttcatatagaattcttgaggtttactttatcatataagtaataaaaaaatcactagaactttaagagtaggaggtaggcttgtaccttttaaatctgaaactacataataagcagaagcaatgcaagtatagtctattcttttttttttttttttttttttttgagatggagtctcgctctctccccaagctggagtgcagtggtgcgatcttggctcactgcaacctccacctcctgggttcggtaattctcctgactcagcctcccgagtagctggaattacaggcatgcaccaccatgctggctaatttttgtatttttagtagagacgaggtttcaccatgttgccttggctggtctaaactcctgagctcaagtgatccacccgcctcagcctcccaaagtgttgggattacagggtgagccaccgcaccgcaccttgttctattcttattataacttgcctcaatcctcaccccatacacactatcccttgaaaaacagacttgtgaatattttgttctctatttctgtggcgtatagtgtatgcttgaaaatatgccagttgttcaatttatccagaggtcaaaattctgcaacttcatttccccaattaaaaaaaagggtctctgaggagtgaaaacaactgccctaagtccataaattaatcttgatataaacatccctcactttcaatattattaatgattgttaataatctggtttcctagtttctcagcccatagcaggttagacagagaataagaatggagagtaagcctggcgcggtggctcacgcctataatccaacactttgggaggctgaggcgggggattactggagatcaggagttcaagaccagcctggccaacatggtgaaaccctttctcactaaaaatacaaaattaactgggcatggtgacgtgcatctgtaatcccagctactcggatgctgaggcagcagaattgcttgaacctgggaggcagaagttacggtaagctgagatccaccattgcactccagcctgggcaaaaagagtgaaactccatctcaaaaaaaaaaaaaaaagagtgaggagtaaaggattgaggactgggaaaggtagggttaccacctgttgtaaaagaagtagcttttgtaagttctctgacagcttgagagtagagaaacagagagaaatttcagactaacagacctatcaaccaaacaaataataataaaacaggtttgtgggctattttgcaaagggcaaatgccccttatatagccccttttatgcctcaagagttcacgaaacactgttctgagccctcaagaagtgacattaggctgggcgtggtggctcacatctgtaatcccagactttggaaggccgaggcaggctgatcacttgaggtcaggagtttgagactagcctggcaacatggtgaaaccccgtctctactaaaaacacaaaaaattagctgggcattgtgatgctgcctgtaatcccagcaagccaggaggctgaggcaggagaatggcttgaatctgggaggagaggttgcagtgagccgagattgcaccacagcactctagcctgggtgacagaatggaaaaaaaaaaaaaaagacattattttttaaaggcaaaagttcagttatgtggaaaatttactatgtaaaattgtaatttgaagacattgggaaaatgagatataatgtagtgggccttagtgatgaaatgaatttaatttctttataatttaaacagataaaaaataatagggcccttggagaaaacaatctatatgtcttgtggttctgcattctgactctcttagaggaattgtggttttgctgttgcttttataaaatacctcttcctaggtagagtcctttttgaataaaaaaatcattcccagaagcaagtgtagcctgcacatttcaaggatgagaaagaaaggaagaaatattatcattttcctcctctagtgcttacaattataaagagctaatcggtttttagtaacttaaagctatgacttaacatcatagaattttagaacgggaatgcctcttagaaaacttctgtttcaaggctgggcatggtggctcattcctgtaatcccggaactttgggaggccaagcgggcagatcacctgagactaagagttcaagagctgcctggccaacatggcaaaccccatctctactaaaaacaccaaaattagggaccgggcatggtggctcacaactgtaatcccgcacttggggaggccgaggcagggggatcacatgaggtcaggagtatcaaagaccagctggccaacatgatgaaactccgtctctactaaaaatacaaaaattagcagggcatgttggacgtgcctgtagtcccagctactcgggaggctgaggcaggagaattgcttgaacttggggaaggaggctgaagtgagccgagatcatgccactgcactccagcctaggtgatagagtggactctgtttaaaaaaaataaaaataataaataagaagtaaaaataaaaaataccaaaatagccaggcgtggtagtgcccgcctatagtcccaggtactcgggaggctgaggcacgagatcaattgagtctgggagacagatcttgcaatgagccgagatcaggccactgcactccacctgggtgacatagaaagactctgtctcaaaaaaaaaaaaagaaagaaaatttttcttttcaaagtgagaaaatttgggccctgagaagttaggtgatttccatagctaattagtagagagctacggctgcaactcaggctttaaaaatttttttctgccaggggtgtgggtggtggggttattttctggtgtcctactaccataattatctttctaaaatacaggtatgatcattattgcaacagatactacatgtcattcccccattccaacttctttttttttgagacaaagcttactctatcacccaggctagagtgcagtggtgcaatctcagctcgctgcaaactctgctcccaggttcaagtgattcttgtgcctcagcctccccagtagctgggattacaggcgtcaccattacgcccaactactttttgtatttttagtagagatggggtttcactatgttggcaggctggtctcaaactcctgaccttaggtgatccacccacctcagcctcccaaagtgcgggattacaggcatgagccacagctttcagacccaatctctctctctctctttttttttttttgccttacttgaagcactaggaagtaaaggaactgaacccaagccttctttgtggtacagatcactaagtgactaagttctggccagtgagaggtaggcagaagttctcaaggaagttttattttctagaataaaaaggcaagacacatgaggacaaggtgttttaccctttgtctctctccttcttcctgcctggaatgaaaacttgagtcatggcaatgtagcagccatttatgacaaagacaataaaagctacatgctaaggatggtgaagtagaaagagagaaagagctgggtcgatgacgacattgttgagctgcttagagctttggactgcttacgccacttcctttccaatgtcctggacttcctattacatgagataaactcttacctgtttaaaccttttaaaacagatacactctacatcttaatatctcactgtctcttagataaagtgtagccttttcagccaggttcctgcttgtatttctaggtttaaatctagtcattgctactcctccttccacacaattctaggtacattctaggtaattctaaacccgtgcatacctttcacacctctagcctttgccttcacatctctatgttctctctgcctgcaatcccatctcctcattgttttttttatttttattttttgggacagagtcttgctgtgtcgccaggctggagtgcagtggcccatctcagctcaccgcaacctccacctcccgggttcaagcaattcccctgtttcagcccccaagtagctgggattacaggcatgcaccaccatttccagctaattttttgtattttatagagatggggtttcaccatgttggccaagatggtctcaatctcctgacctcgtgatctcccacctcagcctccaaaagtgctgggattacaggcgtgagccactgcacccggcctcccattgtttttaaaagcccactgttctccaaacccctacaactggaatgccctcggactctttaaaaggacaattttattgttctcaaaaatatgtttactttcaacactcaaataacaagaaaaatgtataaaaaaagaaaatcggccaggcacggtgggtcatgcctgtaatcccacaccttgggaggccgaggagggtggatcatctgaggtcaggagttcgagaccagcctgacaacatggagaaaccctgtctctactaaaaatagaaaattagccgggcgtggtggcacagcctgtaatcccagctactagggagggcgaggcaggagaatcgcttgaaccagggaggcgaggttgccatgagccgagatcgtgccattgcactccagcatgggcaacaagagcgaaatccgtctcaggaaaaaaaaaaaaaaaagaaagaaaatcacccgaaattctaccatctcgaataaatacataaatattaagttacagaatatcattttagacatgtccctttctttctccagaacaatgaataactagaaatcattttacatgggaatctgattatacaagctaatttatgtataatcgatttaattaaggtatatttgaatttaacaggattagaagagactgaataaaacgattgcataggctgtatgcagtggctcatgcctgtaatcccagcactttgggagctgaggcgggtggattacttgaggtcaggagtttgagaccagcctggccaacagggtgaaccctgtgtccactaaaaatagaaaaactagccagacatggtggcgtgtgcctgtaatccagctgctcaggaggctggggcaggagaattgctagggagaatctcaggaggcgaaggtgcagtgagacgagatcgcgccactgcactccagcctgggcaacggcgcgagactctgtccacacacacacacacacacacacacacacacacacacacacacacatgcacaaattaaaaataaaacaattgcttaactttagttgtaatttcttcaccaaaagagttatctgttcctacagatcctctaaagttaaaaaaaaaattattaaaggctttacgagattgaagttacttagttcttttgtcctatatattttaagaaatgttattgtccatctacttggaaagataagaaattagtatgcatacgtttttcctgcccttagatttttctaattacattatttttacatgcaaatgtttctaacatttacatctgtcctttaaccatttcaataattttacctcagtgtttatttaaatggattaagtgtgaaagtgatgttttaatgtcagggcaaaaatgcatgaaaagatgtattattgaaaaatatctgggagtaagtagatagcttagctgggggaaaaaggtagatttttacctcactccttgtaacaaatttttgcataactctccccacctcctttcacaaaacatcagcataaagaatgtcaaaagagaaataggaaaaaaaaatccaagatctctataaattaaaaaggaaatacaaatggcttttcaacttacgagagagatgttcaacattcccataatgtgaaatagcaattaaaactatagtgagaaaagttttcactgatctgacaagttcaaaaagtatcagtcttcatactttcacggtgggactataaattggtgcaactgcttgaaggacaaatgggcaatatctatctaaatttaaaatccacattgatgagcaatccccttctaggaatttctttattttatttttatttatttatttttttgagatggagtcttgcctgttgcccaggctggagtgcagtggcacgatctcggctcactgcaaacttcgccttccggttcaagtgattctcctgcctcagcttcccgagtagctgggattatcgacgcatgccacatgcccagctaatttttgtatttttaggagagatggggtttcactattttggccaggcggtcttgaactcctgaccttgtgatctgcccaccttggccccacaaagtgctgggattaaggcatgagccaccgtgcccggccagaatttattctttagatattcttatacagggacaaatgccatatacacaaagatattcattacggcacagtttgtaatagcaaaagattggaacatcctaaatgcgttggttaaacaaattatggtccatctaagaatattatggagccattaaaagaatgaggtagctttgcatgtagtaatacaaaacaatatcctaagcacactgtaagcaaaaagaaaaatcagggtggaacggtttttatggtttgctgtcatttgtgcaaaaataaaacaacatttacttttatatgcataaaatatcactagaaggagaggtacaaaatagggcagtggttgctagtgagggggcctgaaatgggagggagatttctttttcatgttctacttctcttattattttttgagacagagtcttgctgttgcccaggctggagtgcaggggcaaatctcggctcactgcaacctcctagttgatcaagcgattctcctgcctcagccactcgttagctgggactacaggtgtgaaccaccatgcctggctaatacttatatttttagtagaatggggtttctacgtgttggccaggctggtcttgaacttctggcctcaggtgatctgccgctttggcctcctaaagtgctgggattataggtgtgagccattgcacccggctcttcttttcttcttcttcttttttttttttttgagacagggttttactcccatcacccaggctgagtgcaatggcaggatctcggctcactgcaacctctgcctcccaggctcaagtgattctctccttgagcctccgaagcagctgggactaaaggcgcatgccactgcacctggctaattttgtagagatggggttttgtcatgtccaggctggtcttgaacacctaggttcaagtgatcgcctgcctcagcattccaaagtgctgggattacaggtgtaaggcactgtgcccagccccggttgtaccttctactgtatttttccttttggaaatttgtgagacctatttaaaatgaaaacatacagcttctttagccatgcaaaataaataaataagtatttggggaggggcctcttaaattcaatatttaccatcagcccttttaccagtttctccagtccctcattcattcttctgcttgccttcctccctctttttcttctttttgcttcatctctatattggctagattcgttattgagcaatttttaaaaggaaagcgccgaaaggttgcattgcctaaatgtgtgggctcgaagatgtcagctgcctttataatttaagaacatcttggctggctcacaattcctgcttatattttatttcccttagaactctgcaaacactgttctattgttttctggctttgatgttcctgaagaggtaggtctggagccagttggtttttccaccccaaaataaactttttagtctgcttgtatgaatctttctttattcctagagttcagggacttcaccaggatatgattactgatcaatgaagatcagtttcatggtccccctcttcatgcatgtatctgcttaaagttacctcctcgaacggccttctccttacctaaaatagcagcacctgtcaatcttgatgttgtctaatttatttttctgcacaacacttaacatcaactggcactataacatatattttttcttttcttttttcttttttttttttttttgagacctagtgtcgctctgttgccccgctggagagcagtggtgctatcttggctcactgtaacctccgccttccggcttcaagtgatctcctgccttagcctcctgagtagctgggaatataggtgcctgccaccatgcccagctatttttgtatttttagtagagacggggtttcgccatgttggccaggctggtctcgaactgtgacctcctgatcctcccaccttggcctcccaaagtgctgggattacgggcatgagccccacgcccggcctacttttttatttcttactccttcttgtaagtttcacaagggcaggcctatgtttttattgtgtactactgtattctctgcgcttagaatagtacttgacacccagagacaatcagtaaatatttgttgaataaatagttggcccatttgatttggtccatcaaacaagatggaatcaaatcaaaggaagatccaaacatttccagaaaagttttcttcaaggaatctttaaaaatcttctcctccatgtgttttgttttctttttcaggaataatcggttggatatattagatctcctgtgtcttccaaatgtatcattttctttatattcatctttagaattttattttttgcacttaattctattttatttccttaagcctattcaccattggaaacacctaaatgggttggtttactacatgttcgttgcttataatatgattttttaaactgttagttttttctcttccatttttttctttacctctacccatttgctttttatatccttttgtgtctgtaacccttaacttttaacatcgcccaaatttattcatattttccttttttttttttttaaagagatggtattttcactctattgcccaggctggagtgcagtggcacaatcatcctcactataacctcaaaatcctgggctcacgtgatcctcctgcctcagcctcctgagagctgggattataggcgtgagccaccatacccagctccacattttttccccttttatggtgtaatttttatgtcttggttttttgtttgtttgtttttaagatctttgtgtacttcaagtaataaagatattattgtgtgtttctggtgttttgttctggttgctattttcccctaaaaaacatggaattgttgctaagtagttcatgtttaaaacatgtaagggctccacaacaaagagaacaagatcaagctctttgtcctgttgcttctcttaccatactcctgtggcctaccctcacaagaagtaaaaacttgtcacctagccaaggtgttcttaaattataaaggcaaactttttaagctttacaaattgaggcaatacaactcttctgagttcttcttaaaaacgaacaacagaactgctatacaataaaagccagccattctagagacggaagaaacagaaagggtgaaaaacaaacatgcaaaagaaggattaaagaaatttggactattgtgcgccaaataaagaaaacacttctactgtaaaagatttccacatactacactgatattgatgcaacacactcctatgtataaagtctacagtaaaatattacatgaaaagagatgcttggtgataattaatcaaataaatgtggttaacacgatactcttatcactaacatgtcataatactatgtaaagtctactctatatagttatcatacaccttcactgcctgaggatttggcaacaacctaacgaaaatcccagagttggtgtttgaaccaccggccagctctgtcttgagaccactggattatgtttatgcagatgttaggcccaggaacatcacaatgatgactagagcaaggaggagaatattatttgttataaggcaaaaaaggaacagggagggaggggaaaaaatagaaaagatgggaaaaacctatccacagggaatacatagcacataacgttgcaataatcttgctattttatgcctagctacttatctcaggataaatgacaaggcagcacgtcctaaaccactttgtatgatgagctgccacaggaatgatttattatattccattataacatgactttaaatcccctcctcaaatataaatttgaaaaattacccttaatagttctgctgatgttggcctttccgaggtattttctgcaagcagtaatcaacaaatctcctaaaggagtctgtcctgtgtgtgaaatacacaaaagaaaataaactcagggtctgtagagcacactgattacttaaaacaatttcattcaagggaaaattttgcatttaaggagattttaaaaaaatgttttggaatatcagataactggagcattttcaagttacgatatctaaaattcttttggataatgagtgaggaaagtttcaagttagtcaacatattaatacatcttaatatataaggaaggtcaaatcatatatacatcagaaaacaaaaatactatgtttaaataaaagttttatatacatttttctctcaaagacaacaattctcatagtctcaactctatattcttaattaccaattgttaattccctaccacccacaatctataacaaagtagtaaaatttgaagcatgagggatggagaacccggagtaggcttcctgaacaaaaattcttcctatcttaaaagttccattttatccgttctctttaatattgccccttttaaaataactcttgtggcccaaatagttataaaaatgtcatcttttcagcaaggaacactgtatctgaatagataatgtatgctctgtctcaacacatttagtgtacatatagtttaaaaaaaaaaaagacaactggagaaataatgacatcatagaggccccttatctctgctgagaagtgatatcagctgagatgatcaatacaagaccatcatgactgggacaatagacttgttaggagggtagcagggcatgttccctgcaggattttggttatagacacattaagaacacagtgcaagccatggtgaaggcaaaaataagaaaatctatgctgtgtgcatgtgtagacagttgatgcttgtgaggcatcagtgtcacttgtaacaacataagtgaaggaaagaaatgctttctaggtcagatatttaaaatgtaatgtaataaaaatgtaaatacatacggtgattttcttagagatttaaaatgatagcagagtcttaccattcattgactgtaacgttggggagtcattctgggcaatgtgatataaggcactcattgcattcatttgaaaaggggcggcttccgttccgctggaagaggaaagaaacacaataaagtagttctgaaggaaaccaggcagacagagaaataagaaactatgagcaaagctttgcggctaaatcatagctcattactgtcatcatgccacataatccacttattttaatctctaaggttggccaagatagccattcagaagaagctgccggacattaaatgtacattggcaaagctcctaacgaactcatttcaaaagagtgaaagaaaagtttttttctttttttcacatagcttcaaaaattggcttttgcatattttcccacaataggtatgaagatctttgcatgtgcgttttagccaaaaatatatattctctccttgaagtctgggtatttggtgaaaaagaaaaagaaaaaattcatattcacttaaaaaagtcagaaagcaaagaaacatagaataaggaaaaaagattatataaaatgcaacttttttttttttttttgtgacggagtcttgctctgttgctcaggctgagtacagtggcacgatctgcaacctctgcctcctgggttcaagtgattctcctgcctcgcctcctgagtagctgggactacaggtgcctgacatcgtgcatggctaatttctttcttcttttttttttttttgagatggagtttcgctcttgttgcccaggctggagtgcaatggacgatcccagctcactacaacctccgcctcccaggttcaagcaattctcctgcctcagcccctgagtagctgagattacaggcatgagccaccatgcccggctaattttgtatttttagagagatggggtttctccacgttggtcaggctggtcttgaactcccagcctcaggtgatcacccacctcagcctcccaaagtgctgggattacaggcatgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctgaggcaggagaatggcgtgaacccaggaggcggacctgcagtgagccgagatcgtgccactgcactccagcctgggcgtcagagtgagactcctctcaaaaaaaaaaaaaaaaaagaaaaagaaaaggaagagaagaagaagataaatcacttctctttctactgtgcttaccctaatggattttttatatagtctcactttctaattcatatctgatctctagtttcatcagagcaccttagtttttaagtaaaggctcttcttctattaccacttctaaaatgacaaatcgggcttattctatgcagttcaaaaaacagaacaaggcaagaggtgaagttatagaaaagacattttcactcacagaaggaaaaatttggacacagcagagtagttaaaacacaaaacaagaaaccagaatggacaaggttgaaaagtagtaaacttaagtcatttagtagcacttaagcagatgacaactatacctattcatttgttatattttgaggggcatcttatagtcttgattaagtgatttctgtacctctgaaatacagtagtctagccaggcatggtggctcatgcctacaatcccagaactttgggagactaagcgggcagatacctgaggtcaggagttcaagaccagcctggccaacatggtaaaaccctgtctctactaaaatacaaaagttagctaggcctggtggcatgcgcctgtaatcccagctacttgggaggtgagaggaaaatcacttgaacccgggaggcggaggttgcaatgagctgagatcatgccatgcactccagcctgagtgatggagtgagactccatctcaaaaataaaaaataaattaaaaaaatgaaatatagtagtctctctctatatatagacagttaattttatgtatatatatgattttatgtatatatgtatatgtatgtatgtatgtgtgtgtgtgtgtgtgtgtatatattatatatatatatatatatatatatatatatatatacacttttttttttttttgagacgagtctcgctctgtcaccagggtggagtgcagtggcgtgatctaggctcactgcaacctcgcctccaggttcaagtgattcttctgcctcagcctcccgagtagctgggactacaggcgatgccaccacgcctcgctaatttttttgtatttttagtagagacggggtttcaccatatagccaggatggtctcgatttcctgaccttgtgatccgtccgccttggcctcccaagtatttttattgacctctcaataggatactttatacttaccaaacagatactggtattacagtatatgaactgttaacaagtggaaatttggaagttgctgtgtggtcgaatggatttatattgtttcaaatgcaaaagattaaaaaaatctggtttgggtttatttttcagggggcagatttagaaagtttgcagagcttgctttctggcaacttcaagtacagtcatccctaggtatcgtgggggactggttcccgttcccccctgcatataccaaaatccatggatctcaagtttctatataaaatggcatagtatttgcatgtaacctgcacacatccttctgtctgtatacttaaatcatctctagattacttatgatatctagtgtaatgtaaatgttatgtaaatagttaaccgcattgtttagaaaataatgagaagaaaaaaagtctatacatgttcagacttgtatgacattttcttgtcattatttcctaaacaatttcctataaagactcaaccctccttttttttcctgaatatttctgatctgtggctgattgaattcatggatgtggaacccacagattggaggaccaaccgtatttaaaaccacgtggaagcctggccaacatggtgaaaccccgtcctactaaaaatacaaaattagccaggccgtggtggcttgtgcctgtaatcccagctactgggaggctgaggcaggagaatcacttgaactgggaggtggaggttgcagtgagccgagacacaccactgcactccagcctgggtgacagagtgagaccttgtctcataaataaataacaaataaataaaaccacgtggaactaggaactcatcacgtaaccatcaatggcttcccatattcttaggccaaagtccaaatccttaaacatagtctcttggacttcattatcatgggatggctacttccagagcccgattctgagaagtaacctatttttccctctctcatgctttagtgtgcttcactcaaagaaccaagctcggtgtttttcacaaatgctgttttcttggtctgacacccctctcccttttgctccctaaactttatctgggtacatctttttgtgtatgtggtgtgtgtcggggtcttgctctgttgcccaggctggagtgcagtggcgtgatcagctcatgcaacctcaaactcatgggctcaagtgatcctcctcccttagcctcccaaagtgctagattacaggctaattctcgacaatcctttcaggtttcatctcaaatataatttcatttctcatgaatttaataagtatgtattcaggattcattatgtgtttataatcacttcctcaggaaaccttccctgacctctcagactaggtctcctattagattttgtcattgcaaattatatttttgctttcttccacatatcacagccctagttatttgtgtaatttttttgagacaggtcttactctgtcacccaggctggagggagtgcatctcagctcactgcagccttgacctctgggctcaggtgatgttcccatttctgtctcctgagtagctgggattataggcatgtgcattaagtccagctacttttttggctttttttttttttttttttttttttttagagatgggttttgctatgttgcctaggctggtctcaaactcctgggctcaagcgatctgcccgcccaacctcccaaagtgctgggattataggcatgagcgaccatgcctggcttatttgcataatattttcttccttccttctttcctccctctctccaaccctccccccttccttcctttccccctctctctttctcattcaagccatccttctacctcaccctccctagtagccgcagctcaggcacacgtcaccatgcttggctaatttttttaaggttttcgtagacataaagtctcttatattgcccaagcttgtctcaaactcccaggctcaggcgatcctcccaccttagcctccaaagtgctgggattagaggcatgagccactgtgcctagcctagttctttatttaatggtgtcttctttgctaaacttcatgagggcaggaacaacatctatcatgttcatctctgcttctcagtgctgagaacagtacctggtacacagcaggtggcccctaatacttttaaataataaatgaaggtgagggaaattaaagcacagaataaactctgtcaacaaacaaagaatcttgttcagtaagtaattacaaaattacaaaaatgactgagaagacactaagtctcggggtcatgacagatactatttgatggcttcattcactattagaaggaccagaaccctcccactactggcaaaaggttaaaaaaaaacaatcccagcttctcagaacactgaattgcatagggaaacagtgaaacagaagggaaaggagactgaagcaagagaaaaacaaatttgaaaagaaaggatgaaagaacaaaaacacaaagaaaactcagttcaataaaaggcagtggcttggattgaagcagcaaagagaaggcctgtaagtagcaagcactctgcctaggaacaagcagaaagatggctgaccatgtaatggtagaagaaataattttaatagagaagcacatgactaaagtactctaaccatagaacagctctatagtctgggaagcattctctgagtattagcttcagtgatctcatctatgttcaagtctttgctagatgtaataaataaatcctctgagcaatgtgacaaggctcactgctgagccagaatactacagagcaagggctggcaaactatggccctgggccaaattcagctatcagcctgcttttgtaagtttattggaacacagccatgcctgacattaatgtattgtctatgactgctttcatcctccagcggcaaagttgagtagttatgtagacattagatagcttccaaagcctaaaatgcttattatctggtccctcacagaaagttgtcaatacttattgtagaatatagcagttttcttttcttttttttttctttttttgagcagagtctcgctctgtagcaaaggctggagtgaagaggcatgatctgggctcactgtaactccgcctcccaggctcaagagattctcctgcctcagcctcctgagtagctgggattacggcatgtgccactgtgcccagctaatttttgtatttttagtagagatagggtttctccagttggccaggtggctggtctcaaactcctgacctcaggtgaaccacctgcctcggcctccaaagtgcaaagtgctgggattataggcatgagccaccgtgcccagcaaaatatagtagttgaataaagcttcttctacatatgcagcagaataggaattgggaacgcttctgaagaatcaccttgtgatacggaatacatataacctttttttttttttttttttgagacagagtctgctctgtcatccaggctggagtgcagtggcgcgatctcagctcactgcaagctctgcccacaggttcacgccattctcttgcctcagtctcccgagtagctgggactacaggtgcccccaccacgcccggctaattttttgtatttttagtagagatggggtttcactgtgttagcaggatgttcttgatctcctgacctcatgatctgcccgcctcggcctcctaaagtgctggattacaggcgtgagccactgcgcctggcagaatacatatattcttaaatgaaaggaaaaggtagaagcatacaaacgttgagctagctacattaaaagaaaaaacagtagtttcccttaacttagagacaaagatcaagtttctgtgtatgatcaatctctgtcatgtaagatcaagttcaggaaggtcagtttgatcaagtttctggatactgctctgcttggtaaagagtaaacaaattagagtgcctacatgtatgtttatcacagcccaatttacaaacggaaagatatggatgaacctaagtgcccactgaccaaggagtaaataaagaaaatgtggtggccaggcgtgtgactcacgcctataatcccagcactttgggaggccaaggtcggaggatcacgaggtcagagatcgagatgatccttgctaacagggtgaaaccccgtctctactaaaaatacaaaaatagctgggtgtggtggcacgtgcctgtagtcccagctacttgggaggctgaggcaggagattgcttgaacccgggaggcggtggttgcagtgagctaagatcatgccactgtactccacctggcgatggagtgagactccctctcgaaaaaaaaaaaagaaagaaagaaaatgtggttatatacaccatggagtactactcagacagaaaaagtaatgaaataatgtctttctcagaacttgaatggagctggaggcaattattctaagagaagtaactcaggattggaaaaccaacagcattatattctcacttacaagtgggtgctaagctatgaatacacaaaggcatacaagggatctaatggactttggagactcagaagaggaagggtaggagggggtgtgggataaagactacgtattgggtacaatgtacagtactcaggtgacaagtgcactaaaatctcagattcgccactatataattcatccatgtaaacaaaaaaacacctgcactacaaaagctattaaataaaaaaatgtaaaaaacaaaataaaataaatcagagtgtctactgggcttaatttactaaggaaaatgaaagagtacgcctatctttagataaacactacctgaaaaggtataaggttcttttctttctttctttctttttttttttttttttttttgagacgcagtctcgcatgtcgcctaggctggagtgcagcggcgtgatctcggctcactgcaagctctgcctcccagttcacgccattctcctgcctcagcctctccgagtagctgggactacaggtgcccgccacacgcccggctaatttttttgtatttttagtagagacggggtttcactgtggtctcgattcctaacctcgtgatccgcccgcctcggcctcccaaagtgctgggattacaagcgtgagcaccacgcctggccatttttgaggcagagtctcgctctgtcgcccaggctggagtacaaggcgtgatcttggctcgctgcaatctctgcctcccgggttcacgccattctcctgcctcgcctcctgaatagctgggactacaggcgcccggcaccacgtctggctaattttttgtattttagtagagacggggtttcaccatgttagccaggatggtctcgatctcctgacctcgtactcacccacctcggcctcccaaagtgttgggattacaggtgtgagccaccgcacccggatttttttttttttttttgagacagagtctctctttgtctcccaggctggagtgcagtgtacaatcttggctcactgcaacctctgcctcctgggttcaagcaattcccatgcatcagctcccaagtagctgggactacaggtgtgtgccactacacctaatttttgcatttttaatgagacagggttttgccatgttggccaggctgctctagaactcctgacctcaagtgatctcccactttggcctcccatagtgctggaattacaggcatgagtggccaagcccagcccataggtttcttatgaacaaatatggttgaaaaccataataactaatgataacaaaataatcctaccatttactgaattcctactatatgccaggcactcactgccttaggcatgttacattgttattcataattctcaaaatagcttgtcaagataggtattatttttccagtttcccactgaagaaactgaggttcagctaagtaacaaaaccaaatcacatagtgtttacgctgaatttcaacccaatcctatgagactccaaggcctgtgttctttttactaggccatggtatccttcaataactctgtacattttaaggtagatagcactagaatttcaaaatgaaaagaaaactttagaagactaaatataaccccttctccccaacaacgatcatggtattcatttattacagataaactataaggggctaatgtataagaagaaaattccaggcagagaatctataaatttatgtttgtgttttgttctttcctggagaacttatttctggacacaatccattcccgacagtgccgacagactatttgccagtttctaccataacctttgttggtgaactaaatgctgtagtttaaacagaagagaaccaagattaacttctcctgaatgtaatcctgaaaaataaatatctggtgactggacaatttcaacctccaagagttttaactagtcctttcaacagagatcaatttacccaaagataatttataaaacaggattaaacacttaggagctgtaaagttgatctttaggaaagaaggacagtgtcagtaacactatcatcatcctgctttttgatgcatcccagcaattcaacttctagattagggtgtttttaaaaaaatatatactattatagagagacagacaccataaagaaaggggataacaagctattatggaagagagagatatcagacaaaagggaacaggactatccacaactttccatgtaatttcgatgttaaaagtacaactgggctgggcaaggtggctcatgcctgtaatcccagcactttgggaggctgaggtgggtgatcacctgagatcagaaggttgagaccagcctgggtaacatggtgaaattctgtctctctaaaaatataaaaattagccgggagtggtggtgggtgcctgtaatcccagctactcggaggctgaggcaggagaatcacttgagtccagggggtggaggttgcagtgagccaagatccgccattgcactctagcctgggtgacaagtgcgagactgtctcaaaaaaaaaaaaaaaaaaaaaagatacaacttaaaaatatactattggtattaacagttagaatttcattatgcccaaacatacagaaaatagcaaaatcattgcttagggaatatttgaaacagtttaaccttgtcttgcatgtaaaaaaaaaaaaaaatacccttcttttacatgtccattagcaaaattatgctagggagatgaaaatgtatgataaagctgtcaaagagatacttgtatgacttattaattactgatataataattttcaagtaattgctgagaaattaaatgttcttggtaataatttattttgtgaatatttactgaccatctacaatcacatttctttgagtctgagatgtcatgactgtaaggtgtactaccgttaaatattcaccacgattttataatatgtataacagaaaaatgctgccaactataagaggctgttgcctataaaatacctcctactttaaaaaagtatttccttgtttttgacaaaattgtatatatttaaggtgtacaatgtgatgttttgatgtcatatacattgattaatcacaatctgtccatcgcctcatatagttactatttttttttttgtaggaacatttaacatcatttactctctcagcaatttcaactttcaatgcattttacatgttgcttcctagtgttaaagagatgttaaaatgggccggcatgatggcttgcgccttaatcccaacactttgggaggccgaggtgggtggatcatttgagatcaggagtttgagatagcctggccaacaaggtaaaactccgtctctactaaaaatacaaaaattaggccgggtcggtggctcacgcctgtaatcccagcactttgggaggccgaggcgggcagatcacaaggcaggagatcgagaccatcctggctaacatggtgaaaccccgtctctactgaaaatacaaaaaattagccaggcgtggtggcgggcacctgtagtcccagctactcaggaggctgaggcgcagaatggtgtgaacccgggaggcggagcttgcagtgagctgagattgcgccactgcatccagcctgggcgacagagcgagactccgtctcaaaaaaaaattagccgggcgtggtggaggcgcctgtagtaccagctattcgggaggctgaggcaggagaatcgcttgaacccgggactagacgttgcagtgagccgagatcgtgccactgcactccagcctggtgacagagcgaactccgtctaaaaaaaaaaaaaaaaaaaatttacagacttgagataatttgaccaaagtagacaactacaaaatggcagaataagaactgaagtttatctgactgcagagtctatgcttttagcacaatttgacactatcacttatcaatttgcagaaatagctgtcatagaggattgacaatttgggagaaggctactttgtcctttagttcagtaaatcattttataaaatgcatcaaaggctgatacagagagcatgtagttatacatatttcaattcatttttataagaagtaaaatcagaaagcacatataaggggctgtcttaagagaggaagcactaaggtatctctggggtctgtacttgtgtccaatgtcaactgctgttgacattttagtcatttacatgtaccggtacaaaatctgatgtgatgatgatcttgaatcatcataaaagggtatatgtagttttacaattgaagaagattggaaagggaagaatccatgtcaaatttcggcaagattttggtagaaaaaaacttgttaagaaaaaacttggtaagaaaaaactagttaaaaaatgggtaggactaacagtaaaattcaacacaagtggcacattcttttaaaagatcgtaactgaggtgtgctatgatggtctcagtgttataaggaaaattttggtttatttttataaaatattactttatattttaatataatataaaattatgttataattttataatataaatttatatataaatataaatatataaaatataaaatatctgtgttataagtaaaatataaaataagtaatatttataagaataaaccacaattttacttataacactgagaccattgtagcaactcctcagtatgaccctaaaggtactatgacctctaaaagtagcataattttatatggcctaaaacaaaattacaaaaaacaaaaaacaatcctatatatgaatacaattaactgttactgagcactgctatatgccaggcactatgctaaatactttacctaagttatcttattgaagcctgtaatatctatgatatatccattgttatttttacttagatgagaaactgaggattagggaagtaacaaaatgatccatgatcacacagtcagaatcaatatgttacacagtcccaggagggtcatctgcatcccagactatgtgaatgcctgatggcattatgttacagccacacatggtgtcctgccagctaagtgctggtaaagccaagattcacatctagggtgtctaattctaaacttactccatactgctaactctatgctatgcacagagtagttttgttcccccaaaggaaatatatttacttctaatttttgaaaagttcaattattcaatatttaaaatgtgtaaaatttgtagaatattataacagacacctatcacttagatttattataatcttgtcatatttgttcaggtcctttttcttctaaaaaaataagaaagtagatacagctctatttgccttccttctccagtgtttactgttctagaattatatctttacaactgtattcttatgttttattatatatatactcttttttttttttttttgagatggagttttgctcttgtcgtccagctgggtgcaatggtacggtcttggctcactgcaacctccgccttctgggttcaagcaattctctgtctcagcttcccaagtagctgggattacaggcatgcaccaccatgcccagctaattttgtatttttagtagagatggggtttcggcatgttggtcaggctggtctcaaactcctgactcaggtgatccatctgccttggcctcccaaagtgctgggattacaagcgtgagccactcgcctggccagtatatatatagttttaacaatatataaaagaacttataaaattttcatactggcatcaaaccatccttgtacttttgcaattttatttgttcaccaaatattcaatgtatgattttgagatttatccatgatgatacatgtagatccagttcattcttaactatgaacagtattccataatttatacattctcctttggataagaatttaggctagttctacctttctggctactataaaaacagttgcacccttgtacacattttccagtgtgtatgcatacgagttcttccttccttggcagcttctccaaatttattattcgaggacttgaaattcttgcagtctcataaatgtgaaattgtttcaaattgcatttctctgattactaatgaggcttaggtcttctgatgtttgttttccatttaggtttcctcttcaatgaattgcttaatcatattctttttatttttatttgagatagggtcttactcccatcacccagactacagtgcagtgggtgatcatggctcactgcggccttgacttcctgggttcaggtgattctcctacctcagctcacttaatcatattccttacccatttctctactggttgtttggctttttcttttttttctttttttttttggggggacagagtttcgatcttgttgcccaggctggagtgcagtggccaatctcggctcactgcaacctccgcctcccaggttcagatgattctcttgcctcagccccctagtagctgggattataggcgtgcatcaccacacacaggtaattttgtaattttagagaggtggggtttcaccacgttggccaggctggtctcaaactcttgacctcaggtgatcgcccaccttggccgcccaaagtgctgggattacaggcatgagccaccgcatctggccagtttttctttttcagaaagaaattgtaggagttatttataaattttggaccaatactttgtggttaaatgtatttcaactaccttctcctagtccatagcttgtcttttaatgtttgtgtttacatggttttatattttaaagtagtaaaagttatgatatttatcattatgttttaaaaacattgattagaaaaggtcttcattatacttgtaaaagtattttagagtaataataaaacactaggccgggcctggtggctcacgcctgtaatcccagcactttggaaggctgagggggtggatcacaaggtcaggagattgagaccatcctggctaacacgatgaaaccccgtcctactaaaaatacaaaaaattagccaggcgtggcggcatgcacctgtagtcccagctacagggagcctgaggcaggagaatcacttgaacctgggaggtggaggttgcagtgagctaaagcacaccactgcactctagcctgggagacagagcgagactctgtcttaaaaaaaaatataataacacttacatagtgcttattacatgccaggccatgttctaagcatataatagatttaattaatcttcataacaaccccacaaagtgggtactatcattatttctattttacagtgaggaaactgaggcattggggggcttcttctaaatgtttaaagttttacttttgggcattaaccaatctaaaatttatttttgtgtatgacatagctaggaatccagttttagtttttcatataattaacacatttctcagtattatttaccaaatgagccatcatttccccattgtctgtaacggcttttgtgtcttataccaaaatctgactcatactagagtttcctagtctttctaccggatactagtctttccctgcaacaataccatatggatttaattaatatggtaggattctggggcagtgattcttctgttcaaattctatttctccaaagttgttttagctattttggtcctatgacttctgggattaccctgtgaagtgtttttttttttttttttttttttttttgagacagagtcttgctctgtcacccaggctggagtgcagtggtgcgatctctcctgcaagctccgcctcccaggttcacaccgttctcctgcctcagcctcccgagtagctggactacaggcacccaccaccacacctggctaatttttttgtatttttagtagagacgggtttcaccttgttagccaggatggtctcgatctcctgacctcgtgatccgcccgcctcggctcccaaagtgccgagattataggcgtgagccaccacgcccagcctaccttgtgaactttacgtagtattgtgggaagttcgttataagccctttttaaaacatgcaaatatttctgcgagtggcccccaaaatcagtatgaataactttgatcaatttcctttggagtgaaataaaagtagtaccatattataacctaaaaaagaaattcatcaactcaatatccatcaatacaaaccagttaaataaactatggtatatcatgtaatggaataacatgatgccattaaaatgagaaaaacatgtctaagttagtcatagaaaacagatctccaagatattattaagtgaaaaccaaagtacagaaccacatatatacgttaccttgggtgtgaaaacgaatataggaagtgatattcatgtttgtttgtatatttaccaagaagatctggaaggacacaccaattaataagtggttccctgcgtgtgttggcaggggtggtgtaggaactgtgtagatagggcaggggtgaagaagatctttcactgtatgtctttttatgttttctgatttacaaaccttgtgattcgctacctaattgaaaaaaataatattcaaattttcctccaggaattcttttttttttttattaatacttctttaatgtaaaaaaaaaatccagataaattgtgcatctttatcatatgtgttttgtcggaaggggtcaatgaaacattggcaatgtaatataaagtatcccaagttgcctaacattttaggaaaagagaagaccatagtctgtgaatcaaactagaactcagaaatcttataggatcaatttggaaaccttaatagaattacatgaaattaatatcttaaaaaatagacaaagaatttttttaggccaggcacagtggctcatgcctgtaatcccagcactttggaggccgaggcgggtggatcatctgaagtcaggagttcaagaccagcctgaccaacatgcaaaaccccatctctattaaaaacacaaaattagccaggcgtggtggtgcatgcctgtatcccagctacttgggtggctgaggcaggagaatcgcttgaacccagaagagagaggctgagtgagccaagattgcactgctgcaatgcagcctgggtaacagagcaagattgtgtctcaaaaaaaaaagaaaaaaagaaaaaaaagaattttttaaaaactgattttttaaaaagttaacatttttgatttaaaatttatgaaaatatgtagataaaggcagcattatgctgtagcagcacatactggctttggaaggcccattgtgcacatctttccccattttcacatttagtaatagcattggctatagtaagagtatttacatcatggaaattggcaaagctacaaatcaggccttttcccctctccacaagagattgatttgttaaatttaccagtataccactggatgaagtaagcttaagatatattaaagttcaaaatatacaaccaaaggagagattctgtggactttagacaatgttagataactgtaacaatatttggggaataacttaatggctgaagttatcttataacacaaagttttcttcacagttgtgctctacatgggtcaaatacagttttgagtcagatccctgataagctttctattactttttcagatttccctaatacaagttggatataaattaaggtaatgggaactcccataaaggtaggacatatattatcattcatagtaggagaatggatatttttcatatattactatgtgctattttgtatttcatttgttaactgcatatctgcttcaactccttcaattaaattaataacatgagactgggtgtggtgtctcaatctataatcccagtgctttgggacctcgaggcaggcagatcacttgaggttaggagttaagaccagcctggccaacacagcaaaaccctgtctctactaaaatacaaaaattagccaccttggtggcaggtgcctataatcccaggcactcaggaggctaaaggaggagaattgctgaacttaggaggtggaggttgcaatgagccgagattgtgccactgcactccagcctgggaacagagtaagactctgtctcaaaaaaaataaataaataaatcatgctgctataaagaccatgcacacgcatgtttattgtggcactattcacaatagcaaagacttggaaccaacccaatgtccaacaaagatagactggattaagaaaatgtggcacatatacaccatggaatacatgcagccataaaaaatgatgagttcatgtcctttgcagggacatggatgaaactggaaccatcattctcagcaaactatcgcaaggacaaaaaaccaaacaccgcatgttctcactctaggtgggaattgaacaatgagaacacatggacacaggaaggggaacatcacaatccgggcctgttgtggggtggggggaggggggagggatagcattaggagatatacctaatgttaatgacgagttaatggatgcagcacaccaacatggcacatgtgtacatatgtaacaaaccgcacattgtgtacatgtaccctaaaacttaaagtgtaataataattaaaaaattaaaataataaataaatacataaataaataaataaaaataagaacatgaaaatgtagcagagagaagcaatctgtgttatgagtataaaaaaatctaataaattcgcattgcctagcacacataaccagtaactcattaagtaatagccagatgaataactcctaatcattatgattcttaaaatacaatgaaaattcatctgcaaaatagaattttaaaaaatacaatgaaaacaaataacctttactcacccaattcaatacaagtgatgccaagtgaccaaatatcaactttcccatctactgtccttcatccatagctaagatcacctctggagccatcctaccaaacataaggtaaaaactcaagttggagattaaaaacaaaatttctccaggaaagtgattcaatgaaatagtgttcttaagggtattctgaaattttatctgatatagatattatttccttacacaaatattttgaaaaacactattcaaaatataatctacttggtgatttacatgacacagtatattttttcaataaagactggctccaccccttactatcagtttgatcttagggaagttacttacctatctgtacatcagtttcttcatctgtaaaatggagataattctcatagcaactttaagagatttgtaaaggatgaatatacataaagtacttaaataattactttggaacatctgttatattgctttatatagttccataaagtatttttcatattgtttaaagtaattaaataagcaggaaatttttttttttttttttttttgagacggagtctggctctgtcgcccaggcggactgcagtggtgcaatctcagctcactgcaagctccgcctcccaggttcatgccatttcctgtctcagactcccgagtagctgggactacaagtagctgggactacaggcgcctgcaccatgcctgactaattttttgtatttttagtagagacgcggtttcaccatgttagccagatggtctcgatctcctgacctcgtgatccacccgcctcggacttccaaagtgctgggatactggcgtgagccaccgcgcctggagtctttttttgttgttgttgttgagagtcttacttgtagcccaggttggggtgcagtggcgccatcttggcttactgcagcctctgcctcctggttcaagcgattctcatgcctcagcctcccgagtagctgggattacaggcataggccacacacctggccatattcttttaaaataattaaacaacatgaaaaatactttatggagcctataaagcaatataatcagctgttccaaagatactaaaacctacaaaaaccctaggttgagtaatggatgttactttacttgtttgtccataatgcatcttcattaggagggcaggggcctatctgtttaatatgctttgaacagaactgtactctattatgatgtgtaagcagttgttagtaaatgttatttggtgatagaaaaaaattcaaagactagctgattttttttagtaacaagtaattttgcagagatctaagtcattctgtaaggcataatgaaattccaacgtgttaggaaaggaaggaaaataatctggaaaagaatagggtgaaaaactctgagccagactgcaagctaggtaacctatcagaactcaacaaagacaagaacttggatttctttcactgaaggtaccatctctgcttgttggctagtcagggaaggtgaaagaagctgccctgtccttactggaggctttgcctcaagagaaaagttcaaaagaaactgcaaatgaaatcgaaaacctgacttggtcagtgaattgataatcctgctcagtttacacacagtgacaccaaccttaactcacaatttaaagtcattgtaaattttatacaaagccagagtgtttctttttatgccagtggctttctatccttctcaaatgaaacctcgttttgaggcatattggtaagacactgtcaaaaaccaagccaaaccagcaccatagttgagttcatgtatgcagattttaaaactatgtatatagcctaattctacataccagtaaggtgtgcccacgaaggagttggcaggagaagcattgaagcagatccaaaatcagctagttttacctgacctggctctgttagaagaatattcctgctttaatatccctataggaaaaaaaaaaaagggttagaaaattacttttcaatttgattatggaataggtcagagcatgcaattaataagacaaaaagtttatttaaacgaacaacaaacaaacaaaacaaaccttgctcagatagccagaaggagatttagtaattactgcagttgtaagggggcccagattcctgggtgtacttgcaggtaggtcatactagttacttaaggtagagctttcttcagagggagggaatacaaatgagaaaaaaggcagacatggcgaacagaaaacctattcagctgctacacttacaaaggcatattcttaaaggctaaatccagtttcaatagtattccctgtgctgagaaaattggtgccaattttaactgctttttctgctttccaaattatgtgacatttttggagcctaaacaaacctgcaatgattccgtattgaccactaccaataaacctcaactacacacataccttttctttcttgcctgtgaccctttctctcgtctttaattgtaactgcaactctaaggcatttgaggtacatgttatatagaaggtgatttttaaaaataactctgtacagtaaaaagaagaccctgaaagatcaaaacaaacaaggataggggttaggaaattacatttctattgtattactacaaagaattgcacgtggttactataaagctaatagaggtattatatagcaaaaagttttaaaaatataattcaaaaaattcattttcattatggtaatttagaatgagaaggtgtggatgtactccttattctttttaaaaaggcatgaggtgtaatgagcactagaaaccatgaattggaagttgatggtcagtgaaaaataaaacagagaagatgaggaaatttatgtcaagctgaaaatgataaggttcaaatgctcaaaataacttttataaaaacttcccttgaaaattcagtttccttcctcatggtgacataggcattggcagacagaactaaaaaaaaatgcattatttatttttcttcacaacagaaaatatattttctctacttatctttagttaggagattgaattgcctttaaaatcaaaacaaaaaaatctgagacacagtatttacttttaaattaaaaaaacattatttataagtattttactcttcaacaaattattttacatactaaagaagataaagcataatacagactaaaacataagttaatgtgcagattaaggtaataatggcacaaaaaactgaactgtagctttaaatagagcaggcaaaataatcacaagcaagttggcagtagtattaacaccttggtaccaaagcatatatttacaaaaagttgtcagatccatagacattatgataattttatttaatcagttttattaacatgattaggttcactctttgtccttaattcccagcaggatttcggtctgctatctttaggaagttctgcttttgtggtaccagtaagtggtcatggctacactggggtgttaaaacagaagcaaaagaggaaccataacccaatagtttcacttcttcctagtaaatgcagttgttttctttcatttgtgagccatctcagattcttcatacctaatatttcactcccctcccctcattcattaatgtaactgtactaaaagttcattactgagagaagaaaagatggtaacatgtttctctagaagttaatggagggagggaggttgcagggaggagagtgtggtgtggtagagaaaatacaaggcagagaaaagtcctagaataggagtcaagaaacttgagttcaatccttaacatattacttaaattctgtgaaactctgggcaagttaagtctttctggccctggtctcttcatatgccaaaatacagtaaagataatatcttcctaagtatctatagaactatagaaatgagaaatattttaaagttataaaatagcatatatttatataagactgcttgttatttgtaataggaaagggacaataactctgctaacagataaatatatgcaagaaggttaattttcttttcttttcttcatgacacagtatctaaagattggtgggcccttttcaaatttccctgcaacatttagcctggagaacagttacctactgaacaaagatgatatattgtggatacgtaggagagaataagagatagaagctaaattctggcaactttatccttatatccagaagcagcaatctatttgcttcccatgaatgcttaggcaacctaaaaattgggcatgcactaattttcaaggttcctggaatagacagtcctgcaactgaaaagaaacatactggtctctaatcttacctatgaatcaatgcatgagaatgtaggtaggctagtccatgcaggctccatgagtaatggcagcgatctccacttcctgaagtggttttttatgaactgagaaggaaaaaaaaaaaagtcagtagatgatcagtttcattcctcattttattattttataagctataccagactgggttacatactttctcacatgacaatttgggaacacattcacctgatcttctatagaagataataagtgatcagacaacaggaaacccaagtatataaacacaatgacccttcaaaacaaaaataaaacaaagaaagcctgatattccttaaatgatgcattttaatttacttatcagttgcaagccaagccacactgattccaattaaccaggcccaaataaccagtcccttccaacatttcaatgtctggagtgttctaggttacattttcctcctctccacaaagccatctttaattaccccttcaaactacaggttttcattatttgtgaaagaactaataagcaatttctattcagagatcaacagtgatttaattttttttttttttttgagcaggggtctcactctgttacccaggctggagtgcagtgtttcaatcaaagctcactgcaccttgaattcctgggctcaagtgatcctcctgtctcagactcctaagtagctggtattaaggtgttagcctctgtgcctggctcaagatattttttttaaagtaaatttttaacacagctctggttatagcagcatctgcagagaggaatggggtcagtcaagatttctgaaagggttaacatcaatataacgtgagactatctacctctctttcacatatacccatgaatatgattttttggctacatgtaccatatcacattagccaaacattttggtagtacctgccctggagggccatgaactaaaacagcaggaagactgctaacatcactcagacactttcagtggcatgaagagaggaagtgtgcatggcttatccacaccaccctaaagctcaagccatcattcattagactgcccaaactacactttagtatggcggtagataacattctgatcaaagtaaaaagaaaggagagtttaattccttctttcttaccttctaataaatcagaggctgagcctaacaatattccatcaccaactataagagattaaaataatattcagaataatgaaagttaattaaaaactgctgaaaccaactaaacaaccaatcaaggaactaagaatactaggtgaataatattctgatctacccgaacttggactgaatttttgtcatctggcactaattgattttttaattttcatcatctcagtttttattatttcttgtttgaaattggcctaaagattattggggactagatatagaaatattcactataaatggtgaagccaagattgccaatttatttataactccttcactactttatttcaaaaaggattcaggtgactatgttgtactataaattgtaactcagaaagtggcaaacaaatacacgagccagtaaaatctattttggggttatacagttaaataaaataaaccagtaagtagtaaattcctttttttcacactttaaaaagtttaaacaagaaacagatattgttttgaactgaatctgaagatgtagcctgctatgtatcatacattaccttgaatccctgagatatatgtgttatttacatttagatcttaaaatatttcagaataatattattataatactattgataggctaggtgcagcggctcacgcctgtaatccagcactttgggaggctgaggcaggtggatcacctgaggccaggagttcaagaccagccagtcaacatggtgaaaccccatctctactaaaaatacaaaaaattagcttggcatggtgcttgcacctgtggtcccagctacttgggaggctaaggacggagaatcgctggaactcgaaggtggaggctatcgatagttattgggtttgcaatctgcggaggctttctaaaagcaaagtgagaaacctctttctttactctttttttttttttttttttgagacggagttcactctgttgcccaggctggagtgcaatggcacgatcttggctcactgcaacctctacctcctggttcaagcacttctcctgcctcagcctcccgagtagctgggattacaggcatgcgccacccacgcggctaattttgtatttttagtagagacggggtttctccatgttggtcaggctggctcaaactcctgacctcaggtgatctgcccgcctcagcctcccaaagtgttgggattacggtgtgagccaccgtgcccggcctctttctgtactcttatcctcgatttcttttttttcttgtatttttagtagggacggggtttcaccatgttggccagcctggtcttgatctcctgcctcgtgatccacccacctaggcctcccaaagtcctgggattacaggcataagccactgacctggcccttcttatcctagatttttaggtgcccaagactactgatttgtagtcaaggcaaaactatcagggttcagcaaccaatctccacacacacatgcaagcattcacactcctcaaattattgttatttaaaagaatagtagatgctcattatgaaatataaatttcctatataaactagacataaccaatatcaacatattagttcctttcattaaaaaaattaatgtgaaatatatttatattatgtaccttgcattactgagataatttagaatatgtgatgtctagagtttaaaatttagaaactattatacttttatagttatatattataaatatcaatatattgaacatattataaatataagtatactgtgtctatattatatagaatgcaattaaattaatataacatacttataatactatttatatattacatatgattatgtcttatattttatattttacagttatatatttatatagtatgtaccttgcatttctggaataatttagaacaagagaggtttagaagtttaaaatttagaaaccatactatagttttctgcttgacattaaaacaaacagattcagaaacattaatcttatttcttattataaaatggaagattctacatggtaaatgttataatgaacactagcctttatgtgccctactttttctttaatcaattttgtgaaagcatttctaaattttattacataattttctaatttttaaaagtaactgaatatgatacataacctccttaaaccaagcatatgaaatgtgaatatagaactttaaaactgaatgaatgaatatgtttctagctgcattaaatgttttaaattacatgtttaaaaactcagcattttgtcacaaatattttttcccctattattctataacacaaaggcacctgagatggtttttgctcctgacactaaacagctctggctgctctgcctttaaatgattagctctgcctttagctcccctgactttttccgtatggttaaattattcttgtgcctgtttgtatgcatgttctaacagctcagttccttagagctctttctgattggtctatcaaaccagttgtagacaaaaccaggtagccatgcttattagcagtctatataatctaagaataaacaggtggccggtgcagtggctcatgcctgtaattccagcactttgggaggcagaggtgggcggatcacctaggtcgggagttcgagaccagcctgaccaacatggagaaaccccgtctctactaaataccaaaattagccgggtgtggtactccggtggctgagacaggagaatcacttgaacccgggggtggaggttgcagtcagccgagatcgcgccattgcactccagcctgggcaacaagagcaaactctgtctcaaaaaaaaaaaaaaagagaaaaacgagcttcaagtaacagtgtgaagattttctgaagacttgaaatacatgagattttagcacttggattttgtaacatttattcgcctgcttgaaatccctttcttgactccttcaagacagctgagattgccagagaactgattctagacaatgagatatgtctttgattaatttcttattttcagaatggaagcaatagcctacataaaagttccttgaacagaaatatgtatgtttagtatactgtttgatagtctattaagaacaaaattccattccctaattagagatcacatacaggaaaggagttggtacatgtaaacaataaatgctagttaaattggagtttaagtaggaatgtgcaatttgaaaaagtaaaagcataacattttcacatcctaaatgtgcctaatgtgccaacctaaaaccagaaataaatcatataaaaatatactaagggccgagcacaatggctcatgcctgtaatcccagcacttgggaggctgaggcaggtggatcacctgaggtcaggagttggagaccagcgtggccaaatggtgaaccctatctctactaaaaatacaaaaaattagctgggtgtggtggcatgtgctgtagtcccagctactcaggaggctgaggttcaagaatcacttgaacccaggaggcagagttgtagtcagctgagatcgcaccactgcactccagcctgggcaacaagagtgaatctgctccaaacaaacaaacaaacaaacaaaatatatatatatatatgagtgtgtgtgtgtcttgtgtgtgtgcatgtgtatatatatttatatatatatatcacaataagatgacagagtgaacaaaagtctcttattttaatcatatggtggcccctgtttggtaaaaatcacatagcattaaaacatcaagaacaattccaaatatggggggaactggagtggaggatgagaaatgaaaagataaaaattctaggatgagaatataaggctgtgccttttacttttacaaacaaatattataaaatgatgtcaacttttcaccatctctttctgagtgtttatagaatggaattttaataggctagatatcatttaatcttacagaatatataccaagtgacacaccaaagtataacaaatgttaaatactgataacaaaagttaaatggaacagaaatgaaattagtaatttacagatcaaatagataaaagaaaaaaaagaaaaagaaaaaaatgtaatagtaaaagatatagaggtccttcgacttacccaagcagtgtgttctttcaagtaacagcctttgtactcatagtattaggatgcttcaattgtcgtaaaaatttaacttccttaagaatatcttgccattctattgaagtcagaaaaggaacattttaatttaatttttgataggaaaatagtatttctatcaagtatacgtatatatcatttatattattgtaaatggacataaagtaaat

SEQ ID NO: 5028 - DNA, 13227 bp, Homo sapiens
gaaaccccagaagggttattgttttgtattatttatatatactatacttcttaaattaatgtaacacataactaaattcaggattgatcccaaccttctagagccagctcctctggcgcagggaggaaacagttgtcacatcaccatgcaggttacattcatcttccactggaatgatagagccctcaggcagtggcctgactgcagacgagcagaggactggctcctggggacagcaggctctgttgcttctcctcattggtcatggcttagcatggttcctccccacaagtcctagtaaacaaagcaactcgcaaaaacccaagtcactacttttaaactctgttggataagggagcttttccacagcttggactgagaacctgtgctctagaagtgctattctgactagatgtatgaagggagtgggtgcaggagacaaaatggctaaaatgaaaatgggagtcactggccccatctgcagctacaactcaagatgtctacagatggggtcagtgtgacatgtgcagggggaggggcagagggacaagacaggcagggagggtgctcctggggacagtatcctccctctggccttcacttcttggccttgccctgggcagccacagcttccatggctttgcgtacctctcttcatcccccagaaactgcatgggcttgataggcttcaagttcttgtcccattcaagacaatgggaataccagtcggcaggttcagctccatgatagcctcttcagagagacccccagatgcttggcaatgccccggaggctgttgccatgggctgcaatcagtacacgtttccctccttgatctggggaactatttcttcattccagaaggtcagagctctggcaatagtgccttcagactctcacaggagggtagcagatcttctgtgaggtctgcatacctgcgatcctactgatgttgctatagaaaggatggttgggctccattggaggtggtgggacatcatagagtgcctccagatcttcacctgggcctcaccatgctttgcagcaacctccgcctccctgttcaagcgattctcctgcctcagcctcctgagtagctgggattacagatgtgcgtcacccgcccggctaattttttttttgtatttttagtagcaacggggtttcatcatgttggtcagctgatcttgacctcctgacctcgtgatctgcctgcctcggcctcccaaagtgctgggatacaggcgtgagccaccgcacccagccgtgaggtgccagatttttatctttgccaaactctaagtgggaaacagtctcttggtgaaattttaattcacatttgcttttcagtgagctcacatcttgtcatatgtttaagacctatttgtcttcttttatttgtgaacttttttttttgagacagggtcttgctttgtcatccaggctggaatacagtggtgcgatcacagctcactcagcctcgacctctgggatagctgggactacaggccaccatgcccagctaactttttgttttttggtacagacagggtctcaccgtattgtccaggctgatctcgaactcctgggcttagcgatccacccactttggcctcccaaagtgctgggatttacttttattttattcttaggacagcatcttgctctattgcccaggctggagggaagtggcacaatcatagctcactgcgcctccaactgctgggctcaagccaccctcccatctcagcctctggagtagctgggatgcaggcatgcaccaccacacctggctaattttctaatttttttatagatggggtctcatttgttgcccaggctagtctcaaactcctagcctcaatcaatcctcctgtctaggcctcccaagtgttaggattataggaatgagcgaccacacccagaacatgattttttatatatgtaatggagaaaaatactcctttaagatgttaattgtaaatgttttcttcagtccatcatttgacataactgtatggatttttaatgtagtaaaaaatgcaattttatgacttttgggtttgtgtcatagttaaaaagactgtttccacactgagatgatacaaaaagtttctcctttagtcctggctgtattttttttttttttttttttgagatggagttttgctcttgttgcccagctggagtgcaatggtgcgatctccactcaccgcaacctccgcctccatctcccgggttcagcaattcttgtgcctcagtctcccaagtagctgggattgctggtgtgtgccaccatgccagctgatttttgtatatttagtagagatagggtttcacgatgttggccaggctggtctgaacacctgacctcaagtgatccacccacctcagcctcccaaagtgctaggattacaggatgagccaccgtgcccagccagcttctggctgtattttcgttttcatttttgtacgtttaatattgaaggttaacatttaatttttatttttatttatttattttttttgagacgttgctcactctgtcgccgaggctggagtgcagtggcgcaatcttggctcactgcaagctctgctcctgggttcacgccattctcctgcctcagcctcccaagtggctgggactacaggcgccgccaccacgcccggctaattcgttttgtatttttagtagagatggggtttcaccgtgtagccaggatggtcttgatctcctgacctcgtgatccacctgcctcagcctcccaaagtgtgggattacaggcatgaaccaccgcgcctggcctattttttattgattttttagagatgagtcttgctttgttgcccaggctagagtgcagcggtgctcactgaggccttgaacccctggctcaagagagcctcccacctcaggctccgaaaatgctgggattacaggtggtgtgagtaccacaccagacctagagtttttattttttaatttttaaaaaaatttttatttattttttgagacggagtctcactcttttgctcaggctggagtgaagtggtgcaatctcggctcatgcaacctccgccccctgggttcaaacaattctcctgcctcagcctcccgagtagctggattacaaacgcctgccacccaccatgcccagctttttttttttttttttttgtatttttgtagagacgaggtttcaccatattggccgggctggtcgtgaactcctgacctcaggtgaccatctaccttggcctcccaaagtgctaggattacaggtgttagccaccacacccagccttttaaatgtttttttcattaggaacaacatattccaaacctataaattgagttcatcttaattttttctaagatacaaattatgaatccaacttactttttttccagattgctccctttcttcctaatgtcttttattaactcatcttttctcaacagattagaaatggtactttttcatctactacattcctgcctgtatttgaatctgtttctaaatttctctgtcttctattatctctatgtgtcagtaaccctctttaattattaccttttaatgatagatttgttgtgtttaatatctggtaggattagtctatactcattatgtcttttattttcagaagtttcctattgtttaatttgccatatgacctttaaatcagcttttctagtccctccttatctcccacagaagactcttaaaatttttcattgtgatacacttagagattaatttaaggagaattgaatctatatgaagcatcttcatatgaagaccaaggtgtcagcccccttgcctctgcttttggtggctagtgactcccaaatttgtacctctattttgagcacaaggtctgttcctcaccctaggaatctcctcttggatagggggatcccaaagataccccataccctgatcccatacgtccctccagcttagtgcattcccccttctctttaatctactcaggtgctcaagccagaccagggtctgaagttgtctttggtctctcctggtgtccaagagccatatctaaccagtgctaagttctatttttttttttttttttgagacggagttttgctcttgtcgcccaggctgagtgcaatggtgtgatcttggctcactgcaacctccatctcctgggttcaagtgattctctacctcagcctccctagtagtggggactacaggagcccaccaccacgtccagctaattttgtattttttagtagagacagggtttcgccatattggccaggctcgtctctcgaactctgaccttatgtgatccgcccacctcagcctcctaaagtgctgggattacaggggtgagcactgcgctcagcctgtggtatatttgtaatcactgatgaaccaatattgacacaatattttaattcaagtccatagtttacattaaggttcactcttagtgttgtacattctgcaggttggataaatgcatgtcatgcatccgtcattacagtatcatacagaatagtttcgctgtgtaaaaatgccctgtgctccatccctctcctacccctctgaatccctggcaactgctgattttttaccattgctagttttgccttttctagaacgtcatatagagttattggaatcataagtatgcagctttttaataccagcctcttttacttagcaatatgcgtttaaggttatgcatgtctttttgtagcttgatggctgatttctttgtatcgctaaattttaaagaaattgcaaactgtcttccaaagtggtggtgatcattttaccctctcttggtgtatgacagctccattcttctatatccttgacaacataacaacacttggtatggttgatcttaacttttagccttctagtaggtgttcttttagaagcagtccttctagtggctttaatttgcatttccctagagtaatgcactcagtgttttttaatgtgcctatttgccatccagagatctttttggataagtgtctgttcaaatgttttgtccattttttgacaggcgcggtggctcaccctgtaatccagcaccttgggaggcagaggcgtgcagatcacttgaggtcaggagtttgagaccagctggctaacatggtgaaaccctgtctctactaaaaatacaaaaattagcctggtgtggtgcgggcgcctgtaatcccagctactggggaggctgaggcaggagaattgcttgaacccagaggtggaggttgcagtgagccaggatcgcgccactgcattccaacctgggtgatggagcggactccatctcaaaaacaaaaacaaacaccagaaaacaaacaaatgttttgtccattttattggatttttattcaattgtaaaagttctttatacaagtcctacatcagatagaattttacaaatattcgtcctagtctatggcttatcttttcatttttaatagtttcgtgcatttgagaaacaaaagcgttttattttgatgaagttcaatttattgatttcttctatcatttcactttttgtgtcatatttaagaaatctggccaggtgccaaagctcacacctgtaatccagcactttgggaggctcaggcaggaggactgcttgagcccaggagttcatgaccagcctagtaacacagcaggaccccatttctacaaaaaatttaaaaattagctgtgtgtcgtggccgtgcctgtagtctcagctactcaggaggctgaggtgagaggatctcttgagcccaggatttaaagttacagtgagctgtgatcagggcactgcactcctgcctggtcaatgaaagcagaccctgcctttagaaaagaaaaaagaaatcttttcaaacccaatattgttaagattgttccatttttaaaaaaaaaagttttatggtttggccatttatatttaggtgtgtaatccatttgagttaaattttgatggtgtatcctaaatagttatcaaatccatctacttctgcctccacctctctagtttaaaccacccttctctgtccctggacacctgcgcagaaagcctagagctggttccacccatcactcaccaggttaggtatttcaggcaagtcacaccctctcagcctcagttttcctcttttgttaactgagggtgaaagtggggttagattagatcagcggccttaacttttgaggggtcgtgggccctagagtcctgggaacgctatgcagtttcctcagaaaatgcttgcatccacaacatgcaagactgcagcagctgctgggctggggctgcgagacagcgaaaagccctgacttgggggggtctcgggagtctctgcagtctccccacccacaccccggcctccgcgccgaatcctggccccccaacttcttgcagcccgtgaagcaggatctagggtcctgggggtggggagagggggctgccgtcctgctcgcagcctctgccgccctctctgggtaaggtgacacatgggcgcttccaggtgggtgggctgagagcctgggggagagacagggatgtccacctctctaagtttccaggttcaagaaaccccagaacgttagagaaagtgggctcccacaattgcccaaccccatcccataggatgcacgcatgcggaaagtcgggcgaacggggcagggacttacccaaggtcacgcagcgagcccggtccccctgcgttccccgggagcgctgagccgggacgcggcggtggggtggggaaggggagtggcgcggccctgcgggtgaggctgccgtttgctgagtgtccggcaggggtctgctcgctgccagcccggcccctctcagagcagctgccgcagcccgaggtaatctcggccccgcgccggggctggctgggaaggcgggagcagctgcggtcgcgcggagcgaggggagctggggaccgggcgggcccggggtgcgggaggcggcgccgccgcacaatcgccccggaatgcccgccagggcgcgcgtgggggcggccgtccggccctgcaactcgagctgctgcccctggttaaaaataccccttgcccgccctccccctcgtttccccgcgtgcccttccgccgcgccccagcccccgcatgtcccccgcgctggcccctccccggggactgctctgccttttactaatttgtcctctcgcggaattgcccccggctgcggagggaggggcggggagacaccgtgagtaagagatagtcagagacctgccggagagataagggagagccgagaggaagcggggtaggagccccaggaggaggaggggagaaggagagagggagggcggagggcggaggggcggcgggaggagggcggggaggaggctcttcctggttgggccctgccctgagctgccaccgggaagccagcctcagggactgcgcgacccccaaacacccctcccccaggtaagaagctgggtagccgagccgggattccttaccctggccactgctcctgggctgaggggctgccccagcacggtcccttctcgggggccctgcgttcctggagcaggggtgggggctggcggagcggcacagcccaggcgcctgtcccgcctggctcaccgctgtccccaggggctgggctagggcccaccagctctgatatcgagctgctgcgggggcctgaggagggggaccccgaccgtctggggttttcagcccacggcaagggccggtgcaccaggagcttggttagtttggggagggggttgcaggcctgtgaacaggacaaagaggccttccctgctgtgtcccacctgcccagttccttgtgctgtctggaggctcgccctgccccacctgacctgctggctcactacagagctgcaagcccctgacaatgggatcgggaaaggagaggtggccggcacgcctgggaactgggaaatccctttcctggattcacgggagcaccgggaggtggctgagaaccctacttctgtgaggggagcagtgaggcagggaaccctaggtttggggatggataagcaggggcaggagagcagagcttgcaggcaggagccaggttctagtcttgggaaggcctgggttctgagcaggcccatctgtccggcaggatgtcgaggagatcatcacgccggtgtactgcactggggtgtcagcccaagtgcagaagcagcggccagggagctgggcctgggccgccatgagaatgccatcaagtacctgggccaggattagagcagctgcgggtgcgatgcctgcagagtgggaccctcttccgtgatgaggccttcccccggtaccccagagcctgggttacaaggacctgggtcccaattcctccaagacctatggatcaagtggaagcgtcccacggtgagaggggccatcctgggtgggactcggctaagccaatcctggatgaggagtagggatgggactccatgtccctggtggggaatggggtctggggggcctggtgccaatttctgggaggggctggccgaggaacaggactctgggtctctcgtagaactgctgtcaaacccccagttcattgtggatggagctacccgcacagacatctgccaggagcactgggtaggcccccagggcgtcgggtcccgggtattttttccacagtagttcccattcccgctccttcaggctctgccccaacccctccctcttgcaagcccaggcaggatcggctatcagcgctggggctggtttgcccagattcctgggtcttttctgcaagctgagggagttaagtggcaccctggccaaggaaccccagattctccctagcacccgcttcccccccggggcaggttggtagagcaggctaatgtgcatccctcctgccccaggggactgctggctttggcggccatcgcctccctcactctcaacgacaccctcctgcaccgagtggttccgcaggccagagcttccagaatggctatgccggcatcttccatttccaggtgagggctcccctgggaggaggggcagcaggcactgggggagatgcggaaggatgacccacaatacctgcagtagggccacaccctgtggggccagccctccctctagcaggtatttgacctctcagtgcctctcgggtctgtcatgtgtgaagtgactgggctgggcaggtatttcggctggcagttttctaggtggttgtatgtatcaggtggaaagtgcttgaaagaacagaaagacttttgtgtttatcctgtgggacaaattccactcctcccggaggtcggtctcagttgccccatctgagaaggagtgttcgctggggaaaacagatcagcacgtgtggccttctccacgtgtcaagcctctatcccccaactcctcctgcgctttggcaaggtctgactgagcccagcagaaaagaaaactcgggattaagtctacgtaaaccagcttttcctgacggtgtgcccagggcccattttcaagtcacaccaatcaattctcaatgagctgcctttgggagggacatgcccagcaacccggatgagactctccagccttggaggccccagccctgcccgaaggactcttgggtgttcctccttctgcctggttagagagccccttaccctactctgtccttgcccgccttgcgcgggggaggtggccctcggaacccagggtgcggaacccacagtgcggatccactttggcccaggccacacccacctgctccagtctgcaggggcgcagtctcgcccccttccctcgctcctcaatccgctcctccctggcctccgattggccagttcagtacccgccacccacactctccgaacctgggctcctagggccgcctccaccccgccccgccccccgttgtcctggccccgaccctcagatggtacctcgagtccttggtcgcttctgaccccagacgccttcggccccgacctgccctgggaaacgtggcctttgtggcatctcagaaacaaagcccgtgattgtgagaacagtcctgcccatcttgtggttgtaggatctggatgccacattttcactgctcatccaagacacaggtgcccctaacccccttgaatagggagggaagagccagggggccatggcctaaagggggctagttccggaaagcccaggccccagagcttttccacctctccgtgcctgagaggaaccctgtttgttcagtgactccctaaaggctttgcctgtgctcttgtttaagtctccgtgaagaaggcaccgctgctcctttttatggatagggaaactgaggctcagaggcgaaacttttccaggatcatgtagctagtatgtctcgagcatacatgtacatatcaagtataacatgtctatatgtggtatgcatgtattagtatacagcaaatatgcaggtatctagtatcattgtacaggcaaaggaaagcatccccttagccctctgaaggttcactgaaaaatcaatcacaaaaggaggttagtaggagaaatggcatacaaattgattagcctgcagcgtggggcgggaaccacagagtgttcaccccagccccacaatgggtacagaagcctatataccatctgaggttacaggaagaatgggggctcgaacatggccaaaaccagtttctggtggtaaataggttatagtggcaagacagactatggaagggggagaaaagggggcctgggtagcaaagcagtcttgttatgtagatgaaacctcacaggtagcagccctcagagggaatagatggtattgtttcgttcagacctttaaagggtgtcaggctctcagtctgacaagggaaggccttaagaaagcctggctacatcaatgcagattttctctacagatgcaaatctcccccacaaaaacagtattacagggctacttctgtttgcagaccctctgaacagctatctcaaaatatgtgaagaagtatatttcagggtgaaatactttgatttccttcaatacctagatacatgtattagtatatctgtagcatacatgtatctagaggtacacatgcatctagtatgtatctagttatgtgatttagtatacatgcatctactatgtatctggtatacctgacctagtatacattagtatgtatctaatttacatgatttagtctatgtgtatctagtatgtatctgggatgtgaatcctgcatctaggaaggtaggggtaaggatggagctcaggtccgggggattccaaacaggtactcaccgtgcccctcccccacagctgtggcaatttggggagtgggtggacgtgtcgtggatgacctgctgcccatcaaggacgggaagctagtgttcgtgcactctgccgaagcaacgagttctggagcgccctgcttgagaaggcctatgccaagtgagtagcggctgaggggcaactccagcttccagctccccctaggggtgggggctcatgactgtcttctcagaggtcctgcttgatgccagagtgctgacctggagctgcccacagggtaaatggcagctacgggccctgtcagggggcagcacctcagagggctttgaggacttcacaggcggggttaccggtggtacgagttgcgcaaggctcccagtgacctctaccagatcatcctcaaggcgctgggcggggctccctgctgggctgctccatagacgtgagtgtgcccggccccgatgctttggaccctggaaccctggtatcctgacctgtcacattttctaaaatccccacccaggctccgtccagaccctgtcctgcacttaagcttcatctctggatgcataccctgcctcatccatccttccaccccccatgcctggtgtcgctcctgtcctcacctacccactcctcccccaaaattcacacctcagctctttcctgtgcttgttttcccgtctaccatgctgtttccctcattctgtcatctcaatccatgccatcctctgtccagttcaccagcctcagatttcatctcctgtctcagttcccacccatccctagcctcaatcccacactcactccattcccacccttcctgctcctctgttcccacactcaactccgctccccagtcctcaacgccagacttgaccccgtatcactgccatccgcagctctaaccccagctcccattcccatttctaactgactctttgtcctcacgtccttctccgtgaggcccactgagggctgtgtggctctggtgggctgtgacggctgtgtgtgtgcacatgcatgttcgcacaggttctggtcagccctggccagtagcgtgtcagcggagtgcctgggctcccctgtcccagtggcagcattggtggggtacccaggtacccctctccaaaagagcagcatctatatgtgggggtgtctataggtgggatcggggtcctgcttgcttctcctagcaactgttgtatgtgcaagtgggaacgtccaagaccctgaggctgggggctcatctgatagggcggggggacctagccactgaccacagtgtgtgcctcttctgcagatctccagcgttctagacatggaggccatcactttcaagaagttggtgaaggccatgcctactctgtgaccggggccaagcaggtactgccctgggtggggccttccctgagggcggttcctgccccctggcctgtccttgcctctctggcacctgaccagggctgtggaggtgctggctcctcctttcccctcctgcagcaccttatctctcttctggggacacccattgagatgcctatcatgtcctgccctgactgactgtagttcatgtgtgcagctgcctgccgggctgtgaattccaagaggacaggcttcatctgggtgctgagcagggcttggagaggagagggtatgggaggcggagtgttaaagtgcgtgcatgggccaggtgcactggctcacactgtaatcccaacactttgggaggctgaggtgggcagatcacctgaggtcaggagttcgaaccagcctggccaacatggtgaaactctgtctctactaaaaatacaaaaactacctggggtggtggcaggtgcctgtaattccagctatttgggaggctgaggcaagagaattgaattcttgaacccaggaggcggaggttgcagtgagctgagatcgcaccactgcactccagcctggtgacagagc

SEQ ID NO: 5029 - DNA, 15118 bp, Homo sapiens
ggcttccaccattgaaagctcatatattttctgcctccaagagcctcctgtgagttatcaaccccctagagttgatggaatatttatggactcaattagtttctctaaagccttgatgcattcaatttttagatcaatccagggaagaatgtactacttgtgtccccattttacagaaaggaaactgagtcccagagactgtacatcgcttcactagccctacagctagtgaaaacggatggctgggaaataaagcagaaactctgatgccagaggccctgagctaaccatcagctccactgcctcccagtgcatcttcagacaaattttattcccatagcctgtgtcaggcagggtctacttattggctggcataagcactggattcagtgccaagtcctcatcccagctctaccattcctcactgtgtagccctgggcaagtcaccttccccctctgagccttcactcctcatctctgaaatggaaataaaaataataatacctattcttaagtggctgggttgggggaacaaggaggcaagccaggtaaagccccagacatttgggaggtgcagcaaatagttatctaatagtagttctcttcttgttccaggttgacagatacactcatggcccaaccacttagacaagtattttcgctcaacccaatggaatcttcctcctcctcctttttcttttaaacctcactctgacgctaaatcaaagctgagtgctggtccctgacaggtcttgccttcagccagcgctgccagcagacgtccaaaatgctttatgggtcccctacctttgcaattagcaccacgcctctgcaggatgcacaggcctgaaggacaggcaatgtcctcctctctcggtggcaccactcctagaactcagagagccattccatgcccttcctggagccgaaggaaatctgggttgttctttggacagctggttaccccattctcagctttggaggagaacactggtctgggggttgaatgggggtgggtggggacagatcatatccttggttttcaacctgaattattattatgttgtcaacgccattgttgttgtcattgttattattttagcagaaggttgctttttaacgaaatcttccagagattctgtcaagatgtagtgggtgccctgaccatgcctgcttgtcctcacccttcccatgcccactcactttactactgcctttgcccaggggctttctctggtcactgagtacactgggcatgtgcaagggattaggccagagatgtaggggagttggaggataatatcccaactccctcacccctgggagagacaactcccaggtgtgctctgtgcagcctccagagttccccagcaggactgtgctccaagtgccggcagcagtcacctgctcattcaccactctgtattggtctcttcttttcctgtctccctggttactcctctactggggcatccgagttcacctcccaaaggaaccacctgccctgaagtctgtatctcaagctctgctactggggagcccaaagacagatgcctaaaaatgaccgtaactactcacatttattttgcagttctctgttagtaggcactatattcagtgcttttcatggattgggtcatttgaagattacacagttctatctagaggaaggtattttttttcagtccctttttacaggcaaggagatgcggatcagagaggtggagtaccttgcccagggtcacacagccaggaagtgtcagagcttcttgttggaggcagaagtgggtacttggactccaatggctgaaccctatcttgaccttccggttgctccagtgctcagctctggaactctgtaaacatttgtcctgacaccaactcactgatacagccagggaagcctcagataccatcagaaataggaatagtgatgtctttgtttacgggggctgctgagagggctaaatgggacacagctggtaatgtgcctgtgtgtgctgcttccacagcctggtagccctgtgctctccctctagggacacactccacagttgccctcgtttatctattcatgtggctgataaagcagcctagaggagggatggagccaggcagcctactcctgggtttgaagcctcattcagccattgatgagcccgtgtgaccttgggcaagtcttatcttcagtttccccatttgcaaaacagagatcgtagtaatagtttagcaatagtatctatcacagagttgatgaggccatttaaggaggcagcccttgcaaggcactcagaacagtgtcctctatcagcaacccaggtcacagctgtaaccaacgtttaaccttgtggagtcctgagctttcagcaataaaacggggacaatggcattcccacattgagtgatgtgatgacaatgagtcatgtgaaggacatgcctggagcatagtagctactcagtaaatgatgagttttaatattgtgctgattaatattaattaactatatgaataatcattaataatatagtaattgatataacaaattagtattagcacttaatatctagtattcctggtgtggcactaacagaaatgtgactgggctctgatcactttccctggggtgaagcacgccgtgaaggatgtgtacacacatttcactttattgttacaacatcgagggttgccagatcaaatataggatgccccattaatttgaatttcagaggaacaaagaaaaatttctgggataactgtgtcccaaatattgcaaagctatacttacactaacaaatgtaattcattgtttatctggcattgacatctaactggcatcctgtgtttctatttgctaaatctggcaacctttacaacaactcatgaaacagccatgaagaaacagatacgaggagaggcaaaggcttacccaaggctcaaagagccagacgcagccaggtctcttaggtctgcgccccctgggttcattcaatttcccgtgttggctgttgtagtaggaagatgtgttctcttggatgacattgctattttggtcaactgcactatctcataggtcatgatgggagtgcagtctgctggtgttttgggggacctgctcccattttcttattcccccatcaagatcccagggagtctgcagcacccgctgctgtctatgtacccaacacatctcactggcccccaggcaggccacctgttctatgcacaatctgggttgggctccctggtccagctgtgcagagaacaggaccaaattcaaggctggctagtgtcaggcaaccctgcggaaacaaacaaatgcaaatggaaaaggaaaaaaaaatccaccaattacttaatgctttctgatgtccaaatatttcgcctcatgtgaaccgagctctgagacctggctgggaaaacggatggggcaggggccagacgttttctacgcaaatccggagggataaaattgcactttcaatccagagaggtggactgggtatctctcgtctgaaaacatcttgaggtgaacaaccaagtcaaggatgggaactgggcccacctggaaatgaaaggcctctcgggctgctcttcccagcccagcctcagcttccatttcctgctgctgctgctccagcctgacttccctcctgttccctacctgtatgggtccagctctcctttcttggcctggaatgttttccctttcacctgtggagcttcttttccctgtgaaggtgtccctgagcatgcccagagacacagacacacactaggcatctggatgcagccccactttacagatgcagagattgaggcccagagagccgaacaggtttctccaagcttcaagccaggtctctgggccccacatccagggccctcttcactgcaaatgttgtctttattggacaacataaatggcaccgaccctgggctctgcttctttcttctggggaacctcaggaaagttgcctaacttctctgagcctcatccagataatgttgtaaaagcatattggtgggaaagaatgagacccaagtttttatgccaaaattcattttctttcttctttctttctttctttctttctttctttctttctttctttctttctttctttctctcctctctctctctctttctttctttctttctttctgtctctctctctctctcctccctcctccctccctccctccctccttccttccttccttcctcattcattcaaagatgcctttgacatctctctatgctgtcattaccctatggcctaaggacatggagtgaatggtgcccacacaagtctccaaggaccttctggtctagggggagaagcaaacatccaaatagacacagacacctcaagacagacttattagtggtagggggagtccaggggtctctaggaacacaaagagccctccccccaccccacccaggcagggaaggccttcctggaacgtcatctgggcttgaacctgaaagatgaataggaatctggtaaaaagggatctgggtaaaaagggatgagtaggatctgggcaaaaagtgagtggaagggaattttaggaataaggaacaacttttacaaaggcaagacagccagggtcattctgggacttgcacagagttcaagatgatttgagaatggggacaaggtgaggaaggaatcgaacaggggagtggggctggtcctgaggggtcttgagtgccaccaagcttcttgggctccacccagaggacccaacaccagcccctccatgtggcttcatgagtttctgctttcctgatctggttgggaccagatgagagtcgccagcctgcaggccccagtccaagatctctggactggaccagctctaaaaactctgcttgttctaatgctctgaggaaaaaggggtggagggaccccactcacactacgtgcaggttgaagattaaacaggataagtgcagagcctgccttgtaaaccacagagctgtgtggaaagaacatcgtaaaggtatggttgggaggaggaatcctctatctccttccaagccacgagagactgtgactcaataatgaaaactgcatctgattttccttgacttgttctgggcagaatcttgccttctctcccctctgactcatgtgcaggctcacaccatccttcttgaatgacaacagccaacacttactagcacccacgctgcccatgtgatgctcccaacgacagccttggaagtatttctaagctgcatttataggtgaggaaatggaggctcagagaagtgaaacaatctccctgggatcacaaagatacaacgagctcagtgaaaattaaaaggcaggtttgtattattccaagatcacctgagcacagtagttcttggttaataaactttgaagatgcacttaaccttggcaattggaggtttaggatggggagggaggtgtttaaaaatgtcgcattcactgcccagatgaaagttaaacataattatctccttcttgaggaggaaagactgctagctccctaagaccccccggattcaaataagcaccttcaaccctccagagcccacttggtctgttcacagctgcctagtgctcttggtataacagcaagatgccagagaccttgctagggatccgggcaaaaagtgagcaaggtagctggttccccagtggtgtgatgcttggctgataggaaactcaaaagaaaccttgtaacacacacacacacacacatacagacacacacacacacacacatacagacacacacacaacacacacatatagacacacacacacacacagacacacacacacacatacagacacacaacacacacatacagacacacacacacacacacatacagacacacacacacacacataatgtagcacattctagagtttataaagccactgcatcactgttcacagtgatgaaggtcatcaagatggttttatcagctgggtgcggtggctcacgcctgtaatcccagcactttgggagccaaggtgggcagatcatgaggtcaggagatcgagaccatcctgggcaacatggtgaaccccatctctactaaaaatacaaaaattagctggatgtggtggtgtgtaactgtagtccagctacttgggaggctgaggcaagagaatggcttgaaccctggaggtggagactgtagtagccgagatcttgccactgcaccactccagcctggcgatagagtgagactctgttaaaaaaaaaaaaaaaaaaaagaagaagaagaagattttcccaacattgtccccatttcccagaaagaaaactgaggcccatccagaagttaaggattccagtggtagaaccagcaccaggtgcacgatccagctctgtcacatcatgagtccctagagagcagaaattttgtgctgacttcggatctcccatgaacagctcctcacctgaattccagaaatcagtggggtgaaccgcacaaggtaggaaccaggtctgtctccttcacctcttaattccagagcctaacatagcacttgcacaaagtagtagcacttgtaaatactcgggggtctgaatagaactgaaagcttagtaataaataaattaaaatacttaataaatagacacatggttaagtgaataaattcattaattacataaaggcattagggtgttcggattaaatgaaaagtatatcaatggataatggatgatgcaggatgggtgaatggatgatggataagtggatagatgggtggatggaaggataggtgataaatgggtgaatgaatggatgatggataagtggatagatgagtggataagtggatggtggatggatggatggatgcatggatggatggatagatagatggatgacaaatggatggggatgaatgggtgaatggatggatgatggatatgtggatagatgggtagatggatgggtggtggatggatagatggatgcatgaaagaatgggtggatgaatggaaagatgggtggatgtgggtgaatggatcagtgatggataaatgtatagatgggtggatagatggagagtggaggatggatgaatagctgagtgcatggatggataaatggattaattcataagtaaaaaattaggatagataatgaatgtataaatagataagcaaataataaatagggaattaattaacattgacttggtggaaagatggataaatgaataagtgagtataattcaagtgtgggtgtggggtaagtgatcagaccggggttgctcagtgatcagactggggctgctcagagagaagaggctgcctcagtcttcagcctcccagtacccgcctcccatctccattaaaatcctggaaatcctggctattttcgtcccttttgcaaaggggagctatttttttttttttttttttttagacacagcttattaaaggagaaagcacacagagcccttcctcccacaggtgcctcttttctgcataaacccaccctctgtcaggcagccaggaataaaactaagcagaaagccacagaagtgtaagaaatcaaatacagaaagacagaaaaagaagttgggcaaattttactgctcctctagagagagccataggagggagatttattaggctgagcctaaaatgagtgatctcctttacccatgcctgagttattagtgagctccatatgccaggctgtggggacacatggataaccacgcagacacagtcactgcccttatggaacttaatgcctagtgggagagacggagaaaaaaatcagcaaacaaaaatatagtatggcatcagaaaaaagaaatagtgagtgtatggtaatctatggctgcataataaatttcccaaaatgtagtggcacaatttctgggggccagaatccatctgcatggctctggcttaggagctcttgtgaagttgcagtccagatggtgccaggactgcagtctcatctgaaggcttaactggggctgaaggctccacttcccaggtgctctcaaacatgcttgccaagttagtgctggctgttggcaggaggcctcagtttctctcatacatacatctccaaaaagttgcttgagcaccctcatgacatggcatctggcttcctcactgtgaatcatccaagaaattgctgggggaggccgaaatttcacttatgacctaatctagaggtcacacaccatccctctccaccacattctattctccaagagcaagtcaaaaagtcagcccacactcaaggagaggggaatgaatcattgccttttgaagggaggagtgtcaaaaatgtaatgacatattttaaaaccaccacaaagagtgccagaaggccagaatgatgtgaaagtagatgttgtcaaagtctttggaaagagcctcccagggagaagatctgcaaggacaaggcctagaggtgggagtgagcttgtcatgtttggaaacaagaaggtgtggatgaggctgagtgtgtaaagaaagcagggatcaaagaagacctggttggagtaaggcaggaggggggtgtggtgaccaaggtatgcagtgtggattctagcccactgcagattttatggagtgcttcctgtgccaatttttcgactccctccagaacttcgtgtgagaggtgctattgttattccactgtaaaaaggagtatgctgaggcccagagaagttaagaaaggtcacacacctacctggaatccggagctcaggtgtgcattcaagcaggccagcctcaaaggcaacagtgctgatgattccagagggaatgctgcaaggaacatacagagacattggggtgaaaatgcttctgaaggaaaataggtggagaaagagagagaaacagaagacgtggaactgagatgccaagagatcaatgacagagaaagacagcaagggagacagaggaggattaagcatcagaaatctttagcaggcagacacaaggaggtggagagaaaaataaagtaagagacagagacctggagacagggaggcatgggatggaggatgtgagccagcatgtgcatggcgtgcgtgagtgcagtgccttgcgctgggtggtgccgggaccccgctaactcagaccatccatcgctcctgtctctcacagcaggagggccgggggagggagagaaagctgacaggagacagtgtgattccagtaatccagatgaaatcacagccagaaggcttgccaggaagtggggtggggtggtcagggagaggagggaacgtccagagaaagtttagcaaatagctttacaattccctcctccataccctcaaatgccgtagatatggggtggggaggatggccctgagtttcgggctgggatcaaggcaccaggaggggagcttgtgcccactgacaaggaggacgtctgcctccatcagtctatgtgggatccaaggaggatcacatattttcgtggttggttttcataccgctttcctgtcctttctctagaacagcccctcaccttttttccttcctttttaatgacattgacgtttttgaaagtctggaccaactgtgttttgaatgtctcacgatctgggtttgtccagtgatgtcctcacatctgattgagggtaagccttttgggcagtcacatcacaaaggtatgtgttgtccattcatctcttcaggggacatatgatgtcacttggtcccattactgaatatgctaagtatttgtcagttggttaaggtgggatccactagatgtttctactgttaaagaacccctttcccttgtaaataatataatctgtgggatagtatttcgggagtatgtaaacacccctttctctctaaactttcaaccagtagttttggaatccattaatgatccttgccagaatcaaatattgagggatgactgcaacacggagttctgaaatttatgtattttttcacactgttaacattcttggtaaagaagggtttcccgctgctctcctcttattttaaatactatgcatgagcaattttaatgctccaattgtcccaggtttagctgggtggacccctgcaagctggcccctgcaccttgtacatgtgcctccttcattctttgagaacttcctaactttctgacacaataaaagttccagactcatcttctattttccttgttcaaatccttaaaccatccatttctccaagtgacctgatccctttcaatggaaaatggtatttaaaagccgtgatatcaaggcaggagatcacttgagcccaggagttccagaccagcctgggcaaaatgacaaaaccccatctccacaagaaaaatacaaaaattagccaggcatggtggcgcatgcttatagtcacagctactcagaggttgaagtgggaggatcacttgagcccaggaggtcaaggctgcagtgggccaagatatgccattgcactccagcctgagtgacagagtgagatactatctcaaaaatgaataaaaaaaataaaagccaaaatacatgttctaggtgtgcttgttactacaaaggtattgctattctagtttctttcagtaaatagaagacacacttgagttcattctgatgcctccaaattaatccaacatcacaaagttctttctcacaattccctcattccatatcatatctctctgattcacggtgagaaccccatttcccccaatatcaacatatttgctcaatggtttcagaattaactgatcctactatcaacaactatctattcattcaagttcaaggtttctttgaagttctgttgtccttagagtgtatttaattgagagcacagttagagaacagtgttcaaaggttattgagctgattcccttcctacatggttacatttgtattattattgattgttgcttaacaactaccccagaacttagtggcttaaagcaacaacatttcttgtctcacagtttctctggaccaggtgtggcttacctggttcctctatttccggagctctcacaggtttcggtcaaggttccgcagggctgggtccttctgggggcttgaccggggaagatctacttccatgctcactacatggctgttgtgggatttgattccttggagactgctggactgtgggcctcagttcctactcagtacattgccagatgtccttcagttccttgccaggtcaccttctctatcaagctagcacatgagaagcaccagggagacagaataccaacaagatagaagtcacacccctttgaacctaattgtcaggagtaacatctcattactttttccatatttcattcattagaagtggtcaccaggtccagccaacgttcaagggaaaaggattaaacaaaatgccggagtatccgaagtgagcatcaatgggggccactttagaagcctgcctagcagagttatcaacgtgatggtagttaggcttgtttgtttctatttgccttcaattttagggtttggtgtctttttcaaatctttgattaaatttcatctttgaatctgtaaaatatttatatgattcaagagtataattatagacaaagaagtcccaagagcagtctcattcttatctccatgctgtcaccccattccaattaccttcttttttaaatttttaaattttaattttaatttatttatttacttattttttgagacggagtctcgctctgtcacccaggctggagtgcagtggcgtgatctcggctactgcaagttccgcctccccagttcatgccatccttctcctgcctcagcctcctgagtactgggactacaggcgcccgccaccatgcccggctaattttttgtatttttagtagatatgagtttcattgtgttagccaggatggtcttgatctcctgaccttgtgatccacccgtctggcctcccaaagtgctggcattacaggcgtgagccaccacaccctgcccccaattactcctatagtcacttttacccataagtgaatcctgccagtttttacttctatgactctatatcatgtatttttagctttccatattttttagataaaagagaacataccataggtactcgctgcactttgctttttcatttaaagcaaaaaaagatttagaaatcattttcattcgtaacgttatcctcaatttttttgtagctgcttagtacttcattatccagaagattcacagtttttcaactggtctcctatgagtaggcatttaggttgtttctaatattttgctactacaaagatataatgaataaccacatgcatttgttgttctgggcttgcagaagtatatttttaggaaattccaaaatgtaggattgaagggctaaaaggtaaacacatatgtgatattgttagaattttcaaataccccatttgcatttccaccagcaatgtatgagataatctgtttccctaattgtcgccatgttccaacagagtatgtggtcaagctttcaccttttgtcagtctaagagtaagaaatactatgtttgggtagctttaatttgcatttctcttgtgcatggagttgaaaccttttcacattttgaggtccatttatacatctctttctgtgaaccatctaatcacgtttttccttatttttaaaaactgagtttttggtctttattcttgatttttaagaactcttatgtattaaggacatcaactacttatctgtgacatagattaaaaatgttttcttccagctctcttttgacttcactttcgatgtttgttacaaaatggttatgcattcagatttatcatcttttttattacattatgttttgaatcataagtagaaaggtttttcccatactttagtatacaggaatctattcatgctttcttctaatgtttatatggttttgttgttatttttactttttacatttagatctttggataatttagatttaaatctggtataagaagaccattctattttataatggagaaaacctctgaggctcagaggattcatgtgacttttttaagttcaatggacagtaacaaaagtatttgtttaatatctactatacaccagacaccaaagtatgcttttaaatttattatctcattaaatacaccttgtatttattatcaataatcttttaatcttaccaaaactctttgaagtaggttgtgctcctggtttacgtataaagtaactgaggcagaagacctgaggtaacatgtccaagtccacagggcagcaaaatgaagaaaggcagagagaaagtagtatgtgctagttgtcatttaaaaaagatttgtagaagctacaataaaacaactacatccaataggacgcaatgtagtcacatagacatagctagctgcaaaggagtctgggaatgtagtccttattctgggtgttcatgcatcccactaaattcatggaggctgttaccatggaagaagggagaacagatttcacatttcagcaggggtagggtaattgaggcctggggtgttttgcagttcccaaaatgatatctttggtcagcaacaaataatgggacctagaaaataagtgtttattgaatttagggctcagatgccaatggctttgaacttaactccacacatggttctgtttatagactgcatggatctaagatgtatatgctcagaacctgcttccaggtttctctcaggttgcccatccctgcctcatccctggagttaaccctctgcctctttctgattgtattttgtaggctcttgttcaaggtaaggaagaatacaaatctgtccatgtctcaagtcaaaagtcaaagaatggcctctcccctaaagaagagagataaacctaatgacctactgaattaagtcaagctgttttttttttttttttttttttttttgacccaactgtagtgaaataattctggctactgatttctaagtacctgctatatgctagtccctgtgatgggcatttacatgcattacttcttatctgcaactcagttttaccagtgaagacaatgggactcagaaatttgagtaaggtgcccatgatttcaaaactacaaagtgctagaggacaaatttgaaccagttctgcctggctactcagaaccctatttccgattctagctagttaggaaactaccctcatgcagttgatgtttaacaggctgaatttttgctatattcatttattttaaaaatattgtaaaaagcacctaccatgtgcctggaaatctgctgaacactggggatacagagaagataagatagagttccatccctaacagggctcatagtctcatgggaggactcaggcaatgacaagtagtcaataaacctacaaattgatttcagattgtagtaagtacaaaacaaatcaaaactgggatagcttgtagctgggggtgggaggcaggtaggtagttattgataatgaagtctgagacctgaagaatgagaagaaagcatccatcagtgggtgtaagagtattccaggcaagggaatggcctgtgcaaagtccttgaggttgaaaagagcttgatatattctaggaactacctaaggttagtaggagtgttgtggaaagcaggtccctggcttgcaattaagcttgaggaaaggaatgaaatagatcaaacagtgccattagagggaaattgaatttaccttttcattgcctgggatagtcgggtgaaattaagagtgcccttttttttactctcagaactattccacttgaatgttaaattatatgatgtgtcagttagctactgctgtgtaacaaagcacccccaattgtagtggtgtaaaatggtaagcatttagctagctcatgaatctgtggctcagctaggtttgtgccaatctgggctgggttccctaatgtgtctgtggccagctgcagggcagcgggctgctctatatctgggattggctggctgttggctgggatgctgggagggactgggtacctgtctctcatcctccagcaggccagcgtgggtttgttcttatggcagcagcaggctctacaagacagagaagtgtgcatggctacttgagtcacaggtttagaactgacacaatgtgtttctgccacat

SEQ ID NO: 5030 - DNA, 52747 bp, Homo sapiens
ctttacagctgatgccggaatgagttaagattttggggatatttggatgtaataaatgttttagcatgtcagaagaacatgaattttggagggctggggtagaatgctgtgaattgaagtttgtgtctgatatggtttggctgcgccccaccgaaatctcaacttgaattatatctccaggattcccacatgttgtgggagggacccggggggaggtaattgaatcatgggggccgtctttcccatcctattctcatgatagtgaataagtctcaagagatctgatgggtttatcggcagtttctgcttttgcttcttcctcatttttctcttgctgacaccatataagaagtgctttcgcctcctaccatgattctgaagcctccccagccatgtggaactgtaagtccagtaaacctctttttcttcccagtcgtgggtgtgtctttattagaagcatgaaaatggactatacagtgtccctccaaaattattatggtgaaaccctaattgcccatgtgatggtagttgagacagggcctttcagaggtgattagatgagagtggaatcctcatgaagggattagtgccttacaagacacatgagacagtgcgacctctctctctctctctctcaattcctctcagcctccaccatatgaggacacagcaagaaacaggctacttaaaaaccagaaagagggacctactaagaactcaacaaggttggcaccctcgtctcggacttccagcctctagaactgtaaaataaatatttaagccactcattgtatgatatttttgttattagcccgaagtaagacaagaagaaatattgctccaacaagatttatgagtatattttacagatctgcattggacaagtagctttccctgcaacgaccatttactgaatctttactatgtgccagaatctgagagtctattagcatctgcaggtaaatcagccaaggttcaaagagatgactaaggccaggcacgaggcccatgcctgtaatcccagcactttgggagacccaggcaggaggatcgcctgagcagggaattcgagactagcctgggcaacgtggtgaagcccttcctctacattaaaaaaaaaaaaaaaaaaattagccaggtgtggtggcataagcctgtagtcccagctactcaggaggcaagatgggaggatcacttgagcccaggaggtcaaggttgcagtgaaccatcattgtgccatgaacaccagcctgggtgacagagcaataccctatctcaaaaaaagaaaagagagagaggatgaccagatttgcccagggacaccgagtgagttagtattcacactgggatttaacccagatctgtatgactccaaagctggggctacctctattccactgggttgcgtctgcatattaaaaattagctgcattttaaatatttgtctaaaataaaccttaacctatcgcagggcggctgccccagcctgagactggctgcttcatctacagttgtttctctacttgtccttgcgagggaagttttatcaccacaaggaccgtttctcctctgtttaatctaacacctgctagttgagattctctaaatgtcccacaataaatatgaaaaacagtctcaggcatatttttccctcttaaataatggagtctaaatgccaagtggccaaaagcaggcctttcagccattggcgctgaacactgtctgaacatgaaatccgtctcttcaaactatgtcaaaattgcttaataaaactcaggggaccccacattaatgaaaggatgcatctgctttgggtttcacattattggagtgatggttcagagccagccacctatgcttgactttcactctttaaaactctgcagttatcacagccctcattatacaaaggttacatggatataaagtttgaaagattcggttcaaactgcgagcggtggccaggaaaaaaaaaaaaaaggagaagacacaaagacaatgatcaagaacaatgaataacattcaagactaagtcggtgcaaaattttcagaatgagaaatgaaaggaaaacttagaggataagtaccaagcacaagttttaggtattctggagacaggaaactagaatattttagcaaccgattatgtctatgagggggatgaataatttattatctgataagaatcttccctgagcctgtgacaagaaaggtcaaataggcaactgaagtagaacagtaatacacgatatactactcgaaaaggaagtctggaacggaaggcgaaggaaagagcttcctggcccatgttcatcaactccctcagattacaagaagcgcagcggatgtactttttaggtccctcatattaggaacccagaagtattcatacaaataaatgcaaataatgtatgagtacatacttgtctaagtccttgaaaaaggccaatcttccggcatcacccacacaccagctgcaatcttggatccaccccgttatctcccagctgtgtgagcctgggaaagtctatgcctctccagcctctaaactgcctcatctgcacaatgggtttcacacataatataaatactttacgttaaatgctaagcacagtacctagtacaaagacaaataggaatatccaaccccccaccgcaggtgacaataataggacattttgcaaacgccccaaagaagaacttcagaactttacttcctttgtgagcatgcgcttattgacttgagcaagtggcttatatagttcttgctggttgcagacttgtttatatcatactttatttattgaaaatccaatactatacagaaaaacatttgtaaagcaaagaaatgaggaacaaatctaatggctgatttaggatgcgctcttcccgtaatctacaactattaataatattaatagcttttatctttttgtttagctacagatcgtcagaacaatggagataagccctgtgacttgtgatgcgttgacgaatgatcatcttttcaagccaagtcaccagcttagacaggcatgaggctcgtattttacccgccccacataccaatgcctccccccaacacatatatcataaaagaaggccaaggccttccatccacaaaggcaatcatgggacttaagcttttagtgtcaaaggagattgcatggaattcccacaaacagtaagctataccagctcataaagtcactgaattttaaggagcctaaaagtaggtggagtttgcagaagtctttaaaagtgcgagcaatttactcctcagcatcctacccatcgttccttatatcatgccatgaaaacacaggatgcggcagtttcccggcagggaaaacaacaacaacacaaaatgaaaacacaggtgtcagtatctatgaaaagcacagcaaaatgttgagcccatggcctaatataatggttggtactgagtgctccctatctgaaaataatgttaaagtcattattccgatgcttatcaatgaggctgcaatcacataatgctgtcagtactatccctatccctcactcccacaaaataaatagacccgatatcaactctattgaaaacctgaatcattacacacttcagcagcaaaccgtgtggttgcaatcaactgagcatgcgctctctccctaaaactgcacattccattacctctggctaataaatcttttatttttacccctcatctctctgcttctcaataatcattttgatataaaccattgcttgctgttcctgatgactaatcccttaacatctttccaaaatatatgcagagtgtatttctttgtaaatacaaaagaaaaagcaatccataaatagttaagatggcttttcaaatgacagttgagtgctaatatgagctacactggaaatactaatcaacaaactaaatacacatccattaaaatgtaggagtccagacatatgagacagaaaaagaattcattgcaactccactgaaatcaggctgataaacatctgccctaggctcctctttcagccagttggagaggttaagaaaagtaagcatcactttgcactttcatcgtgaagaaaatattattattgttgttattaatagcagcagctaacatttaattgagcattaatttattccacaatgggttaagactttatatacacagagttgatgtgtttaatagaccacctgtatctctgaatagagatattatgatgtgcattttacagatgaagaaactgagtttaaagaagttaagaaacttgcccaaggtcataagatgtatctgattctaatctttgcactataatacagcatgttttatagccgtggttatgaactggggacgatttgcacccccagagacatctggcaatgcctggagacattttggttgccacaaacatacttgggtcacccccccatatgagaggggaatagactcaagacacattctgggaagtcaggggtgagtcaaatgtaactctaagggagagccacctgcccctcttcccataccagccctctctgaccaaccttggccatctcaatgtccagcagatgctgatgtttcacaacacttattgggcccctcgcttactaatggccagtccccaacagaagctcttctgcactctctgttaaacagatctagtggggcctggcaggcatgaggaacattggttactcataacaatccctctcctctctctcaaccaccgcccctgcctcccagcctcagcctcatcccttttcctcctgcaaacaacgtaggagatggatgacatcaggtccatctgctcccactctaccctacctccttcttccacaggacagagttttagatcccaagttccggggatctaaaatttagaaactaaaatttagaaatcaatagaaacagaagaaggaggaactcagagccccactggggtctttcaagagctctacatggaatgtcgaggtcttgctgtagctgttcatgaagtatgttttgatacctaataagctttgttctttacatgcaatgcccctcagaggtcctgagatctcaagacagggagtgggattgccagaccccgagaaataaagcaacagaagcccaactccaatagatactgggtaaaggaagaataaaccatggtaatgcaggactcagacacacctatcgttgtcccagacttagagactcacatggattcctaacacatagacactgctgctaaataaaagagagtccactgcatttgaaaacaggaaaacatcttattccaccagccacactggcctcttggaatacacaggaaacgataggtgcttgtcttaagaggtgagggcaccagtgtataattcacataaggatgtaatgaggtagatcacatctgtgtgctgttccacaacataggaacaagccccactgccccttttctttatttaaatatgaatgggggctgatgtgcctccatctcctccctctttttttattatgccaaatggattggccttttaagacagtggtttacttctgtactgtccatgttacctgttttaattgttttcattttttctcttctaactttggagcatctaaaacatctcagaggagggcattttcccatgaaataattagtagtcatagtaattacatataggttcttaaatacttctatatggaatgtgttttcacttaagttgtattttattaaatagctccttcttccaaaagtaatttgagagctctataaaggatatcttgaatataaagagacgacagggtaatcagagtggcttcctctaagaaataggatggatcctgaaattaatcactcaaaccgcactagagagtttgaaagcaaaatctgcaaagtatgaacattgatactaaacatggtaaaagatgggccatggggtggagcagacagacttggagtttggaagccagatggaccaagcaagagcctgactctgagctcaccagctgtgcaattcgggtgagttccttcacccttctgagcatcccttggctcgtctggaaaatgcaaaaaaaaaaaaaagaaaaacaccaggtttttgatcctcctggatgagggatataaagtgcctgacacagcatatgacagggatttgataaagggggctgttagctgtcccattgtggatgtgagaatagcattctgctggctaaaaggcaacatgaatgttctagaacatggcgatcccggaatgtgcagtgaaggcaggaagaggaagatgggcagggaagaacaagttgggatggaggaatgaactcttatctccagaagcagagcaagaatgcccacggagccttggcacatgacagcctccgctgagccaaatggcccaaagattctgaatgagcttttgctgcaacaaaaaactttggatcattttgagagcctcccgtgagtgccaatatgttgcagtaccttcccggccccgacactgatgtgattcatcgtaggtaaatatgaatacgctcaagctggccagcagcttgaaaaattggagtctatcaaattgacctgagaaacacaggaaggtaatatttagtgacataccagatgaaatccttgcgcagagatggaggtgaggaaggacctgaagtgaagtagaccagcaaatatcaagggtcaaggagttggggatgatatagagacgaagcctaacagatgtcaccagagcaagaaggccttacgacttccatcctctctgcagggtatgaatggtgcaatggaatgaaatggtaactacagcttctgggcaaaatttgagtttccataatcatcatcttgggaaaatgaggaacacaatataatggctacacagagaacaagtgaaaagatgagagatgatgaacaggttgagtttcttcagcctaaacctatcaaatctaattttaaacatctggagccacgtgtattagttttgtttctgttcattttcctttttctgtgtccccgacggtgaatgattctgaataattcttagtctgggatactggtctatctcaaggtactacatgttagagtaaaactataaaacagcaaattctatctctgaaattgactcacagggacccaattaaggctcaaaatataagaaagaaagactgaaagtgggtctttgacatcatccatccaacctttttccttaaagatgaggaaacaggctccaatagatccagaggcttacccaaggtctcatcgctaattggggcaggtccaggaatttcgctctaagcatcaaacaataattaaaataggataaatgcagatgaatgtgttctcatattattgtgttctcagaaaagaagaggataaatttaatgatgcaaaaacagttgtgctacacattatcttccaagactggtttaaacatgaatgtcactgtacaatcaggttaccatagttcactagcgtccctggaattttacctttctagtttcaaatattacatcaaataggcagattttacaattttgacacgccctcctgctagtcccaagaacactgcaagccctcagcagtgtctgtctacactgtcagtgggaatggaaattggagcaacaagataagaaatgactcggaggtcgggcacggtggctcatgcctgtaatcccagcactttgggaggcctaggtgtgtaatcatgagatcaggaggtcgagactatcccagccaacatggtgaaactccgtctgtattaaaatacaaaaattagctgggcatggtgacgcgtgcctgtagtcccggctactcgggagctgaggcagaagaattgcttgaacgcaggaggtgaaagttgcagtgagtcgagattgtgcactgcactccagcctggtgacagagtgaaactcagtctcaaaaaaaaaataaaaaagaaaagaaaaaaaagaaaaaagaaaatgactcgggaactgttaccaaaattttaaatgcattgccctttgaatcaaggagtccagtgctaagattctgccccaggcatttactcacaaatcgtaaataaagaatgctcacagcagcatagtttaggcccaatatcagatgatatcgtaaaaagactgatgcaagaaagagagaactgtgaaacaccattgcttggaataacaaatagcaaacaatgcaaacaacctaaatggccaccaaagggaagactggttatagcataagcacagatggaatattatacagcagttaaaacaatgaagtagatctatatgcactaataacagactcctgcagtactaagtttaaaaaaaaaaaaagtacagaacagaatgtgagtgtgtttgtggtatatagataacctttttctggaagaatacataatgtttatcttccaagagaaggacaagaacgactttcacatttcatttttcaccttcccattctgcgtgtagattcaaataaatgcacgtattcccatttgtactcttctcaatacatccctaaaaatcccacctactagagttactactttttaacattagtcagaaagacaataaaatgatcagaaaaagtaagactcgttttcttttttatttaacccaaaataataagctcagtgagctcaagataagggctcattcaaatatactgaatttcaaatatttcatcataaatacactgaaaaagcagaaataaatttccttttctttattttcactacttttcagtccagagtaccaaaaattttcttaagtacctgtagtctatttcttcaaatggcaagaaatctttcacagcattcaaaaatgaagacggctccacagggtgtacccagcccccttcaggctctgctcccaaacacgctgctctatctctcctccccctcctcccagggcctctgcacctgccattcccctaccccatctgacccttcccaccctcttcaggtctttcttcagatcttagttcaatcacttcttccttggggaccccaaggtctcccaactccctggcatcattactgattcctaggaccactcactgctttttcagtttacattaagatctgtgttttttgactaaatttgtcttccacaataggctgaaagcttacaaagacagtggcaacgtctgttgtccttaacagtagaccccagcacccatcacagagtgcacttcatgaatatgtgaatgaatgaaaagtgaatgaatgcagtctggacttcatttgaaatccagcgatgtttcaaaaatcaaacagctcgcatcactctctagctcaaacccttaatgtcttcctcaccgctatctcagagtctaccagatacccatcccccaacagcaccttcctacccactccattcatctccagccacactagcttccctgatgatccttgaaatctcaggcttgtgcctacctctgagccttagcatatgctcttctcactgctaagagaatactttcttgacatctgcatggcttacccctacttcattcaggtctcagatcaaatgtcacaacttggaaggctccctgctgatgactccatcacactcacgctatcattccccccaccttccctgctttacagtcctttatttactgacattatggcaaatattaaacttgattatggtcttttttcctacctagaaggtaagcctatgagggcagggattctgtttcgtttaatactattccttggtcccaagactaatgcaagcccttagtaaatatttatgtagacacgtatcaactcaacttctacatagacagagaaaagtaagaaatcagagatagggttaaagcttccttcttctaatcttaacaaccataagcataacagtctcctagttgcaatcatgggcgttcacccgttttatttttcttaataaatgagttaaaggaagaaacattctcaaacccctgactaaaaagcagatgacactgacaatgaactacaaacaaatgcgtgaataataatggacttgctatgctttcattcataagacaaacaaagtgaagatgactttaaaaataaagacatgattcaagagcaataaactttacacactccactgaaatctccatatggttagcccggcatgtgttttgacaattaaaaaaaacaacaacagtcaagcgcttacccattcttctaaaatgcgtgcactgcttcactcgcccttgccatgttcctgcaggccaagatcacatgtgcaccatggaggcaaaagacttggcggtttcgaaccctatggtttaaaggaaagtcaatgttagaaaactaacatcaacacagtgagtcatgttgaatggcctttaccggagcaccacttaaattacccaagttctcaaccaggggtgattttgatccccaggggacagaagcaaatgtctggagacttttcagtggccacggttgtggggtagagtcctactggcatctagtgggtaaacaccagcattacaaaacatcttaccatgaacagggcagcccctgacaacatagaaccatctggccggactgtcaacactgtgatggtgagaaaacttgtcctagggatgcagtgatttcaaagagaagactgggacatagaagagttcacggcatgtccagccatttaaccatcaataatgacagatcctgtgcccacgataaggactttatgctctactctatggtaagtgtcgccagcactctgcttctaccagtgttacctaggtttcttagccccatttcctactgagaacaattagaaagatggacaaaataacacacgtgcatacacacccatatctgtttgaaggcatcagaaggcactatgactaagaattttgggggccaagatctgcaaaaactgcaaggccagcatttgcagcttttttccttcaaggcatatttcatttccaaacatagtggttggaagcctgagagatgggctgagcttttggcaattttataacaaggaaaaagacataaatttgagctcaggcccaccaggaaagggccacggtaaacacaccaaacctttggtcgggatcctaaagagtttaccctcgctgtaataacaagagacagtccagccttcacaagagtggaaactcagcttcggccatttcaattcctagtttgattaaagtgatcagtccctatctatccaatttccagagcaagagaaaatgttctctggaggaagataccattatctagagtctcaaattaccactagattatttcaaatactcatataaactctcagacattcaaacaaaatagctaagcatacaaaagaaaaaacttcaccaaaagccagaggggaacaaatggaaataaatgcacaggagattgtctaatcaagttattcagaaacagtgattaaaataagtctgactgacaaattcaaggacaaaaaggcaagatggagaattttgccagggaattagaaacaataaaaaaattcaaatgatattctgaaacttaaacaaaataagagtaataagagtaaagaagaattcagcatatatttaacagaatacaagacacagctgacgacaagattgaggaaactacaaaataagttaaaaaaaaatccaaagtgaagcataaaaagaaaaaaataacacaataaaacaaagcacaaagagacatatgaaacacattctcccaggctcttacacatacatgtaatctgagttccaaacaagtgaaatagactaagaaaagcaatatttaaagacagaatggctgataatgttacaaatcaatgacgcatacacggccaaaaaaagaagtatcctgagccataagcagaaatatgttgtgtatgtgttgacatgtatatgtataaatgtgtgtgtctacatgtatgtgtgtgtgttatatatatatgtgcaagctacaagcagaaatgtacgtttgtatatatatatatatattatgtctgtgtgagccgcaaacagaaatatatatgtgagtgtgtatctgtatgtgtgtattgtgtgtagatacacatatatacacatacatgtcaaagcaaggcacatcagagtaaaacgctaaaaactgcagatagttttagaagtagttagagaccagtagctacaagactgatagtatacctctcaggaaaatgatggaagccacagctgaaaaaaaataaaactttcatcttaaattctatacctagtgaaaatatttttgaaaaataaaggcagagaacaaaaattttaagaaacgaaagctgctttttgtttgtcacctacactacacctagtgtcacgtatagacccaactagaggaaacactaaaggatgctcttcaggcaggaggaaaatgaccttagctataaaccagagatgcagaaagtaacaaagagcaacataaagggtaacgacatgttaagatccaatggtaagagtgaaatctgtgagttttaaaatatatagcaaaaattactatatcaataatataacaatgcttaacctaggaggtgagtaatggaagcaaagtatcctaaggttcttgtctctccaggaagtgatataatactgatttatattagattttaataagtcaaagatgcaagtgtaaatctctacaaatttaaaaagctaatggagaagaaaagcagaatgataaaaaggcagaaaggagagaagatgactaggtacagtggcctgtaattctagcaccgtgggcggccaagcatgaggatcacttgtgaccagcttgggcaacatagcaaaactctgtctctacaaaattaaaattaaaaaagaaatagccaggtgtggtggcaggtaccggtagtcccagctactcgaaggctgatgtcgagggattgcctgagtccaagagttcaagggcacagtgagctatgatatgccactgcactccagccagagtgacagagcaaggccctgtctcaatttaaatggaaaaagaaaggaaagagaaagaaagagagagagagagagaaaggaaaaaggaaaagaaaaagagaaagaaaggatagaaataagggaaagaggaatatagaataacttaacaggaagccataataaggtggtatatttaaacccaaactcaaatatatctgtcattacattaaatataatggcctaaagatggcaattaaaagaaaaagtttgtcagactgaagaaaacataaatataatatactgtccttaaaaaagaatgtacattatgttttataccttatttaaacataagcaaaaaaaagtaaaagaatagaaaaggtatactgtataacacgggccaaaagaaatctgattagctgtactaatttcagaaaaaaaagactctaaagcaagaagcattacaagagaaagtctgaatatttcacaatggtaaatttcaatccaccaagaatacatgacaattctaaattttatgtacttaataatagagcctctcatatatgtcaaaaattgacagaattaggacaataatagacaaattcacaattataatggaagattttaacatatccctcttagtaacagataaataagcagacaaacacaaagtatatagaagacttgaacaacttaattgataaactgaaataattgaatatgataaacactgaaagcaacagcaaaatatactcaagtacttcaagaatcttaccaaaactgatgatttgcaggggcaaaagcaagtctcaatgaatttcaaaagattaaattagaaagtatgctctttgaccgcaatggaattaaattacaaatcaataacaagatccagaaaattctcatttctggaaatatatgtataaataaataagacattatggctcaaaaattacaatgaaagttagaaatattttaaactcggtaattacaaacacatatacaaactaaggagtatagctaaagccatggttaaaagaaaatctatagccttaactacatatattaaaagaagaccaggcacagtggctcatggctgtaatcccaggaatcggggtggccgaggcggtggatcgcttgagcccaagagttcgagaccagcctgggcaacatggcaaaattccattctacaaaaaattagttgggcgtggtggtgcacacctgtggtcccagctactcaggaggtgatcatgccacttcactccagcctgggtgacagagtgagatcttgctccaaaaaaaaaaaagaaagaaaaaatgatgatctaagcatccaagatgatctaagcatccattacattagaaaataacccagcaaattaagcctaaagaaagcagaacgatggaaataaaaggagaaagagaaacttataaatctaaaacaaacataaaatacagagaaaaaaagaagctaaaagtcttcaattgaaaaaactaataaaattgataaagggctagcaagaatgacagagagagagacgagacagaaagagagggcttgaacaaccaatatcagggatgaataaaaggacaacattagccacataaaagcataagcaacaaaagcaaaactagacaagtgaggttacgtaaaactaaaagcttctgcacgttaaagaaaacaatcaagacactgaaagggcaagctacaaaatagaaaaaatacttgcaaacctcataactgatagtgttcatatccaaaatatataaggaactctaaaacccaatagcaaaaaaaaaaaaaaaaaaaaaaccacagattttaaaaacaagcaaggaaccaaatagacaattctccaaagaaaacatacaaatagccaagtgtatgaaaagggctcactgtcactaattctcaggaaaatgcaaattgaaaccacagtgagatgtcacctccacctcttaaggtggttctcatcataaaatgaaagataacaagtgtggttcagggtgtgaaacaagagcccccttatgcgtgagaaacttacattccttagtggaatgtaaattggtgaaccattatgaaaaacagtatggaggttcctcaaaaaacgaaacaagaattaaaaattgtggattatgatccagcaatcctacttctggatacatatccaaaggaactcaaatcaggacacaacaatatgtctgccctctcatgttcactgcagcattattcatactagccaagacaggaagcagcctaaatttctactgatgaatgaatggataaaggaaatgtggaagacacaccacaaacacacacacacacaaacacacacaatggaatattattcagccttaggaatgaagaaattctgctatttgcaacaacatggatgaacctgaaggacattatgctaagtgaaatagccagacacagaaggacaaatactacatgatacaatttatatgaggaatctaagacaccaaactcatagaggcaaaaaatagaatggtgtaggcaaagggctgaggggagagagaaaaaggaggtattagccaaagggtatgaagtttcaggtacgccagatggaaaagccctagaatctaccatatagtactgtgctcatattgtatcatgtacttataaaatataatggtttccaggtatatacttatctccaaacttatcaagttctatacatcaaatacgtgaggcttttgtacgtcaatcatacctcaataaagttgtttttaaaaatgaaaaataaagaaaaggactcagatcctatgaaccctaagaagatcttaagatatggtgaacaactttataccaatgaattacaatacaggtaaaaaagacaaattcctagaaaaacactacaaaaaaagttgccacagaagaaatggaaaactgaaaaagttctgtatatttaaaaaatatgaatctatattttaagtcatctcaaaaaaggggaaaggagaggaggggaggggagggagggaggaaaaagaagagcagtctaatccagagcttgaacaccaacccattgctctaaactaaaaaataccatatttgtaatctgtggtggaagaccctatagagtacagtacaataacaaagtagtcaattctatagagaaggcagctatgcaattcagccaaacccatgtcaaatggccataaattattgttacaagataatgttaatatgcacgcaaaatcagcataccgttatcttcctgacatcaccagtgaaagagcctagtaaagttcattcattcatatcactcccacaggcctaatcttcataaaaacagtctatttatacagaatacttctcaaggaaaatcagcatagcacagaggaaaatcaagttggacacacttgtgttgctgccagttctaagcacgtacaagctgtgggatctaggtcacgccttgaacccatgtgaaactcagttatcgtttctgtaaaatggggaataagtgtaaacatatattgagagcctaacataatcatagtaggtggaaaacaaatgttagttgctgctttttgcaaaatccttggtgtcctatgcctcttccccaattcgtacgacctaccaatccagcacagtcactatgactaaaaaattaaaacttgctcctagatgtgctaccaatggaacccgagggctgaatgactttaataccaaccagaattcaaagaaatcaacctcgggctcaccattccgtttgtctgaatatggactctggagcacaatttaacctcattgctgagacacctgaaattatttcttgagattttgccaaatcccatattccaaaatacttacttattactaaagatgacctctgatacttaaatcagatgctgaaataatgcacaaaggatttcaaactgaagtatttaacacctaaatccatttgactccccttgggtgtgtgggtagtaaaaggttttgaagctgtatctccaacctttaaagcaagacgacaataatctcaaatttactcattttacctgtgataccaatgtcaccccttatcaccagtgagcaaaagacacctagatcattggggaaaatgagagaagtaaaatgccaggttttgtagcccagctggctgggggcaggcccgaacaaagtcttgctgactgatctgccccatcaatcaggctaatgagatgccaacagcatatgcaagcaacacagtgaccaaacacaactgcatttgtgagcccgggacttcacaccccagaagatcttggacggaatggtggactgtgggtccctttgaaatttccaggtcaaacaatgatcaggaatatctttcttcacagtttcatcacagggtattaaaagaaaaaaaaagatgtaagagagtggaaatgagagtaaacaattcttagtcattcaatagcagctacgttttaacagattgagaaagcatcgatataacacaaggccaggcaggttccagaacttgattattgactgattgactgactgagacagagtctcactctgtcacccgggctggagtgcagcgtgcaatctgcaacctctgctcactagaacctccaccgcagggattcaagcgattctcggtctcagtctccccagcaactgggattacaggcgcgtgccaccacacccagctaattttgtatttttagtagagacgggatttcaccatgttggccaggctgctctcgaactcctaactcaaatgacccacccacctcgacctcccaaagtgctgggattacaggcgtgagccaccaacccagtacagagctttatttatccagtttctcaggtaagctccttgagccttacacccccaatctccgtatttcgccagactagcacccagtaggattcaataaatatctgctgaagaacaaatggttcttgcagactgctaataggctgcagctctggactattttaaaacaatcaggctgtttcaaactgcaacacgatggccctcttccttcctttataataatgaataaatttaaaatcctgcaaagatactgctcactgtagttttgaatgatgctaccaagaaatctggggggaaaagcatgccgtttttctatcaaattttattttcccaaacaaacctgttaagtctgctatctcacttgacaaaataacccacggcaaaggactttttattaccagaaagggccatctgacaagacagcagcaacaggctacaggctcaagcttccaccctctctcctttaggaattcctgactgtagttacgggtaagccatctgtctctgtgtcttgtgaaattacacttggttcttacatcttcctttatctaagcaatgcattacccgttgctagtctacttttaaagctgcaatagacaactccattttcttaccctttacaattgcctttggaacagaaacaagcgtggctatttcaaaagatgatagtttaacaggaaggacaataacacttttatagtaaccatatctctagagtgtggagttttatataaaaaaagcttaataatgctacctactgttaagtcctggataaaacccaagagaataacatccctcactcttgtaatactgcagctgacgccagtttaattagctaaatgtagtagtgctaagcctattctgcacagtgccaaagttttgcaaaataatgaaggcaatggtttactaaatttaataacctgattcatcttataaaaattaactttatgacaatgtttaaattgaactagcttaactgcatggagatggcaagagtggttcggaagaatatgtaaacctaataataccaagaaaataaagaaagacgttttaaagcatgaacagcatcagtttttctagcacttgttacatcagatgcaatcagaaaaatgacgtgccatggaggcttaatagctcactgtcttgggttttaagctttgaacacaaacattcaattctatgaaatggaaaaggtgcaaagtaatttaaatacctacttatctgatactatcttcatagttttcactctttagaacagaggtcacaaactgatgatcagaggacaagtcaagccacagacctgttttgtgtggcccatactttcttcccttcccttccttccttccctttccttccttccttttctttccttccttcctccctcccttcctccttctctcctttcttttctctttgctccttctttctctctctcccttccaacctctcttccttccttccttcctaattgaattagttgccagcattaaaacattggggagatcacaggtccaaaagctagatgtgtacttctctgaaaaagcttacaccactgggggcccaatcccacgtggtgacaggttagctggaagccactgtcagctagaggtggggtttgggctttctagttggtcatgttgaccatgacatcacccgtgctgctggcattacccgccaggccactgcaggcacttgatgctcagtgccattattcaggaaacatccttgctacagacatgactcaagccttaccacaaaacaccctagtccatatgttcacaactcaatcaccgaatctcaaagaacatctcccactgatctggtgagattttatttaaaccatgtcaaaccctactatgtcaagtgtgagactattaggatgcagctatgccttggaaaaccccgcagtagcacttggctttgcgtggacagagaagcacaaggtagcaggctcagggatctgcaggagcttgaacccatggtgcaagctcccttgcatttacaaatgtcactgagtggcagcagaacctctgggccaagaactttactggaaggagagaaaagacgaaacagacaagcaaaaaggcagggtgcttggcaaaaaaaaaaaaaaaaaaaagatcaaggattggggagcaactccgtgtaaataaatcacatgaatacaacagagatgaactccatgaagcaagcgaaaactgtgggactcctctgtaggcagcgggagcctgtggattaggcagggagtaaacactatgagttattattcatattattattttatccatttacagtactccagtggtcacaatggactcgctcaagatactgtggccttgtgaccagccagaaatgacgaggtgccctcttatcccgagcagctcaaggtataaattagaaaatcatgtaggaagaaaaaaaatctacaaagccagggactgcctaagtctaggtgtccaaggtgccctgtgggcactggtgagcttggcaagttgtttacccagacagggaacacaaagggagaaatggcttggcatggtggtggagagcatcggagcaggcagccgcacaccatgagactcactggtaggtggacaggtggggacagtcgcccacagaatcctcaggcacaaaaaacatgaaggtgggaccctgtcccctcaaatactgacaaagctcccacagaggtaggagctaagaaaaaggcagttctttccccgatgccaggaaggttccttctggtttaagttttttaattttctccatatgtggatgtacttgggcagtgtccccatttactgtaaattatggttttaattatcattttattaagacgcccaaaggagttggggcttacaatacccgtaatttctaatgggtggttatattaatttataattgtgaaacactggggacaaatgttacttgtaactgggcacaattaaaggccacagagatggtgatttccagccccctccagccccgccccacaaacatagcactaaacgatctttaggaaccaatcaacaagttgtagaatcttccagcacacatcctctccctcctggagatctgccattatgcataaagcaagaagataggcctaatgtctttcagcttggttagatttggggacaatgcaaatgtggggactgtttttgtattaacagactactatcttaaggatgagtttctcctatatcctcctaaaagtaggaagaccatactttccaaactaattgattaatgtaaatgaaattacagtgacatgacattgacgatgatcttgaaatccaactccccacaggcatttccagatgaagttctaagatgtacaccacgcttatatgctcaatgcacatctgcaatgactagctaatccatacctctgtttctgtagttactttgattacctgatgatcacacttgcctcccaggccatttcaattacatagttctgagttccaaagagttaggatcgtgcttactaaacacgatccacagctgccaaatcttaagaacttacaaaactacaaggtctctctagagaaaaataagtcatagccagccctgctttttaaaagtatgtgttattacagcaagcaacaaatccctacagagcttcctaaatagccctaataacataaatacattcaaatatattaatcaaaaaaaacataccaactcaagaagtgggaaacgggtcagttcagtggaatatctttaaaatacaccaggcggcatctgcatgctttgggcagtacaaggctgggccgtaatgttttgtaaagctgtacaataaatcccagttgactgcatgagatctctcggaggcaagactgaccccaggctggctactagtgctgccactgtgctgggtgaataagtttcatttaacctgccagtgacagtcctggttaggaatgagtgagaaaaatgcccaaagatacaattaacatggtcctagacaggcacatgcagacagattctacaagggtaactacattagcggcagtcctgtcggtaaagatgtggggcaaccaggcaacttcatagattaatgaggatgggggataggaaatggcttaacatatttgggggcagttgggacatagctatcaaattgaagtggacatgctctttgacccagccacaaccagaaatttatcctacaaatagacttgaaatatgtgggaggaatattcagtacggcattatctacgacagactgcaatcaaccaaatgttttatcaattaggttatataaattatattgcatgaataggacaaaatactgtgttaacctaaaaagaatgaggagaaatgatacggagatgcaaggaaacatttccatgttataatttttttttttttctcttgagacggagtctcgctctgtcgcccaggctggagtgcagtgcgcgatctcggctcacttcaagctccgcctcccgggttcacgccactctcctgcctcagctcccgagtagctgggactacaggcgcccgccaccacacccggctaattttttgtattttagtagagacggggtttcaccgtgttagccaggacggtctccatctcctgacctcgtgactgcccgcctcggcctcccaaagtgctgggattacaggcgtgagccaccgcgcctggccccatgttataatattaagaaaaaaagtcaaagtaccgaacagcgtgcacgtaagacacaaagtggttaaacaggtgccaacattgattactgcaggagagagttaccggttgggggcagaaaacttcttgtgcatttcataatgtcgacgctacttccatttttaacacatgcatactgcctgctataggaagaaactaaaaataacaaaccaaatgctatctaattgataattcagagcctttatgaattttaatacagagcaatcaaggcaagtgagaaaaaaagggaggagctattcctattccaaacaaggtatttcctgagcatcctgatttatacaaaggatgctgtatgtccaggtaaggaggagcacttcagagtgttactcttggctgggtaccacgccatgtgtttatgaaacacattaactaattctaaggtgttctctacagaaaccctataaagtgtcatgtcatttcatgtaagagaaaaaccactgatccccaatgttaaggaactcacaagatcaagggcaaaaaagggggaggaccccaatgggcatggtagcctgacttcaagcaggtgtacccaccatcaggccccccacactaccacaatcaccatgtgactgtggatttgtgatattggatataataagaaatacatactgggtcttcatccaggttcctggcacagagctcctaaatccttgaaattggccaggcatggggtctcatgcctgtaatcctagcacattgggaagctaggcaagaggatcacttaaacccaagggtttgagaccagcctggacaacacagtgagatccatctctaaaaaaaaaaaaaaaattgtggagcacagtgccatgcacctgcagtcccagtactcaagaggctgaggtgggaggatcacttgagcccagaagttggaggctgcagtgagtatgactgcaccactacactccagcctgggtgggtgacagagcgagaccctgtctaaaaaacaaaaacctttgaaattttctgagcaatgtgggtgaggggagagtcttttattattccaattagagagttgtgaataattgataacccccacattccccgccttgggggaagaggagggctggagattgacttaatcaccaatggccaatgatttaagtaatcatgcctagggtacaaaacctctctaagaatcctaaatggagaggcacagtggctcacacctgtaatctcagactttgggaggccgaggcaggaggattgcttgagctgaggagttcaagaccagcctggggacatattgagacctcgtctctaataaacaaaacaaaaaaacttagccaggcatggtgggtgcaactgtagtcccagctactcaggaagctgaggcaggaggatggctttagcctgggggtcctggctgtaatgagccatgattgcataattgcaccactgcactgcagcctgggcacagagcgagaccctatctcaaaacaacaacaacaaaaacctaaacgatagggtttggaggcttccagattgctgagcatgtggtgcctggagaggggcatgccgggagggggtatggagctccacatcccctccgcatgcctggccctatgtaccgcttcatctgtactctttgtaaatcctttatcataaacaggtaaacataagtaaatatttccctgagttttatgagccatttagcaaattatcaagcctgaggagatggtcgtgggaaccccaatttgtagccagtgagtagaagtgcacttgacaatcttgaacttgctactggcatttgaagtaggggatgatcctgaggactgagccctcaaccatggggtctgtgctgactctgggtcgttagtgtcaaaactgattgtaggacaccaagctggggtccagaaaattggagaattacgtaaaaggagggaacatccacacatttgtcatgggaagggctctgtatgagagaagaggaagacacagtgtttcctcctttagggttaagagcacacactagaagcagctccttgaggcaggagaaaccagcctgaatgcccccaccaggctcacaccccacagggtcttgactgtcagtcaaatacaaatcagggatttgccatctattctctgtggatattacgagatataggcttctcatatgtgtacagcttggcatgtgtataatttaagctaaacctactaagcagctgtccggaaagagggagagtggtccaaataccacctgtttcatcaacagcctaccagtgctcccttcggtgtaatccatcaaggcacagaattgaggtctcttcagctactgtattacataaacctacctgctgtaggaatccattcccagacagtgatgcattggcaaatgttcttctcttttacttgatatttatcttggggctcagaattaacactgtcctttgcttttacaaacatttatctgtaagggcgtgagatgggatcaccagtccacaggaataagtttctctctatgttcttccaacatcaaagtttacaattatagacttaatttaaccccacttctatacttccaaccagtaaaaaatgtctttacaccatgaccgttacaagttatactcaattttttttctttaatttccaaaagtttcactgtcaaactttaaagaaccaactgtattaacgtccaacacaaaggccagccaggacagtggctcaaagtataatcccagcactttaggaggccaaggcaggaggatcacttgacttaggaattcgaggttacagtgagctacgatcctgccactgccctccagcctgagtgaggagcagattctgtctcaaaaaaataaaacataaagaccctctaccaataaaaagaaagaacaccgcatgaaattttttgtaatcaaaatatacatggcactttttttttttttttttttttttttttgagacggagtcttgctctgtcgcccaggctggagtgcagtggcgcaatccggctcactgcaagctccgcctcccaggttcacgccattctcctgcctcagcctcccgatagctgggactacaggcgcccgccaccatgcccagctaattttgtgttatttttagtaggacggggtttcaccgtgttagccaggatggtctcgatctcctgacctcgtgatctacccccctggtctcccaaagtgctgggattacaggcgtgagccactctgcccagccaacatggacttttataaacttgtctgagaaccttaggaagaaaaataaaacagcacaaaataaaactaaaaaatttaggcctcctgttaaaaaaaaaaatgtaatggagctttttagaggcagagcctctgtgtcttttaaaggttctcaagaagacacagctcttttgctccctttcttcttatacaagaaagtaacaattgctccataattccaccccctacacgtgctgtctggcccaagtcatgttcttcagagggcaatccttttgttaactaaccaatgacacacacaggcatgcgacacacgtgcacacacacacccatggtctcacttcgtataattctgtactcacactccttctactaagacaaccaaagtgtttctggttgtttagaagtagaaagatttatcctgaagttggccttttttattttgatgaattaatttatagccacttcaagagaagaagggaacccactctgaatttgtaagcacactatattctattactgaacgtgtctcattgttttcacagtggtacaggatttcctttcaccattgaggcctccgttactctttctcgtctgctcgagaagggttctttatgatttagagcaagcaggccagccaccaggattctacacgcacacactatccaaagagaccccgttccttgactttcttaatgaccaaaagggctgtgatccctcttgcaacatagtttccacccctgtcaattaagaaatgcttaggagggaattgtttaaaaaaaaaaattaagaaaaaaaaaaagaccttcattccattgccagctctcagaaatgaaaaagcagccccatcctgcactgtccatgtggacaatgtgctacctttctaattcaagcaccttttttttttaaaaaaaaaaaaaaaaaaaaaaaggaagaaagaaaaagaaaaattcagattaccttggctctcaccattaaaaaagcgaaaagtggtatattactttgcctcttgaaaagctaaagtctttatgctaccaaagtcacgtggaagtgctcaaaacacaatgttgggaaaatcagcagttttttgaggctcacttttaaagtgtccaaattgacttttcattctccatcgtagtaactttttaagacgcaacttttcaaaaatatgacttaaattcaggcttcgaagctcatcaacggccagagttccattaactctgtgctctgtgggctcaccatcaccttgcctaaatcaatgactcctccaactccaaaccggacatttattgtgattggttaggaagtggtatcaaacatacaaaaaagaggcaaaatgtaaaaaactttaaagcaaattgagtttaatagaaaacactaaattaaaggataatccttaccttgtagttgcttttttaaaagtatctctgtaatcaaaaaaaaaagtatctctgataatctatgtaaccagatcactatcttagatatcttaagataattactttttaaagttttgtaaaatctaacagtggcttgtgtgtgtttgttctattgttgttttggtctttaaaaaaataatgctgacaccatctcaattcacactgatacatttaaagcaagccctaagtttctgcttctgtgagttttcttgcagtggtcaaatatcacaacagtcccgcgtggaaggcacgggcaatgctagctttaaaacaaggaagtaaattaactctttacctcacttctttcacatgccaggatgcacggaacaaaacacaccgaatcatgcgagtttgacctttttggttataacatattcagtgattacagcacccaggttcccacaggcatacaattggtaaaagaaattctccatcactttttacgctatctgagaagccatctagcttgaataaaatcagacactcagaagggagagctgggaaggagttcttcatttgatacattttgtttggggataccatgatgagggacgggtgaaatacaccaattttgaaatctaacctctcaggaaacgtgtaatctaaccatcagctgtgatcaggcacctgcttgtgtgaagtgagggatgcacggaggagcttccagctgaggctgattttacatgacttctggagactgacagctataaatttttgtttcattcccctcaccccgctgctgcttctgggccaaaaaggggtcttggtaggatccccaacataggtaatgtgaacattgtgactaggatcaatttaattcaaaaaagagaaacagagagagaaagagctctgagttggtgaaggctttggaaccctacagaggattccaacctgcacggcttgccaggcagagggtcttgtcagcagcgggagccaagcacttgggaggcaagtactccccaaaagatcccaacagagattctccttcctagagaaacagcttatggaagcatgcgcaactagaattgttatctggctcaaagctgcccctaacacacaccattttagcaaacaccattttaaagtccttatcagggcaagggggacttgatttcttcagtgctttgagacagatagggaaaaggagataaaatcaacatgaaaccaaacatttcttggaagagaaacagatcaggaatcttacgattctcacgagctgaactgctccccgccatcccaaactcatacactgaagccctaacccccaacatgactgcatttggagatgggcctttatggtcataattaaggataaatgaggtcataatgggggagccctaatccaatagactggtgtccttatgaaaaggggaaatctggacacagcacacggtgaggagactatgtaacacgaagaagcctactgagatggttaatattgagtgtcaatgtgattggattgaaggtgcaaggtgctgttcctgggtgtgtctgtgcgggtgtttccaaaggaggttaacatttagtcagcggatgaagagagacagacccaccctcaatttgggttggtaccatctaatcagcgccagcgagccaagagaaaagcaggcaggagaagatggaacaacacacttgctgagtctccggcctttatctttctcccatgctggatccttcctgccctggaacatcggactccaagtcttcagcttttggactcttggacttacaccagtggtttgccaggggctcttggggccttgaccacagcctgaaggctacactatcggcttctctatttttgaggtttgaggactcaactggcttccttgtccctcagcttgtgattgtgggagtcaatactccttaataaactcccttcataaatattaatgcacctatcctattctgcccctctagagaaccctaatacactcactacaagccaaggagagaggcctgtaacaggtatctcctcccagtcctcagaaggaaccaccctgccaacaccttgacttcaaccttctggcctacagaactatgagacaataaatttgttgtttaagctacccaatttgtggtgctttgttacagcagctctagcaaactaatagattaacttctgtgaacctcaatttcctcatctgtgaaaggggaataataagatgtactctaagagctgttaggaaaattgaataaaataactgcagagctcttggcaagcagcaaattctattaaaagaattatttcaaattttaattattaaaagaattatctttgccattaaaagtacggcaggccaggcacggtggctcacgcctgtaatcccagcactttggtaggccaaggtggcggatttcttgaggtcaggagtttgagactggcctggccaatacagcaaaaccccactctactaaaaatacaaaaatcagccgggcatggtagcgtgcacctgtaatcccagctatgggaggctgaggcaggagaattgcttgaacctgggaggcagaggttgcagtgagctcagtcgcgccactgtactccagcctgggcgacagagtaaaactccatctccaaaaaaaaaaaaaatatatatatatatatatatatatgtgtgtgtgtgtgtatatatatatatatatatggtgtatatatatatatgtgtatatatatatatatatagtaatggcaaaaaccacgtttgaccaccctaataaaacatcaggctatcaggctatccagcttattaattattgctacattgctaaaaggctctccatgtgagctgtatctcagattctcccatggaaacctaaaaattttactgaagactaaatagaataaatgaatcttaacttctccagctgtgctattcaactataatcattagtgccccagccactaccgaaaactatttaaaacagcttgtaatagacaattcatacaacccagggttttaaaataacgcaataatcagtagtaagactgacaaattgcctagccaaggggcaggtggaaaatttcttacagatgtgaatattctattatcttgactgggtggtggtttatgtgtgtgtacacacttgtcaagaccttcatgtgtatgatttaaatgtagggttttacaacatgtaaattatgcttcaaaaagttgatttttttttaaagtgaaaatgatccccgtgttaagaaaaagaaagctgatccgaaacgtgaagtgagctggttacttaaaattttaatgtttaaagttctgagcttcctggcaaccaaggtaaggaaacgaaatataatctttataatgtcctcctcattaaacaaccaccaccaaaaaaaaaaaaaaaaaaacatacaattcttttagaggaatgagctttgttttcttaataattctgaaaacttattagaggaaccttatataggaaacatgttaacagaataaaccaggggttgccaaactttttctgtaaaggcaagagaataaacataaatacagtaaataaatgcagtaaatatcttgggctttgctgccatagggtctcacagctactcaattctgctgttatgatgtgaaagcagccatgggcgaatgtaaacgatgagcacccgtgttccaataaaacctgatttacaaaagtgggcctcgggggctggatttggtccacgtgccacaatctgacccttcgaatagacaatatccttttaacttcggttctaaactgacctgaagcaaaacaagaactaaagacgtgaagatgaccttgactgtagattttcactgcaagaaaatgtgaataattataacagcaagttcagaacccatgtgatgacaaccacagaaaatttaattttagacaatttacaagtttctatgaaagcagataaaagagaatctcattaaaacaaatataaaacaaattttctaagtattcaatatgcatcaaatcttattacacagtttgtttcacccagaatttcattcagtgtgctatagctacattgcttttcattgcaaagctggatgtttaactataaactacatcctgcctctccttttgtgttaaaactgacaaatgtgttgtttttggattctagaattctggagaaagccaacttaaataattaagatgactaatatgttgattctgtttccagtccaacaaaatgtgaatgtaagacccatgtcatatgatgctatgtgttttagttcaaatttaacatcgaatattgaataaggcgtttctaagtaaattactaagctaaaaatattccttcaacatagcaaaaactctatctttttaaataagtggaaatttgaacatctttgctcagatcagcctaaataagaaattagaaaactgtaaacctccattacagtcaagagcattgattccatctttctgtggaaagtagcaaatattgtatatcaaggaaaacgatttatttatttaaagttattcacccacaatcatgattcacacaaagttcttcctaaatacaacacttgcacaagacgatgcttttctggcatactgaggaatcacatccaaggtgaatgaccactaagataccacaaatataactgtgagaatacaagtgtttttgaacacccagctactagggagtatctagcatttctagttcttttgcacttgataatgtttttacaaatgttttcattgcattaacttaacatttggctgaggagttctgtggctataacacactgctacacagttttgttttaagtaaaccaacattagtttttcttacataataggtgggtaatttctatttccacagaggcagtaactattttgctttttaaaagctgttgaaagtgttgcaaagcctcaactcaattccataaatattgaccatgttgctccataaataagactcttagatgttcacctaattctaataacaaatatttctagttttctaaactaattatatttattgactaccaaaggaagcattttaataattaccttcattgtgaaatcaaatctgttatgagataataaaatgaaggaaatcagttagggagcaccatctttaaaaaaaaaaaaaagaaatttaaaattttataaggaagaatttagaaatccagggtctagaatggaaactacatagaatatatgtattttgcccctagctcttagattcaactatgacagctgtcagtaactgaattttttttccattacctgccagttatttaggaaatttccattgttagcaccgtataattctgaaatcaatactactttattaattacacactgataaatttcatccaaaaaaaaccattacaatgaaaaagtaacaaatatttctatgcatatttttattctaatcctattcaatgaatttttatgaataaacacactctctaaagcaagtatgtgtattaatggaagtatgtctacgtaactgctactaatgattacaattcccataaagtgtagggattcttaattcagtgtctatgaacaatcctttcctcccctacaaaattgtacacaaatgctggctaggaatacatttatttttcccttgtagaatgggccagaggttccactatattctaaaggagtacaggatgcaaaaaaaaaaaaaaaaaaaagaagggggatggtggggttgactccagtggtctagaatctttttatttaagcagagacctgtgaaaacactatttgttcccttaaagataaacagaagtgttgtatacttgacaaaacagacagaggcccagaacctgtcatttgtacaatcataccatctccgcagtggaaatggactttaaccatcacaaacccaaaccctgctcggcatttaaattgcctctgcaacatcctcactaagcagccaccaagctatgttaaacacctttgcaattcgaactcacttgctcaaggcagcttgctctgtgatccaaaacaggcaatccccccttggttcctaatgtctgatgataacgaggcaaaagaacaattactctgaaaatcatgctccataagaaagtaagctgcacgtaggcaggagcactttgttcactctgtaatcaccaggtcctagagcagagctgagttacatactagaccctcaggaaataccatttctttcgaatgacttgttgaatgattgctatgcatctggatagcatcaatgataaaagcaacatctcttttatagcacagttgctattggtctaattgtgtccccccaaaaagattgttgaagtcctaagcccagtacctcagaatgtcaccttacttggaaacagggcctttgagaggtcatcgagttaaactgagggcattaaggtgggctctcacccagtaaaactgtcaccttagaagaagaggagatcagaaaacagagacaaacagtaatagagggaagatgatgtaaaagatacagggagaatggcttgtgcagatggaggcagagactggaattaccctgccaaggccaatgaacatctagggctaccagaagctgaaagaggcaaggaagggtccttccctcacattttaaagggagtatggccctaccaacaccttgatttcagacttctagcctctagacttggaaacaataaatttctgttgtcccaagccacccagtttatggtactttgctacacagccccagaaaactaataccacagcagaaaaggctaaagccccagaattcatcaaactggactcatttatagtcccatcagagagccttttaactttaaggatacactgtggtagatctgcttactcttaagagacctgagcatggtgcagggggtggactgtatcgggcacctctatgcaccccttcaaattctcacagctccattttactcaaaccatttttacgctcaccatcagttttcaaccaacttgacacaaatgcaaccagatggcctcacctggggctacaatatgatccccccatttccatcctagagattctctgactctgcagcatgggatgcctacaagacctgcttggcacttgcacatgtgcaaacccaaaattctgggacatcaaaacttatgggagcccttgtccaacggggtcagaagccggtggataaatgccctttattccgcaggcagacgctatgagatgcatttcctaaagtgcctggagttgagcactagttgcctctagtaatgataactaaaaaacacatttttatattgcctctccttccttcctgaattccccatccctcttttgtaatcacatcccaaattatgcataaatatgtctttttctctggttctgtttttggggaacctaaggtaagacaaagaactcttaaaacattttcaatacagaaaacttactctcacttttatttatttatgtatttagagacagagtctcactctatcgcctgggctggagtgagtggcgcaatctcagctcgctgcaacctccgcctcctgggttcaagcaattctcctgctcagcctcccgagtagctgggattataggcgcctgccagtacgcccaactaattttttgatttttagtagagaaggggtttcaccatgttggccaggctggtcttgaacccttgacctatgattcacctgccttggcctcccaaagtactgggattacaggcatgagccaacagtgcagacctactgtctgctttttatacaatgtgaatcattagaaaagcaacaccctctcgccaccccacccccgacaattctaatcagttaaatgctgcctccttgcagattctgtccattgtcctggttctgtcccttgaagaaagctaggattatctctctcctagatagctactgaggaactaatttacataaatcttttcttctaccaactaaccagccattcactcttcctttagggttgctcctaggacatgacccaatgactttgccatcctttagcctgtctatgcgccaccctaaatgaacgtaatattctagatacggtctgattggtgggactgtgtacctttcttacaacaaaccatgaaggtttcaaccacccagaggtataaacgggttgtctgcatcagagcctcgttgcaaatgttaggagttgcaagaaacagttgcatggggggaacatctttgagcgctgtaggtaatagagatgccaaatgatgattgcaattcagaagccccattttgagcactgctccccactcacatccgtggagtggcgcattaagcacttcgctgggactctcccgcacgtgctgcacgtggttcttgaaagcttgattacggtctacagcagttgggtgattgctatgaaggcaggcagatgcctggtgacttctcagggtgggctgtccccagtgtgttttatgccatgcaggaaggaaaaataaggaatttaaaaaatcttctttcaaaagatatggattctatcggactttcattccttagtaaagttgcattaaacccagagacatttattctttaatttccctattctctcatatggaaggtaggaagaatttgcactcaggccccactgaaagatagtgccagattcactcctgtcctcctttcccttttggttttcacatccttattctgagctaccacatcacgagcacatctttactgctcaactgagttctcctgaagcattataaaaaaaaatcagttacatgttttaaatatccgttggcaagcatcatagcatggctcttaatctggaaataattttaattaaactaaaaagaggtaagtcattgaacacacaataattaaacagagactgtgctgtcagcaaaactgggctggctcttgcaggattatcagagggactggcgtgtcatgtgatgttttgtgactcttctacagtcctaccatcagctctcgtgaagaggatgagcgagccatttagacagttggccaagaacagtctgctagacaactttcctcattgcatcattatagaagctgatcagaagaattctcattttccttgagcgaggttctgtttcctttaacaatggtttgctcacccactctgttcctttcacttcctcttgtgctgtttgtgatatcacacactatggataagatttaggtctaaacggataaggaaaaagacctgctttcatattcaattctattaagagtatggatactgctcaagtacagcacatagagccatagctttgcaaaaacttttattatctgttgacaattttgcacactacctaagagctgtcaaataaaacggccaatttttatcaaactcccaaagtggaacagagaccacaacaactttagaatccctagcagactgtttcaggaatctaaaacccaagcaaaccctttttccctgtttcatatgacgtgcatcttaacccagctcctttttacctacaaagaaaaacggtaattccctctgtggcgcatatatatgaagtcatccataagaagaaaataagaacttggtcctagacacaaaacatacgtaaggaaattcctcatggactaacacaagcggtcagacaccacactagttgctttattccaccttgtcgaattctcacaactctgtgatgctgacgtcatggttcccattttacgatgaggaaactgagactccggggtgaaagatactgtgccaggccccagaattggcaagtggaaagcatagacgtcaaaacagcacgtctagttatcggagggtgaggattcacaatcaaaagaaaactagggggtggacacacatttacgttgcagtcttatttcccaaggcgtcaaattttcatcactctcttattggttgcaggaggaaaaaggcatcttctccatttcagattgtctttctgggtgaagggatctccatttgcgttaacatccctgaccccctctgccactacttattcctgctcaagggagctgatccaacttatgttgtgaatggtatgtgaatggtattccaggattgagaaccgggcacacgcagctctgcctctcctctcctcttacagagagccacaccctgctctcctgcactgtcttgaacatgctgcatgaatggggtctgccctctgcaaggtctggcctgacctagcactgacccattaccctgtctaattgtggtggtcaggattgaaagcccaccagctcacacagctatacatattctccagtatcagcttcatgaatgactaggtgatgttttggtcttccatttgcctaatgggtggtcttactgctcagttaggtagtacttgggaaagggaaactgtgttatttgatagacctcttaaaacccaaacatctctttaaggttaacgaaccaacctgtgcttagatttctctagtgagagtaaaaagctctacgttctcaagtctctgtaatttaagaataacacggctacacatttcatttcagtttgaaactcaaaacagatgtgatatgacagcactttattaggttttgtcctctagatttgaaagagctccaggccccatgatgaagactagatccagtaaggtctaaagagagagacatgactcaatgacaccaaagcagacacccaggaaacagcatcctttgctcaccctgtcctgggaatcaaaaagcctgttatgaatctgaatgtatattacaagcaaatactatttttccagctacacgtcttccttgtttcactgtatcacaataattttttaaaagcataggcatatcatgaaatccttgctttgtagaagattccattataagagtaatcattattgaaccttttagcccagatgaatttcttacatgttacaacaagtttggcacgcattgtgaatttcagccaaggttgataagttcaataacttggctaaccaaccatgtgtactactcattatagaagtaataaatagatcatcaaaatggacatgaaaaagccataagaaaatcggatgccatttccagcctgcctctaaaagcacctcttggactttaatataattttatatatagttatcacaactgcccatcatcaacaccaggcatctataaaacaatcacccacccacatttgcatgctgaataaattccgctacaaaggtgaattctctattctagacgtctcaaaagtcacatagaggtacatgtgctatatgttcaactcccaaaaggactgacaagtaaaaaaggaatcacagatcgacatgtcttttccctgctattatctttttgagtcagttttagtggaaggtgttttttttgttgtttttgttgttgttttgtttttttttcagtaatactgtcagtctaattattctcatagcctatggtaattgaaaaatttagtagaaagaaaagaaagcctgatttagataaatgtcatggaagaaaaaagaaatctaagttcacagaatggaagaatctcctatgattaaatgtgcagaatcagtaaagctggcttctataataatatctaaacaacattaacaaaattgaatttagaaatttgaattgaagataacttcagcaactgtatagttaaaaatccagattctgcctactgacgtcttttatgcttctaaaaggaaactcagactctattagacattcaaggaaactaaacttcccctccttctcagaaagaaatagtccctcacacttggtaaaccacagtagagctcagtgtcaagctctaaactaaacatgaaaaggcacgtggtacatttcaaacactgtcatggaacactttgctaggtaaataacgactcttgagttgttgcacgtgggtgagttttctctcatcccaagacgggaagcctgagggtggaatctgcatcctctatttctcagcaaggcccatcttcatttacaggaatggtgggagtcaggtttgtctgtattgcagggactgcattgtatggcactgggatttttcaatgcgcaggtgacaccctttctatctgtgcattgcttctgcctctcccgttctcactgtgccatcagcaccatttgtcaccagaaatgtccccaggcttagtgaaatgctttcttctggattttctctcttgcgtatctatccacagtgggatcaccaatgacaatattaccaatatcctcacactctcctggttcttttcacatctaacatggagaaaacatagatcaagctttctaaaaccaacgttatactcttaacaacaaggaaaatatctctgccattaattgcaaacaacacctaaatgatcccaagtttggccaaatattgtgagttttcacttgccataagcagctcataacaacagtggagtgctttattttctcaacaagttacaaatgcctgatgtttccaagagcttaaatactataatggcagatattgatgtacagaattaaagtaaaatatgaaactaaacagagaatgaagagataagccagaggtgtgctctgataaaagaagtaatgaaaaggaaaaatttcataccaattgtcataataaaaacaaaggctaaggcaactaagagaagaggggctcaacggttcccaaaaagacttacagaataggtaaattcagcaggcattgcgaagtattcactgcaccccaaaaaaaaaatagtctttgcaaagttgtactattgttgactgcaatgcccaccattaaaaatatggttaaatttctaaagaaagcttctgacagccatccagaaatgctatcaataatagcagatagctttctatcacatggtttaaaataaagccatcctgctagcatgttgactctaaaatccaatgctaatatttgagcactagtaaagtcaacattaacaatgtttgccatttcttattcgtcacaagggttagttccctaaccaacatgagaaacacagacacatagagccgtaccatacaaaagcaattctttaggaaacagtctaggtacattgaagaaaacacatcttagggataatacctgtgcaagaggacaaaatctcttaagaagatggaaggcatctacagtccattgactgtaaatttggaatccttatttctaaatgtgacaactctctaatatttttcttcccttgcaagctcagctcagcttgcaggtatctcccttgcttttgtgagctagcttccccaggattctacttctacgcatacatgcagtctggaggttctagcagtctgatttttctattcattgaaagtcatgagcattgttcctcaggggttaatttgaaattatttcaggccaggcatggtggctcatgtctgtgttccactactttgggaggccgaggcgggtggatcacctgaggtcaggagttccagaccacctggccaacatggtgaaaccccatctctactaaaaatacaaaaatcagctaggcatggggcgtgagcctgtaatcccagcactttgggaggccaaggcgggcagatcacttgaggttggagttcaagaccagcctggccaacatggtgaaaccccgtctctaataaaaatacaaaattagctggacgtggtggcacacacctgttgtcccagctagttgggaagctgaagcaggaaatctcctttacccaggaggtggaccttgcactgagccgagattgagccactgcactcagcctgggtgacagtgcaagactccatctttcaaaaaaagtaaaaataaataaaattttcctttcaggtacttctcagtttaaacataacacgcggataaggttttttaaaaagcatccttgaaaagttaaatatgattaaattcttcaatccaaacaagactagctttataaccagtatacacggcatgtagaagtcactccctcaaggttgatggtgagatcttaatttggctaaccttccattttacataataagaagtaaaaagtttgcttggaatttgtagatccaaatacatccagaaacatgaccgctttccctgcagccttgacagaatgtaaaatcataagctgaatgacgattctctacttcatgttcaaatactgtgctttgcagctgccaccccatttgagagctgggaaatggaatggagcaaataagaattatggcaattataaaacctccctggtataattgtcagattaataaccagcattagcagagctcagctacaccatcagcacgtgagaatgaagagcccagagctacagggctaagtcgtaacaggagcaaagcaaagaagccaactaaagaaacccagccagaactgtaaaagaaatctgcccacaaaataaaatgggtaaggctgcactcagactagctactcatttttagcacataccatctcaagagtacataaactgctcagttataagcatggactggacatcaagatactggatgaccttttaaaaaatcatcacatggcgcatacgtattaacaaaaggcaagcaatggaagcgtgattaatataaattacagaagagcaattaaacttgaccacagatacacacatttgttcaagctgatggtgactctgcactcctccatacctactgtagattttgcttttctttatagttactcagaagatgcataattggaataaaggttaagaaaaatcaaggccgggcgtggtggctcacgcctgtaatcccagcacttgggaggctgaggtgggcagatcacgaggtcaggagatcaagaccatccttgctaacaggtgaaaccccgtctctactaaaaaatacaaaaaaattagccgggcgtggtggcgggcactgtagtcccagctactcgggaggctgaggcaggagaatggcgtgaacccgggaggtgggcttgcagtgagccaagatagcaccactgcactccagcctgggcgacagagtgagactcgtctcaaaaaaaaaaaaaaagaaaaagaaaaagaaaaaagaaaaatcagagactagtagaagacttaatgagagtgtcattcaaaatagcaaaagttctttttaacttataagaacattttgctgttagatgtttcctcaagtatgaaaaaaaaaaaatccttgccaggcgcggtggtcacgcctgtaatcccagcactttgggaggccgacgtaggaggatcacgaggtcaggagtcaacaccgtcctggccaacatggtgaaaccccatctctactaaaaatacaaaaaaaatgctgggcgtggtggcacacacacctgtaatcccagctactcaggaggctgaggcaggagatcgcttgaacctgggacgtggaggttgcagtgagccaagatcgggccattgcactccacctgggcgacagagtgagactccatctcaaaaaagaaaaaaaaaacattttagtatccttacttttaaatacaaatagaaatacagaaataattagaaactacccagagtttcgccagtgtggtggctcacacctgtaatcccagtactttgggaggctgaggcaagtggactgcttagcccacgagttcaagaccagcatgggcaacatagcaagacctcatctctattaaaaatcaaaagaaattagccaggaatggtggtgcatgcctgtagtccaagctactcaggaggctaggtgagaggatcacttggcccaggagggagaggctacagtgagctatgatcacgctgagcactgaagcctgggtaacagagcaagaccctgtctcacaaaagcgaatcaatttaaatttctctagaagcacaaagatcaagctgctggtacagtcacacactgcataacaacacatggtcaacaatggagtgcagatacaacggcggtcccataagattacaacactgtatttttctgtaccacttctgtgtttagatacacaaatacttaccattgtgttatgactgcctatatattcagttcggtaccatgctatacaagtttgcagcctggaagcaacaggctatcccatcagcctctgtgtataatgggttataccacgtaggatttgtaagtacatcctatgagggtgcacaacgatgacactgcctgacacacttctcagatcatatctctgtcattcagtgaagtgactgcattttggtgtgttttgtatcctccacaagggcagggaccctgcctgtttctaactgaagtcttagcacctggtactcagtagtcaataaatgtttgttaattgcacaaaagctgaataagggcgtggcagtggctatgagccagtgagtccaatatcatcacacagttttattgcagactctaaaccaagctcaagcctctacaggaagcaggcaggtaaactgaccatgaaaatagcctgtgcctgcctacagggggtcagcctataggaacagctctgttcaacctagtgcaactatgttccttgatagacataagccatagtcagctgaagctgcagcaacaaatatcatggaccgagtggcttaaatagcagacatttctttaacacagttctggaggcttaagtccaaggtcaaggtggcagcatggtcacgttcttggggagggccctcctactagttaagatggctgccttcccactgtgttctcacattcacatagcttaaggaaagttagctaccttctatcctcttctcatcagggcacaaatcttacttatgagggctccaccctcatgatcaatcacctcccagaggcccctgtattagtctgttttcatgctgctataaggacatatcgagactgggaaatttataaaggaaagaggtttaattgactcacagttccacgtggctgggagacctcaggaaacttacaatcatggcaggagaggaagcaaacacgtccttcttcacatacagcagtaagagaagtgccaagcaaaagggaagaaagccccttataaaaccatcagattcatgagaactcactcattatcgtgagaacagcatgattcaattatctcccaccgggtcctcccacaagacatggggatcatgggaactatagttcaagatgagatttcagtggggaccaaccatgtccaaataccatgaccttaagattagggtttcaacataggaatttttggggagacataaacatttagtctacaatactcattctgatttttcaaaactgtcataaatctaatttaagtaaaatatcctgattttagtatgctggcaagtagtctgacaaaaaaaaaaagaaaaaaatcccactatagaccatttttgtgtggtccatacaaaaaacatctggaggccaatccaggctccaggccaccaaccagttcttacctctgtcctaaaggctgattgggaagcttacccttgagcttatggaaataagcaaacacaaaaatgtccacctcccttaatcactacacatgacaatggactgcacacacaacggcagtcccataagattacaacactgtattttactgaaccatttctatgtttagatacacaaatacttaacactgtgttatgactgcctatatcttaggtttgcagcatagaagcaccgagtttgtggtggtccattatagtagcaacagacattaatacaccttcccaataattaagtaaacatgtaaggaacatacaagtgagatgcaacatgtgtacactcgggtaagtcaatcactaacagcgtcgcgatgatgacacaccaacagactagctttcccaaatccctcccggatcaggccagcaggaaataaaaaagaaacactggcaagtggcgacgctaaccctgggaggaaaaaggtcctcgtgcacacaggctgacagccccaagtcagcttttcaggctgaaaggatggtatcccttgccaaaaatctgactccacacctgactgagatgttccccatatggatctactacagagctctctaccttgtcaaacactaatctagtaactgtacgtgaacttagaattgaaacttcctttgctaatagataaagctgaacagcatttttaatgccatttggaatgtactgatgatctctcagctgatagaagcttccaaacctagctgctgaatttagaagccacagctgccttgctgtatcacacagccacacataaaatcaaaggcagttggaagacattatattgcaagatacaaaaagttttgagagttctccttatagccaatggtggctgacacagcggagtctctccatttgaaagagattgattatttcattcttttgctttgtgtgatcaccaggaaaaagagtttctataatcaagatgtggcagcaattctgttgatgttatataagcaaggagcatcccgtttgtgtctgaatccccaacagtatctaaattcgtgctgcactgtgagcagaagtaaggacctgggcaggtgaaacttaggcaagcaggaagaaatcgcatcacccaagaactcgcaacatttccacctgtgtaatccaacacaactgcaacccacagaagtttctgcctctgcaggttcccttcttattgaatcagtttctgctcctgaatatctggctagagtcagagcctgtcaactttaaatgagatcgcacattaaaattttagtcatcaccacccagtcaattgcatgacatgcaaccctgttaccggcatccggttcacttcgtaaaccctgaagaagatatttgcagaaacctctccccatatccaacaacaacaaaaaaaaaaagtcaagagctcttattttattctttccattaaggaattaattactctcttcctccatcttcttccaaccctaatcttccctttaggagtctttcttcttaactatgatttttccccaaacgccagcaaccttatattcatacactattggacttcttattacagcatttcacacattgttttacttgatctgtacaaaacagtatgtgacagagaattattattctcttgaatttacaaacgaggaaattaaggctcagatggttaagtgacttgcttaagtcacccaagttaaggacaatctgtgtcaaattacagctctcttcctaccatgtcagtagacgccaataaaactgtcctacctttttaagtggcaataaaactatattcaaacctgacactttttggatatgatcaaaaaaataggacagcaaagttgagcatttctacttatacaccaggcagtcctataaactatcacaaacttgggtgaacaagtgtgctaatgcagactctcagtaaaaaagatgttaccatgatgcatggtataacggttttaaagaataatagtttccttctctttttcccccaagtttaatatatccctttttgttccttgactgtaacaaaataacctcgtctcggtggtttttttttttttccgttgattattcttttctggatgaaagtactgacctccagccaaaaaaattctaaaatgttttccttcataccaaagacaagccaggtctaaagcagttatttatacaggtcattttaggacaaattcacagagattatggcagctcttgaggatctgggaaccaggaagctaggaaaataccaaactaatttcactggtaactgatcctcttgcctcccattccagaaatggctacacgttattaaacgcctgcaatgatgatagacaattccctgggcactctggagttcccatctttaacaactttgcaaagtaggagtctgtccatattgcacagaggtggaacaggagttctgagaaggaaagtaacttgctcgggcatacagataggaagtggttatcccaggtttcaaaactaggtcacgtctgcttccagagcagtgttcctctcctacatctttccagatagaaacttgctaccaatgaagcttgccctactgtcagcgaagctattttcagcaatggtacaatttctccacctgaaagcaggctcatcaatgagagaatgcatagaaaagctctgaagcgctgttactgtcattaatagaagatctagggaaatttgcataaccaaagtaatcaaatcttgcctactgtgtcatcttgggactccacaccattgcaaagccagacaagtttaagttttttggggtattccctccttaaatgcgggaccaaagcaacagtgcctttgatttgagttgcagctggcataatagacaagatgtgtgctaaaagattttagtgaagcaaactgaggagttaggccaatttctttctctgtgaatttctcttgatcacaggattgaacaggtacttaaagtaatagacactttataaattaacttctagggacattttgaaaattaaattatagcacatgaggcaagcaatcaattagtaatcgatcatatccaatagtcatgcatataagatgaaagggcaattcgttaaaaaacaaatggcccacataagaaaagcctatcaatcttgctaatcatcagagataggcaaatttaagtgatatttttaaaaattctaattctcaagtttggcaaggatgctgggcaaaggagcattcaaattgtacaatcttccagggcagtttgacaaaacaaatcaagatattaaggttggggagcaaacacttcattcagcaattccacttccacaaaataaaactatagaagagtcacggatgggtcaaacatttaattacaaaatgtgcttctccattccacagctattaaaaagctggaaacccccgaatgtaccacactgggagaagagctggaaccacataatggaatactatgcagccattaagatgtggagtatttaacaacacagaaagataatcacaatttaaatagaaaaatcagaaagaagggaaaacatgcttacaatcatacatgctaaatattaatagtatacttctaatggtaagaattggggtttttttaaatcttttattcttatttttatttttcttcgctttcaaattttccataaggaatacatgttaatcacaataacctttaaaataattacttatattaatgagaaggcacatcaagctaatctagcctaacacctggcatatacaggcgcttgatgatgctacttcccattcccccagacttattccttaatgtttgttttacaatcataataccaagtggttttggtaaagaaagcttcagcttttaaaaaaaatttgatttggtagagatgggtcttgctatgttgcccaggctgctctcgaacccctgagctcaagcaatcctcctgcctagcctcccaaagggctgggtttacaggcgtgaaccaccatgcccactcctaagcttcagttctgaatccaggatccaatgcagtctggaaatgacatctgccttggccctccccgcagtgccactcccagcacttgaccgggcacagagcgaggcttcacgggtttaaataaattggtgattccaaactcaggattaacaaaatgaatgagctgcttagaaagagctcattcaggatgtgctgttattcctcccaacaggatggtggcatgtacagtggaaggggccccaggcacgactcaattaccctttgatctatcctgcaggcacccgccgcccaagacctgtatgatctaagcacgttacctcacctcccttctctttcctttcgacattatcacaagacagctgtaacacggtgctgagaattaaatatgacaagtacggaatcttcataaattttaaacggctataatgtaatacaacatgataatcaataaatacgaatctgtaacaattaagtacattgtagggtaagggtaaaaatgaaaaacattgtattagctttaacttcagtttctgtgcaactacgaagaaatttgattctgattttgttcctctttatatgaaataaacttcatacaaaaggctagctccgttcatctggctagttatcctccacctaggtagaaatagtagagacactgaataggtttcctccccgcccccatctctctgtctcagatctcctcttagagtctagtgaagaaccttgtcttgctttcagagagcaccatatgactatggcttctaacatgaaggctccaaaatcacaaaaagtaaaaccatcaagcacagcctggtgagcaaataactcaaagacttaaacaattagatttaaaccttgtcacacaatgcaacccttcctatgtaccccattcagttggcttgtgtagactgagaccagctcttcatgaaatgtaccgttatttatgaagccaaaggagatcacaaatttaggcaagaaactaaaagcgagctattggaacctgctttttgatcctctactggtgccttaatttaagacatctttccaagaaggcctcctagtgaccccaacctattttggagaaggctgaggattcatatctactcatgtataggctacaaaagtccaagaagtctgtgtcataccaaacaggcaacggtcaagggggtttcaactgtcagcatcttatttttatgaagtctataataattcccagaatcgccatctagttttaacaatttattagataacaacgaacacactcgtatatgaacaaccaaaatatctttactctggtgaaatagctttgaatgttacaagtatattcacaatgtttttcaggctcttgcattttcaaaagagaaaaagtgctgaaaaaaaaattatataaataaaagtatataatatagcatattcgtttttgtcccatttaaaaatttgaaaataagcagttttgtaaagccaaagtgtattcctttctgggccaatttctatttgacagctgaaatatgcgattaatgggctgcctcaaaccataattacacaccaaaacaaaaattaccctccctaagattgtacatggagaacactggctatctgcttcaattaagtagctggtttaatatgatccctcttacttaagaaacatatactgtactgagccaaaaggacacgttttcttctacagcaagaatgtatcattaataaacaatttaattacaaaaattatgtaacactgggtaaggcttgtagcagggggcaagggacactatattcttagaaaaaacatagggttgcgggtgcagtagctcacgcctgtaatcgcagcattttgggaggcgaaacgggtggatcatgaggtcaggagttcaagaccagcctggccaagatggtgaaacccatctctactaaaaatacaaaaattagccagacgtgttggcaggtgcctggactcccagtactcgagaggctgaggcagaagaattgcttcaacctgggaggcgaaggttgcagtgagcaagaatgcgccactgcactccagcctgggcaacagaggaagacttcatctcaaaaaaaaaaaaaaaaaaacaaaaaaaaaaaaaacaaaacaaaaaacaaagaaaaaaacatagggtaccaaggcgttcaaaatgaaccttaaacagaggtattaatacttaaatattacaatttcacttaggaaaaaaaaatcatattattgctaggccagcacactcaaaagcaataatgtcagaaaacacatgcccttgtgtgatttggcagaacaggctgctccctgaacacaatgggccttttattaagtggatcccttcatccctggcattttatacaaacaaaacaaaagagagagaaaagaaacaaacacgacactagtaacagtcttcagtttgaacttcatcacagagaattgaagacctaaaagatatgttagaaaagtaaaagacattatttaaccaaaatgaaagcaaatggactgagaggaacagaactatattgcaatgctgcctcttttgtttaattatatcaagggcaacagagccctctagtggaaaaaaataaaaatatataaagatggttctgcttttaattaaaggaaatatgtacaacacccccgggcatggtggctagtgtctgtaatcctagcatttgggaggccaaggtgggcggatcacttgagttcaggagttcaagaccagcttggccacatggtgaatccctgtctctacgaaaaatacaaaaattagccggacatagtggctcacgctgtaatcccagctattcaggaggctgaggcaggagaatcacttcaacccgggaggcggggttgcagtgagctgagatcacgccactgcactacagcctgggtgacagagcaaggcacgtctcaaaaaaaaaaaaagaaaaaaaatgtaaaataacatcttccattacaatttttatgtgccactctatgatgtaaaagcaaaagatcaaattattttaattgggttttaagtaaacaatttccaagttttcaagctttacgtaatgctacaaaacctcaagtagaacaaaaatcattattaatttttttaattatgggtttgacccactttgtcattaaacaatagtttgtatactctcatttgttatgctgacaccataaaaaagtaattaaaatctaaacctacatgcagcatgaaattcaactgatggcctcatgtgacaaaaaagtttcagttgagatctaatcaggtcacactgacagtagcccccccttatcctcgggagatgcgttccaagacccacagtgatcctgaaaactggatagtaccaaaccctatgtattctatgctttcacctatacatacatactaggataaattttaatttataaattaggcacagtaagagatcaacaataataataaaaagaactataacaatgtactgtataaaagttatgtaaatgtggtctctcacactctctcttctcaaaattagtattttcagatgcctgttgacctcaggtaactgaaacctcaaaaagtaaacacgggccaggcacagcggttcacacctgtaatcccagcatttggggaggttgaggaagcagattgcctaatgtcaggagttcaagacctgtatggacaacatggcaaaaccttgctctactaaaaacataaaattagtagggagtggtggtgtgcacctgtaatcccagctaccaggaggctgagacatgagaatcaccaggccctgggagacaaaggttgcagtgagctgaatcacgccactgtactccagcctgggcaacagagtaatactctgactcaaaaaaaaaaaactgaaacaccacggataaggggggactactgtatacatgattacaaatttattttaaaatatatataacatacacacacccctattataagcattttacatgagattaccaaattatagatgatgctcattagaatgttttaaattggtctcttcctttagatatttacttctcaatactttgatcacgtgatttccatgtacactcaatgtccaataatatctcagtgtaaaatgttaagtcataaggtactaattctcaatttttatataatgtcatttaaggactttgtctacactgtcaagaatctccatagtttcttagaacaaagtaacttcaaaataattttacttcaatacctgggtataatttagcataagataatagtaggcacaaatgtttttaatttaaatggagttccaatgcccaaaaggttatttcgattatttcagaatattttcctttccttaagagcaccaggtttttaaaaagataaatgccaagatcccactagtttaagtctggtcaacatcagaaaggaaactaatcaggcatttcaagatcccaagtgcaatgatctcatatgagttgttttacccatgaaaatgactaaatgtaagttagctatggccccagatttatgggacctttggaataactagaaaaaaaaaaaccatcaatgacatgctttaggctcaaaggcaaaat

SEQ ID NO: 5031 - DNA, 75779 bp, Homo sapiens
tcagcgaatttgtcacacaaggcagctggagtaacaatgtttttaattaatggaaaattttttttaagtacttggaaaccagaaatttgcagcggtgtcaatgagaatataaaccatcagaagtcctcaggctaagcacagtggctcacgcctctaatcccagcactttgggaggctgggtcctgccctcgagtggactacttaaggtcaggagttcgaaaccagcctggccaacaggtgaaaccctgtctgtataaaaaatatgaaaattatctggcatgttggcatgcgcctaaatcccagctacttgggagactgaggcaggagaatctcttgaacccaggaggctgaggtgcagcaagccaagatcccatcgctgtactctagcctaggagacagagtgagactctgtcaaaaaaaaaaaaaaaaagaagtcctcagtatggcaagaagctcctcccctcagcagccttgaccacagacttactccttatctacctctaggttgctgggaaaataaaataattgataaaatcctagtggctagcccacaatgaatgcagaataaatgttgctattgtttataatagatcagtgaggtaattacagattctccttgaccattaattctcaaaggcctttcattgacttttacttgctattttgtttctgtatatgtgtaaaggtaataagacagttatgctataattgcaccattaatacattccaactaaacttccctcaaattaatactaattattgatgttacatataatttcaaagggattagagtgatgtttgctttgcaataccattgggagggaaaatcagtgtttaagtataaatggaggaagataatataaagtgaagatcaaataatgacttaagcatttactaaatcatgttgtgtgctgcttcttaacaataaaaatatcgcttacactgcaaacagaaggaagatccctctagcctggtgcaccaagtaagggtggaaaagtcagtcttatactctcagcggagcatcatgctcataaaaatttttgtaataatattaaattttttattaatattttttgagatgggattttactctgtggcccaggttggagtgtggtggtgtatcatagtttgttgcagcctcaacctcagaggctcaagcaaccctcccacctcagcctccaaatatctggaactacaggtgcacaccaccacatctggctgaatttttaaattttttttcagatagggtctcacatttttctgcaggctggtcctgaactcctagcctcaagtgatcccctgtctcagcctcccaaagcactgagattataggcgggaaccaccatgctcagccttaatactaaagtgtccaataatgtgagtttgccctgaaacataggacacatcaatcatctttattttaaatggtttaagcaagatagctcacagaagttgggggtgcttgactgcttcaaattggcaacatgatttattattttcaaaaattataggtgttattatcctttctagtggaaaatgacccacaaatctccagttgtacagaaatcagtatttcccaaactttccaagcagagagtcacctgcttaaagatacacattcctagaccactccagggaatcaggatttctaaagcagctctagtaatcggacaagtttgggtaactctttccagcactggttcttagcactaccacttgctagaatctgctgggaagcatgaaaaacagcagcaacaacaatgataacagtgtccaggccccatctccaaccaatttaatcagtatgcatctcctaagttggcctggcctggatgtgttttctaaagccactcagatcatgctaatatgcagccaggcctgagaaacacaactgctttgcctcggtactcagtgtcattggaactagcaggactggcctcttctggggctggttagaagtgcaggatctcaggcctggccccaggccctgagatgacgatctgcttttttttttttctgagatggagtctcactctttcacccaggctggagtgcagtggcgctactgggctcactgtaacctctgcctcccaggttcaagcaattctctgcctcagcctcccggtagctgggattacaggtgcctgccaccacgcccggctaatttttttgtatttttagtaagagaggttttcaccatcttggctaggctggtcttgaactcctgacctcatgatccaccgcctcagcctcccaaagttctgggattacaggcgtgagccacctgtacccggccgaacaattctttaagagatctgtgtgcacactaaagattcaagtatgcatatcaagggaacaaaacctttccaccaagaggatggatttttgctcccctctcccctctacctttgccagcactccatcaaaagcagcttaaaaccttgactgaggtctttttctttatacacttagccattgaagccaactgaagagtgatagggtgaggcccacctatctgttccaaaatcatttaggaagcatgttaaacagcatacactgctcttacccaatcaaatgtctccgcaaaatttaattgcagtttgtttcatgtccagcaatcaaagacattaaggaccactaatatttacatccatgattcatttagacagttttctttaattgatgatgaagacactacaattctaagtaccagaagaatcaggaaaaaaaaaattgaaaataagcataacactataaagaaaacttggaaaaggaaacacttctaaataaaaaatatatacctggcctggcacccattacatatatacataaacatgttataaacatatatacagtaaatgttttggtagcaatacagaccatgcattggttttgtgtacacagatgaagtagcaccggggcagcaccaccatcttaagatgataaaccaactgcacatacattaaatgaaaatacatatatgtttaatttggcccaccctgtagccaaaggtgtaaggaaagtactttgcaagaaaaaattgttttgggaactacattcttaagccatggtgaagttctaaaaagaaaaagaaaaaaaaaaccctacaaatgtctatgcaaatatgacaagttttcctgtttactgaatttgtcctatcctatggcatactcgttaacagcataacaaagagagatttaaatgccaagtgaatggcagaagtctaaaacaccagatcttttggttatacgtcacaaatggcaagtcatacacaaactagaaaagaaagctaactctccacctagtcatgtgttttctagtcatgttagctaattataagctctttattcataattaattcctgagtagggttaagcacctccaatatcattccacctcctccctgcccctaatgtgatgcttgtttacaagtagtgggagacacacaacaggctacatattctctacccatacttaggagcagacttacagaactacggaaggaccacaaagatcttctgtggcgctgcctcagaaaggcccatggccccagtgtttatcctcggtgttctactcactatgaagctgtttttgttctcataactgagctcacagtctagaggtcttttagtcttggcaaggtcatatttcctcacatcctagaagagcatgcttcttcctctcaagtttctcacaagcctatacatctatatatattatatatatatatacacacacacacatatgtgtatctatatatgtgtgtatatatatcttatatgtgtatatatatctatatatgtgtgtatatatctatatatttgtatatattcattatatatacacacacacatcccacacacacgtcacatatatatacacacacacaaagaccacacatgtcacatatatatacacacacacatatatatacacacacacaaacacacacaacacacacacacacatatacagcattacctccaactaacattcatcattcatggcatccaggaacattaactcccctgtcaagtcattgcaaagaagaaatttcatattggcttccaccattcttcttcccattcctaccaaaagggtcacatctctccccgccaaggtcttaattccagtgtctggattcagggcctccttgtgtgatggactaacctacagagtgctctgcaaagcagcatgagaccaaatatggggtcattgtcaccagcagttggaagactgcacatggatctatttgtcatggctctcgttgtcagtggatggtgaaaccctttcccccctttttttaacacctgcagtaaataaatataaagtttccgactttgtggtatattgtattcaagatgcagattgaataaaacagggcttcagtattgtaaaatactgtttcttaccatacagaaaaatgtttcttaatacttcaaatgtctcaaatttaaatgatagctagaagacaaaagccagggaagaaaggttaaaaatctctacttctggctagatgacttttagtagatccatttttgcatcactggattagtcaagagtccttgacctttgaaagtcagcaagaaatagccacaaatgaacatcagtactgatttctcattattgactcaggtggttgatcattaatggattctcttacttctagctggttctagggccattcttttgcccagaatgaagatatcatcaaagtcataaacatatttgttcttttcgcaaaagaggattttaaaactctgcttaagtctctaaggaaaacgctgtgagaggttggtgtcatcaagaaaaacccactaacttctaggttaaccagagccactagaagcctcaataatgaaagcccttggctggcctacaaatgctttgaaatggaaaaagccaactctcctcaatgggaactgaacacaaggactcagcagctgacgttgctcaaggaaacccttcgtgtcgccagagtatgaacttttggtttgagtaccagcaacttccagtttaaatcggtagtttgatgccaccatcaaaaccagctcaggcaccactagaagcagctaaataagaatttctacctttatgcttttcgactcaaaaagtcagagaaatagaaaccaaagatagatttttccagtctgttcatttctgctctcattcaaaacatgttgataattccaatgtagaggtatctcggtaacacatattcaaagtgtaggttccttgagaaataataaccgctttacaggaaaatggttgggagtgactttgttcattgatttctctttaactatttcatcctcaaaggaaaagagcagggcagcttgctctcttcttccactagcaagagtatgaatagaatgcttgaaaatatgaaaagttagtttgactaagaaagtctttttttacaagagtaaaaacaactttcatatcagattttcaaaatgggtagtgctctctactaataggaaatgagtaattctgcaagttccttgaaaacaatggattcttatgactctagaccctatttatctagaaattgatgagcatgcaaatgattaaaatctgcaataacggacactgcacaacagtcgtgaggtacatgccacctggctgaatgaacagtaacacgggcctcagcagtgtgaggggtccatttatctccgctcccttttgagtagagctggggtccccaaacagttcatcaggagcagcagccactacaatgccctccaaccctggcccctaccttgtagtccccactcccaccagggagcttaggcgttcagagaaataaaatgttgctcctcccaatagtagggatgcgaatcctgatagagagatagaggctcccacagactcagagggagcctgatatttgcattaatcatttaacctttaggaagtttcctggtaaaaagatttaaaaatctgtcggcaatatcttaaatgcattcattgccatttgtttttcacgtggaaaaaattccaagacgtgtatactttcaaacaagaaaagaattaacattttcactgctggctaggtgtttcagtagcaggtcattagcttttctgtgctctctgtacgctgtgttttgttaactaatcactaataggccagcaccaccaaggcaaatgggccaattacattcagttaaataatgtaacactggaagttctcaaaaatatgagataaggtaagagtcttagggaaggtgacacatagccctggtcataatgaaaacacttactggaattttaatttctggttagcaacagctcacttgccttaccatctttccaagacaatgcaggaaatgaaatatatcataatgtgtgcacagaaaaaaatggtgggaaagagcaggaaacttacagaagtggtggggggaggggacagaagaaaagatcaacagtattagtttattatgaatagaaagacatttccagaatttacaaacgcccacattgttcattcaaagagagcttttgaattgaaggaatcacccatctccttctgtttacaatacatgcaatgaagactttaatttcctcttcttataattttgcttccattcaattaccaattttaagctacatttgaaaacacccagccaaatatatccttcttcagtttaattaacatggcctattgcttacaggaaaaaatacaaaattaagattaattcttataaggaactcagctcaacatcagtttatatgacaagagatagtatcagcaaatataactatacaattgagaaccatctatgcactatgattcttatattatgttttctgaattacaatcttaaaacaaggatcataccctttctactcttttaagccttgttttaagcatttgctccactctttacaacagaacattgttacctccatcccacatccaaaaaaaagatgtgctgtaagaaaagttacattttcatttaaaaattacacatataaatcaaaacctatgttaaatatttaatactctctccacccaacggaacagttttgtatgaaataatttacaatgatgctttgtcgtacacagtttcagcagcaatgaaatgtatcttgaaaatgcattgagagtaaacccattctctcatgacacggtggtggcacatcagctcactgtggccagctaagtccttaaggttgaagatgaagtttatgcagatcattattctggtgtcacagtgcatttttttttttcgcttggcacaatatagaacgtgcgttcagtcaatgaaatcctgaggattggataaagtaaacaaactgaaatggatgcatcgaccatctactgatgaggaagatatgaggtcctagttgtgaatcatgaaatatttagagttgggtacccatgagttagaagaggatttgctgaggtcatttaggtcttcattctgaaaaaaaaaggaaagaattcagcaccacaggtatctcaaactgcacaatcactactttagaactttcttttacaaggggcagcgtcacataaactgaagttacaggcacaaatagtactgtcacctaaatatgatcaacaaactgtatttagctttttatttatttcaaaatgcaagagtcaaagaaatcactaaccaaaagtcatcaatgtggaatctgtaaacaaatcaacatgatctgatgtttcagaggtttagcaaaggaaaaatagaaaattctttggtgttgtgattgaagcaaaacatacatcattagttgctatgtaaaatgaccatccgacatgagcgggttgtagtcgtctgtgttgtatctccttctggttgaaagtcagctgcagattttagaatttgaagttgagagcttcacatgacaaaatcggaaatcaatttttcatgtgcacaaacattgtttgacagagaattttagatgcaaagggagacccaagcaaaacggacctactgaatcattaaataaaaaacaaaaagattcagatttacgtctaatagaaataagttatttaggcagaagcacagatttcttctttgcaagtcaagaaggtaaattttaaagggtcactatccgtgattcccctcagagtgaagactcttttttttttactttttttattattatactttaagttttagggtaacatgcacattgtgcaggttagttacatacgtatacatgtgccatgctggtgtgctgcaccactaactcgtcatctagcattaggtatatctcccagtgttatccctcccccctcccccaccccacaacagtccccagagtgtgatgttccccttcctgcatccatgtgatctcattttcaattcccacctatgagtgagaatatgcgctgtttggttttttgttcttgtgatagttactgagaatgatgatttccaatttcatccatgtccctacaaaggacatgaactcatcatttttatggctgcatagtattccatggtgtatatgtgccacattttcttaatccagtcttcattgttggacatttgggttggttccttttcaacctcataaagcatcttttactcaagattacactacctagtcttttacaggtccttgtttttcatgcattcaaaacttatctataatatcagtatctacagagtgcatcaaagggtatttagcagagagtagatcagaaatactgttgaatgagtacgtggttgcactaaatactaggaagtgtagaaagctggattctgttgaagccctgccttctagtaattctagaaaggaaggcaagttctgttcataaatacatggctgtgaagtagacatcagtacatgccaagatacatgcatgggggcaatagctctagacactggaggatggaaagaatcctcccagctaggggtgtaaggggagcatctcactgacacactggcttggttttggaagaaaaagaataatgtggggatgtggaaactgggattgtgtctagttgctttggtgttgcagtcccagaagataacacaaggcttgccacgtggtagtacttataaataggagttaaataaatgaaaaggaaaaggacacttcccattgagaacatatgacaggtcctacagggtgagatggtagccgtgagcaggctcaagtagaggatgtggcttcactgaccccaagatatctaaggagggatagaaggaattaagtctacaaatgtagcttgaggtgatggtgaagaaccttgaatgacaagctaagaggactttatctaattatagagacaacaggacatgctacattgacataaggtcaagatgtagcagtaataatgcatatcacctacaagatagtgacagcttccaaaatacacgcaacgtaagtgtggaccgatatattagggtggacaaaagcaattgcggtttttgccataaaataaattgcaaaaaccacaattacttttggacaacctcatatctttttccctctgtctcctcttgaagggaatgatcatggctggcatcatcatcattcattacgcaatggttttctgataagtcaaagtttaccaaatgatgactctattttaggagatttctatttatttttaaatattaactctgcctctaaaagacaggtaaacaactgtatttttaactcactaataaagacttggcatgacgatcacaatataaaaacaaaaaaaaaggaagcattccaagtttgcccctttaattgccagagaaacaggatttactctggtgtctacaattgtggtgtccacaaatgaaaagaaagcccgtcccttcacaagccattgtatgctaggaaactccccacaacaagctccagatctcttatttactgtcaagattctccgaatgcatataggaatgttcccaccagaatttctagattagcgcttaacagagcttcacgctctgggcctctaattaggcaggaaggccacactttattaaaggacttgtgacaaacaacaaactgccgaacataaaatgggggagaaagcaaagggcatatggtatgtttttcattcatatctggctcttctccagaaggggtgggtaaacagcttagtacaggaacacactgtacctcttttatcatcacacgtaccaacctgcacggatgcataaggacagagacccagggcctgtgaggagagggaaaaacaggtggcttcactgggtgctgaaatctgttgctttgggcacttggaaatgatctctgtcattatccacaagtatgttcaaagagcagggaataaaaggcgtatcaagtgcatcgacaccttccttccaaagtcttacttagcacactacttttcaaaccccttatcttaagtcctgatcaacacttgtctcaaaagggaaagtctgaagttcacactgtttgtctttgtacagggtgtgtgtatctgtgtaggcacataaagtttagctaccaaaaatgacatggacatccttcagtgagaactgtccttcacaacagccaacttgggggctgctacttattccagtcatgcagccattgtttgcagcatttttggaatgcctgctcagccttggcatattcttttgaatagtctctatagcagccagtcttagccctctgaggacacgtttatctttggagacagccaaaaagctttgagagccaaatatggtgaataatgggactgattagctgggtaattgttcccagcgaggtattatctaaagccaaagagttccgaaaccgaagtccaaaatcagagttgtgtacaacacttgctctgatgagtttgttggaaaggaagtctctcactttagagacagacctcaacatatgcttaatgagactaaagttcatctgtctgtattccctagctccacatactcacaatcaagcaaggctgaacttgaataaagcaactcactcaaaaaggcaaacatttgcgtaacttaatatattttttaaaaaagaaaaaagcaatgccctactagggtcttgcagtcagtcattcaatgcaataagcataaatacaatgataaagactgaataagcaggggaaaagcccgcataggcgtacatatgtttaatacactttatatatacccacttcaattgactgaagggagacaattgacagaccagaggtagcaaatattgctacaagttttacaaatgcaaaaattcatttgtaacaggcagaaactggaaacaaaaaggcaaacatttccttaagagaagacactgcaaatatcaagtggtgatattcctacaatgcattcttctggttacatcattggggaataacttctgaaggcagaaatacaatgcacctgtcacgaatttagtagcaggaaattacattttgacaaaatttcatcaccacatcagtatctactattccttctgcgtgtatattcttgtaagataaaacccacctaatcctgttgccagtaatgaaaatgtaatttttaaagcattatcaaataagtcaacacttgagcaatgctacttgacactatggattattgcattattgcatctagtaggaatttacatcttctgggttctacccactaaactatgcctataatagctgaaaaacaaataaagactttgcttccttttacattgtctagcttactgatcgtttttactgggaaagcagctggaaacagcacaagagtataagtgtgtggaaagatctgtacactcagcaatgcattcttggtcagaacaattgacaaatgttttctcctgtatttatatgttttgaaacttcttgccaatatgttaaatcaagggcaatatagtataaaaatctagttggggcattgctagtcgtttctacttttactagggaaataagagtaaatattttaagttgcttggccactgtcacatactaaattgttagaaagtaactcttcctatccaactgtgctttaaaaaaatgaccgtagtgatgaccttttttcaatagaggtcatttttgaaatcttatattgtagatggaactagaaaattaatataaattaatttcctccactaaagaaatgaatcaaaacagcatatttctctttcagttaacataaacagctgtgtgcttttaaaaaaaaaagtatcttgaatataatacagaaaatgtataaaatacaggaagatgtaagaaggaataaacatgacttatattccccatcaccagaaaaaccactactcagctgtggtgtaatttcacaatctacttaaaggatttgaacttttaaaatgctgcatttaatgtccctcaaaaagtctaagtaggaaaggaaaatactgttttaatcatacttagatctttcccatcttaaaaatccatgatgagaaaaatttttgaaatgttacccaactttttaaagcatcctgtattccatccctttgccatcatcccaacgcattgtataatatggggagagtaggaattgaaagtaggaaaatcttctggctccctggctttagtttccaaaagcctcagtatttaaagaagggcacaggcaaaatatttggaagagccaggagaacagaaggattcctctcaggttgaaaagattcccttcatgagagcagaggggtcagtgggtagctctgtactttgcaagatctgacaatgatgcctgtaacctctctctattctgtcttcccacgtctgttgatttcctattcacacaattacattaaactgcatacccctccctcctaccacaattcttcagttacctactgctgatacacttaatttacagtaccactaactggaagcaaatcatgtcttctagaagcttattaataaagcaccttacaacacacacattcagcatacctgaatctggcaaatgacccagtaaacacacacacacacacacacacacacacacacacacacacacacataacaccacacacatattatcatcagtctcaaatacctttatagttctggtaatagatgggtgttttcattaaaattcatacctccataaaatcccactataaaatctcagatgaataaaaatgccactgacctatggatagactgtgaaacgcttattaaaggaagttcccagcttaaagcctggttctagcatttgagttagtagcacagaaggaggaagctgcattctcctggtccagcctattaactatggtcatattgctgatacaaaaagaagagctaaatccagagagcctctaagtctgggacatgggataatctccccgttctttacaagggacagctgggaagtatggggcaagctgaagcttggaaaaggagaaaactaaccagtgaattctcaattctcaactctaagccttcagatcataatcacacacatcaagtgaagattgagctaaagttagaggtaagacaacatgtttgctacttggatgttgaaaggagaaagccattttagctaaagaaaggaaacaacttcttttaaaacaggccaggattgagctggaaagaacttggttttgtggtctcaaaggcaaagggtaagccaaccagccaagccagtgctttaatggagctgcttaaatagcactttgcctggtgcaagtcacatgggagagggctggtgaaaataacaaggttgctggccagacttccagtgcgcagggttgccaaggaagaaaattcagggagagttgccaacatatgagagccatctcgctccagttccccttttgtcccagtgaaagagcttctggcagggctggtgattcaggagaccaccaatgaagaaaggcacacgcattatgaaaaaaaaaaaaaagaagacgaaaggcgaccatcaagcctgtcagctctggcagaggctactgggctgaattctgtcagctcgtgaatttctccttccccagctaccaaaggcagaaggagattccagaaacttttcagatggttaggaatttgtggagaaggcagaccaaaacaacatttagttctcagtaattaaagtattctgtcagtgatatattaaggaaatctgaataaatattaatacatcttttaagcaaagaatatccacttctgttatttcccattctttttattaacaggaagcatgctgataagaaaatgaggtcaagaccataacagctcctcccctcaattgcaaatcaaaatgtttccatctcccttttaccaatactatagtttgtcctatgtacatgacagattcaaggtaaaaggcttaggaaaaaaaaacaaaaaaaaaaagtccctcttcatttcaagtcagaccacacgtatctcaggcaggaagatttaattttttttttttggagacagagtctcactctgtcacccagcaggagtgcagtggtgccatttcagctcactgcaacctgcccctcctgggttcaagcagtctcctgcttcagcctcccaagtagctgggattacaggtgcacaccaccacacttggcaatttttgtatctttagcaaagacggggtttcaccgtgttggccaggctggtctcgaaccccaacctcaggtgatccacccgcctcggcctctcaaagtgctgggattacaggtgtggccatcgtgctcagccaggaagctttaattttaacagagctcaaccaaaataaacctgttcgaaaagacatgaaggtaatatgacagaatattccctactaagtgagaatgtcatacgatgtctttcttctgctttcatgggcactatttctgcagcatcctttccctcacagaaattcatttcagttctgaggtttctattgtaatttcacatcacttttgggtttggggttttgttgtaatggtcagattacaggatacaggttttataggtctggctttgatacaaaccagtaacttgcattaaaatcaaaacttcatttagtgtatggatggtgaaaattgtgtgcaaaacgtttctataattagacaaaagggaatcaggcagagcctattttcactgcctttgcttttttgttaaaaactaatagatttctcattctttgccctctccctggagtcaaattgcttcagaaagcaagcgtctgattttacatttgagtaactgtctgactacccaattgtttctcaacatcatcagtttttccataatagcccaggaatcaggcaccaaacaagcatttgcatagaaaccctggtctgcagcggactgaggtaagaatcattaacaccactgacatcacttttggagctggagaagtgggaaaacctgtgtttaatctatttcctactcaccgcaagttttagcagagtccccgataatatgggttgtggttcactttatggaagaacttggtcatgtaagaaaatctactgaattgaacaagcatcttccaaaacaaccatgaggtacctcagctgtggggcatgatcttcccataggtttttctgatccttaaacaggcctaacagaggacaatgccaccccaatagtttctaataggggcaagctcaacctcagtagaagattttccctacaacataatctaaggcaggggtcctcaattcccaggctgtggaccagtagagatccatggcctgttggaaccgggctccacagcaagaggtgaatggtggatgagcataagcacctgaactcggctcctgtcagatcagcagcggcattagattctcacaggagtgtgaaccctatcatgaacctgtatgcaagggatctatgttgcacatgctctttatgagaaaataatgcctgatgaaacattcatcccctcacccccagccatggaaaaattgtcttccatgaaacctgtcactggtgcaaaaaggttggagacccctgatctaaggaacgtctccaggaagccatcatcttacagagcaaaaaaggtttagcctttgttttcctttctgcattgaggagaatatcagggggaaaagttgagaagaatttgatctgggattctttgaagcgaactgttctttaaaaaaaaaaacaagtggtctaactattgaagaaacactccctctctgaaaccagctgaaactgattataatcaagtatatggcagcatatttcaaatgtatttgacccacagttctcatttgctttacctaagaatatctgttatggaaatgcaagtcataaagatttctgggctatgatagtaattctcaacaaaagtcaatgtaaaaggagcaaggaaaagtataccattcatcttagatttcagaggccatacacaggcaggaaccatattaattagctcatgttaaagagaaagctattaactttgcttacagtaaagtaataatgcaataaatgtgtgtttcccttgagttgcctctttctagtgacaagtgagtaacctgtatgcgattttgaattaaaaaatgtactttagggaattcaccccaaaaaaggttattttcagaatgaagatggaactattacatggctgtcatgcttttaaagactgataattttgtttaagtcaaaacttatttctgaattaaaatttgaaaggaactaagacaagttccattatcccatctctcagtgttcttttctctgtgatttcaggcaagtgctcaccctccaaaatcccaaatgttttcgtctgtaacacaggagagcattgcccattcacagggttctcgttgagattaaatgagataatacatgacattttcttatcattgtgccgacacataataagccctcaatcattagctcttagtgtaactactgttatgaagaactagaacccttggatcccacatcttttcctgatacctgaaaacacaccagccaaaaacactgtgtggaactagcaagcaaggatgaatccaccaaccaaatgccaggcaaggactgaatcagagccaaaatgaggatgcatcttgcgaagagaggacaaagttatttcagaaaggaggaagggaaaatgccagaacaaaaagaaaaagtaaaagtagcagtagtagtaaggctaaagatagatatgtaatacaacgttatacaaggacctgtctacctacacaggaaagagtacaaattaatattgagacagtagcattcacgtacaaaggggaagatctcaaatgaatgctatctacgaaacatcagaaaggccacttttattgcttgaaaaaaatcagaagcttgaagccccccatctttctaagtctgctaatgaaagacttctaatactactgaaagtatttacaaagaaatacatgaatatgcttaaatgggtgttcagtgagattcttatgcattatttctaggttctaagcatgtttatgattgttgggggtgggggcagggaattgggtggcttttgtttccaaatcttttccccaatctctcatctgaaggaactgaacaggagtgtgatctagccagtcaatgtgcttgagtaacttgatgaaaaattgaaattgctgccagatgcacatctaattgttggcgctggaagaggagggagggaaatctcagaaagttaatctaaaataattgataatgcatcactgcttgcagctctaaggtcactgaggcagacaatggtgcaaatttctaactgactgcttgtgtaaagaggcaaaatttttccagttgacaatgaggggtcgacctttcacctactgccccaaagctcctgttcttttgctttcatctttcaagtcttacttccactttgctcctgccctctctattttctccattatctgacatttcagcctctttctttttaatgtggaaaaaccacttgcttaaaagtttcctagcagcattcttttttttttttttttttttttgagacaagtcttgctctgtcacccaggctgggctgcagtggcttgatctcagcttactgcaactttgcctcccaggttggagcgattctcctgcctcagcctcccaagtagctgggactacaggacgcaccaccatgcctggctaatttttgtacttttagtagagacggggtttcaccatgtgggtaggttggtctcgaactcctgacctcaggtgatccacctgcctctgcctcccaaaggctgggattgcaggtgtgagccatcatgcccagccctaacagcattcttaaacgaaactcatatcacattattgcagggttgagctgcttgtctggctgagctaaaagcaccccatggcagttgtgccccattcttaataaacaggtagtgacaacttttagctaaggaaccgccataagaagtatttatagtgactgttatggactgaaacatgtctttccttgcaatttatatgtgagatcctaaccctcaacatgatggtattaggaggtggtgcctttggtaggtaattaatcatgagggtggagccctcatgggtgggataagtgcccttatgatgaaacatgagagctgctttctgctctctaccacaggaggctacaataagaagacggccatcgtaaaccaggaaagggcacaccaaaccagggtctgtggtgccttgttcttggacttacccgcctccagaacgtgagaaataaatgtgtgttgtttaagccaccatcaactcaattttgtaataacagcccaactaagacagagactctgaggggactacagtcccaagggaaataaatggggtcaccttagacccatggaagggccagacagaagccatccatctggcctttggcagaaacacgctcagaggctcaaccaatttctctttgcagacaccctccagtctccaagcatttcactaaatcctagggtaatggttctcaatttgtgtgggtgaaaaaactttgccccacagggaacatctgcaatgtctgcaggtatttctgcttgtcacaaccaggaaaggggttggggaggagagatctactggcttctaatgggtaagggcctggaatactactagacaccttacaacacagtgggagtctactgcaacaaattaacagtttaataaaatggagaaaatacctggtttcacaatatttgcaaagctcagggagataatgagataaggctgcagtgaacaaggagacacattactacgtgacccattcatcacgctcattgccctcaaatctctgagagtccaaaaaaaaaaaaaatcctcaagggccaggcatggtggctcacacctgtaataccagcactttgagaggccaggagggcagatcacatgaggcctcaggagttcaagaccagcttggccaaatgatgaaacccatatctactaaaaatacaaaaatttgtcaggcatggtggtgcacatctgtaatcccgcaactcaggaggctgaggcacaagaatcacttgaacccaggaggtggaggttgcagcagctgagatctagccactgaactccagcctgggaaacagagcgagactctgtctcaaaaaaaaaaaaaaaaaaaaaccaaaccaaaatgttaaatattagattccttctgttccagaatagtagactttaaaaaataaattcactttaaaaaataaatccactaaatttattctctaaaggctattcctaaatcagaacactgtttcatagaggttttccctactttataagataaaatccacacctcggaagataatttatgatcaaaaaacaaacaaacaaaacaaaacccagtgtcaaatgcaagactgagatacaaatcatagttgctgtttctgtgtttaaaatgtcttccaggaagacacttttaggtctgctttcccaaaacttaatattgacaaaaaacagcaaagggggatgctcggggcacatatatcatcatccgtgagtacacagggttccagattctaaaattagacaatgaacagaacaagttgatttccaggtggttaaataccagggttttcagatgaaccctgaggcagtggtaagaagaacagatcctccttaaatatagcaaaaggagctgcgcaggtcccagagtacaccaagaaaacaacagcttctattctttctagaccatagcctggacgctgacaaaatgctttcaaaataaaagggagccacaaaatttcaccttactatcaacatcaacaggctataattaacacttaattaacagcattatggtgaaatctgcttattctctcaaaaactgcctgaagctttttttccccattaaattattacatgtcacaagcgggcctggcctacctgttcatttggtttctccacgctttccttctgtaacaatgtaagcaagagtgtggccaggcaaacgtccttggaaagccttaccctttagagatagttttctttcttccgaattctcttcactcccaaccagcagcaatactcaccagggcccctaaacacagccactacttgccccacatcatttcttctgggattctctttgtgggaatttccagtagaaacaaaaccttcccagggactcttgagcagaggtgggaggattgctaagtccttgctaatttccccctctcaaacgcatagttagaaaaagtcaataggaagttgacttgagaaccatttgccaaagtcagtaagctgggacccttctccatggtggcctcctccgtctgccttcaaccatttgtggttttcttgcactttttccagagatagatccaagaaataaaatgaaaactgaacaaaattcaacttagtccatttttcccacctgagagttctatgaaagtgggaaggaagatggccaatgactatccgaaagatgcacctggatgagttattccagagtttaactgccctatttcatttctacaggtggcatctaccacgtgaccaagtcaccatataaaaagctcatgaataatatggacagagccatcaaaaagtctcaggcctggtattatgagggtttccttgattggtggtattgttgacttagaagcattaaatgagtggccgagagtcgtggctcatgcctgtatctcagcattttgggaggccgaggcgggtggatcacctgaggtcaggagttcaagaccgcctgaccaacatggtgaaatcttgtctctactaaaaatacaaaattagctgggtgtggggtacatgcctgtaatccaagctacttgggaggctgaggcaggagaatcacttgaacccggaggcggaggttgcagtgagccaaggtcacgccattgcattccagcctgggcaacaaggcgaaactctgtctcaaaaaaaaaaaaaaaaaaaaagaatcattaaatgtgttgtctgattcatgcaactggttagtagtagcactagggtgagactaagcgttctcctcactcccaatcagtaaaatcttaatagcataactatttagagaaacagaaagatcctaacaaaagagaaaaacaaggtgatattcaacataagggccaaagaagattcttagctgccaaatcactaattaaaaaatggggacttccacaggtgaggggggtaaacatacagcagtaaaaaagacccaaaatgtcttcagtgactacaaacgtattgtaaaggaagaatacatatcaaatttagttaaaatgttttaatatcatgggtattagattaataagaagttgaggtacataaatacttgtaaaatatttccactatacttggtaatatcctagtcatcaatataggaccttgtctagcttagtgtccactgttaagccatactaaagaaaagcacagagaaaatatccagattataagatatagaataaagtggcacttctctaacttaaatgtgcttaggatctgctggggatttgttaaagtgcggattctgcttcattaggtttggggtggggtctaagattctgcctttctaccagcttacaagtgaccccagtgctgtgggtctaaggaccacactcagtggcaaaggataaagaaccaaaaaggaaggaggaaacctactatttaatttctataaatgaatactaaggggcttagttgagggccaataaggaggctacaccacaagccatgtctgcagggtgaatggctttgactgcagaaatagtttggaattaaaacatgaaggaaattttccaggtgggtaagttctagaagagttaactagagaagaatgagaaacttctgccgccagggctcttgaacatacagatttggatgactgcaaagaggacattgggggaaaactacaatagttagaattcctaaaagactccacacgggtatttttttttttttttttttttttttttgagacagagtctgctttgtcgcccaggctggagtgcagtggcgcaatctcggctcactgcaagctccacctccgggttcccggcattctcctgcctcagcctcccgagtagctgggactacaggcgcctgcacgacgcccagctaattttttgtatttttagtagagacggggtttcaccgtgttagccggatggtctcgatctcctaacctcgtgatctgcccgccttggcctcccaaagtgctggcttacaggcgtgagccaccgcgcccggccgggtattttttttaaaccctgcttagtgttcggctaaggagaaaggagggcccagtgacagaggcagatgcacaggggagggaagagggacgaagctgtgacccagtacatttctatctctttacaaaatgaatgcgggtgactctgaccctgagaggctcagttaggaggaactgaggtagggccacgtacgttagctcaaaagtgaagaaccaaaaagaaacaggcattccccaaactcagtgaaatacatcgccctgccctacaccatgttttaccaaataaaccacaaagcacaaatttgagactagctcccaactccacattttattacttgagaggcctgcagttataaaaagccacaaaactgccaactcagatctcacccaaataaatgagtagaactgatataacaggtaaatgactatcatggtctataacaactcaactttgaaatatcaaaagtattgatattaagacatgcttgctcccattttctgctggtattaatttatcctcagaatcttaaagaacaagaaggattccttgtgcaggtagctcatcccagaaccgtagatgcttccagagaaagatcccgaagcagcacattttctaatatcaggggagcacagaggcataatgactcaaaggtaccaaaatttagaaaagactaaaaaataaaagaaaggatggtctgtgtgtggtgataacttccactgaggccagcagacagtagcaactggtccccaattcctataggaaggcaaacaggccctgaatcaacagcacacacttcagtctacttattaggaagtcagccacagattcgcttttccagtaaataaagttttatggcatcaacaggccttaattattacatggcaatttcattcaccaggcctaactctggtctctaccccaaggtgcagctttaccactggtctgcaagcataggctactaaagattttaggaaagataggaaatgatgaggtggccagagatacttcccaagagctaatttccaaaccactgcggacagtgcaattcacatatcgtgtaattcacagagttgttttcctaaccagttgagacgagtgagaatacattttaccaagggatatgggatacaatgagaatgtagtatgtaaccttaaaacggtatccagtatataatcctgcctgtaaggcactcactgctggacccatgcgacactggacagcaggaaggccccagctccacttactggcgtgggacctcgggcacttgatagcctcactgagctgcggtttcacggtaaaacagtgataaaattacctaactcactgtgtgttgtgaggattcaatgagatggtaactgtaaagcacgtggcacagatcctaacaactacaaattacaggaccatcaattcactctatccagtagcaagaagccaccagaaaacaaatggccccgagggggtggcaaaaagaagaactgaaaagggatggaagggacttgacactgagctctgcctctttgcagttttatctaagtgtttgcagagaagagaacctcaaaaaatctgccattaaaacccagacaattacattaatcatgagatatgacaggccttcaataaggatattgccaaattaccactgttttatcactgggtataaaggtacttcctgttttgctttaacttataattttaatcaccgactcattatttaaaatggattgcccttaactaaaagggcattcaaaagcaccctaaagttttataacctgcattattacacttcattagctgaaaggtaaattatgtctaggcagagtagaatcataccatattctaaatatgccatgaaatgtaatttctgagaccgtgaataaacttacatttgattacaatcctttactaaactgtttaagagtttcttatctctaactttctacctgatccattacagtgttttatatataactggtactcattaataaatgtcaattaaaaactgtgtataccaagaaaggatctataagaaaatcatagtactcataaatatagtctaaggtccatatgacttgattaaggagaagtaatttcagccaatcaaagataatggactctgaagtctttgtgacgagatcctcatagttggcagtgttcaaaggggtttgctaactttttgaaagtgttattttcttttgataatatattgtttaaaatcagcactgattgattgattgattgattgattgattaagacagggtcttgctctgtcaccaggctggaatgcagtggtgtgatcacggctcactgcagcctaaacctcccgggctcaacaatcctcccacctcagcctcctgagtagctgggactacaagcacatgccaccatgcctcctaattatttttattttttgtagagatggggtctcagcacgttggctaggctggtctcaactcctgggctcaagtgatcctcttcccaaagtgccaagattataggcacgagccacccccttggcctcagcctatcttttaatgccacaaattaaatatctctactaagaaaataagcaattttaatattgatgacaatggttctcaaatcacaatagtatcctcctccctcccatatattttagtaaaccattcctggagtgagggtgggtttatttcagtaaaccattcctgagtgagtgtggggtggttagtaaactaacccaacccacaaacacatacacagtaatttaaatctccaaaaacaatatagccatcatttgttacacgttaggcactacgtgaacagcgtaatatgcattatttcatttcattctcgccacgatcctgagactgcattatcattcctgtttaaacacaagaaaaccgaggtttagaaaagatgagtaaataaattcctcaagatctcaactagtaaagggacaattaggattcaaaatccatgctattaaccaaaaatttatagacatgctataaaaagcatgggtggaagtactgtcaaatctttcatctaaatagagtccactgaatatacaaagttatttttataaaaggaaacagggtaagctttgtgtttacaaaggtaagagaaattacatactgaaatgccattctgttaaatctaaactaaatcagctaaaacaactttcacttaataggcacttggatatcagaaataccttcacttctagaaaacagcttgcaaagagattgtcattataaaagcacgtttttatctcttattatatgtcctcctataaaaaactaaaatgaaatctcatttccagaagagtctagacagtggtagacacaacaaactggggtgactaatattttgacaaacacaaacagccaaaaggtaaagcgtgaggcctgacatttttgatcccataaaatagaaacccttttagctctcctgccacactgcatgacctggtaggatggggatatttttattcaacagctttccttcggtccttccatccttttttagaaagccaaataaaaaccagaaaaggcatacttataaagtcataagccatatgctataacaggtaataaaagtcctttgacgttagaagccacgaaagaacagaagattaaaaagtaaatcataacagctgcatctcgcctcccagtgtttacattcttagacatccactttttaaaaatattcctctgtagatcaaaacatgctgtactttgagaaggggaaaacaatgacgttaacgttaaatattgtacagtttacatataaacagagctaagtttatgcacatcattctagttggcagaactcatctgaatggctcaaactgagagctataattaagtgtgttaattatctgtgtaccaaaaatctaaaatatatatgttccttattatagagcatagaatacaactggtttaacaatcaaaataatccaaaaagctttttcaagttaaacttgggtgctctgaagctggatgaactaggttcaattactgggggaagtctgtttcttcatcccatccttcccctccccacaacttgtattcctttccctcagtaccttttctctttcaattagtgccacccacaaatactgccagctcattactgacactcaggctttaaaaactgggtggccccataccaagaaccattttaaaattactgccttcaagcattaaaatgctaatccaacagaaagcaaagcttaagagctggagctcctcctcccaaaaacatacatgtatatgggagagaagcacggatgagccacagtttaaaattctagtttgtaacatattcaagagataagcagttggcagaaagctttcaaacacaatgcccattcacagactttatgcactcactttcagccttataaagggaaatactcattctaagaaggatctaagttttaacataatacaggccaacttccatcagaagcagcaattaatatcagtggtaagaaggctagtaagttcaggcagatacaagatttaggggccctaattatcattaagaaagcatttatcttatacccgcatgtctaaggtacaagccaaggtggtcaccaactcatctgactgaaagttctgttgctaaaatctggtatcgctgacctcactaatcaaaacatatatgctcctttgaaggtggtgaaacatccctagtcagtgaatcaccactctcaaaaatctccaaggattataggtaaacatgagccctgccactacaagtcaaagtttgatatccaaagaactggctctggtgttaatgcatgcccaaggtttaatgaggatgaaaaaagaaaaaaaacaaactaacatattttccctttagaacacaactaggacacatggtttttaaatcagatgacttattgatcaattataatatgcttattgatgcagaacaatagcacgtgacctaaggctcagggattcaatccacaactgggataggttataaggaagaacagattgtctcctttaaaatacaatggctctggctgggcgaggtggctcacgcctgtaagcccgaactctgggaggcccaggtgggtggatcacaaggtcaagatatagagaccatcctggcaacatgatgaaaccccgtctctactaaaaatacaaaaattagctgggcacgatggcgtggcctgtggtcccagctactcgggaggctgagacaggagaatcacgtgaacccaggaggtgaggttgcagtgagctgaaatcacgccactgcactccagcctggtgacagagtgagactcgtctaataaataaataaataaataaataaataaataaataaataaataaaatacaatgctgctttccctaacaggctgtatgtagccaaagagaggcctaactgcttatgtgcttgctccaatgacaaagtgcgtgtgtaagaagcacagatatacttgactgtttataaactactcaattaataatttatgacaacgactgcaagtcatacaacatctgagggtacctataataactaagcaagaagctttcactactagaggatggtacggtttgaactctcctggagccctgttctgggcattcagtaggccagcagttcccaaacatgttctacagaacatgagctccagagaaacagtcttgtgaggctgaggcacagtggctcacaactgtgatcttggcactttggaggctgaggtgggcagatcacctgaggtgaggggttcgagaccagcctgaccaacatgtaaaaaccaatctctactaaaaaatacaaaaattagccaggcatggtggggtgtgcctgagtcccagctactcaggaggctgaggcaagaaaattgcttgaacccgaaagtggaggttcagtgagccaaggaaagaaatagagtcttgtgtccaaagacatttaggaaatatctccccctgacatctctcatctcatattagagcttgatattttgtttaaccatgtgtttcctaccttataatctgaaaatatgtagttttcatttcatatctgtgctaactactctaacatctgtaaaatacattttgagaaatactgcattaaaattttccctcaaaaagccttttcccttaactttgctattcacaaagcattctgataaaatattcaacaaaagatacataggcataacaaaagaaacatattttagaatagaaaagttgatttaaaaattaacaacaaaatgtttttttaagaatatcacatttgtgtttttagccctaaatttctaatatggtttgtagttaatagaaaaatactaacatatcaataatttacaatttgccaaaacatttatgtgtcaaaagattctttgcttctctgattttgaaggaaaagaaaatgagagaggcagagacaaaaaaatgattaaaaagtggagagacagcttcttcccctaattattcacagattccatttgaattcaaaaacgattcttcacatttcaggactcatgtatgaaggttgttttatttttacttcatgaattggtggatgaatgttatataaattattactgcacaaataattttaaataatacttgagaatgagacaaaaataatattttaaatttctagaacagcagctatatcattagtctacaccatgaccactaccatgaccaaacacgtgatgagtaagtctaaaatcataaaaacacctaagtgaaaatcgaatacctttattttctaaaacattaagcagaatgtcatattacctttagcctaaatactttcccaatatacagttgaatatcaggaaaatgtaaaatttgaatgctaaatataaatatttagacttgggtagaaattttcctcttattagagggttaaactttgtataatatagaaataattataatgaatcagacaattactttgatccccttcttggtttcaagaggctgtgatgatacacaatattttctaagatatctctatgtgcctcaagtatctatgctagaaatgtggaaatgaaacataaaaggcatcatgtttacagggagtttaaaaaaaaaggtgtcagtgaagggatgaggttaaatgattggatgctaatggaaaccacctccaaatagccagacaggacacacccaacctacccttcctaaaatatccaaggaagtgaaatttggatgctctacagatagatacaggtactgtctttcaagaccttcttgtaaattcctttagaaagatgctcattgcacattacaaattattttgcccagtaactgtggaataagtggttggtgattatacattcacttctatttgtgtccagagtatgactcatagaggcccaatggggataatgaaaaaatcggctctaatatccaaaactgcctgtgtccggggctggtgcaagggttacacaagcctcaaaacacaaataaaagtcacaaactagcaagtaatattcattaggccccatgtggttttgaaagacaattccaaatgctttcttatataaatgtgagatatggttctagatttttacaatgccatgctggaaaatggaaaaattctctctacaaaggaaaacgttagtctggagaaaatgtttacagaggtttgcagcaaataaacttctaaatatagtaccacacttaataaagggtcaaataagctctgggttcttgagcctgaagttttcaaggattttacacagccccaatgaaccatggcagaaccatggcagctggcaaatgccctgaaccattaccatcaaacagctgctgaagcaagtcacattccacaattctgtagcacttcctatcataagtaacagttggtatgtgcccaaatttattttctcactaaagctgaatgaagatcatgtagcagagaaacacttttatgattaaagcagatatacattttcagatgtattttttaaataatggaaaacaatgaaaactttttcaaaattcatgcaaagacaaataaacaccctttttgatataacttaaaactacatagtttctttatagcagagaaaatacaagagaatcagaagcacaataaaatgcaaatatgccatgaaaaacaaagccatgaaaatgcactgaaatgtttgtctcctagcactctgttggaacttgtacataggcttagctgagaaagaagagttatgcctgggtgctgtggctcacacctgtaatcccaacgttttgggagtgcgaggcaggcagatgcttgagctcaggcgtttgagaccagcctggccaacgtggcaaaaccccacctctattttagaagtacaaaacagccatgtgtggtggcgcatgcctgtagtcccagctacttgggggctggggctggaggatcgcttaagcccaggaggttgagctgcagtgaaccgtgattgtgcactgcactccaggctgggtatcaaagtgagaccctgtctcagaaaaaaaataataataaaatgcatatagaataagtctaccatccaaatgagtcatttatgtgcacaaattaaattttttctttttttgtcttattgcaagattaaaaattaattttaaaactacaattcaataagggctttactaaaatgttccttaaaatattattttgacaaaagccggcatcaagaatctcttcttactcctcagagagagttgaaaatacccaattactttataaaatgtcaatacaagggatctcacagatagcaaatctaatagtgtccagtccacacttccctacaaatacatgcgtcataattttttttaccctcttaatctgctgtggctccattagtaagcccctaaaaatcaacctggcatttacattcttgtccatctggaatgtctctgcatcagaggaaaaccctcaccccacccccctccacaaaagatgaacaagtgcacagctggtataaatctgggcacgttgaaggcaaccacttgcatgcatgcatacacaaggctaaatgtttaatccctcaagcacctcttctacccattttcagatgatgctaggaaggatatgatttgcttttttaaaaaattaattatgtacttttattagacaccaaacaattccttattgaaaagatattgcaagaaaaaagcttgaaaacttgccatcaaagctgtctgaagtccaaagtgctatcttttgctgtcacagaagacttggaaccaaataggcagaaagctaaggtcaatcttgtgaaagtatgattggaaacctaaccctagacctctgtcctcttcagagcagcagattcacatatgtgcatttcgcagagatgcaggaattgctgatgttttccatgctgcttccatgaaaaccaacacttgcgggttcactgccagctcatgatgtgaagctaaacttagaaatcaagctgggttctatatgagctacaccacctaagtagctgtgggcaggaatatgactatatagacaactccaattctaactattggtttttaacgagaagagcagaccaataaaattcagctttctaaaacaacacataattgctttggaatgcattttggtaataaatttggctgctgtaactgaggttttgaaggacaactacagggggcactatttacaccattctgggtgtgaaaacaattccatggaatgtgctgtacacagcccaggtgactgccgggtttattgtcattctataccaacttccaaagctctatcccagggaaaaaaagtatccattgtatctctctgatactttcctactttgcatattcctctgtttctttctggcccccttctccactctggtcaactgtcacttatagtgcagttttgtttcttatcaaactttaaatcgaataaaagctagttgagcttccagagagcttactcttcccacaaagaatcctaagttgtagatgattcagatattaaaatttgagcagactagaattttataggtacctcaataaacctgaaattccccaaatccaaaactctggaaagttccctaacataattagctacaaattttcaatcttgaaacttaaatgactgttccataatgcagtttggaaatcatgacaaagccataagtacagacatggataacagaggttgccggtggcattatgttccatcataaactacagaaaaattaaactgttccattatttttagcaagacctctggttattggattgcatgggtgccctgcattccgcttatccaaaaagcaagcagaaagaactaaaatggcagcatagaggctgagctgttgtcctacaacatagcccttgtcattacagaagcactaggcaccctaaggttcattttgttccaacaaccagcaatcattttttccagaaaaactgagatgtgagtttggtttgatttattaatttagttactcaaaatttgaccttagtgactataaatatgctctatcactattcaggggtggcatcctcacttggatctctggccagaattctttgggaagttatcattgatatcttattgcattgacaattaaagacagacagctcatacctcttgagatattactatctaaaatgccatcagaacataaaatgcaaaaaaaaaaaaaaagagagagagcaaatctttatctaaacataagctttacctacacaggtaacactagtgaagcatctgtataatttactcattgcactaaaagttttagccatgaagcattggcaaattttctaatagggtcagattgcaaatatcttgggctttgtggacatgtatagtctctaccccaacaactcaactctgccattgtagctcaaaagcagccagacatacataaagaaatgggtgttccaataagctttccagaaacaggtggcagctggatttgccctagtttgctggctcctggcctactgtaaagccagaagaactataggttggtgcaaagtaattgcagtttttgccattacttttaaaatgccaagacctgtaataacatttgcaccgccgaatacatatttcattgtaaatcaggaataaaaatccaaaagaggctgatcataagacaaaatcagctcaaagtgacaagcctacaaatataaaacacctttccaatggaaggaacaggtaaaactcttacctaacaagtggtctgccagagcgttaacaggcgtgcatttgttttcttacaaaaaagtataatactcttgcgatcatccagaagagaaaactcatttgggaaatttatatcatcatcttcctttaaatgcttttacaacaaagaatgtacagtaactttctaatagaaagataaagggggaaaaatgatgatacagtacctccaacggcaagaaagggaaactgttggtttcaggaaaaaagaaactgaagaaaatgcattgctgaaggccttgtactgtggaggggcatcttagtttgaattcaccattccctaaacacttcccataccatcctattttggtttctttttattcaaattactacatttttggggtttttctttttataccatgttggctttctacagtcttgaattacacaagattctcacagtcctgcattaaggctgtcttggagactactgtccacatttatgacaaaaatactacaacaaaatccacaaaaactgccattatgcatgccacatctcagatcctggtggttaccccctttgaatgccaacgtgaaaatgaacgagcaatccagggagcttgaatttcaaggctattttttaaaagatgccatctgctttcaaaagcaacacagacacagaaatagttctctccttgactagctacattccaaaatattggtcatggtgagtgcatcccattgccaatggcccaggtatctacgtattctggcctttcctcttggtttctgtgatactagtcaagttttatttcatctagaattattcactatcctccagtaattccaaatcacctttaattgccatttaaaaaaagaccctacataagtcttccatcaaacaaacaaacaataactgacttttgaatcaaatttctttttagcaatacccaagcactcttttcttcattgtggaaacctacaatgaatctcagggtactaatccatcctatgaaatctttgggccaatcacttagtaatcagagcttccaaactcatttgtatgaccgttgttagtaaatgaacttcaaatccaaataaaatgaaaatccctatacacaactctgtagttctgccaaatgatgaaaaatggatcatggataaacttcagcagaacacactccaagaatcattccactcagtctgaaagtaagttttattatttccccccatactagatttcctaaataaatttccttttgctttttctgcactgctatggtgtatgttcctttagaaacatcgaaggacactaatggaatgtggcaagaatcagagctaaaaatacagctttttggccaggaacagtgctcatatctgtaatcccagtagtttgggaggtcgaggtgggagaattgcttgaggtcgaagtttgagaccagcctggacaacatggcaagaccccttctccaaaaaaatataaaaagtagctgaacatgatggtgctcatcgtagtccaagctacatgggaggataaggcaggaggtcactcaagtcgaggagtgcgaggctgcagggagccatgatcactttaccacattccagctgggcaacataacaagaccctgtttcaaaaaaagaaaatctatttacctacagagagattttaaaattgtcatgaaaagtatctcaaagcctgacacatacatcattagtctcaatgagaccagaaaaaggagagagaattaaagagggtgacattagcattcctagaaaagggagtaaagcagatcacagtgagggtgcgccacagcataacctctgtgaatcctcgcgcaattacctcttgggttgccgtcgtcaaggtttgattgctcatctatatgcgagcagatcagaatggaccagctgcctagcttgctgttctacaagatgtaccataagacactaatcaactacccttaaagacaacagtgtacatgtatttttaagcggtggttatagaaatgctgtcgatatgtacttagaagtctatcgcacaaactttgtttcttgttaattttcctcaaaggcaagaaatctacttatacttctatttcactccttttgaattatatatccttagctctcgcaagctacactatagcttcaccaattcctattctttttataaatattactcattcattcattcatcatttgagatggggtcttgctatgttgcccaggttgactcaaactcctgggctcaaccatcctctgatcttagccttacgagtagttggggctataggcatgtgccactatgcccagtcaccaattcatattcttttcttagaaaaaatctgcttagacttacctccctcgggaaaacacagttgagctgaaatggaaattagagacaagataatgcctttaaatttttattgacaacaagtagcaaaaactcttactgaatcactatttattgtcatataagcttctttgaaggtactctgtgcatcctactcctggactggtccacataagggccaggaagactttttatcgggccctgtggggaatcgccaacttatctgggtttcctacaaagttgactaatattgcttctgtgagttctctaaaacaaccccatgagcactaatggactttcctaggctcacaggataaagtatccatggagcttttccacctgcctactcaacagctggcctcacagctttggacaacgagaaaactccagttcctactttgcaaaaattggggaggaacaggaaaggctttccacatttctcctctgccacttccgtaaaagaactatgcaggatgtcttcatcagctgaaataacaggaaccaaacagaagccactttaaaaagtaaatctgttgaaaacatggacctatttttattgtaaatggatttaactgaaattttacactagggaataaagctgaaatatataaaaaactatattaccttatgtttaacaaagcatgttttaattgaatctactagaaaatcttaaatgaacaaagtttgatcaagtgttcatgtttttggattacttttccttcacgttcaacttcgacttcttgtttggtcatcatggaacaaccataaaaagaatcatttctgtagaatattcaaaggttttatgaattttcccaaggccctctcttaatcctatatatatatattatatatatatatatatatatatatatattttttttttttttttttgagacagggtctcctctgttgcccaagctggagtgcagtggcacgatctcggctcactgcaatctctgcctcaaggttcaagcaattcttgtgccttagcctcctgagtagctaggattacaggcgtgtgcaccaacctcagctaatttttgtatctttagtagagacggggttttgccatgttgtccagctggtcttgaactcctggcctcaagtgatccacttgcctttgcctcccaaagtgctgggtgacagcgtgagccaccacgcccagccaatcctatactatttttaccatgcattttagagtactaaagtagtcattatctttgatttgtttcttcaacagttgactcatctgctagattttactggtcattgactgcttgtgaaacccagcaatccaccagcattactttcattgacttatgaaatgctgcatctttcacaaaaggtgtatttccacactgaataaaactggatgaggatcactggtattaagtataaagagataataagcaagggcagagtttagaagtgcttattcattagtgaatatttttgtgtcttctgcttccctactaaaaccttataattgcaggactcaaataatgaagatcactctcttgccaccattccatatggtaggattcggtttcatcacccactagcatgccttcatgaaaccatagagccagctgtcgagagcagctcaaaacaaaatgatcacagaattaacacctaaaagcaaatggtataataaaaaacatcattaaaagttactcagccaacataattttccaggaagttagtaaaatcaagttaaaaaaaaaaaaggcatgaaggtcaaagcaaactcacatttacctgattagtgccaaatgtttctactacaggtttgcatgtcaccagaaaaaaggcctgatatgtaggtgttagagcagaatagtatctagctacaggaagattaaaggattaaaatgaactaatactctacttcctaaaacatacagactctacacagtgccagtcaaatggcagccaagtgttatcagcaaggctaaatttggatcactaacctaaaaaccacttaagataaaaagagtgctgaaataagcgcaagccataataaggccaatgagagaatgggtcacgtcaggtgacatggtttccaaaataaaaaaaggccaactaaaatacaaaagaactgggataaattcttgatagctggaatgtttggtggaggcttaaatgagcaccttacaccccacccccaacaaaagggcccttagccattctttatagaattgaatcctgctttaaagaaaccagagcacacatgtcttgcaaggaatgcattaatgatcatacctgggtggccaagcatccagacaggcctggaactaggactgaactctggtggcaataccaaagggcctggtttgaccaatgggtatctcagaagctagtgcagcctgccgctgtggcagactaaaaaagaaaccttttggagccacccctaaaataagcctcggtgatgctggtaagaatgtatgaaaatctagggtagaggtggctttagttcattatctaagaggtctcagctattggcactatcaaactcaaaggcatgaggagtaacacgtcacacagaagaagtccatgccctctagaataaaacttagtaacatggtgagtggtccaggcacacacactgacattccaggctttcatcatactttgaatgaaattcaagcaacttcccatggcctatgaagccctggagaccctagcttactaccccaatcacaccttctaccccatccctgctgctccagatgcccggaacataggatcgttcccagcataggattctgcatctgctgcttctactgggacaccttcaccagcacacagcctcgccccataagtctctcccttacttcactcagatgtttgccagtcactgcctcctttctggctacccttatcaaaaatggcccaccctacccattcttcctatccctttacactatttcattggttatcatttgtttcttcccttggaataataaaaatccacgaacacagaaacctactatctgtctgattcaccacatagtctctgttttccaaaatgtgtctaggcacatagcaaatctcaacaaggaatgagatttggaataaatgaatggaatatacttgttgcattgatacaaatatattttataaagtaatgaaatattaaaataatagcaaataatcatcaataagactaaaataaaccaaaccaaagccaaagggctaatcaaaatttgaatgtttgtgtgctaaatattgtaccaacagcagcttagtaaaccaccctgaacttcctctgtacctgctgaccttaaaattcatgtgaaactaggttctggctgttactaaacaatctaaatgccatcaaaagttctccaaaatcttgtagtggcgctatctcggctcgctgaacccccacctcctgggctcaagcaattctcctgcctcagcctccggagtagctgggacataggcgccccccaccacgcccggctaatttttgtatttttagtagaaacagggtttcacatgttggtcaggctggtctcgaactcctgacctcacgatctgcctgcctcggcctcccaagtgctgggattacaggcgtgagccaccgcacccagcgaatccttctttaaagtaaccgagctcactgaggcaagacagatggtgccttcagtgacccattctctaacaacaatgtttaacacttgtctgcaaaataggaactcatgttcaatatgttttatgtaactatattcaaatattgcaatattgtttatgcaactgaagagaccatcagaacctagaaactagtaatagattctcccaactcaatactcccactatcaccgaatcactctgtgaccatatattcttaagcacggaatacatgccaaagatgaaaatccactaagcagagtcaaaaaagagttatgaaagatgatgaaactgaagacaactaaggccatcagccttgccctgccaaagatggtcactgcagtgcagtacacatggacactgaactcaggacagtccaggttcaaataatcagtgacggcaaggaaacagaagctgctgcaagactgcccggagtgtcttcagaaagcaattagattatggaagactagaccaaggcaatgcaggcctgcagcaccccaaggaaccacagagccattcgaggctgtccttccagccaaccagacatggatggaagatctagacatgcagatgttttttaggtttccgacgcgtttcatgggaggcttagaaacttaactttcacttgaaaagcacaacttatcaacccatcattataacctcaaagttgtttaacaaagctattgttttagtggaatgaggcagataacagggaaggactactcttgtcgttatctctagaaaactttctattatgactccagaaaaacaggtgcatataaaaattagtcataagccaatggaatggagtttccaacttttctgaatttatcggtccattcactgatcacaagtatacattcatcttagtgagacatatcagccattgatcgccttactgccatataaagtatggccgttcaagtcttcaaaatgtagcctcccagtttcactgctctcctgtctggtaagcagtggaggcactaggaatctactcctctcccagaaaggatataggaggttgaaaaaaaaagagcagtaataaagcctagcagtcatgaatgcattttgaaaactttatgactagggttgactatgtcatagatcaggcaattgattaccagtgttcagaaagtattttcaagcagggctaataatcaaacacccacatatgaaagagaaaacttcatttaacaagctaccttttaaagcctttaattattcaataaattatgattttcccctcaaacatgtgtgaattgctgaatggcatcttgcccaatgaatttttcaaaagaaacttcaaaaacaataaaactaaatatgagtgtggtctacttagttctttgataaatttagtatgatacattgttcataaactcctccaccctgcctaattttcctaagagtacttaccactatctgaattaacttgatctgtttagtgcctatttctcccttagaacataagctcagaagtgtggaaacgaagtcttattcctagccctattcccagcaatagtaaagccaaaatagtgaatggctttacaaatatttgaggatcaaatgaatgaacaagacatctataacatacagtctttggacacatatatatgtgaatatgcaacatatatgtaaacatgttgtatataaagatacaaaacagacaaagcattttacacatgtacaacctgattagtatagcatgggagaaaacattaacctggagatagaatatcagggtttttatttttgttttgtttgctaactctaccatgtaacagctgtatcatcttaaccaagttacttacacttatggtcctgagtctatttgtctgtagaaagaacattctgagctttattatctttagggtacttttaactcgaatatttttctcaataaactggactctttggaaggctgaggtgggagatctcttgagcacaagagtttggggtaagctatgatgatgccacagcactccagcctggcatcagagtgagaccctctctctttaaagttcatgtatatatatataacttttggagctgagaactagctagatcctgtcactgtcagtgacggaagaacgttggtagtgtgggctggttgtttgtgattttaaaggttaccctatttttatgggagggagtggtatatgtaaatagagcacattcttggtcctgactgtgtttatcaaggtcagaaggtgttggggaaggatgaggtgatagggcatggcatggctgctgaggagtttatagctgggtcccctttcctgttccaagcacatggtatcagccggctgtccggtggctcagtaggctcactgtgttccaaaattcttcagagcattcggctccaccactcaaggaaaagcaaaatagaaaatgaggagaggaaaaaggagtaggttggaggaagggtgaaattcataggacagttttacagagagccatgaacacagttagttactgatttataattacccagaggccaggagttagaattttagtagtttgttattttgctttccttacagcatggattatgtaaattgttgtatatatgtctcttgaaatatataatacatatttaaacatacatataatatacttaaacatctatatatatgtttaatacatatataaatccatctctttaagatgctcatgccttctgcctggcacagcacacacactggatctctctgtcaaagagtgctgagactcaagagtagagtcaagaattctacagagaaaacattcagcactccccagtcatacttttattttcaagtttttatatataattaatccacaggaactataaaatgcatgtacctagctccttttaaagtttaataaatatatttagccattaatcctgatttatacttacagcttgtaacataatttagcccacatgtagaacttgctttttctatgccaagctaataaatgcaacccagtttcctagaatttaacagtacacatactcatacttcataaaataaatatctgaacaagagactcaacactgttgtatctttcaggcactcaatcttgatatactcttacagccaagaaatctaggaagctggctgagttcaaaaatatttttaataaggaaggaacaaaaaccaaaagcacccctatgttctaagggtgaaggggcgttggtgggatataactcaaaccatgacaaactctgtgtatgagaggcaattacagcttacaattttactttcatatgttatttcatttgatccacaaaacaacattataaacagactggggcaatattactatctccaattttgtgaaccagaaaatcaggtcaaggaagacagttcccaggaggtggcagaatcgggaataaaattcacatctcctcttttcttgtcatgatggttctatactttcatttgatctttcacttataatagtcaacctagtcttgcacaaaacaaatacagaatcaatactatccacacacaatagatatagctaatgaatgagtgacagtagcgtataatttgtctcttagccaagcaaatactatgagtggcaggaaatgacagaccttatcaagacaggaaaaatgatgctggtaaattctttctcttccccctacatggacgtaaaaaaaaaaaaaaaaaaattctaagtcctcttatagaagatgattacaagaaaataatcttgggatcaggaaagcagaactgaaacctaaagcttatcatgctgataaggatattacacaggaagcagtaagttaccactgcttcctgttttaagtatcttatctgtaagacacaaattttttttcaccacagaacctcacatttaggacacttcccaaaatagcatcttctgtcttcagctgtcagctgaagttgtttcataaatagcccagcatatgtactccagagaacggtcacactctaaatgcaaatatagtccagtaataccaattccttttaggctttggtgaagcatgaaacaagcaaaatcaaacagccacagaacttctaaagagaataccgtagaggttgtagctaatgacctatgtaactctagctggactatttctggaaactttgaaacaaaggcattggcagatatatattcctgttttttagtatcagtttataaaggaacataaggtttgttcaggttagttaatatttaaacaattaaaaacaacttttttgcaaagattcattttgggaataggatgtatatatagaaacagctgggttctctgtttgaaacaactcttctggggccttcacagtcaacaagtacagacagccaaactgattataagggaaggtgtttgaaatatacacatgaaactctaaatatatggagaaaacacatacatacacactggtataaaagaagctcactgtaatctgtatgatctagcatgtcaggaattctactgcaagaattatacaacagctgagacaatttcggtgagagagaaagaaaaatcaatgtctgtgtttttaaaagaaaaaaagaaaagattgtgtagaatgggactgtataacttgttagcttgcaagttaaaaaaaaaaagaatgggactgtagagcatacctgggattttattttcttttgcatctcggtccttaacaaaacatgtgtgcttttgtgaactccttcctacaccatcgcctgcccctttacccagagcccctccccatcacatctcccccaggaaggcgaagaaggggttttgccttggttaacgtaaccactccaggagagtagtcttaaggctgattccatgctgtacctagtaaaggttcaaagtacttgttgagtgttgaaagactgtataaatatgatcctcaagcccttttagctattggatagtagctgccctttttcacataaaggtgatagacagtgaggcatggcagaatgccctccttatgatcccagagataattccctgtagtccaacagagaaagccctgttcctaactacagaccaggcagtccaggcagttccagattcccactggacgtccggaaagcacaaagccaagcctcaatgaacttcattaacttgattccccgagacttgagagtccgttatagaagaaagaataaaaatgttgtaaatgtctatactgaatcaaaatcacaaaatactttttaaaaagactactggtagataggttcaaataaatctgttttttaaaatgcaaataactgtcttcaaggaagagggcttaaaaaggctctgatgatcacagtggttccaaggtggtacatacctataaagttctgtctctgaaaaagtaaaacactaacatggggcaaattaaaatggaagaacatggggaaatcgggaagcaaatgtccaactatgtccagtgtggagttggtttgaacactgtactacagaatgttggacaatttgggggaggaaaatgatgtaaaaaaaacaagaaacaaaaaaaatattcaaggtttgggaaagagccacaaaattaattgaagattttaaaataagaatgatgagtaaaacctaaaaatgtttagtattaaaggaaagctgagacctgactcacaaatgtcttcaaacacatgtagagaaacatttcataacaggttggtggtctaggtaataaactatgtttcatccatacaagagtattaaccagcaataaaaagaaatgagctataagccacaaaagatgtggatgaatcttaactgcatattgctaagtaaacgaagccagccgataagaatacatactataatgattccaattttatgacattctggaaaaggcaaaactgagagacaataaacagatcagagattgccaggggttggggagagagaggaagggttgaatagtgaagcacagagcattttttagggccttgatactatactgcatgatactgtaatggtaatacaagtaattaagcatttgtcaaaacccagagaatttatagcacaaacagtaaacttaatgtatgcaaataaaaaaatacacctaggaagtcactgatcccaggatggaatgcagatgtgacaaaataatctaaatgtgttataaattcatgaaaagacttcagtaaaagaggtggagaataaggtgctgaccgaagtaactctggaaatgaggggaacctataagactaaagcaaaagaaacttgacagaagcattgtactctagttgataaagttgtttcccatggggctgagttaacaatcctgaactgctatgtatatgtatgcagtgaaattgaacaaacaattaatggatcaaggatagtaacagccggacttcacactgttgaggtgggaggtgacagataaaaaggaggcgagaatggtccatgtggaaatggattggagttagagacagcaatgtgaactatgcttggcttagtacagatacagatggttacatatagaaatatttatagatatgtgtaacgtatgggttagtacacacatacatttccatgctctgtcagctgagaaggcaaagaagaatgacatctcagtagcaacaaacactgctagttcccagatcttagtttccaatataatgtccatcaggtatctgtgggggattggtttcaggattcctgtgcctaccaaaatccatgatgctcaagtcctttgtataaaatggtgtagtgtttgcatataacctatgcacatcctcggtatactgtaaatcatctttagattacttatgatacataatacaatgtagttgctatgataagtgttataccgtattgtttagggaataatgacaaggaaaaagtctgtatatgtttgtaaagatgcaactatccttttttttttccttgaatagttttgatttgtgcttggtgaatccatgaatgcagaacccaaggttacagagggcagactgtacattctccaataaaaggagcagctccttagagaaactgatgattttagaactggggcaggaaataaacaaggtgatctgtagtatattggagtgtcaaaaagtaagggaatgctcaaaaaaaatacaaaagcaagacccacaatgatgggagtatgtcaaagggacacaggcgccaactgaaagggctaaagctgaacaatttgagcaacaaaataaagtgttactggattatgacctgaagtataaaataagcgccatgagtccatactaatataaatagaattgactaagtaaataagaagcaaatctccttgcagaagaatcgtgtgtgagtgtggggtggttcgggtgggggtgggtagataactgccaatccttaattgtgggttgtgtattgtgactttctgccaaagagcacaatatggaaagggggaaaaggctaaatttatagcagaaaaacctgacaaacactccttcagccaagttatcaggtcaacatcgaccttgagaaatcctgttgataacaggtacacttgataggtgatgaatggcacctatcaaggtgatgaaatggcactgttacaaagtgtaatccttggttgggtgcgtggctcatgcctgcaatcccagcattttgggaggccaaggtgggcagatcacttgaggcaggagttcatggccagtctggccaacatggtgaaaccccgtctctactaaaaatacaaaattagcctggcatggtggcgcacacccataatcccaactactcaggtgctgaggtagggaatcgctggaatccaggaggcagaggctgcagtgagccaagatcacatcactgcactcagcctgggcaacacagtgagactctttgtggtcttcatccccaaaacacattactcagttaatcatgagaaaaacatcagacaaatcccaaatgagggacattctattcctcaaaacttcaaggtcataaaaaacaagaaaaatctgggaaactgatacagcctaaggagacacatatataatgattaaatgccatgtggtatcctggatgagaccctagaacagaaaaacaaggaattaggggaaaactgaggaactctgaataaagtatggactttagttaacaataatgtgtacattagttcattgtgacaaatgtattatactaatgcaagatgttaataaaggcagaaataggtatggggtacatagtaaatctctgtactgtctttgggataattctgtaaatctgtactgtcctgaaataaaaaagtgtattttaaaaatgctattgagttaaaaatgagtgataaacaagcttaggtgactatataaatattcaggtattttgttttccaaaggattttcaaactatttaaagttccttaccacttatagaaccccaaattgtaaactgtatttgatgaattttgttcttcatagaatagttagatgatggaaaatttcttttagaggaaactcgctgataggcttggctctgtgtccccatccaaatctcatcttgtagctcccataattcccatgtgtatgagagggaccctttgggagatgattgaatcatggggcgggtctttcctgtgctgctccatgatagtgaatgagtctcatgtgatctgatagttttaaaaacgggggtttctctgcaaagctctctttttgcctgcttccatccacataagatgtgacttgctcctctttaccttcgccatgattgtgaggcctccccagccaggtggaactgtaagcccaattaaacctctttctatgtaaattgcccagcctcgggtttgtctttatcagcagtgtgaaaatggactaatccctgaccctattattaagtttcagcaaataaatatatgttgtatttgaaacccagaaaagcatagtcagtttaattagaattgtctcatcaattataaaatattttctatttataaatatttttctaagcatttcttagaaaattcatttcctgtcttatttcctcttttagcaaactattagttgcagtaccaaggttatgatttttccatttattcttctgcatatttaaatatgtcatcgtgttttattttaaatttgtttttagaacttaatagtactttacagtatatttcataatttaaatcttctgataaaaatataatttatagcctcatgatttttaaaaaaggcttttgtcaccactactaaaatcagaatgagggaaattctctcacatgtaaatgaaggattaagttagcgataaaggaatttcctcaccataaaagctgttatccactagaaaaagcaacttaaaattgtgagatttcttcttgtgatgtatggatttaacaggaatatgcctgaagattttacttgtaaaatacacagcaataccaaagtaaaagctttttacataagagcagtttcagatagtctttcctcccaaacattaaatagttttctaacagaatttaaaaaaaaaaaactttggaaaagaaaggttagagtatatacattaccacttttgcataatagtcttaaaaagaaactctttacaatacctagtgaaaattactaccatccaaagctgcaacataagctatgttcatgacatccctgttccctccaacacccaatgcccagtacacataggtggccacactgtggccagccccagtcttctctagggcttcccagatgtaccacatactcctaacatcctctctcaatatgtcacctgttccagatctcgactttcatgtaagacaatctctctcaagccatatacatcaacttcaactcttacttccttctcttttataatttgccctattacatcaaaaaatgtgccctgggaaagttggtcctctatagctttctcactcacatggccctcaagaaggaagttctaagaaagcttgaagttttgtctgttttcttcacagttgtaattcaagacttaggagtatgcctggtactcagtagaaattcactaactccttattgtaccacttaacagaatgctctctcatgacaggtctacaaccatttgagtcttcaacgactccctaccaagtcttcatgattggttatgatttcctttaaatttcaggttcagcaattacaacagcttactctgcaatgaatggaaaaatctaagaaaatattcaatacccaccaagtattagcagtagaatgtagttaacaaaaactttattttcctgaataggatatgattctggtctacagataatgaggtgttggtatatttccatattgtgctttaaaatcctatggtccaacattcattcatatttagatacaacaaacagtatctaccaaatgccagactcattccactgagcattcaatctactcagccacgctggtgaaaagagaaatagcctagctcaataccagacacatatcttaaggacacacatcttcaagttttagaaagcagcaaaaatgtgaatcaaccgtgaagggcaataaaactgaagtcttatttaaaataaaatagaactaatttatattacagatcttgtgagttgtgggtttcatacccaaatgtgacaaatgttctgctgtaagtactataaaagttttggatcctaagttttagctcaatacttcaaatgtccaacaatatttaaaaacaattgcacagtagcggacacaccagtttagaatacacattccattactttggtcattacaccagtcagcctcaatgaagtgtggaaacaaaagtcagggaatgcaggggaaaagtctcaaagcattaggttcagttttccagaccaaggtaacatcttagcagagtacctaccaagggctacatggcaaaatggactcatttaaatttaattccttttcctaaaccttatgcatattttagtgaggggctaattagcaacaaagaggaagaaaaaggaggagcaatgggacacatcaggaggaaatctatgaatcacaaactttctaactgacctctttttaaaaatagaggtagcagccggtgcggtggctcatgcctgtaatcccagcactttgggaggccgaggcgggcgaaacacagatcaggagttcaagaccagcctggccaacatggtgaaaccccatctctactaaaaatcaaaaaattagctgggcatggtggcaggtgcctgtaatcccagctacttgggaggctgagcaggagaatcgcttgaacctgggaagcagaggttgcagtgagctaagatcacaccatttactccagcctgggcaacagcatgatattccatgtcaaataaacaaattaattaaattaattaaattaaattaaaatagaggtagctgtgatataatgcttatttttcaaataatttttcattgcttttgatatctgaaacgtcagtaaaaatgctatgctatgacctagatcagtagctacaattaacatcagaagaactatactagtagaataaaagttgatgagctactgttgaagcacaaaaataaatcttgtcaaaacaaagcaaagttcctgtcaatcttcaaaagaatgtttgggggaagggaggaagtgtccaagatttaagatacataggaagttgcaattaatttatccaagtttttatattcagtcataccagattacagtcttgtaattttgatggacttttaatatatctgatattgttaaatctgaattttttaaatattggacaaatgaaatggtttagatactcaaaaaatatccacattattgttcttgtttgaaacttttctaaagccatccttcccttgatccaagactcttccctgaactgttgataaatatgttttcaatgtgtcaagcttttgtgagcaccaacttggataatggagtcatgaaatgaagagtgagcctactctcaatagctcacaatttttagtaggaaggagtgccataaaaccagtaactgaagcaaggacagtggtgttactgcttccatcatccttcatgaaggggtaaattttctgaactaaaaggagagcagggtggttgatacacttgaacccagctaataaaagatttgggcattttctttggtcatgcatttaaaggcattgattttacattgcaaatgcaattttacttactttcgctggaatccattcagaactcctctcagctaagagagttgttcctaaacaacttctgccattattttaaaaataatatttcccatccacaaaaaaggaaaagaaaagaaaaatgctgaagtttccaaagtggtgagtaacagtaaatcctgagttggggtagggagggagccgtggaatagggcctattcatagagaagagacacattaattaaaaatccacctaaaaggagccagtgaattaatcgaattgggtggtatgggtttttgttgtgtacttgataatgcaaagacgctttccatagcccatctaactaatacagcgtggtgggaagcaggctttgaagacacaataacattccccagcgagcttcaagctggaggctaaagcaccagccattcatttttccatcttgagacaattcttcacccagttcaaaggcccaagaaacaacaagcctgtacactttctgaaggtcgcctctgtagggacttgtgagggactaaaggctcaggctgcaaaatatttttaaagaccagttttaggaatgtaaccttttttattggactgcagtttccactcccttgccctcctcctacccctaaatacacacacacacacacacacacacacacacacacacacacacgtttgggaaaagggagttttaattatactcttggtaacttccagggtactctacaaatggaaataaatatttttagaaattaatttattacctattcttttaaaaatgtaatattaatattccttacctaaccagaaggaatgggattcgctttgaaaggaagttattgtttagctgtggttcaagagtatgctggaattgggaaggggggcagagggagctagtaagggtgggttaggggggggactggagctgccaagatcacaatataaataccaccacgttcaactttcagtctctcctcttggctcccctccatgacatattttatacagtgtcttgttttgttttgttctgtaactcaggaacatttacggtatttgagattctggtaaaagcaaaatgtaaatagtagctgatggagagctgggtgaagagttaactaaagtactgcctttgctttgagtaggatgtggcaaccatttgcatttgctttccaataatcagcaactttgtgttacccaaatctagatttatgtcaggcagcgaaagccctttcaaaccatttcaaagtctctgactccatttaggcccttgtctccacctccccagacaaaatgcccagcgccctgcaccagttctcatgtggctcagttgttgtgtaagtggggacaagcagtaagtcattggtgaagagacagtgggaagatatccctggctctgcgttcccttccagtaccatatttgctttcaagtcctatgtgagccacctgagactgttacaaagtgtaatccttggttgggtgctgtggctcatgcctggaatcccagcatttgggaggccaaggtgggcagatcacttgaggtcaggagttcatggccagcttggccacatggtgaaaccccgtctctactaaaaatacaaaaattagcctggcatggtggcgcacaccataatcccagctactcaggtgctaaggtaggagaatcgctggaatccaggaggtggagctgcagcgagccaagatcacaccactgcatgccagcctgggcaacacagtgagactgttcccaaaacaaaacaaaacaaagtgtaatcctctaacctagttcatagtagacatctagacaaatagtatattttcaccatccaccaatggcactaaaaatagagacaaccgcatctatactagaaacctcaatagtcatttttcaatgttttacttaggggtgagctttcagccttactcaactaataagaggtattcttaaggagatctaactcttaaaaagatgccatcaagactgaatctgcacttggcccacaaagcatgtaatataaaaatatgtgtttctcctttacaacctgaataatagaagtacattatgtattttctgaaatcatttcctgcccctacatttaggtagtgcccattattctacttcataacactctgcccttcctcttcctcatgccacatttgcagtagcatatttctttatttacttgtttatttttgccccctgtaaagtgccacaaagcagggacacacgtatttcagtctccactgcctggctcacagagaaaaactcaatgaatgttatttaagggaatataagtgtttgtgtttttccaaaaaaagtagtatgaaggaaatcctgatatttcacccaaaggtagaagtgttcactataaacatctaagaataattttattcaaatgttcaacatgcagttgataaacatttactaatgacaacaaaataactgcatttagatactatggtatcacagtaagtcaaaaaatacagattttctaatagtatctctattttaccccttgatgctgggtgtggctatgtgacttgctttaggcaatgggatagtagcaaatggatataagcagaggcttgaaaagtatttatgcactcattgcttccctgctcttgctgctggaacctgttcaataccacgtgaggactgggtcagtctgctggggacacgtggaccagtaatagcaagcaccaactgacagccagcatcatccactagatatgtgaggaagagcatccagacaactagcccccagtcaatcctccaactgactgaaccactgcattcaccctgatgaacaagcagaagaactgcccagctgaactcaacctaaattaccaacacacagaattgtgactagtaaatgattgatgttttaaagcactttatttggttgtggtttgttacatattgaagctaaatgatatatacacctgagaaactagatagcttcatatataaaactctttaacagtttttaaaaatttccttcatatggatgaatttcattcctccttactttaatctggaagaaactaacactactgctattactatactcttattggtaagtcaccaaaaaaacgatcaaaactgacgattctaattcaaatgtttttttttaatttttttatttttattttattttttatttttagatagagtttcgctcttgtctttcaggctagagtgcaagggtgtgatcttggccactgcaatctctgcctgtcaggttcaagtgattctcccgcctgagcctcccgagtagcgggattacaggcgcctgccaccacgtgcagctaatttttgtatttttagtagagacgggtttcgccatgatggccaggctggtctcgaactcctgacctcaggtgatccacccacctcgcctcccaaagtgctgggattacaggcatgagccaccatgcccagcctctaattcaaatttatctgttaccacattctcgaaagtttctattttgtagcaagagctaccccattctatcatcctcttcctggaccacaattagcaagaatagcagggtaccagtcataaatgtttttaccactagagaagctcctctttgcttcaaggtagaaattatctcagcaatacacactttcttaggagacagggtagattctccttattccattcctgtccagtgttaataactttggaaaaataagtgacaggacatcactagtgtaaataaatttcattaattagttgtatgtagtttatgtataaaataaattgctcccagaatttgaaatgttgaaagactattccaataaaagcattaattcttttgagcactgaaaaatatgagacattggtatccagaaagtcttcaaaagatccttaaccttaatacttaatcccattataccatattaagaactagttattcactcgtcttgggggaatgaatgcctaagtaccatgaaagtgaacaggaaaagaaaataaagtataaagatttaaattggtggtgtttaaaaacttaagacacttttctggccaggtgtggtgctcacacctgtaatcccagtactttgggaggctgaggcgggtggatcacttgaggtcagagtctgagaccagtttggccaacatggtgaaaccctgtctctactaaaaatacaaaaatagccaggtgtggtggcgcacgcctgtaatcccaactactcaggaggatgaggctggagatggcttgaacctgggaggcgaaggttgcagtgagccaagattgtgtcactgcactccagctgggtgacagagtgagactccgtctcaaaaagcaaacaaaaataaacaaataaataaaaagacacatttcttaatttgaacatttccaacttgaaaaaccagatcattttttaaccttgcttttcccctttcactgttatgctagattaatcactagaaacttttcttttttttattatatactttaagttttagggtacatgtgcacaatgtgcaggttagttacatatgtataatgtgccatgctggtgcgctgcacccattaactcgtcatttagcattaggtatatctccaatgctatccctcccccctccccctaccccacaacagtccccagagtgtgatgttcccctcctgcgtccatgtgatctcattgttcaattcccacctatgagtgagaacatgcggtgttggttttttgtccttgcgatagtttgctgagaatgatgatttccaatctcatccatgtcctacaaaggacatgcactcgtccttttttatggctgcatcgtattccatggtgtatatgaccacattttcttaatccagtctatcgttgttggacatttgggttggttccaagtctttctatcgtgaatagtgccgcagtaaacatacgtgtgcgtgtgtctttatagcagcatgattatagtcctttgggtatatacccagtaatgggacggctgggtcaaatggtatttgatcatagaaactttgtgaacctgaggattgaaaagagacgtggaaagtagtgtgtcctttttttccctttaaaagtaacaacaacaacaacaaaagagaacagtaagtctgtgatacaaggttattatctgctgtgcccctttaagtgctgaaatttgggatctgagcatattcttccataaagacttggagcagttgggcatttaaccaactttttattacaaagcttcaaaatttatagcagtctatctctggaaagataaacaaaacccagcagtgatggtggcctatgagaaactgggacaaaggtgggaggaagccttatttttcactctctaccttaaaaaaaaaaaaacaaaacaacaacaacaaaaaaaaaccaaaaaaaattggaaacttacagcatgtacatgtatccctatacaaaaatacagagaaaaaaatagtgtgaagagacccagcaagctattataaaattggtagtctaaaaaaaaaaaaaaaaacttttaaaacatgtttctgtaagagactaccaaaacttaaaaataaacgtgactgcatatcatcaaaacagagggagaaaaatctcaaaagaattatacttgcagccagaagcaagcaaggaaccacagttcaaagtgttggaccttttctcattaaaaataaaaaccacccacccaaaggaaaaaaaagaaaaaagtccttgaataacaagctaagatagcaagaaaagactttaaaatttattttgtagcccccactttccccccagtttcctaacactgaccaccccataacaagtccacattcaacccctcttcatttaacagtggatgcctcttcttctggttgctttcactgggactaaagatccaaagcaaagatatctttttcctgctttttgtcaatattatgtttgcaagcttaatatccaaaaatgggccattctccaaatgagagttccttcctgattatttagtatgctgatggtattgtcagacaggaagcatggttagaaagattcagaaaaatacaaacctttaagctagatgggcacttttgcccttaggtttatgaaaaatgccaacttttgtgaactacacaatcggaatcttgatttggtttcccggataacttatgtcataagaaatttggtaactcctttggtgatctcctctcagtacatttttccctccatttccatgaatctaccttcatcccctttcaataaaaggtgtactattggaacatgataggtgctcaatagagcttactgagtaaaagaaggggaggggaagaacagaaaaaatggcttagggcctatttgacaaaagcagataatttatgttagggttgagaaagggtggtgggcttgaatagtattaaagacaattaaagatcttctgatcttctgattgtcccacaacccctaaaactcaagggtaaacataattatttttcatatccatagagccctccaataatttttaagtgaatagggacatgatgattggagaagattagataaattatagttgctacttagcaattactcaatattccagtggcctttaactaactgctaaatgtttataaagtcttttattattttgctagctcacttagatcatatccttcctaaaagtaaaaatcatgctttctgtgcaaaacataatttgtttgccacattacatatattcaaaaaaaaaaacgtcctttgatcatttcaacaaacgtgagaaaacttctcaagattaagtgatattgttcagcatatgacctaaatatgtcagggaggatcagagaacatgcattaaagtattctttggtcaaaataaaagtggagtgcaaggatacatatgtaatatgcaatatttataaaacttgggatgtaaaaaggaatacaatgaatgcaatccaactcagcttactcaataaaacattcctggtaagtaataaaaccacaaaatctctactctgctttaagaaaactgcaactagaatcatagttgacccatgtattcaactctactgccattatcaatggaaaatacagaaaaagggtcaaaagccttttcaacataaatacatctttttcaaagctctattattcaaagatcactggctcctgaataagcacaaataacatttatccaaccaaatttatttcaacaaatagattatagcgagcctgctgcaagaatactattaaaatggaaagtgttccttttatcatacatgacagtccttatacttgtccaatccatcttctccctttttgtgaattaagaatgggagaggtactccatttccaaagtataagacaaaaatagaagcaaatagatgatacttactaacctatctcttaaaaagctttacaataaatttttgtaactatgtcatattagtttgaaattagtatgaattattatatcatactaacgttaaaatgtaattttaagttaaaattcaatatgattacctttctgaacatgtttcaataacattttaaagacagctctcaaagtctgctgcatagcttggactaataaggtaacgaaggaataaatcagttacataattataaatgtggtagaggcggatctattattttacatgcaaaaaaatactagtatgaaaaaaagttacaggatctttatgtgaaactggcttcaagcatgattcacaagaagctattttccttgaatacaatttccataactttgtaacatgaggaaataattgaggaaatggctttctttaaaacaaaacaaaacttaaaactgtgaaatgttccaatatactaaattaccaacccatcaaaataaaaggaacctttatatactattcagctaagacacatatctgattatagtgagaggattggaaaagcatagtccgtggagtttcttaagaggcaacagactattttaatgacttgtgaaatccacatgagggacaaaaaaggtcggagcttctgaatatattggcaactcaacagtcaagataacacgggttggaaaagcagtgttggctcaactaactaatcaaaaaccctaaagcacaaaaaattggacaacactaattttgccagcaagagaaatattgagttgtttcatacacctaagagaaaaaataaagctaaagaaaaaattgtggaaggcctcctatagtccccagttggcttctcaatttccttaccattcacttaaatggctgtctcactgaagaacactgatggtacaaatggacacattatccacaaacacaccacccctgaaaaagaggtgatttccaacaggatgcattgttaatttccacagtgtgcactggttaaagcttactctatagtgtggggaggggtgggtgtttctgagagctgaccttaggatgtaggaactagcaggtgccttgcattcccacacaattttatttttaaaaaggcggaaggaagaggagcataattcagtctagagatggttccaaaacttaggctggtcgatcaggagggtttgtcttagggtttgttaaaactcgaaaatgccccttgaagcaagaaaagttaatgtcaggcctgaatcaaacaatgttttccttccaggcccagtctgtccataaagaatgtctgatccaaaggctagaaatggacagaacaggctatttcatgctttatcatgaccctgtcaacagcttcttcggaaagaatcctcattgcaactgaccattaaagagtatcagtcattttctccacaacattcctatgtttagagctgcaaaggagttagaataatttagaacaaaatcctcaagttactgatgaagaaataggtccagagaaataagtgacttgcccaaggtcactctgctagtgaagggcacaggctgtgttggagcccaaatctctggctcccaagaactgctttttccattgcatcatttaagatagcacaaagctatttcctggaattgtgatttaaaaaaaaaaaaaaggtggcatgccctttggatcccaagtccttcctgtagggcaatgctggagatagtatttattgagggggaactcagagaaatgactcaatatatgcaacattttatggatttatttttactataaaaagatacctaaacaattgcaacattaagcaaattattagctgctcaaacttttctggaacaacagagaaactctctccactgctcagtagcagttttgggtcataacatttgcacctgcttggtacgtttccacctggatgtttcacttggcccctcagaaaaagcgctgccctgggatcttatgattcagtgatgaagagggatgttggctggtgagaaatgcttatttgagagggaaggaggaggaggagaaatactcccatagcacttttctttcttattttccttattttagaaaggccaaatctgaacaattttccatcccatgtagtaatatatctcacataattttggttactggagggtacacaaacaaatctagcaagctttcaaaatcgatgtgcccagcctaaattgacgggctgtcactggactgtcaatgatggaaaaatgaatctgtgtctgagaacgccacagcatttcctccaagctttaaggaacacactacccaaacccttgtcacaccgggttctcaggatctgcaagctgagtcccgtctttcatttcgctgtgagctccctcacagcccaggaggatgcgttttcccactcttacctagctctggtgctttgcagtaaagtgtatggagcctagggcactttcaagcaaaggaattccccctccccccatgacccaaaacgatggcatccgcagcactcgcaggtcctctccctcccttggttgaggggggcgggcaggaatcgcgggccaaccccacctggccccaggcccgcagccacgtgcgggactccctcctgctcgcggatctcgagaccggaagacgaggaacgtggcctcgtagtaaaccgtagtaaagagagaagggaaacaaaatggggctcgcacatggttacggcctggatttttctcaattaaaaataagagcaagtgtgtgtttccggccccgtccgtgggctggttggactttttcattcttaggattctgatccaaatgcaagaaacagctgagggcacaacgtcctcagtcggcgggcgcggtgcagagggggcctgcggctcgcctgcgggcacccgcgggaaagaggtgccaggcagggtggcagaaagcggcccagggagcccgcccgccaccaccgccaggggacccgcggagagccccgccccgcgcccgccgcggtcagccgtttcacatgctgattggctgtggtgggggccaatcagcgcccaaccgccccgccgcccgggacccagagccgcgcggctgtgcccgagggcggggcctcgcccgccagcgcgaccacgcggcccgggaaggggccccaccgccctggatgacccgagacgggcgggggcggagacccgagggcggtctggctgcagattcccccaccccgggcgaaagggggctcggaaagggaggagaaggaatgcaggaagcggaggtgacccggaaaagggaaagtgccagggccagagggtttgcgccagccaaaaaggccacagggctggggaaaggggagggaggggaggcaccttggaggtacggaatccttgacatcacaaaaaaggaaactgaatgaaaaagaaatgaaagagtctttttctgttttttttctttttcttttttcttttaaagggggagggcataaaaagaatgacaaaaacaaaaaaactgaacccaaaaggcatggctggggtctgtgtcttttcagctgcagtttcaaaactaaaagataaatttgatgccaggtaaaggtggcagggctgtatgaccgagtctgagaggctctttttgccctgcttcttgggctctcaatttactctctcagagagtgggccacaagtactgcgaaattctgaaaaggagcaaaagaaaaaaaggatatgtcaggaacatgaaataagaggtggaaacaaagggatggcaggggatagtactagaaacgagcaagccagaactaagaggctatgcaagagaaagggcaggcagaaaaggtcactggctacaggtaaagcagacaggcttccaacaagtagagctcctgagctcagtgcttcacaatgttctcctcttaacagacaatgaaaaattttaaacaagccgagatgtttcaacagagccacgcctcatcatacctctattcctttcaccgagtctcaggttttacctgagaaatgagaaaagaagcaaagacagcaattgctgaggaagtgaggaaaataatgtttgcacacacatcggagcagaagctgtttgccactcacaggtctgacttctgtctgtttcagatagctataaataacatctttggactcaacagggcacaggcaagcaagcagaattgaggatgtaaatggccaggtagcatttggtgcctcactttaaacaccaacacaaacatctcaaatacgcatttagaattttcctggcactgtgcaaagcatggtcgattgttactccagaattattagaaaaggattatatgattattccagaatattttattttcccaaagaaggttaaggatagaatttgtagagtttttgtttttttaatgcatccaacacataggagaattttattttaaagcccttttaaaaatgaaaattctagttggtcatcaattctcttcagagcaaacatcatttatttactctataaaaagaaacctaaacaaattaagatgacaagtaagaaaaacttattctcttatctcctttaaaaccaaaattttagttctgctgggctggttttcttcaaattctcattttttaccaatgaggcactttataatacaaatgcttaaagtgttgagggattctgactccaaaaacatcatttgatataacaagatttgtactactgatgttgatatacacaattaaattttcttctagtgaatgatgaaaataaatgttgaagtaaatactgatcaaataaatgcttttgtaacatatcacccaaaatcttcatttgagtgttcatatacctttttcttgttctataaatagagaattatatggatcaaatattggaaacagaattaagaagactatgaacacatataaataaatacctgtcaataggaaaccagggcacagattaatttcttatgaatggacaaaattaagaaaaatcagtgcttttaaaagctcattctgtggagcatagataaaattcacagataatcagtttgtcagagtaaagtgtttccaaatgctggaaacttctgcattgccaatcatcacattatttgcaaactgtactctcttctacccacaattatgaccaccagaaaacggatcaacagaacgaagggcaggctaatttcctattacaaatgtttttcatttttaataggcattagccacagaagacctaaagccaactttcagcatttactgtggtgtctacttttaacttaaaggcacacagcaaataaccctaaaagtggagggtatacagtttagcccttctctcaatgcaaaacaaaacaaattaaggcatgttcctgacttagtatgcattcttctcaaaaataaaagtaattttacagaagatatatagtagcccccaaatgatatctgtaatgtctagtgcaagaagagataactataaggcagacatcctaggatgaactcccataactcttaaaatgggtcccagacacatacagagtttcctgcatatcctgtacaagagaggccaggccctgggatggtgggtcggtgtgtgaataatatttcacaaatcctggtacatgaacaaaagggaacgtcacccataattactttcttgagagatcacaaaatagataggtacttctctctaatacatatttctaaaaagctcttactcctgatctttttagggcaggatgaatagaaatcatgcttcccgctgctgtttatgttgccctagtattatgaaatcacagaacaaaagtacaagaacaacttgataagatcacccttaagggctcccagaaactattaagatagtttaagaaaggaagggtttagcccctgtgttaacaaatattttttgtagaactgtcccttccagggctgacctaaatatatagtgaaaagaaaacttcaacaaacaaatcaagcttcttacggagaactctacaaaacgcagaactggcataggatatatgttttaaaaatactgcagtaactattcacttgggaattctcaaacgaaaaagccctcctgtggctgctcctacatgtttgtttactctctgccagatgtcagtgtggggtgagcatcttgtgtgccctgagaatgtaagtgcttctccctgaggaagcagtgggaaagaacaggaaggggcagaggcgaagaacagaattcaggacaaggttaaaagcagttttgtcttctgactttgtcaccatgaaacgcacctgctggatgtccagttgagctactgacggtcctctggctgcttctggaaactgatgctggcatagcgcttaaatcctcacttgagcggcgggtggagctgctctcaccgctgcccaggggttgtgagggggtgggggtgggggaggctgcggttcaggggtgcactcctgagggcactgtttaagtccttgaccaaatccaggtctatgtagttaagaccattctccaaacccccagcagcccacacagtttggctggctccttgggggctcccccaagctccccaggcctcagccacacttctcaaaggaagcagagctgtggcgtttcacatcctcgctgctgctgctgctaccgccccgccccctactgctgcccccgctccaaagggcactgtgttgcccacccgggtggcactggtgttgaggagaaagtctcggagctatgcctccgccggcacccttgtgggtctgcacgatcactttggcactctggttgcggttaggactgaggttcacccgggtgaaggcgctcatcccccaggtccttgtgggccccccagcagggacgagtgggcagccagctctgctgcccctgaggcccagtcggggaagcagaggctgctgaggatgaggaggcagcagccatggtggcctgggcaggctcacctcctctgcagcaatgcctgttcgcatgtcagcatagcttacagggcagctggcgaggtgtccacgtagctctgacggggacaactcatctgcatggtcatgtatcaccccggctgctgggcactgcccgggtaggcctgcaaatgctagcagccccgggagggcagggcccagtctgcccatctcgaccccagtgctctcctgccaggctgccctccggccggccccaggtccatcttcatgtactcctcagtgccagtctcttcctctctgggagctggtggagctgggatggacacctgacagaaggtgagctgtggaaagccaccgggccagacaatagccagactgatcactcccaaattcaatattgacatattcccccgggctcttgggctcggagggtgcagcaagggctgctgctgctgctgctgctctcgggcccgaggtaaggtgctgccttgggatcccccagggacagcctcgtgggccgggccaggcggctattggtctgagcgctgtgtccacctttcgaggcagatggggctgcagaacctgatggtggggatgtggaagctgggctccagcctagccccgcagtatcccccacccaggctgtcgctgctggtggaagagaagaatcatctgctgttgcagcatagagaaggcgaccagagctagtggaaaggcggagtgctgatgccgggcaccctcctccggctccccggggcgctgggtgtgcttaaaggatctggcaatgagtagtaggagaggactggcttgtgctgggggtcctcagggccgtagtagcatcggaggggctgctggtgttggagtcccccactggtgacatgttcatgtagtcacctgtcaaggtaagagcttaccaccgctgctctccactgggggtttggggtgaggcaagacatggagtggtggccccctaccccgtttgtccacagctttccatagctggtcccggaagggacgcgttgctgctgctgctgctgctgctggggccacctccaatgtcaggagagcagccaccctgggggacatcatcatgtagccattggggtccactctctggggatggcgtctgatgggttgatgatctgctgtggggcagatacgctcttggggctcatgggcatatagtctccactccctttcggccactgggcactggggccacccctggggacatgggcatgtagccatcatcgtgtggagggtggagctgtctgggcggtggtgccccccccgacgctccaaggggtgcattccagaccctcctctgggtaggagcgggtgggcacgaaggcggagtgcctgtgtcccggagtcggcctccactgccacctcctggtgggtaggcaggcatcatctctgtgtactcctcatggaagccactgaggactgggacggggtcttctggtgggtaatggtaggggatgtgccgccgagtgagttctctttcggaaccgattatccagatctgcagcactggctgcttcatcccagccaaggctggactcgtgcccaagcctgttcctggggtgcagcggtggccattgccccccgagacaaaatgtagtgaccgttgggggcggtcagggtggagggccccttgccaccatgcagatatagttgcttagctcctcctcaccgcgggctggtggggtgtggcccagggatccggagtgacactgcggaaggaactccggaaatcgcagggactggagccatactcatcgaggagatgaaaccgccatcgctgggggaaccagacaccgaagcactagatcgccgtggaagagacaatccgaggtggagccatggccactggtgctactggacgacagactgaccggctggtggccgaaggcgagcagcgggaagccggcatggggatggagcggctgtggttgagggggggtgcagccgggcgctgccccgatgccggtgggcgtgggttctgttggtgctgggctcacagggctgccgtccaccgaggctgggcgggacatggtgccttcgccgtcactggagcgcggacacggaaggagcctggcttcccgcccaccatgctggccggggaggtggcggtatgctctcagtgcgtgatcggcgggtcagccccacctggctgggcgggggattgttgagtggtgccggcgcagggggacgctgatggggttagagcagttggacgaggactggctcttctgcgagggcggaactcatcactcatggcccgcatggcctccaggatggtctcgtgcatttctgggccaccacagagtcatccacctgcatccagaactccccgggccccgtcacggcgaacggcccacctcgatgaagaagaagttttccgagtggccacagcgcctgatgttcatagctgcagcaccacggccgctgcctccgagttcagcttcacgaagctgatggtcttgctgtcaggcaaaggcggtagataccaatcaggttctttgtctgacccaggcccttgggcttaggatcacttgccagacctctttgaatgcgggtcctgggggcacgtcaccgtagctcaatcctccccagcctcaccaaggccggagctgccgctgcagctgcccccaccacctcccgcccgagggccgcagctccgtcgtggtggcccttagcacggttgtgcagctgtaggagagctggtaccagctgtcttgctcggcctcgctgtccgccgcgatggcaaagtgctcgtcccggtgtagagagccaccaggtgcttgttcttggagtcagcccgcttgttgatgttgaagcactctcaagggggatcgagcgtttgggggcgctcgacttgtgccgccacttcttctcgtttcgtagtactcgaggcgcgccgggcccccagcctcgctggccgcgcgcagtacgaagaacgtttgtgcatgctcttgggtttgcgcaggtagcccaccttgcgcacgtccgagaagcctcgctctccggagggctcgccatgctgccaccgccaccaccaacgctgagcagagggagctccgaaaaacaaccgggtggggggcggaggctcctcgccgcggcccggcacatgcaaaagggctggaggcagcagaaaccccgactctgaaatccacgccgccccccgcgccggggagggcagctgaaggaggacgcagctgctgagcccaggagagagcccgaccggagttttcggcgcttcacgcccggcggggaggcagtgcgtccggggtgagggcagccccgatcctccggagccaagtctcctctcagccgccgccgccaccaggaaggagcgaagatgcatctctcgcgccccggctggagtccggcacagggaggcgacagtcgggggtccctgcggtgcccctcaggagcgcgcgcgcgcgcgcgccttccctcctgagttcccctctggaagcagcgattccgaggcaaattaaatatccttgggcagggggaggcgggttgccaagtcccaacgttgcacgggttctccctcctccttcgcctcctcccaccccccaaccgtcccagccgccaccagcccccaaataccagctcagtcgcagagaccgcggcgctgcggctgttgctgttgctgctgcgctgctgctgctgctgccgccgcccgcgggcgcgtcctctgcagcccccatccgggccctctcggcgggtggagaaagtggcttttccatgcgaaacgataccgggcagccactgcagtggggaccggccggagggacagactcatccctgcccctcgctccaggcggctggggaggggggaggggacaagggcgagaggggatgggggaggtttgggaagggttcggggaagacgctgttcctcgggaggcgctgccgctgcagttacttctcccctcctccctcctcctcctctcctcggagagttgccgagagccccaaccaaaacaagcggcggcgtctggctctgcgcgcggccccctccgaccgcgccgccgtctcactcggaggagaaaaacacgtgacggagcctcgcgctcggcagccgggcagccgccgccgggaggctcccgcccgggtctctacattccggccgagcccgccccgcgcccgcccctctccgccccccagccgtgctgcagcggcgcccggccgaccccggcgcagcgctaggacagcgcccctgcgcggccgccagctccggcgcagccctccctacacgcgcgccaaccggggcgcccccggcccgcaggaatccccgcggcgggccaggcgggggtgtttgggtggctacccgaaagcacgaggggagtctgggaaaacgggaggggcgagctcgggaagacgcaggagtgagggtggggggccacgggggggcactgcggctcagagccccgagtgggaggccggggggaggcgggggcgccggagctgggctgcctcttactatcaggtaagactgacccacgggagggaggtttctagtcaaggctgtttcccccaggaatttaaaagctagatttcggcttcagggcgataggccatggtgaggggatctgtatttttaaggtttttctaaaggacttctgggccagccttccaccttgggatccccagatttgcgccgtgaggtacctggaaggaacagagggacgcccaagggcagtgactgggggcagttaggtcactacaaaaggagaacagggatccccaggaagtgtctcacgtccggcgctgtggattagttgctgatcaagtagggagaaaatgtaaatatcaccttttctcctgctccccttgccatccgtgtgacggggggactcacacctaaggctgagggcatgggggaggggaaatgaaggtcccttatcatattccgaagtctatccgtgactttaaaaagctgttagggaccttcgagggttcataaggccaaaaccctactgtgcaaatattggctgaaatgtttgtttcacaacagctcccacacccattgaaccaccctataagtttttaaccttgaccacaaggataacgggagaaaacaaggatggtgccagctcaactgtacaggaaaatggttacttcatgagtgaccagatcagcagcctgggtctacttgaagcgcccctttcagggtcaccttgcggtatcgtctccccacaaacaaacgctccccagagtttttttattttttaagccgacctataaacagcagtttgtccctgcttgctcgcctggcactaaggacccacagagatgtcactcggttaatgctgtctcattttgatgcctggcccgtttggggttgccgcccctttactacgccggaccctcctcggcctcaggctcccaggcactgcaggatgctggctgggcactcagcagtcaggcgctgggcatgctcagtggctgggacccggcgggccgcgggggagcgcgcctcggccaatgcggctgaggggcggagcgagtttcccggggaggcctgctgattggtgggatggctgtttttcaagccttgcactgcagagggaaggtgggggtagaagggttgagggtaccaagtaggttgcaaagcgtagtaaaaaaagaaaaagaagatgatgatgatgaaggagaaaaaaaccataggcgccattcaggggtgtgcgatacgtaaattagggggattgggcatctgcaaggggctcctccccacccaagcctgggagcctctcgtttctcctctccccttcctgttccggtcgtcatgcagcctcatctaaacctggttaatctataatttgagtacacatgttgattgaaagccctcccttcttttcctctgacagcttggtgatgtgggcacacgtgcccactcagcaaggctattaatagcagatatttggaaatggaagcgaggcggcactcacagtgacgaaattctgggggtatagagtgccttacagggggtagggcagggaggtgcagaataaagagcctgaagttggtggaaaagtgtaactgtgtgcctggttttaccctagacaagaaaaagagagattataaaagggttgtttactagtaacaatgtaatccagataaggccaaagggctttcacaggtttgatgtttagcgctgggatgggggtagtggagtaattaacattttgtagacaacaaatcaaatccatggacatttacttttcaaatggccctgtccctacctccgtcctccaccccccaccccccaaaaaaagctaaataaaggtactgtacctctatgggggaaaatactcttttctggaaggaggggagggttggaaaatttatttgcacgtacctcacaatttcttcataggaaggattttgatcataaaaagctaattatgataataaaccttttaaaaatatatctctcagtgttaaagcatttctgctttaaaaaacacaatttcagttgctaaatatcgataaaaattatgaaataagcctcactgctgtgacaaattatgttcagaccaatgggttcctatggaagataatcactgatcataggatattagtgccattttttctacttgctgagttttactaccaatttaaaggtggttaatatttgttataattatactacagtaaattcattgttctctacaattgttttattaatgggctaactggaaattcatttacatttggttcagtaatatatagaatagaaagagacgcgtttgtgggaactcactgaagtaatgctgagcagtatgggtattattctgtcacctaagctaaattagtcttttggtgtattgtaatgaaatcactgtatgaaaaatttactccccactgaaaattcacggaacagaagaacaagctattacaaaatctgttgctcaatgctgccatctataggagagttagagccgatttgtgtaatatctaaggttcattttaaaagagggctaaaatagtgatttcatcacaacattgcaacagctcgttgatgtcactaatacagtcctaattcaaggagttaagggtttacatgctatggacgactttggggcaataggtctacaactagctttaaaattgagttattggtttatgtatgatctatcaggaaaataatgcaaaatttatagattattacatatatctgtaaagtgcttgagtgggtggatgtaaaactaaacatttcaaaattataaaacactttttgtatcaaaacatagttttccttaagatgtatgggtcataactggaggagctatttaaatactggcgtctcttgaattaattttggcaatttagaacagtgcttgaaggacaattgaatgtggattttctcatttaagatctgtttttattttaagatggctcaatagtaataagcatttgaatgcttacttgcaaggcaatatgaaatagataaaaagacagcttcttacagctttgatggggtaataaagagtacaaaataacaatagttgatgactaaaatgtgtgtgtgtgtgtgtgtgtgtgtggagagagagagagagatgtcaaataacaagtggtatttactttcatgatggatgaaatactacttaatttttacagaagagaggagccttaagcttgaacttgaaatgggctataactagataaatggcaattattttttcccactcaagttttttggaacacctacttgtgttaggactaggctggacactgaggatttagatatcaaagacatgctgcccacaggaaacttacacgaaaatggcagatgaacacaattgcagagcactatgatctcttttgtggaaaaaatagcacagggcaaatgagatcacataacaaccaactgccttctgacataaacattatcagttcagacagtgcaatttgggaatctgaaaggtgcctcttcccttaaaaactttgttttctctgtaattaaaatctttcatctgttttatttaaaaatatataaaataggccaattaaaaggagctgaaaagtcacacttggcttgtaaatcggctagatcagggcttctcaaacccgagatcttgttataatgcaggttctggttaaatgcagaaggtcaagggcagtctgaggcagtcatttttaacatactctaggtgatgctgattctgctgggtaagtagcatagttctaatgctgatgattaattgaaagacaataatttggtgctgtgacatgcaagcaaggcacttatatttagtattatatacatatacagagagaacaacagcaagaaaaattctacttaactgagcttcattgtatttgggcttctctcttttcaatcacaggcatcaaatctttctggtaagctgaagagttattatcaaacagttgtgttagtgttttccaaggtgtgattgaaaatggagtttcttacctcatcccagtcctgctaaaccaaaatctcttagggaaggatgggccccccgcattcacagtttaagcagcattacaggagattattatttacatcaaaatttaagaatcttggcttaaacacaaagaaaaaaatgtaattttattcttccagaattggcaaatgcacaccttaaccagtcaacaaagatcttcacctgtgggctgtttactacagctgggtggagcagcaatgacccaaacctgcatgagtctcccaatatgaattgattttcctttgaagaatataattactggcaatcagctagtgagaatccagttctgctctcatcttgatttcatccctctctcttctagagaactgagggaaaataaatgcaccaagaactaacatgggattttggaagacagtaatgccctcaacagatgatttcaaaacatttgctgtttgaggagcaaataaagatgaaataaacaggtggatgaggttggaagaaaggagggaggtgaaaactccatgccacgtttaattctttcacttcagaaattctactgattgattggtgatttggggagtggtgaaagaatccataactgatatttgtctaaaaaacttggtcctggtccaggcatagtagcttagcttgtaatctccgcaatttgggaggcagaagcagaaagatccttgagcccaggagttcagtttgcagtgagctatgatcatgccaccgcactatagcctgggtgacagagtgagacttgtctctaaaaataaataaaaagacaactagctttttcttttttaattttcttgatttcttaactattatattctcattttcttgtttgataagaatcaggggtctgccagtcaatttttatcttagacaatgccactaatgtttttggtcatttaatccagagaaagaacccccagtgttttgtttgtttgtttgtttgttttgttttgttttgaggcagagtcttattctcaccaggctggagtgcagtggcgccgtctcggctcactgcaacctccacctcccaggttgaagaattcttctgcctcagtctcctgagtagctgggattacaggcatgccctaccacgcccagtaatttttgtatttttagtagatacggagtttcaccatgttggccaggctagtcttgacccctgacctcaggtaatccacccgccttggcctcccaaagtgctgggattataggcgttgccaccacacccaaccactgtttctcatatttgaagagccaagtgttatatctagatagcatatgcttagaaagatttgcagactttacaacaccttttgctggttttgcccccttcttatcttaaatttgtctttttggtgcagtgcactctaaactttctaaatttaaatttattttaaaatctaaaatttgatagcccaaaaatgtcttcacagtaatccctcaacttcattgtttattttttaatgtgaatttc

SEQ ID NO: 5032 - DNA, 57303 bp, Homo sapiens
  misc_feature (6648)..(6704): n is a, c, g, or t
ggatgggccctgcagtcattgctcaggattattgtaatgattcaatgagaatgcaagtgatatgcaaaagtagctcacaaactaaagagaaattgcaaagtataattatttgttatggaagccctgttccctggaccaacaacactcgagtgctgattcaaaagtgctgggacgccaactttccccacttcattactttaccttccggcgagggaaatgaatctttctttaccttacagtaaccagaaagaggtcactgtttgagacccataaactcactgcatatttgctattgagaacacataaaagagagggacccagaagttgtaaattcccccttttgaccttggggtttggagattctcacaacagtaataccatttattgggaagcagtataatcacctgcctggggtgaatgctggcctcaacccttagtacttgtgcaatctatctacagacttaacctttcttggttcattgtccccagctgtaaagtggtgataatattaggttggcgcaaaagcaattgaatttttgtcattaaaagtaatggcaaaaaccgcaattgcttttgcatcaaactaataaaacagtaccacctcctagggttgttgagagccttcagtgatgtagcatatgaaaagcactagaaaagtactcggagggcacctggtaagtatttaataaatgatggggccaggcgcagggctcacgcctgtaatcccagcactttgggaggccgaggtgggcggatcatgaggtcagaatttaagaccaccctggccaacatggtgaatccccgtctctactaaaaatacaaaaatggccaggtgcagtgatgggtgcctgtaatcccagctactcaggaggctgaggcaggagattgcttctcgggaggcggaggttgccgtaagctgagatcgcgccactgcactccagcctggcaacacagcaagattccatctcggaaaaaaaaaagatggttatattattatgaagctttgctgtgtgttagccctgtgctaagcagtttatatgggttaatctttacaaagcccttgagttagaactgttaatattcccattttatggatgaggaaactgaggcctggagggattactaacttgctcaaaattgcggaatttgtggtagaaccaagatttgaaccttcatctcttgactttagaatctatgttgtctactactaagttagtgtgtcttgtataccagatggattttcccttctttcctttatatcagggctgtccagacttttggcttccctgggctacactgaagaaggattgtcttgggccacacataaaatacatgaacattaacaacagctgatgagtaagaaaaaagaaatcgcaagtaatctcatgttttaaggaagtttacgaatttgtgttggccacattcaaagccatcctgggccatgcaagtctcaggttggacaagcttgctttatagaaagccgtgagaaagtggtaagatggcgggagtgggagagatgagatgtaaaaggtaaattttagttaacctctagagaaacatcctatgagcacattaacatatatcccaaaagctgatggcttcatgatcaaagataccttgcggacagaccttttccatagtgaattgcattagtggaggggctagagcccaggcccctggaggctaagggagcttgcgatgtggctggcagtttcaaggccagagcatagtgaagtgttctaattcaacacttcttaaaatgaaggctgcttttgccacccacagtcatttgttttctttcttcactcaccattcttttccttaaaaaggttaaaagctgcctttatgatcacagccaggacttgagtgaaaaggcagaattccaccttgaggaccccagagggacagcagttgcccagaagagctggctttttggagtataatgtgctgtttactgtatgaatgcccaagtcaagcgtttgcctgaccggtggctgcccgcccttactgcagcggacgctgagatgttgatttgacatgcaggaagtcgaggcccttcaactgctgcaactaacttgatgcccaccgatggaatgctttgttcctacagtctgcgcgggggaatcgggacttctgttatcactcagccaaaggcgggggtggggccctaaaaaaacaaacgggcttaaggttcttccctaccagtatgacttttcatttgcacgcagccccaggacactgcctacttgctctattctggtactctgattcttaatatcaaggccttttggaaaaatttagctccacagccctgcatctgcacagccctgcatctgcacaccccagcctccattattgaaatctttggtgtgccaaggcataagattagttttttccacctttattttcttgtctaatcttgttgctttttttttttttcgagacagagtctcgctgtgttgcccaggctgcagtgcatggcgtgatctctgctcattgcaacctctgcctccatggttcaagcaattcttttgcttagcctcccaagtagctgggactacaggcgtgcgccaccacgcccagctaatttttgtattttagtagagacaggttttcaccatgttggccaggctggtctcaaactcctgacctcaatgatctgcccgcctcagcctcccaaagtgctaggattataggcatgagccaccatgttcgccccttgtggcttttttacaaacaagaaaactgaagcttaaggggctacgtgacttgccaaggtcaactggctggtcgatggaacccaagtctgtctgctccaggtccagtgctttgcctctgcctaacctcctcctcctattcccccctacttcctctctgtcctttccacagcttcatcctgaactcccctctggtacatccccactccctactgtgtgtggttagcagcattctcaacctctgttgatgttttgggccagataattctttgtcataggggcctgtctgcatttatagatttttttttttttttttgagacggagtttcgctcctgttgcccaggttggaggcaatggcatgatctcccctcaccgcaacctctgcctcctgggttcaagcaattctcctcctcagcctcccaagtagctgggattacaggtgcccaccaccatacccggctcattttttatttttagtagagacgggggtttcaccacattggccatgctggtcttgaactcctgactcaggtgatccgcccacctgggcctcccaaagtgctgggattacaggcgtgtaatcctgatagaattatacacgttatagagtctttagcagcatccctagcttctacccaccagatgcggtaagcaccgccaagcaggacaaccaaaaatgtctccaaacattgctaaatgtcctcgggggacaaaatatccccagttgagatccttattagccttatcctttttcttcaccatgtaccccatgaaggggatctgtgtaccggggagtcccatcacatggagtggaattaaacactttgctgttcaatccagctagagttcaccaaaagggtgcctacagctgtgctgagccttcatactactgaagttcctcaggctgtgttgtccaggatctgagtgagaaaaaccctcccccttctcagagttctcaggccagaaaggatggagtgggggcaggggcacctgggtctttagtgcttcctggggaagaatcctctaccctgcatttgtagagagacccgaagagacagagcactgggcttggagcaaggccttcctgtgaggtctagagacactgcacctcccaactgacctcacttggcttccgcaggaaatcctgcatctttttttttttttttttttttttttagacaaggtctcatcctgtcaccatggctggagtgcagtggtgagatcatggctcactgagcctcaacctcccgggctcaagtgatcctcccacatcatgctcccaagtagctgagagacaggtgtccaccaccatgcctggctaacttttgtaaatttcttttctgtagagacaggttttgccatgttccccgggctggtctcaaaactgctgtgctcaaaggatccacctgcctagtctctcaaagtgctgatattacaggcatgagccaccgcgcccagcccaatcctgcatttttctagagcagctgattaccatagcatgtggagggagagggccaggcctcagttgagatctggtgaaagctgtgatcccttaccccagaaacgtacattatacctgtagcatcaggattcacagaacccaaaagccatccatccatccatccatccatccgtctgtccgtccatcatccatccatccatgcattgcaggctaggaagttttaccttatgcttgcacttactcttgggttgagatggagagggaaagttctagagctctctccctgcttttggagggcatggcacacacctttttatcctggccctaagccctaggctaggccaaggaattataatgtgagacaggatgtacatcaaggagatgagctgagagagaaaagctggaccaggtacagagtatagaagaggggtgacaatttcgagctgactccttctctgtttcagcccagcctgagggcaggtccagctgagggaaggaagaggagaagaaaggaagggggagagatgagccatgcgctgcgccccctccttccccagctgcgagcagagcagcccagcgggttggatgaatgctgggagggggagagtgaccctggcagaaccctttgttccagctgaggctggagcagggcactgagcattcacacgccatcccagggcatcctgctgggcacgctggggagggggcacagcagctgtcatgggacttggccaggcagatagctcgatgctcaatagggaagcccagctgcgtgcgctgaagccgggggagaggctgcatctgccagccttcctcaaggctgtggcctgtgccaagacaggaaggccctggcaggtcccagttactctgccctgaggtggcctgggggactcaagcagcccaccctgcttcctgctcccctgtgtggattccttatcctaaagaggctccagattttaattccaccattagttcttgccctccctggccaacatcccagggtctggtccaaacagaggcagagcgtccatatctcaacctagttttagtgagaaggctatggaggcctctaacatcaccctttctgtcccttgttcctcttcttcaaaagcaccaaacctctgagtggctcatttttttttggagggggttgtttctttttttcttttttgagacaaggtcttgctctttgcacctgctggagtgcagtggtgtgatcatagctcactgcagccttgacctcccaggtcaagcaatcctcccacctcagcctcccaagtagctgggactacaggcacatgccactacctcagctaattttttagttttttgtagaaacaaggtctcactatgttgcccacgatggcttgaacttctgagctcaatcaatcctcccatctcagcccctcaaagtgctgtgatatagtatgagccactgtgcctagcctaggtggcatcatctgtttctgggcccttagaggtgcatgcaaaaaagccctgtcatagagcgggtcacctggactctttgtaagcccaaagtcagcggtatctgctgggtcgtttatgccctggaggaggcatggttttactgcctgcatctccttgaagtgtcactgtgactctccaggtgacagtgcccctggactaggctcctctactttccctcggaatgggcttgggttgagtgggagctgagccctcactgattccttttccctcccccaggcctggccagcagccccgagtgtgcttgtggtcggagccacttcacatgtgcaggagtgctcttggagagtgtacctgcatccctgcccagtggcagtgtgatggagacaatgctgcggggaccacagcgatgaggatggatgtagtaagtacctccccagaggcagtgggagtggtggagagggacctgggggtggggggcaaggacaaggctgatggagtattttctgctcaactgtgtcggactcagagagttggtcttttgcaagcttgatagatattgacatttggtagtttcttctctatatatggctccaactctcctgtgtttcttttggttggttcatgctatatgtccaagaaaacaaacttgacaacacgtgtaagagaacacaacagggagtttcttaaataggtctctctgtatttatgtgaatatgtttgtgtatatgtaccgcatatttgtggttttaaaatttatatactatacacaaatgtggattatttctatgtttcttattttggtttttgtacaataaaaccttttttttttttttttttgatacagagtctcattctgtttccaggctggagtgcaggggcacagtctaggctcactgcaacctccacctcccaggttcaaggattctcctgcctcagcctcctgagtagctgggactacaggcatgtgccaccatgcccactaattttttgtatttttagtagagatgaggtttcaacannnnnnnnnnnnnnnnnnnnnnnnnnnnnnnnnnnnnnnnnnnnnnnnnnnnnnnnnagaccatcctggctaatacgctaaaccctgtctctattaaaaatacaaaaaaattagccgggcgtggtggcaggcacctgagtcccagctacttgggaggctgaggcaggagaatggtgtaaacccgggagacagagcttcagtgagccgagatcgcgccactgcactccagattgggcgacagagcgagactccgtctaaaaaaaaaaaacttatattttccttaagtctcccttttcccctagcatggtaacatctcacagttggccagggtgacctgtcttggatatatagaaatatccctgctaagccaatagctggattagaggcgcaatctctgacctacctgtagcatctatgtctgagggtggctaatagtctaatgggaacggaggtacaacctggacctcattaaccctaaccagttcagctaatgtgttgatgataaatgcttcactttcatgtagcattttcataggcattatatcaaaaggctctatgaactgagtataattatccccattgtacagccaaaaagacttcagctcagagaggtaaatgacttgctcagagtgttacgtaatgaactggaaattgagcccgggtgtgtcatcatcatttaacaagaggaaaggaggggaaaaaggcgcttctttctcttgctcatgttttcttatgttttcttagctcctgtgagttctttgggttgttcttcccctaccctgtgaaccctcaccacaattaccttttgaatctctgtcttagctgcagtttctgcttagcttctcctcagctggggatgggcctaggagtcagtaaggaaggactataaaacagacaagggggctggtgtggtggctcacgcctgtaatcccaacagtttgggaggccaaggcaggtggatctctgaggccaggagttcgagactggcctggccaacatggcgaaaacccacctctactaaaatacacacaaaaaaaaagatagccgggtgtggcggcgggcacctgtaacaccagctactcggaggctgaggcatgagaattccttgaacccaggaggcggtggttgcagtgagccgagacataccactgcactccagcctgggtgacagagtcagactctgtttcaaaaaaaaaaaaaggccaggcgccatggctcatgcctgtaatcccagcactttgggaggctgaggcaggcagtcacctgaggtcgggggtttgagaccagcctggccaacacgacaaaaccctgtctctacaaaaatgcaaaaaacaaaaacaaaaaccaaaaaaacctagccaggtgtggtgaagcatgctgtaatcccagctacttgggaggctgagtcagaatcgcctgaaccaggaggcagaggtgcagtgagccaagattgcgccactgtactccaacctgggtgacagagtaagactcggtccaaaaaaagaaaaaaagacaaggggatttggagcaaaaggctatctggcctagttgagctgagtaagaataccaggttgattgacttttcttttcttttcctgggattcagtactaccacctgttcccctcttgactttcactgtgacaatggcaagtgcatccgccgctcctgggttgtgacggggacaacgactgtgaggatgactcggatgagcaggactgtcgtgagtgttgcagaggctgggcggaactccattgagttccactgggaaaggattttcaatcagaaagcatgccccaggtccacatgagcccttgtgttttcagcactttgtcctgtcctttcacttccctcgaagtcagataagctgctgagaggcagccacctccttcggagccctcagggcagcatggagctacttgactgctccggagggctttaagtcaggcttccaggcaccagacccccatgcctgcagcagcctgactgctctgtgcccacagccccccgggagtgtgaggaggacgatttccctgccagaatggctactgcatccggagtctgtggcactgcgatggtgacaatgatgtggcgacaacagcgatgagcagtgtggtgggtgaccccaacgggggaaggcaggcaagtggccagtgggtggcctggccatgggagaagatagcagcaatggccctagcactgccaacctccaactgcccagatatctggagcagctagaggaacgcagagggggcagagccgctagaccccccagaaactgtggaccaggaggctgaggcccagtctctccagggcctccgtttccctggagagtctgcactgactctggggtgcctttcgggggctaggtcagacccgccaagccagtgaggttgggagtcagagaggagggtgagagggttgcctgtggggccccctcaaactgctgtcccatcgcatccccccagacatgcgcaagtgctccgacaaggagttccgcgtagtgacggaagctgcattgctgagcattggtactgcgacggtgacaccgactgcaaaatggctccgatgaggagaactgtcgtgagtggccccagacctcaggctgttgggttggagagggcagacagttctgcccattggctaagggcgaggctgaggagtgcatgtaccaaggcaaggagcatgggtgcctcagcagcagctcctcctaggctgagctagggagggagcaagtccccaggtgggaagggaaggcttcctttggtccacctgaatatgggcgtctataagggtgtcccagatgaaacctggttacatctcacttgaagaagctctcctgcctgagcatcctcctgcttgaggaatcagggcccctctccttcatccaggcctgagtgtgtgcccctcccccccctgccttccctccagcctcagcagtgccagcgcccccctgcaacctggaggagttcagtgtgcctatggacgctgcatcctcgacatctaccactgcgatggcgacgatgactgtgagactggtcagacgagtctgactgctgtgagtactctggccagctgggaggtggggagccaggctgggaagaactgcttgggtggcaaggcacagtcgccagctggggcaggagttcgagaggagtttctggattttctggtccctcttgggaagagatggaggaactgggattctgggctgtggccttctagtctgccatgggacactgcacagactggctagagacagaagtctgtgtttccctagcctcccaccagccctgccgctctggggagttcatgtgtgacagtggctgtgcatcaatgcaggctggcgctgcgatggtgacgcggactgtgatgaccagtctgagagcgcaactgcagtgagtggggaaatggaattaggttgggcttgaactaaggagaaggttgtggagccaaagaggccactaccggctgggcgcggtggctcatgcttataatgccagactttgggagaccaaggtgggtggattgcttgaggtcaggagttcaagaccagcctgggaacatggttaaaccccatctctactaaaaatacaaaacttagctgggtgtggtggcgcagcctgtaatcccagctactcgggaggctgaggcaggagaatcgcttgaacctaggaggcgaggttgcagtgacccgagacggcgtccctgtagcagagtgagatgacatctcaaaaaaaagacaatccgggaggtgagggggcgcctctgcctggccgcccctactgggaagtgagggcccctctgcccggccagccgccccatccaggagggaggtgggggggtcagccccccgccggtcagccaccccgtccgggagggaggtgggggggtcagccccccgcccggccagccgcccgtccgggagggaggttggggggtcagccccccgcccggccagccgccccgtccgggggtgaggggcgcctctgcccggccgcccctactgggaagtgaggagcccctctgccaggcaccaccccgtctgggaggtgtacccaacagctcattgagaacgggccatgatgacaatgcggttttgtggaatagaaaggagggaaaggtggggaaaagattgagaaatcggatggtgccgtgtctgtgtagaaagaagtatacatgggagacttttcattttgttctgtactaagaaaattcttctgccttgggatcctgttgatctgtgaccttacccccaaccctgtgctcttgaaacatgtgctgtgtccactcagggttaaatggattaagggcggtgcaagatgtgcttgttaaacagatgcttgaaggccgcatgctcgttaagagtcatcaccactccctaatctaagtacccagggacacaaacactgcggaaggccgcagggtcctctgcctaggaaaaccaagacctttgttcacttgtttatctgctgaccttccctccactattgtcctatgaccctgcaaatccccctctgcgagaaacacccaagaatgataataaaaaaattaaaaaataaaaaaaataaaaataaaaaaataaaaagaaaaaaaaaaaaagacaaacaggccactacccataatcttgaagacactgggtaagaccaccaccatgtacagttgtgtaggttgtgcactgtgagaggcaatatgtccaaagggaagccagtcacataatagatttatatactcatcatggcgttttccagcagatggcagtaaagtgtcttgaggaaaggatacttttttctgattcacaaaagacactatatagaccagctgtgatcccggtgtcaagagtggcatgggtactgatatagctgcagatttgggtggcagggagaatttcaggctgaaatggggcccacctttcattagcctttgctttgcccagccacctccatgtgtacggcagaacagttccgctgtcactcagccgctgtgtccgcctgtcctggcgctgtgatggggaggacgactgtgcagacaacagcgtgaagagaactgtgagaatacaggtggtgtctcccggggtgccccagaacccttagccttagttggggtggaagggtggaaaagagggtgctttggtatctttccagttgggttgaggtttaccagtgtaaaatccaggtgcatcattgacctgcggccttatggcctggagcacagatcagagctgcgagtttcaattgccactcctattctaactcacacacagccagtgccttagctctggtctagtgaggaaggactaccctccatctggcagcccccatgtgtgctccccggccacacccagtattgagcatgtggttgcactttttcattctgttccatattcctcacatcccactgtggagtcctggggagaaagcaaatgcagacattcagccagccctgtctgactgcttcctgcccaggaccctcaccctcccaccttgagtttcatctgtctccagcttacctagaaaatgacaggctcccatctctttgttggcccaagccctgccttgctatgacctgccctccatctctctaggaagcccccaatgtgccttggaccagttcctgtgttggaatggcgctgcattgggcagaggaagctgtgcaacggggtcaacgactgtggtgacaacagcgagaaagcccacagcagaattgccgtgagtgtccccagtgggcggacctggcccatggttttggccgaaccccacccatagggttcaaagggaatcctccctcaggactcttgcagctttggagctgttctttgtggtccaggtggaatgccaagttggctctctgggggaggattctggctcaactcccaactctggcttggctggcacagggccccggacgggtgaggagaactgcatgttaacaacggtggctgtgcccagaagtgccagatggtgcggggggcagtgcagtgtcctgccacacaggctaccggctcacagaggatgggcacacgtgccaaggtgagctggggctggtttgcagcagagtcggggttctgagcaggggcagcagacaggcagctgtgtttccatgggtcaggcatttgaacggtgtgacctcatttcgtcctcacaataaccctaggaggtgggatcatccttcccatttcacagatggggagactgaagcacagagaggataagtagctaccaaaggccacacagctggcgagtagcagagttgggattccagcccaggtctgcatgacttaaagcccttaaccatttcttcttttttattttttatttttatttttttgagatggacctcgctctgtcgcccaggctggagtgcagtggtgcgatctcggctcactgcagcctcccctcctgggttcaagccattctcctgcctcagcctcttgagtagctgggactacaggtggcgccaccacgcccggccgcccttaaccatttcttagacagccttcccactaggcctggaagtagatggggatgtgggcagaaaagcagctcggcagcctgggagcgggagtgggaggcgacagaagggagatctcttgacctgcctggtgttcccagatgtgaatgaatgtgccgagaggggtattgcagccagggctgcaccaacagcgaaggggctttccaatgctggtgtgaacaggctatgaactacggcccgaccggcgcagctgcaaggctctgggtaagggctgttgcacttggctgggtgggcagagggccgagcatggaggaaggccaggtactctggtgctcaggatttgcagagaggtagagagatttctgtcacagtaaaatgcagcaacagttgcattcgagccccaagaaaaatgctgctggggtggagtggggtggggaggggtggaggaatatagttaaaggttgccactcttctggtactgatgctgacagcttggggcatgtccttgtgagcagtggctccatcggtcagctgaagacctgctgatgggtaccaggggcggctctgaaaccagtgggtatcccatgtttatactgtttcccagggccagagcctgtgctgctgttcgccatcgcatcgacatccggcaggtgctgccacaccgctctgagtacacactgctgcttaacacctggagaatgccattgcccttgatttccaccaccgccgcgagcttgtcttctggtcagtgtcaccctggaccggatcctccgtgccaacctcaacggcagcaacgtggaggaggttggtctactgggctggagagcccaggtagggaacaaggccccatggagaggggcagagccagccacatgcgcagcaacggtgggaggaataggccagtggtttgcaaaccttaggcagcagacatctttttcttccagggaaatcttagttggagccctaatatagaaagcatttgttatgtatatcaattttataggttcaaatataacatttgctcatgattgagctcaatcagtggaataatgagaccacgttggtggttgtgatcatgggaatcagatttatggatgacagagtctccatcagcctttgcatctagtttatttctgagttttgtttcgattgcttagtattagaatattctgattgacctggataagtatatcaaaatgttttatagattgttaaaaaaacggccaggcacggtggctcacgcctgtaatcccagcactttgggaggctgaggtgggcagtcacctgaggttgggagtttgagaccagcctgaccaacatggagaaaccccatctctacaaaaatacaaaagttagccggacgtggtggcgcatgcctgtaatcccagctacttgggaactgaggcaggagaattgcttgaactcaggaagtggaggttgcggtgagccgagatcacccattgtacttcagcctaggcaaaactccgtctcaaaaaaaaaaaaaaaatagttcaaggtggtggcttacgcctgtaatcccagcactttgggaggctgaagcaggcggatcacgtgggtcaggagtttgagaccagcctggccaacatggcaaaaccccatctctattaaaaataaaaaattagccaggcatggtggcaaatgcctgtaatcccagctacttgggaggctgaggaggagaaactcttgaacccaggaggtggaggttgcagtgacccgagactgcaccactgcctccagcctgcgcaatgggagtgagactccatctcgaaacaaacaaacaaaaaaccacaaaacagctcacttgtcaatctcaggctattttacaaataggtgaagtggtcaaattctatttggtatcaagcacattggactcaaatgcctagggaatttctgaaatgcctctgcaaaccccagatgacaatttacaaacccctgggtcagtgcagtgggggaccctgggaatgcgtagggagacagaattcagaaagtgatgtatggttgactgtgaggagcaagtgcatgccctggacagttacttaactcttttgtgcctcaatttcctcatcctcatggaaattacagtattagctcacagagttgtgatgcttaaatgaattcatgtatctgaagtgatgacaatagtgctggcccaaaaaattgcttcctgtaagagtttgctcctattactatgggacatgggggctgggttgactccttgacattttttgctgctgcttctcaccagggggcctggctgtggatgggtccatgacaaactctactggaccgactcaggcacctcgaggattgaggtggccaattggacggggcccaccggaaggtgttgctgtggcagaacctggagaagccccgggccattccttgcatcccatggaggggtaagttgtatctcaggctcccgaactttcttgcaacctccgggacagctcccaggctacctggactagacattctgggagtacatcctcaaagtgtgggtagctgggcgcggtggctcacgcctgtaatcccagcactttgggaggccaaggcgggcgatcacctgaggtcagtaattcgagaccagcctggccaacatggggaaaccccatctctcaaaatacaaaaattagccaggcatggtggcgggtgcttgtaatcccagctactcgggagttgaggcaggagagttgtttgaacccaggaggcacaggttacagtgagctgagattgcccactgcactccagcctgggagaaagagcaagactctgtctcgaaaaaaaaaaaaaaaaagtatgatgttaataacatgggctctgtcccccacacacttgagtctaggtcctggctcgtaataactggctgtgtggccttgggccagttaatctctgtctgccttgtttactcattctaaattggtgattaaaaaaaaatacctccatcatagttgtatgaagattaaatgaggtatgcattttaaattgcatataacacacattagataagttgtaggtgtttcgtatttttatattagctcataaggttgacctaattaatacaaattaatagttattagtaattcataagattgtaattaattattatagcctaaaaattaatagaggggccgggcacagtggctcacactataattccagcacttttggagaccaaggaaggaggatcacttgagtccaggagttcagatcagcctgggcaacatagtgtggcctcatctctacaaaaatgttttctaaattagccggcatagtggcacatgcctgtagtcccagctacgtgggaggctgaggtgcaaggatggctgagactgggaggtcgaggttgcagggaaccgtgattgcaacagtgacctccagcctggtgacagagtaagaccctgtctcaaaaaaagttaaataaataaaattgagaaatctggtcggttcagtggctcatgcctataatctcagcactttgggatgctgaggtgggcagattgctgagcccaggagttcaagaccagcttgggcaacatggcaaaaccccatctctataaaaatacaaaaattagctggacttattgatgcatgcctgtagtcccaactacacaggaggctgggtaggaggatcacctgagccctggagttcgaggctgcagtgagccatgattatggcacgcactcctggatgacagagtgagactctgtctcaaaaaaaattaaatttaaaattcagaatctgaattaaagaaaaactcctgaaatgaagttctcacctctggcttttaaaaattcttgcaatcaatggagggagtatcttataaggtcctacagtatgtatcaactgttttagaactgtgtgtgtgtatgtgtgtgtgtctgtgtgtgtgtgtgtgtgtgtgtgtgtgtgtataaatacaaaaggagccgggcatggtgactcaagcttgtaaccccagcactttgggaggccaggcaggtggatcacttggggtcaggagtttgagaccagcctggccaacatggtgaaacccatctctactaaaaatacaaaaattagctgggcatggtggcgggtgcctgtaattccactacttgggaggctgaggcaggagaatcacttgggtccaggaggtggaggttgcagtgactgaaatcgtgccactgcattccagcctgggcaacagagcgagtctcaaaaataaaagaaataaaatacaaaaggcagtggaagagattgtgacaaagaagaaagtgcctgtcctaatttacattatattgtcaattctgtgagacttttgtctgttttgttcactgctagatttccgtgcctaagatagtatgtcctgcctgttgccagtatgaaaaaaaaaattattaaatgaaaaatgccctgtctaaagacatttaaactcagacacttaaaaagcattctgaggctgggctggtgactcatgcctataatcccagtactttgaaaggacaaagcaggaggattgcttgactcaggagtttgagaccagcttgggtaacatagcaagacctcatctctactacaaaaaaaattagttaggtgtagcgatactagctgctcagaaggctgaagtgggaggccttctgagccaggagattgaggccgcagtgagctgtaatctcacctgccctccagcctgggtgacaaatgagaccccgtctaaaaaaaaaattcattctgtggaccaaacattggagtcccctgagtaaatggataaaagcgccctacctgattattctcctggttacctacctgttttctgctgccacttcccaatttacttttctcttcctagtaccatttactggacagactggggcaacacccccgtattgaggcctccagcatggatggctctggacgccgcatcattgccgataccctctcttctggcccaatggcctcaccatcgactatgccgggcgccgtatgtactgggtggtgctaagcaccatgtcatcgagagggccaatctggatgggagtcaccgtaaggctgtcatagccagggtgagccccttccttcagtctccttcatctcttgtcctcctgcccccgtcctgccccccaggagccttggtagaggttttgtgtagttgccaggcctgggcccaggggactggcagaccacatccagactgaggtcttcctggactttccccaggcctcccgcatccctcgccatcacagtgtttgaagacagcctgtactggacagactggcacaccaagagcatcatagcgctaacaaatttacggggaagaaccaggaaatcattcgcaacaaactccacttcctatggacatccacaccttgcacccccagcgccaacctgcaggtaaaaaactgcccaccggtgagccaaagtagcctcgtggttgaggtggcctctggtgcctctgagaaccttccttcccttagagttgccatttcttctgatggggaaatccagcagggcactgacatgggctaatcctccctctgctggacattcggggcagtacaacaagattcacgaaaagattcattagactcaccgttcccatctaattcaggcagacatttacagggcatctcctctgtgccgggtaccactgtgctagcagcaggggcagatgtcaaaaatataagacatagtttctcccttcaggaactatcaccctacctaaacccctattccctagtcttggggtcacttttgcagaccttcctgatcctcttgccctgggctctttgagcagggaaaaaccgctgtggggacaacaacggggctgcacgcacctgtgtctgcccagtggccagaactacacctgtgcctgccccactggttccgcaagatcagcagccacgcctgtgcccagagtaagtgggtctgcaacaccagcctcatggaggctgttgtgaggatggggagaaggaacaagggataggacgtggagggattgctgtcatgggaaaaaccacattcctcagggagccctggagaggaagaacttaagaggctggggatcttctatcaaagctgaggactgaggacccagcactagtggctgaaggctcagcataccgcccggtcgagtgtgaacacctgcagtgaggctcatgtatcattttaccaggcagattgccttctctataggcagcaagagggttttatgctcttctagaaaacaggggaatgattcctacctttttacctttagcgtcaccctgttgaagactttctttcggcccttaaaccggaagccaaaattagaatctctgatgatgttctgtgtaagcgggtcctggataaatatggttaaacaagtggaagatcatgggatcttccctggtctgtccctgaactgctactttggttcctttgggctccttaggagttattgttttgagagggtaaccctggagagcccagcaccgatgactttttctaagaatagtccagagaggagcggtccgggcatatggcacgaccagagggcacctggggtgattcctcacacatcagcagctgttcttgtttactgctgtgtacccactgaccctctgaaatctgggtaaaataaaattctcctgggacctgggtcctttctaggagtgtggttagggaaaacattcaaaagtttcattcatacacatattaactaagaacctatttcattctctgagttttccccttgcattcttttttttttttttttttttttttttttttttgagacagttttgctcttgtccaggctggagtacaatggcacagtctcggctcacccaacctccacttcccaggttcaagctattctcctgccttagcttcctgaatagctgggatacaagcatgcgccaccacacctggctaattttgtatttttagtagggacggggtttctcatgttggtctggctggtctcgaactcctgacctcaggtgatccacccacctcagcctccaaagtgctggcattacaggcatgagccactgtgcctggcattttttttttttttgtcccctcccgggttcaagtgcttctcctgcctcagcctcctgagtagcggggattataagtggcactaccacacccagctaatttttgtatttttagtagagatgaggtttcaccatgttgtcaggctggtcttgaactcctgacctcatgacctgcccgcctctgccttccaaagtgttggattacaggcataagccaccgcccccggccttttttttttttttttttttttttttttgagacagggtcttgctctgtcacctaggctggagtgcagtgttgtaaacagtgctcactcagcttcgacttcctgggcttaagcaagcctcccgccccagccccctaagtagctgggatacaggcatacactatcacacctggcgaattttgtggagttttttgtttgtttgttttgttttgagacagagtctcactctgtcacccaggctggagtgtggcggcatgatctcggctattgtaacctccacctccctggttcaagcgattcttctgctttgggctcccaagtagctggattacaggcacctgccaccatgcctggctaatttttgtatttttagtagagatgaggttcactatgttggccaggctggtctcaaactcctgatctcgtgatctatccacctcagctcccaaagtgctgggattacaggcgtgagccactgtgcccagtgaattttgtatttttatagagacggggttccactatgttgctcaggctggtctcaaactcctgagcccaagcaataccccacctcagcccctcaaagtgctgggattacaggcatgagccaccatgcctggcccttcctcttgcattcttttgtgtccagcgcttcccctgttgtcttagtgagatgcaagaataaagccccctgtcccctgacagcttccccttaaggatttcccagccctaggaagaagaatttggcaacattagtcaggaagtgcctttctggatagaaaagtctactgagaaagtatcagactgaccagaggaaaggcagaggatggggaagagctggctggaagtaaactatgtaaggactggccagagctctttctctggagtcagatctgagtcccagctctggtgctttgtgccatgggatcctgggcaagtttcttgatctctattagcctcagggttgctcgtctagaaatgggaataagaataacacacgacagaggcttggtgtgagatcaaaaaagcaccaagccagtgcctggcaaggaaagtgctcagcttaagctactggcttaaagttgtaaagaggaggcaagaggaagggatccaggtgatggagtggaggggcaggagccctgacacagtcatgacatcagggaagtaggggtcaggggttggcagtgggcaagccaggacaccagaagaggtgagaaaagtaagaagagagaaaagttgagatgaagccgacagatgcttaaacagcatgcattctgggaccttagtagagtctgtttccatttgatttagaagtctgattctgctagcatgcagtgcttaaaagaagcctgaggtataaagtatagggggcaaagggcaccagatcccagaagtgtgattgaaccagatgtcacgcaggtgagcgtctgtgtctgtcactgttcttggtttagagcattaaaagaagacccctttcggcctttgatcaggtcttgacaagttcctgcttttgcccgaaggatggacatccgtcgaatcagctttgacacagaggacctgtctgatgtgtcatcccactggctgacgtgcgcagtgctgtggcccttgactgggactcccgggatgccacgtgtactggacagatgtcagcactgataccatcagcagggccaagtgggatggaaaggacaggaggtagggcccagcgtggggaggttgaagggtggaatccaccctctccagaaagggcttcccatacctttgccaaccttgagaattggtggagtttgggctccagaactaagtggaagtacagttggtgatacagctttgcttcctgcccaggtggtagtggataccagttggagagcccagctggcctggccattgattgggtcaccaacaaactgtactggacagagcaggtatgcataggggagccgtggcctgcctggctccctgggattcctcttgtttaaaccctggcctcagatagaaggagcccagtgtctctcctggaccacttctgtcttcacttcagtccttggtaggtcagaagccggagggctgctgcagagccgaagtgagaagctcccactgagaagctcacattgtggcagctgcttctgctgtgtagctgatgctggggagtgttttaggcatttcagatcatgaacctatgccttgttttctttccatcgctttctgggtaaatcggctttttttttttttttttttgaggcggagtcttgctctgtcgccaggctggagtgcatggtgcgatctcggctcactgcaagctccgcctcccgggttcatgccgttttctcctgctcagcctcccaagtagctgggactacaggcgtgcaccaccatgcccggctaagtttttgattttagtagagacggggtttcaccatgttggccaggatggtcttgatctcctgacctgtgatccacccgccttagcctcccaaagtgctgggattacaggtgtgagccaccgcgcctgccaaatcaggcatttttaattagccaggtgggtttgggaggcaaggggataccctgaaaagtgctactcagagcgtggttgctggaccacagaggctgatgacaaccttgcctcctcgcgtggcagcatcagcatcatctgggaagttgttggacatgcagattcttgggccccacctagacttactgaatcagggttgggcatggtggctcacacctataatcctagcgctttggggaccagggcaagatctcttgagcttaggagttcaagatcagcctgggaaatatagcagacccccacacgcatacacacatccccaatttttttttttaattagcctggtgtaatggacatgcctgtagtcccagctacttgggaggctgaagtgggaggattgcttgaatccggggttcaaggctgcagtgagccatgatcacaccactgcatgccaatctaggcaacagagcagagcctgtctccaaaaaacaaaagtcaagacttactgaatcagaatctttgggggttaggagcatgaaatggactagaatttttttttcttttttaaattttgagatggagtctcgcttgctgcccaggctggagtgcagcggcgcaatctcagctcactgcaacctccacctccctggttcaaaggattcttctgcctcagcctcccgagtagctgggattacaggcgtgcactacacacccagctaattttttttttttttttttttttttgagacggagtctcactctgtccccaggctggagtgctgtggcacgatctcggctcactgcaagctccacctcccaggttcagccattctcctgcctcagcctcccaagtagctgggactacaggtgcccgccacgacgccggctaattttttgtattttttagtagagacggggtttcaccatgttagccaggatggtccgatctcctaatctcgtgatccacccgcctcggcctcccaaaatgctgggattacaggttgagccactgcgcccagccaatttttgtatttttagtagagacggggttttaccatgttgtcaggctggtcttgaactcctgacctcatgatccacttgcctcggcctctcaaagtgcgggattacaggcgtgagccaccacgcccggctgaatatttttattttaaaaaaaatcttgggtgttaggttcagaaatctgtgttttaacaagctctcctgattcttacgcacactaagtttgagaatcatcgccttaaattatggttgcctatgtttgggaagtcttgctctttcagaaatccaactgatcacatccttgaatttcttcttgcagttcaagtcactaaatttccgtgtgcatctgtcacaaaatatcttttgagcccctactctgtgctctgctggcgcataccggctcttgtgttggccatggaaggtaagagggtgaatgaacaagactagaattaatctcgtatcccttcttgataggtacagaccggattgaagtagccaacacagatggcagcatgaaacagtactcatctgggagaaccttgatcgtcctcgggacatcgtggtggaacccatggcgggtgagtggctgccccttgggaatgagctccatccacccctcccaagatctgagctcagagaggagtctaaagattaggaagagtgaccagatcttatggatatgcccaaggaagcagagcagctgtagaaaccagaggctggttgccaagaccagctctgtcggggagaccctacccagtggtgctagaggaattaaagatacacacacagaactatagaggtgtgaagtaagaatcaggggtctcacagccttcagaactgagagcccccaacagagatttacccacatattattaacagcaagccagtcattagcattgtttctatagatattaactaaaagtatccctatgggaaatgaaggggtgggccgaattaaagaaataggttgggctagttaaatgcagcagagcatgtcctaaggcacagatagctcatgctattgtttatggcttaaaaatgcctttagcagttttcctgccctgggcaggccaggtgttccttgccctcattcgggtaaacccacaccttccagtgtgggcgttatggccatcatgaacatgtcacagtgctgcagagattttgctatggccagttttgggggccagtttatggccaaattttggggggcttgttcccaacagcggtgacaactttgtattctctgtggacaaggaaacttttcaattctttctttccttatctttttttattgttggtttacttgcaaaagtaactcattgttaaaaaaatttaaatctgtgaaagtaaaaattctctgtgatctcactctccagcaataagttaacagttcaggatattttttccaggttttcttctaaatgtatgtaaacatttgttgttggtggtgatggttttggtttacaaaaatagcatactttttgtgactttttttctgcttgcccttatatctagtgtactttccagttgagtgtatagatctaccttgtttttgttgttgtttgtttgttttgagacgggtcttgctctgtggcccaggatggagtgcagtggtgcaaatcacggctcactgcagctcaacctcctgggctcaagcaatcctcctgcctcagcctcccaagtagctgggactgcagcacagaccacaatgcctagctaatttttacagtttttttttgtagagatggggtcttgtatgttgtctaggctggtgtcaaacttctgagctaaagcaatcgtcctgcttcagcctccaaagtgttgggattacaggtgtgagccactgcacctggcctatgttgttcttactggtttatagagttctgttaacttatttaacccatccagtcaagaaacatttctctttttgttttttcttttttttttgaaacagagtctcacttgttgcccaggctggagtgcagtggcccgtcatggctcactgcagccttgacctcctggattcaaatgatcctcctatctcagcctccaagtagctgggaccacagatgtgcaccaccatatctggccctttttttttggtagagagggatcctactatgttgcccaggctggtctcaaacttctgggctcaagtgatactctcacctcccaaagtgctgagattataggcatgaaccatggcgcctggccaaggaaatgtttctattcattttcacccctcctctttctttattcccatgtacactttatttgtggagttttcttaagctgtgggctctgcttttattaagactctgtaccttttgatagtaatagaagacaggcattcagagatagtgctgagcccagagctgggctggacactgatgcaggaggctgagctgatgaggatctgcttcaggcagaaaccctgaaatcctaggtactctgagtccctgcggatattaactagcttgtaagacctgccttgccttgcctttgcccaggtacatgtattgactgactggggtgcgagccccaagattgaacgagctggcatggatgcctcaggccgccagtcattatctcttctaatctgacctggcctaatgggttagctattgattatgggtcccacgtctatactgggctgacgccggcatgaagacaattgaatttgctggactggatggcagaagaggaaggtaagggtggcagtaagaggaaggtaagggtggcactaaaacatcttccccagccttgacagcctccaggacagtactttttggctggcagctgattggagataaggggtctggaggttatgggaccagcatggggcatgtgctgtttctctgaggctgtaggtgctgccagagcttgggggcaggggtgggaaagggctgctggttgatgatgaaaagaaactaggacttgtgtggattgtgagctgggggtgtaaatgcacagaatttcctgttaaccagcacactaatgcttgttaaattaccagttgcactgtgggcctgtgattcatctctttttgttttgttttggtataatttcaaacttacagaaaagttgcaagaacaggtaaaaagaataaataaattttgccacatttgctttatcattctgtttctgtacacactcactattattttttggactgtctgaaattagagtggagacagcctgcccttgactccagactattcctgtgcacattcctaaaagcaaggatgttgtcttacatcaccacagtacaatgatcaaaatcaggaaattaaatttaacattgatccaatattactgtctttttttttttttttttttttttttggtttttagaggcagggtcatgctgtgtcacccaggctggagtgcagtggcacaatattgggcactgcaccctcgacctactaggatcctgagtagctgagactacacgcatgagccataagcctggctagtttttttctttttttttggtagagacttcctgtattacccaggctagtccaaacttctggcctcaaacgatccttctgcctcagcctcccaaagtgttgggattatagcacgagccaccatgcccggcccaatattactgtctaatcatagtccttgcccaatttcataccaattgcctcagtgatgtcctttatagctcctcccaccccactttttttctttgttatctaggatccaatcaggatcacccattgtgtttagtaattacgtctcttttaattttttttatttatttatttttagacactcactccgtggcccaggcaggagtgtagtgccacaacatggcccactgtaactgcgacctcctggcccaagggatcctcccacgtagctgggacccaggcacctactactgcaccctagctactcaggagcctacgggtttgaggccactcggcgattttttattttttgtagagatgggggtctcactttgttgtctaggctagtcttgaaccctaggctcaagcaatcctcctgctttgacctcccaaagtgttgggtttataggcatgaccaccacacatagcttttttttttttttttttgagactgcagtcttggtgtgttgcccagctgacctgggctcaggtgatcctcccatctgaggctcctgagtagctggagctgtgcgcaccgggcccaactaatctagtctctttactctctaatctggaacatttcctcagctttctgtgactttattgacatttgcattttttgtttgtttgttttgttttgagacaagagtctgctctgtcgcccagactggcgtgcaatggtgcgatctcagctcactgcaatctctgtccccgggttcaagcaattctcctgcctcagcctcccaagtagctgggattataggcacccctaccacgcccagctaatttttgtatttttagtagagacagggtttcgccatgttggccggctagtctcgaactcctgacctcaggtgatctgcccacctggacctcccaaagtggactttgcatttttaaagagtaaaggccagttattttttataatgtctctcaacttggattttctaatgtttccttgtgattggattcagagtgtgcatttgcagcaggaatactacactagtgaagtcatgtccttgagttctcagtgtgtctcatcagtagacacaggtgttggcctgtccgttattgtgatacttactgccattgtatggttaaggtagtgtccactgtaaagttgtattttttaattttgtacttaataagtaatttgtccagagatactttgagatgatgtgataatagatgacttccaacatcttccaataaaaccatcacacgacccttagagccaggcagatcaagtcacagattgatagagcaaggctcagagagattttataagtagctcttactgaggtcacccagtaggtgttagtgggagagctgctttctgagtccacagtgagctctttgcactgctctgtactgtcagactttgttgaagatgacacagtgttggggccctggcaggtctgattggaagccagctcccccacccatttgggctgaccctctatggagagcgcatctatggactgactggcagaccaagagcatacagagcgctgaccggctgacagggctggaccggagactctgcaggagaacctggaaaacctaatggacatccatgtcttccaccgccgccgcccccaggtgagcagcccttggctcgcattggcttctccgtggccctcctatgccctagtctccccattgaacatcccctcctctctacccagtgtctacaccatgtgctatggagaaggcggctgtagccacctgtgtcttaggtccccaaatccaagcggattcagctgtacctgcccacaggcatcaacctgctgtctgatggcaagacctgctcaccaggtgagtgaaagcacacagatctagatgcagcctctctgggagggggcaatggctctcttccttccttgcagagggctccaatgtggtctgagaaaccatgagtcctgctgcttctagaggcccaggggagaactcacggcttttagaaaaggggacgggcctggggagaggccctggggagcaagtagaaggactggaggcagggtccaactagttcttatgatgtcttcatgcatattagataaagatctcctttctcaagacactttcctctcatctcttagtacattgtcataatatactgatttgttggaataagacacttctggctgggcacggtggctcatgcctgtaatcctagcactttggaggccaaggcaggcaaatcactagaggtcaggagttcaagaccaacctggccaacatgtgaaacctcgtctctactgaaaatacaaaaattagccaggcatggtggcgcgtaatccagctacttgggaggctaaggcagaagaattgcttgaacctgggaggtgaaggttgcagtagcagagatcacgccactgcactccagcctgggtgacagagtgagactctgtctcaaaaaaaaaaaaaaaaaaaaagacacttctaactgcccaaaattggtataataaaaacagaaagtatgatatctacaatgtcacagtaccctcctccttagatgtgccacttttgtgagtgccaacctatgtgacaaccttattggagggtcccagaagcagtacctggctacccagatgtggaagtcaaggcttctccctaggagatgctgcagggtaggctgcatttgaactctaaccccctgggaatttgagtgagaaaggagctgtgaactgtgcctctcaggttgtgagtaaagcccctggggtccctttattccctttctttttttctctttcttaatcttcatggtaaaggtccttcaaagagagccactttcataatattaataaagaggcattatttatgaatatgtggagacctaatggtaagtgctttatgtacatgatcttttaacccttacagccaccccattttgtccccattttatagataagaaaactgaggcctaataatttaagctgagagtagtggtcatgcctgtaatcccagcattttaggaggctgaggtgggcagaggcttgagcccaggatttcagaccagcctgggcaatatgacgaaaccccatctctacaaaaaaatacaaaaattgctgggcatggtggtgtgtgcctgtagtcccagctactcagggggctgaggtgggaggacgcttgagctcaggaggtcaaggctgcagtaagccatgatcatgccagtgcactccagctgggcgacacagcaagaccctgtctcaaaaaataataataatttaaataacttgcctagataacatagctagaaactagcagggacagggcatgagtttcagtttgcctgattccaaaccatttaatggctgtgctcgagtgatcctcttccctcctctccacctggcaggcatgaaagtttcctcatcttcgccaggaggatagacattcgcatggtctccctggacatcccttatttgctgatgtggtggtaccaatcaacattaccatgaagaacaccattgccgttggagtgacccccaggaaggtctgtatggccctctcttcccacctggccttctgtccctgcccttaacaattactgtctttcctctcccaccacctttgtctcctgccaagagccagggtgtttttccccattccctctggcatagcccctgtccctgtctctctagcactttctctttggtttgagagcatggtttggggccctcttctctccgtctctgccaagagctatcctgctatgaatttctgcgttttccttgatttcctctgctagaggctccagagctctctgacatgctctgtgtttcaagacatgaatcagctgtgtgtgtcccattgtaggcggtgagggtctaggttagccaagctttccctctccaggaaaggtgtactggtctgacagcacactgcacaggatcgtcgtgccaatctggatggctcacagcatgaggacatcatcaccacaggtgggccttcccctagcccagggaccacctgtctggcaacagggctggggaaatagcccatctgttttaaataggagccagtgtgctcttttgacttcccacagggctacagaccacagatgggctcgcgttgatgccattggccggaaagtatactggacagacacgggaacaaaccggattgaagtggcaacctggacgggtccatgcggaaagtgttggtgtggcagaaccttgacagtccccggccatcgtactgtaccatgagatggggtgagagctggctgtatcgcaatgggtagtgtgggggccagctcagctggggttatgacggggtaaaggtgggtagtggagaggaagcttgctcacagaaacaaggtgacctccctggggctcttccactctcttgtgacttctcgcagaggacagtacagtgtagaagttaaaagcatgagccttgaatcagaataccaggattgaaatttttcatcatctattagctatatcacttgggtccggtatttaacctctctaattctcagttccttacctattaaatggaggtggtagtgaaaatacataccttgtggcccttatgaagttgagataatgcacatgaagtattttgcaaagtactttgtcaagcaaaaattttgcctgcatactgtaagtactcaagtgtatctgacatactgttaagtattcatggtatgtggtagtgctggaataactagctaatatagctaatattcttcctcactcaggtttatgtactggaagactggggggagaatgccaagttagagcggtccggaatggatggctcagaccgcgcgggctcatcaacaacaacctaggatggcccaatggactgactgtggacaaggccagctcccactgctatgggccgatgcccacaccgaggtgagagccgtgtccctgctgcttcccaggacctgggaagatgggaaaggcctgcctaggatctccatggagagttcccaatctgctgataccacccccgaccctctccttcctctgcagcgaattgaggctgctgacctgaatggtgcaatcggcatacattggtgtcaccggtgcagcacccatatggcctcaccctgctcgactctatatctactggactgactggcagactcggagcatccaccgtgctgacaagggtactggagcaatgtcatcctcgtgaggtccaacctgccaggcctcatggacatgcaggctgtggacgggcacagccactaggtgagagtcagagggctggggctgtgagtcagagcctctggcttctggggccatctcaacatcagagatatatccagagcacagagctcctttacagccagaagacggtgacctgtttaagctcccttccagattgggctgtgttctctctgggtatggctgtactacagctgtcaccttcaaaggactcctggagatcctcctgcagaccctccttctactcaccctgccaggcactgaatcctgtcacttagaacagcaaagagccagccacaaacactgggacctttgtaagattcagatgatgttccaggctaggtgtgaatacttgtgcttctatcaccaggttttaacaagtgcggctcgagaaatggcggctgctcccacctctgcttgctcggccttctggcttctcctgtgcctgccccactggcatccagctgaagggagatgggagacctgtgatccctctcctgagacctacctgctcttctccagccgtggctccatccggctatctcactggacaccagtgaccacaccgatgtgcatgtccctgttcctgagctcaacatgtcatctccctggactatgacagcgtggatggaaaggtctattacacagatgtgttccggatgttatcaggtatgagcaacactgaaacctccagaagacacagatttgcttctggtgcccatgggtgaggttgtgttctgaccactaaatggatgagtgatttggcactttggatgtgagttttaatcctgacttgttcactttgtagtgttgtcacttacagcagagtttcaactttcatttgtttagagattatatggaagcctagtatgtaaaacaaacaacaacaacaaaaaaacaggtaaagtcaggggacctggagactttcacatctaccattgtgccctgaggggctccaagaatcccctaggacttactgatgagtaggccatataaccagtatctgtattgagtaaaggagccccaatcaaatgccaagtcttatggtggtttacaaagctgttgtttttattttttcgttgttttatttttagtctttaaatttgtggccctaacacagcttaggaattgatgtcctgccaccagtaagagtggtttaccatggcagatattctcacatggaggaacgggaacattcccctttgctctccccaagggatgtattagaatctcaaactggggacaggaggcatatacagtttagggaagtcccctaggtgacagtgacatgctccccattctgaggagagttccctcctgcccatagggcctttgcaaaagtgcacagttagggtctggcgtggtgctcgcgcctataatcccagcactttgggaggccaaggcgggaagattgcttgagcccagagttcaagaccagcctaggcaacataatgaaacctcatatctacttgtatttaaaatttttttaacttttaaaaaatgcacaggttggttttgacaaatctgcgtttcttatcatcacacctagcaatccttgtctcttcccaaaggtatgtggggaatgataaacttgtcttctacaagacatcccctggcaaccgccattatgtccagttagcaggaaatactgtgtcctcctagaactggttccttcattctgcaattattttattgagcatctatcatgctgggtgctgagaatgtactcatagatacctggtctctatccctgtggagcttacagttcagtggggtccgttatgggaacatgggttaaagttctactctattctgggtcagtctggttgctcatccacactgggctctccccaaggcgagcagacctgaacggcagcaacatggagacagtgatcggcgagggctgaagaccactgacgggctggcagtggactgggtggccaggaacctgtactgacagacacaggtcgaaataccattgaggcgtccaggctggatggttcctgccgcaaagactgatcaacaatagcctggatgagccccgggccattgctgttttccccaggaaggggtagtttatggccagcagaagagagatccagggaagaagggctgggtggaaagatggtgttgtgggtcctctgtgttctctcaacctctgggtgctgtcttcccatgccttgatgatgatgcactgttgtgtctcaggtacctcttctggacagactggggccacattgccaagatcgacgggcaaacttggatggttctgagcggaaggtcctcatcaacacagacctgggttggccaatggccttaccctggactatgatacccgcaggtgggagtcttgcatcaaacagcctccggaaatcgggtgggcagaagagagaatggttgagattaaccttggaaaaatgaaaagatgaaagcttcttggtatgtggggaagaggaatcattgagaaggataagggaatatattctagagcagcgattgctaaatccagccctcaacccttatgtgggttttgtttggctggtttcatgttcctaatttgagtgcctttggcagagcatgtcttctggctggaccacaggtctccacccctactcatttaagggctgattcttatatttgttataatataacaaatcctgatccttcaggctctggaactttgttgttgttgagacagcatcttgctctgttgcccaggctgagtgcagtggcgcagtcacagctctctgcagcctgaacctccctggctcaagccatcttttacctcagcctctcaagtagcagggactataggcacatgccaccatgcccagctaattctaaattttttgtagagacagcatctcgctatgttgcccaggctggtctcgaactcctgactcaagcaatcctactgccttggcttcccaaagtgctgggatttcaggcatgagccacacgcccgacccaggctccggaatgtacaactccttgtctagataagaaatgctaagggcgggggaaggggctctaaagcagtctgtgcccccttctgatccaaaagaaggggaagggatccaagacttctggaaaggtggtagaatgccttcttcttttaacctcagcaaggtccattagactgggctcacttccttttttgttgttgttgttgagacagagtctaactcttttgccaggctggagtgcagtcgcacgatctcggctcactgcaacctccgcctcctgggtttaaccattctcgtgccgcagcctcccaagtagctaggattacaggcacgtgtcaccacgcctgctaatttttgtattttagcagagacggggtttcaccatgttggccaggctgatctcgactcctgacctcaagtgatcccccgcctcggcctcccaaagtgctgggattacaagcgtggccaccatgcccggccgagtgagctctcttcttaaagaccatttttaagaaattgggcttgattattgggtaggagtcaaagggcaatcaaattcctgaagatgaggctgggtggtggtcctctgaggtcactagactttctatgcctccccagagcagccctgacctccccactcagaaccaccagctcccttcttcagctttgggactcacaatgacccctcatcgagggtgctcttgagttctcatagcatctgccagtcagctcaggaggggacaaacaggttcataggggaagagctgggctccctggcaagcgtttggagcagccactcttttcattttcttcgcaggtctactgggtggatgcgcatctggaccggatcgagagtgctgacctcaatgggaaactgggcaggtcttggtcggccatgtgtcccacccctttgccctcacacaggtactggctcagagagaggtaactaaacctccttgactgggatgtttctttggggttctaagtcagcagtccagctatagctgctactgaacagacgtgctattgcagctcattttagggatttttcctggccctgaagccttggtaggttggtagggccaccgagtgccttgctactcttatcctgccttcccatgttctagcattcaaaggagtggctctcaaagagtggtatacagaatccgataggtgcttgttaaaatgcaggttcctaggccctgactatagagattatagagaagctgctcatgagggctgggcacagtaaaatacattttgacaagttccccagttaatcctaatgctcggtcccagcatctgggcatagggagctcacttagtggcaacagggtggagtggctaaagccagagttttgaggcatctagccagtttgtaagtatttaatgagtaccatcaatttgcaggtacctggattcaagttctatctgtattattaaataactgtgtaactttgaactagatgactgaacctctctcagcttcagttatctataaaataaatcagcctaataatagtatctcctgaaatagacacaaagcattagcatagtacctggcacacagtaagcaccacatacagttatcgctacccattttaattattattagctgtcacttttgagttctaacacaaaaaaaatttgggccaggaaaagaagatctaccaagcctgaggccaacaggaattctcgatcattaaaaatcttggccaggtgtagtggcttatgcctgtaatcacagcactctggctgaggcagagtatcacttgagcccaagagtttgagaccagactgggcaacatggcgagaccctattctataaaattttttgttaaattagccaggtgtgctggtacacacctgtagtctcagctctcaggaggctgaggcaggaggatcgcttgagcccaggaggtcgagctgcagtgagctaatttgtaccactgtgctccaacttgggcaacagagcaagatgctatctcagagaggagatcagagaaagagagacagaaaggaaagaagaaaggaaagaaaagaaagagaaataaattgacccttttttgccaaatattgtcaactctgtctgtattctatattatgtcccactagcaaaaagcattttttttgtttgttttgttgttgttgttgtttttaagatggagtcttgcttgtcgcccaggctggagtgcggtggtgtgatctcagctcactgcaacctccgcttcctaattcaagcaattctcctgcctcagcctcccgagtaggtgggattacaggcatgtgccacacacctggtgaattttttttttttttgagatggagtctcgctctgtcacccaggctggatgcagtggtgcgatcttggctcactacaacccccacctcctgggttcaagtgactctccgcctcagcctcctgagtagctgggattacaggtgcgtgccaccatacccagctaattttgtatttttagtagagacagggtttcaccatgttggtcaggctggtttcgaactcctgactcatgatcgcccaccttggcctcccaaagtgctgggattacaggcatgagccaccgcactggcctagccaaaaagattttatctggttttacttaatgatagtctttttttttcatatctaaatgtaaaactacagggtactactgcatataggtttttcagtctacaggtttcccccagtttctgatatatacccttggatgaggatgagaacaccttcattgcccctccctcccttgattgagaatttcaccatcattgctttagaagaaagctgcctacagaagtaaagagagatttggggcagtgctctgagcaaagggcccagaggaacaggaacctataagaaccttcaatttcctcctatttgctagagagggagtcattcaatcaactaaatggggactgagtgtaggtgctagaattcagagatgaatagaacacattcttgtccttgaagaactaaactggtggatggacagaccagtaaacaaattgcttgagtgtaaaaatgtacttgggcaagtgacttaaggtgcagaactgtatagaggagagaatggtgaagtctatatggatttggggagattccttgacaatgtcatgtctgttgatgcacagaaatgaggaagagatgaagagggcatttagcagaggcagtggcacatggtgaggcacagaagctgtacaggaaggagtctgcttgctaataatatttactgtttttgggcttcccctgttgagtagcaagacaggtggatctactgacagactggcagaccaagtcaatccagcgtgttgacaaatactcaggccggaacaaggaacagtgctggcaaatgtggaaggactcatggatatcatcgtggtttcccctcagcggcaacaggtgggctcccgggtactgagcctgcttccttaacatctgtgggattggtcggtcacccaaggactgttagggaccaagacagttagggccacaagagagcttcttggttcacatttaaacgcttagaactttttactccctcgcggttctatctctcctcctcccctgtccctggagtagggtaatcctggatttcctctgtttttgagaagccttaaattgggagacctgatctgtcccagataagacattcatctactttgcctccagggaccaatgcctgtggtgtgacaatggtggctgcacccacctctgctttgccagagcctcggacttcgtatgtgcctgtctgacgaacctgatagccagccctgctcccttggtgagttggactgtatggctggagccatcggcagagcccctggaagggctgagagtcagcagcctctgatactggtctgatctgtcttctgggtgggatccccataaagaaggtcttattagtggagtgattggtagcagtctgctgggttttgggaattgctcaaacctgggtttgtctgccctctggcatttgcaggaacagattcaggtctcttgattcccaggtccctgctgtgggataatcagtggcctgtgcatcacctctcttcctgactggtgagccagctgtcccatccagagctattattattgaatccaaccctttttattgatagtattaagaagggctactaatgaaggtgcctgggactagggcagcaaaagattgttttgtcaagttctccagctgctactcttgggccatatgtggatgtttatgttccagtggcccactccaatcctcttttttgtctagtgcctggcctggtaccaccagccctagggctactggcatgagtgaaaagagcccagtgctacccaacacaccacctaccacttgtattcttcaaccacccggacccgcacgtctctggaggaggtggaaggaaggtaaatggttcaatgcaggatcatgggccctttgattcaaatcaccatcccatgaccaactcatatcccagcttgataaggcagttgggagatagattatgtcaggagctaccagtccctgttattgggacagaaggtgatattcagacttgtagattgttacaagtgattccctttttagcttgagggcaagaagctttaagaacaactttaaggctgggtgtggtggctcacgcctgtaacccagcactttgggaggctgaggcgggtggatcacttgaggtcgggagttggagaccagctgcccaacatggagaaaccccgtttccactaaaaatacaaaattagctgagcgtggtgcacatgcctgtaatcccagctactctggaggctgagacaggagaatcacttgaacccagaggcggaggttgcggtgagccgagatcgcgccattacactccagcctgggcaacaaagacgaaactccatctcaaaaacaaaacaaaacaaaataaaacaacaaaaaaaagaacaacttaaacagaaatcacttaggaggaccctcccacgtggtattcctccttcttctctctgtgcatttgctctcacatcataggtttggcatattggcttgtccaacagtagtctctgggcttggctttatgacttggaacaaaaaggtttccccagagatatgatggccttagcttataagtcatgtgcacccccccgcaacacacacacacacacaaacaccattatgaaataagcaacataaacacgaacagttctcaaatcaagtataaagtatcttatttcattaaattaaagggctattcattataaaatgcttcctgatttgagaaattaaactgaaaagataaccaacagaaatgtgaaatgctattgattgtaagtcacatgcctgtttaagagatggtaggccatagaaaaacaaacatcttaaaattgattaaatatgatgttacattcaattcagagacattctttttttcttttttctttttttttcttgagacaggatctcactctgtcacccaggctggatgcagtagcatgaacacagctcaagctcactgcaccctcgacctcctggtttcatgtgacctcctacttcagccacccaggtagccgggactataaatgtgtgccactatgcctggctattttttgtactttttgtagagatggggcttcaccatgttgcccaggctggttttaaactctgggctcaagtgatccacccgcctaggcatcccaaagtgctggcattacagatgtgaacactgcacctggcaaaaaattctaatgactgtgttttccatttatattttataaaaaaaatctgggccaggcgcagtggctcatacctgtaatcccagcactttgggaggccaaggtggcagatcacatgagtccaggaattcaagacaagcctgggtaacatagtgagatcctattctacaaaaaagtttttttttaattagccaggcatggtggcccatgcctgtagtcccagtacttgggaggctgaggttgggaggattgcttgagcccaggtttaggctgcagtgagcttgattgtgccactgcacaccagcctgggtgacagactgagaccctgtctcaaaaaaaaacaaaaaacaaaaaataaataaataaataatctggaaatacatatgtgaataaagaagaaggaatatcctatacctatatataatttactcttaatgttttgatgtctatcttttctagcatttttctaattagaacagtttttttttttttccactgcaacatactggtctctttattttaatatcatcagtagcttacaaggtagttaacacttgatttcaattctgaaagcagaacataataatgatcccaaataaaaactttagactcaatgtccctaaagttacaagatttcacatgatcaaattcatatgctgtgtgcccccattctctgtttttactacagtttgtaagaaaaggaaacacccaggtataaacatgtgcctttctcactaacttttaagtactatcatcattattactctcggattttctttaggtttatttagaaaacttttgaccccgctcggacttttcttattgtcagagttctatttgaaaattcagtgcatcttggttccaaatgctctgcaagtagctttcctctggctgtttaggagatgcctttgattgcctgctcataatgtacacaaagaagtcaccttctgagcatttcaagttagttatctgagcactccctctggatgtttgcatattcccttgtgaaagaatgaagagaagaaaaacattttttgaccttgggatattagctcttgtgataatttttatccaatcagattggcttggctagcagctgcttctgactatcctggtagtttaagaaagcctaatattgatgtccttagtattctttctgcagacttcaactcactcccaaacctgcttctcatttttaaaggtacatattttataacacacttaaaatggtataacggcttgaaaacagtgccttgcacggatttctctccatttcctgttgttgcctctccatgcttctgatgtcttccatcttgtacattctcatacctgaaagcccccactacaggcctttccccctttcctggaggaaggcatgaccttcactgagtatgagtaggcttacatccagttttctgtgccccacagatgctctgaaagggatgccaggctgggcctctgtcacgttccaatgacgctgttcctgctgctccaggtaagccctgagtaccccactgttccgaaaagaagatgtaatgaatctaagtctccactgatatctttcataaccttcattgggatctggggttgatgaactctttttaaactaagtccatagaaataataatcataatagctccaccacttacagtgacagcttatggtatgctttccgtatgccaggcatgtgataagccaatatatgccacattatatgtgtgtgcacatgcatatatacatactctcatgtaatttccccagtcctatgagcaatttattatttacatttaactaaagagaaaatgtaggcttacaattaagcatcttgccttatgtcagatagctaggaagtggtcgaaatgggatcagagatgcggcagagtgacagatttcttctcagcctcctccctgcacctcccatttacctatctgaaaggaggcccttagccatcctcagatggtatggggtccaacacctacaaaaggagcctttagctttccattcctcacaccagcaccgctagaaagttgtcggtggcccctgcctagtgttctctattcttcctaggggaaggacttcatatcagctacgccattggtggactcctcagattctgctgattttggtggtgattgcagctttgatgctgtacaggtaacttcagtcttgtacaggggccacatgctcattggtcttcatgagcatgtctgggatctcccgaagctctgagttcactgaatcaagctctgaccagccttattgcaaggttgggtgcctggtcagggcacagaaggaaagggtggaaacctaaatacttactcttctccagtcacagcctaagcatttccttattgaatgactgtaacaacccttcggattttctttatagactaggatgctgagtgacagaggatattacccaaggtcacaaagtaagaggcaaatctaagactgactcttaacactttgctttttccagtactccctgcttcaaaccactgaaattggaaatgattttcccctatacaaacacagccttttactacaatattggtttgtacatctttgctcagtagcaatcatctggaaaggtagaatgtgtcatttataatctttttatgtccctctttctttatattttccccaaatgctttaaacgtagcttacagtttgctgctgttgttcttcatcatcatcatctaacagttaccattaatggatatatatcaatgtcatgacaacctcgtaacacaggtattttattcctcactttacagatgaggatctgaggctcagaaagtttattttttttaattttgtcttatttttttgagatagagtctcactctgttgcccaggctggagtgcagtggtgcatcttggctctctgcaacctctgcctcctggattcaagcaattcttgtgcctcagcctccaagtagctagaactacaagcatgcaccaccatgcccagctaattttttttttttttttttttttttgtatttttagtagagagagggtttcttccatgttggtcaggctggtctcgaatcctggccttgtgtgatctgcccacctcagcctctctaagtgccaagattacaggtgtggccaccgcacccagccagagagtttagattatatctatcaaggtcccagctaataaatccagaggtggaattgaaacagatctgtctgactctaaagctcagtgcatcagttctccatgctgcataacaaattacccgaaaacttagtgacttaaaatgacaaccattatctcacagttctatgggtcagaaatctggatgcagcttagctaggtgcctctgcctcaaggtgtctccagactgcaatccagatatcagctggggttacagtctcatctcaaggtttgaccggggaggatccccttccacactcactcacatagttgttggtaggattcagctcctcataggctgtggctggaggccttcctcattagtttcttgccttgtgggcctctccataggacaacttaaacatggcaggttgcttctcccagagcaagagcaaaagagaatgagggagggcaactcagaccagaaccagtttcttggtaacctaatctagtagccatcacatttgcataatcttttattagaagtaagtcaccagaacagtccacactcaaggggaggggattcttaagggcatggtaccaggaagtgggagtcactgggatcatcttagaggctgcctaccagactcagtttaagctttcccaggtatcatccccttaaagatctcgactaatttctcatcaccttccctccaaagacacaaaaaatccaagttcactgatcctggaatggggaacctcacctacagcaaccctcctaccgaacatccacacaggaagtgaagattgaagcaatccccaaaccagccatgacaaccagctgtgctataagaaagaggtaaaaattgaaatttatattcaagggtcttttggcgaggtgtggggagggattttactccaaatgcccaaataagtcagtaacggctgctggtaatcccatctaccattttggaagttatagtgaacagaagaactgaatgtaatttgggttctgggaagttctagaatctctgagggattagtttgagggaccttagtgagagccaggtagaaggcagatctcagaagatttaggtctgaaagcagttgccctgccatgagatattttccaagcttataggttctttccctccaggaactgtcattcccctgcaaaaggctatgtgttctgaaacaagggagctctcccagacaacacccaaaaaacccaagagctcctggactccccattactaacctccagtccaagctagtagcacctatggttgggaatggcttgtttttactattcttcctcttatcacaaaaatttctctagaattctgaaggtttacctgcttttgttttttttttttttttttttttgagacagagtttcgctcttgttgcccaggctggagtgaatggcacgatctcagctcactgcaacctccacctcccgggttcaagtgattctcctgctcagcctcccgggtaactgggattacaggcatgcgccaccatgcccggctaattttgtattttagtagagacagggtttctccatgttgaccaggctggtcttgaactcctgacctcagtgatccacctgcctcggcctcccaaagtgctgggattacaggcgtgagccactgcgccagcctgcttttgtttgtttgtttgtttttaacttctttgtcacttcaatggaaaattattgctcaatgtgaaggcatgaaaaatagtcccatttcaatgagctgggtgtggtggcttggcctgtagtcccagctacacaggaggctgaggtaggaggatcacttgagctcaggagttgaggctgcagtgagctgtgatcatgccactaccctccagcctgggtgacaatgagacccgtctcaaaaaaaaaaaaaaaaaaaaaaaaaagtcccatttccacaaggaaactaactatcctggtatttcagattttcctaatccaatataagccttgtttttttcctaaaatcctgtactcttcatcagaagttattccttatgaagatcctcatcagtctacttctttggcctattagcacagtcagaacctgctctcacacctgcagggctctcatgtgtaataaacacatttacataataatcatgtgctttctggatccatgaattcccgtatttaaatagcttccactattctggttcaagttggtgtttgaaaaaaaaaattgaaattaaaaattttttaaaagctttactgcagtcaaaacagaatgtgcagggatggcttgtagttctaggaatggtagaccccccccaatatctttgagagaaagactcttgaagattcttgggttcctggagtatctgatgtccagaaaagaaccacaatgaaggccacaggatagcaatgaaaatagtgtgacctctttttctgttgtgtgtttcttcctcagcagctctttcacccctctgatagtctttcacctttctcttctgatttcctcttgatttcaggtacctgttgctgtgtgtttgtagagggagtgggtttcccaaattgcaagtgccatatcccccacctctccctaacttacccagcgtgtctctaattaagacattgagtggtctgcatcttatactaatttcatcttggagggtgtgctggtgaacagacatctgtgtgtttgcttgtgtgctatgtcccactctgcatggctgaggggatgtcactctcagagggcagggaccatgttttatattgtataatcatcaaagcacctagccagtcttctgcttaacataggggctcagtaaatatctgtggaattgaattgttacaaaatagagccacagccacagttgcagaactcttggcaggaatactatcccagggacagaaccaagatgatccattttcttctagcagtggtggtatgtcggttggtataccccagcagccagagtgaggctgctctttgaagaagccataaagggagaggcccgagcagaactccaggcttgcctggaagaatcccaggttttgcttgggaatggtcccaggactcatggcagcagagcagagtaacctcccaaaaaaggttataagttgcaggaccccactatattgacgtttaggaccagataagaagatttccttttttttagttttttttctttctttctttcttttttttttttaatggaatcttgctctgtcacccaggctggagtgcagtggcatgatcttggctcacttaacctcagcctccggagttcaagggattctcctgcctcagcctcccaaatagctgggatacaggcacccgccaccaaacccagctgatttttgtatttttagtagagatggggtttcccatgttggccaggctagtctcgaactcctgaactcaagtgatctgcccgcctgggcctccaaagtgctgggattacaggtgtaagccaccacgcccggccagataagaggattttctgagtcccctgtcttacctcccaagttttctccttaacaaaattagaaaaaagagatacaactagcacccgaagtagcttaaaatcctgaataaatgtacatttaattgctcttgccaatgcttttgatgatttatatcagcatgatgtcccattaataaaccacagtaacaatgtaaatagctaacatgttatagtgcatcttgtgtcaagctccctgataactgcattccatgtacatctcatttaaggtgacagcagttggttgtgaggtgtggatactgttactctcctcacctgcagagtcttaagagactgagttttagaaatgtgaaataatttgcctaaggtgacaagccagtgagtggctgctgcaggaccggaagccatggttttccctcctcctgtatggtaaggtaataattatcacagctgcctctccccttttaggctaggcctcatacacttgtcttatcacatttccccatttgtttgtgggatttttgtgcgcttcactcctactcttaccccatcacttcctttttcagtttaccatgggatcctttgtagaaggccaactgactgaccatattgcccactctccaccctagggagggcctgaccataactacaccaaggagaagatcaagacgtagagggaatctgcctcctgtctggggatgatgctgagtgggatgacctcaagcaacgcgaagctcacgggggggcctcctccgggatcatgtatgcatgaagacagacacggtgtcatccaggccagctctggctccctggatgacacagagacggagcagctgttacaggaaggcagtctgagtgtagcagcgtccatactgcagccactccagaaagacgaggctctctgcagacacgggctggaaacatgaacgcaagctctcctcagagagccaggtctaaatgcccaattctcttccctgcctgcctgttccttctcctttatggacgtctagtccttgtgctcgctacaccgcaggccccgcttctgtgtgcttgtcctcctcctcctcccaccccataactgtcctaagccttcaccggagctgtttaccacgtgagtccataactacctgtgcacaagaaagatggcacatcacgagaatttagacctggattttaccatgaacctcacatcttgtactcatcctgggccccctgaaactgcttattcgtgattcctcaccagcgtagagctccacctccctttccccagtaccctcagtgcctgcttctcagtgctgatgcagctgatgacccaggatgcgctctgccccatcacagccagcatgactgcttctctgagagaacttgcccatcagggctgggacatgggggtgtgggtaaagacagggatgaaggatagaggctgagagaagaagaagaatcagcccagcaggtatgggcatctgggaaacctccagcctcaagtgtgttggtacatgaaaaagctctggggggtagttggatctgggtgtctggtccattgctggcagtggaattattcttgccctaagagacactgccttttcagcagcagatactggtgagatgggggtgctcaggctgttcttcctcctcctagaatgtctggagctgtttctacattcagataactggtcccctatcacaaggctactggctaataggaattccctcctggtgccaccactggccgtacctttcctaagtctttgctcaaattaaccaggttgtgagccagtggcttgagtgaagttaggccttgggggctgagtctctgaaaagtctaagaagctctgcctagaccaaatatgtatacctcctgacccctctctccctcatgtcctgggattctggggaagagacctagaacaagctttcaaagaaaaaccagaagttgtcataaatggtcagaaagaacgatcaggttgagacttgggaaacccagggcctaaagagaagtatccatgagggtcaaacttcctgttgacttcctatgttctttctcaagtgctcagggatctaagttagtggacagcaagcctgtggtacggggtggtgatgttcctcttccagctgtcccctcagctaaggggcttagtttccattgggatgccatcacttggttcatgctcattcacacaaagggcacgtgtctcagcctggttcagggaaattgagacttatttttgccctaaaacgtctccctagctgttcttcgtggggttttttgtttgtttttttgcctaatttgctttttctgaccaagccttgtggcaccagcatctccaaagtcctgtggtgggagggctgaataaataaaaatacaaagaggtgggtaagggtaggaaggtagagagcaccactgatgaggccctcctagcccatggcagacccagacctttctcccccaggaattagaagtggcaggagagaacaacaggggctgggaatggaggggaaatttctaggggaagtttcctgagttgaaacttctcctgtggttactggtattgagaaacagctaccaaagtgaaaaaggacaagatcaattcttttctagtcagttctaagactgctgagagagataccaggcccttagccttgctctcagtagcgtcagccccagttctgagcctcccacattacacttaacaagcagtaaaggagtgagcactttgggtccttagactcatgttggggaggaagagcaagtagaaaagtggcattttcttgattggaaagggggaaggatctattgcacttgggctgttcagaatgtagaaaggacatatttgaggaagtatctatttgagactgatttactctgtaaaaagcaaaatctctctgtcctaaactaatggaagcgattctccatgctcatgtgtaatggttttaacgttactcactggagagattggactttctggagtttttaaccactatgttcagtattttaggactttatgataatttaatataaatttagctttcttaatcaccttgcctggcttggagtcatgactaatcctgcacctgctctgtctggcagcccatgctgtggaaaacctgcttacagacatcacttttaagtcctttgtggatgtgggccagtgaagagcaataaagagtgtgaggttcctgctggagttttcagctcatctggagaaacaggtcgaggccagagttccttgactgatgaaacctttatttcctctggaagaggaatgtagatgggtttcctcttgagtgctgactctgactggttggtagtggctgcctgagggctattcgcacccaatgggaagaatgtcatatggctagtgacatctcttctgtgcactggaggaaatgtcatggcatgtataccatgtatcttctatttctgttctaggtctttgttacaaactttactttgccttgcagtgatggtcactggcaagactatctcatgtagtaagaaaatactggagctggggacatggagggctaattccagtcccagatctgccactagctctgttgatcttagtcaactttcatagttagtctgagagtggatcaaattatcactaggatttcattatttttaaaagctgtcttttcatagctcatccactacttctcaaggctagaacaagggctagggatcccttctcaggttctctggatgtgatatccctcagtgaaaactgggaatctgttaatctcaacgcccgatgtagaatttcatgtcaagtctcaatagttgattttctaaccacacaccatctataggataatatccccattcattcattcattcattcattcattcatcatctgctatgggctaggcactgcccatgcctaaacaaagacataatcttacagagcttgagtctagcaacaccattaccaccaccatcccaaaaaaagacaaaaaatgaaagtaagaagactgaagcttcttgtatttaagtgaccagagatctgagtataagctacagtgtataattttctaactgtagtaaggagtaggtgtgccagaacaaaaacaagtagaatagcccaagataaccatccctccaacccccactgttctctttgggagggaaaaaaaaagcagaaaaggggacatcttgggataaaacaaaggttgggaattccttgtctagttctctggtataaaattgaaactagggtcaggcacagtggctacaccaaagtaatctcaccactttgggaggccagacagaagtaaggagtattgcttgaggcctggagttcacgatcagcctgggcaacatgaaggaccatatctctacaaaaaaatttaaaaatattagtcaggtgtggtagctcatgccttagtcccagctgcttgggaggctgaggcaggaggattgcttgagcccaggagttcaaggtacagtgagctatgatcacgccactgcattccatcctgggtaacagagcaaaaccttgtactaaaaaaacaaaacaaaaaaaccctgaaactgataagtgagcagatggtgggtcaagtctaacaaactggccatatttttgcaaactcactcaaaatacagtcacggtctgtctatgtgtatgaacaaactgtggaatctaaaatgaaaggatctctggcccatagaaaggactcggataaactgaagctgtcaccaaacgtaggcctaaattcaatgcataggaactcagaggagcatctacaaaagctgagggtgcacaggtttctaagtgggttctaagagggttctaagggacccagtaatgcactgatatccaaggttatccagggtctcgctctgtcgcccaggctgagtgcagtggcacaatcttctgcctcagcctcccaagtagctgggactacaggcgcccctgccacgcccagctaattttttgtatttttaggagagacggggtttcaccgtgttagcaggatggtctcaatctcctgaccttgtgatccgcccgcctcagcctcccaaagtgctggattacaggcgtgagccaccgcacctggccctaagttgtctggtttctatttatggacatatgataaaagaaatgtggctgagtcctttttatggctacgaaacagtctgtaatatatctttcttcaaatgtgaagttgagtcgactgattcacttaataggatgtgtgttttgggattttttaggcactctttgttttgaaacattccctcatctgcctacttattttctctccacccattctcccgttaaccagctgcagaggctagcagagctcagcatagggaataaagtttatgtctagtcaaagctccaactcataactttggtctccttgacatggtgttaaaacagaccagacagcctaattaagggtcatagtttaaacccaaggctaagttagccacaagctaccaatctgcttatttcattttataagacacaaagagccaagaactttcatgtatcttgctttcctgatggttttccctccaggccctaaaagcctgttgatagtcttctaatgaggtcctatctctcccttctccctccttcctctttggtggcgctgatgcttctgtggtcaaagttttggacagcctacattttgggggctatggaaaatgaatatgagaaaagaaaaaataaagctattcattccttcattcaaccagcacctactaaatgcaatcaagtgcaagccagggtagctttgcaatcctggaagacagttaaggcactaaaacccacagccacttgaaatctgtataatgtcaccactgctatctccagggaaataatgcagagggcacctgcattgaaagttgaggaagctcatcactgaagctgctccttttaggctggaaatatggatacatatcccatgtagggatgcttcaaccagaattcagcttgtgattacaaaagaatgagcactgtctcaacctaacaggcttttcagaaatgcccagcacagttattcagcagccacagtatttgacattgtttcctgttttcagttgcaaaaatacagcattcactttgatctctaatgcccacaaggcttcactgccctcagagggcagtatgttcataaatatactccttatgtaaaaggactacgagaagaccctggaataaaagcacacgtaactccaataaatacacagataaatgctattgatgataatcctagaaggcaaaagatgactgggcaaacatttattgaatacctactacggcaaggtactgtataagatttctacaaggccttgtgggatctgccagtcctcaccccccctgttataagatttcttctgctactacccctctactgcatgctaccctgggccagtgacctagcctctgtcttcctcaaaaacataaggcctttgcacagttgttggcccttgctggcctttcttcccctagatatactcatggctaactcctttgcctttaagtctttgctcaaattaatctcagtgaaacctaccctgaccaccctttcatatataaatattttgttgttgttgtgtttgtttgttttgagatggagtcttgctctgttgcccaggctggatcgtgcaatggttgatcttggctcactgcaccctccgcctcccgggttcaagagattatcctgcctcagcccccgagcagctgggattacaggcatctgccaccatgcctggctaatttttgtatttttatagagacagggtttcaccgtgttggccaggctagtctcgaactcctgacctcaggtgatcacctgcctcggcctctcaaagtgctgggattataggcatgagccactgcccctggcctcttttatatacatatatatattatagtcagctgggtgtggtggctcatacctgtaatccagcactttgggaggctgatgcaggagaattgcttgagtccatgggtttgagatcatcctggtaacataatgagatcctgtgttttttccaaaaaaaaaaaaaaaaaaaaaggtgttttatgcatgcgtatagtttcagctacttgagaggctgaagtgggacaatcacttgagcccagaggtcaaggctgcagttgagctgtgatcacgccattgcactccagcctgggtgacagacaagaccctgtctcaaaaaaaaaaaaaaaacaaaaaaaaaaaccaacaacagaaagaaacacagcctttcccttgaaatataaaaatcctagaagaaaacctaggaaatacccttctcttatcagctttggcaaagaatttatggctaagttgtcaaaagcaattgcaacaaaaacaaaaatgataaatggataaatgggacctaccaaaagtagagagcttctgcacagcaagagaactatcaagggagtaatagacaagctacagaatgggagaaaatatttgcaagctatgctccaacaaaggtctaatatccagaatccataaagaacttaaatcaacaagtgaaaaacaccccatttaaaaagtgggcaagccgggtgcagtggctcatgcctgtaatcccagcacttgggaggctgaggtgggtggatcacctgaggtcaggagttcgagaccagcctgaccaacaggcgaaaccccatctcgactaaaaatacaaaaattagccaagcatggtggtgggtgtcttaatcccaactactcaggaggctgaggcaggagaacctgggaggcacaggttgcagtgactgagattgtgccattgtactccggcctgggcaacagagtaagactctgtctctaaataataaataaataaataaatagtgggcaaaggacatgaacaaacactttcaaaagagatacagtgaccaataaacatatgaagaaatgctcatcatcactaatcatcagagaaatgcaaacaaaaccatgagataccaccttatacgagtcagagtggcttttgttaaaaagtaaaaattaatagatgctagcaaggctgcagaggaaaggggacacttgtacactgtggtgggaatgaaattaattcagccactgtggaaagcagtttggagatttttcaaagaactaaaagttgactaccattcgacccagtaatcctattactgggtatatactcaaaggataaaaaatcatttaccaaaaggacacatgtacccatatattcattgcagcactattcacaatagcaaaaactggaatcaacccttgtgcccatcaatggtggattaaagaaatgtggtacatatatcatgaaaactatgcagccataaaaaaagaatgaaataatgtccttagcagcagcctggatgcactggaggccattatccgaaacaaactaatgctgaaacagataaccaaacgttgcacgtttcacttagaaacaggggctaaacattgggtacacaaggacataaagaagggaacgatagcacttgggactactagagatgggagagtgggagatgagcaagtgtgggagttcagttagctggtgggaaaattttaagatgaagttataaaatatagacacaaatcttcttggaaggcggaaggttttgcaaaagtctcaggatagggttatggctgaaagccgcctaatccttacttgagtaaatagcttaaagtagatacaaaggaatgtagagtagtttatctgaatagcttgttactcatgtggtcttaagaccaatctttgatcaaccgggtgcacaaccgcagggggtggggcggggttgttggcaaccaggtcaattaccctctagcagtgtttactcaaaaccttttcatttaatctatactgaataaatgcaagcttcgctggctgatggggccggctgctacttttacagcaccttccttggtgtctgtgaggggcccagacccttagctggagtgacaggcgaatatctgtgttagtgtacgttattcaaccgttgttgggtcaaggtctgtgggacagacccggcaagcaaggactgataaactacttactgttaggtactatgctcactacctaggtcaatcataccccaaacctcagcatcacacaatatacctttatcacaaatctgcacatgttcctcgattctaaaatagaagttgaaaaataaaataaaattatagtctttccaaccccattccctatccctttacctagttttattctttttcttttcccactggacatattgtctaaaacatactatataatttatttatgtgttgattgtctacgtttcctcactatagtgtgagaccacaaagggagg

SEQ ID NO: 5033 - DNA, 13156 bp, Homo sapiens
tatacatttacatgaatataaattttataaatagtatattagttagcatagaataaatttgctgtgataattgtagcaggcagaataatggactcccaaagatggctacatttcacttccagacctgagaatatgttatctcacatggcaaaaaagactttgcagatggttaaggattttttttgagaccaagtcttgctctgttgcccagactggagtgcaatggcatgatctcactcactgcaacctccacccccagggctcaagcaattctcctgcctcagcctcccgagtattaggattacaggcatgcaccaccatgccccgctaatttttgtatttttagtagaggagggttttgccatgtttaccaggctggtcttgaactcctgacctcaggtgatctgctctccctgcctcccacaatgctgggattacaggggtaagccacctctcccagccaagttaaggacttgagatggggagattatctgggcagattgaagagcccagtgaatcatgggattctgaaagtgaaagagaaaggctgggcatggtggctcatgcctgtaatcccagcattctgggagccaaggcgggtggatcatgaggtcaggagaacaaaacaaaacaaaaaaattgccaggcaggcggcacatgcctgtagtcccagctactcgggaggctgaggcaggagaattgcttgagcctggaggtggaagttgcagggagccgggattgggccactgcactccggcctgggcaaccagcgagactccgtctcaaaaaaaaaaaaaaaaaaagtaaaaacaaatattctccccaggtgggagatcggtgtcagatctccaggggtggcactgaaggaaatcagcctgaaggccccccaaagttaaagtgactagcccactcccaggcttctttttggtacaccttcctgatcttaaccttaattactgggggaggaggagaacagttgaaaacacagctggtctaggagattattcggtttcatggaacaccttctctgtgcaggcagcgtccaggaacagctgtagaccaacagccaggctacccagcgtgtgggcccagcagccaggctggaactctatctctacttacagctgagtggctggcaggaagttactcagcctgtcggtcagcaacccaaactctgtgtttagttgtttgttcgctgacaaaatgaggcttctcatcattctcatcaacttcacgggctgctgtgaggaacacgtgagctgattccatcacagactcctcagtaggcagcagtaggttttagtgaacgggctatggatgctgccccactcactacttcctttctaggggaggccgattcaaatgcgtgcacacacacaaacaggatggcctgatgcagaccagctggtctagaaagccttcacggcctcagggagcctgggaggcggcctgggggagaccatgaaacagcagatcaccagagaccagagatcagagagaaaacaaaggacccagagatccacagacatccagaaccagaggcaacaagaaactgagagactcagaggcccactgagacccaggcagcttgtttgtgttacgaggggaaaaataaaataagaaacaaaagagagactcggggggcctcagtgaacctagagactcaaggaggccaggagattcagagacacccatagagagccagagacccgccctagcaaggcacaatcaatgaaaaaaaactcgcccaccaggccctcgcagtccgggctcatatcccggctcagcaccttggcgctgcatttgtcaagaggggaacagggatcctactccctgcctgtcctatggggccttaggccctggggtccagctggcctgccttcacccccttgtagttgatgaagctttggagaggctttcaaaccctggggagccacagctgggtgcgactggactcactggcagagaggcaggcggtgaaggccaagcctcgccccccaggaaggcctgattggtggacgggctgctttgggcagggccgccctcaggctatataagcgcactccggcggcgttggtgttatgctctgggccattcctgagctcgggtaaggctcgctgcaggggaggctgggttgcttgcgggcgcctagatggaggggcccagattggccctggggtggtgaccgcacgttctcctcggccccgtggttggcttctctctctcagggatgagggtgggttaggacgggagcttgaaatgtttgaagtggccccatcaacttgctctaaatccaggtattttctaatttcattcctccctgagggcctcagtttcccctcggtgtaagggatcagtggcctttcaactctgctttggtgaggggtcgggggtggttgtgagttggggcctagaggagagttaaactcttgggttttttttttctttttttttggccaggcgcagtggctcacgcctcaatcccagcactttgggaggtcaggagtgtgagaccagcctggccaacacggtgaaacctgtctctaccaaaaaaatacaaaaaaaattagccgggcgtggtggcatggcgcatgccgtaatcccagctactcgggaggctcaggctggagaatcagttgaacccgggaggcggagttgcagtgagccgagatcgcgccactgcactccagtctgggcgacagagagagactgtgctcaaaacaaacaaacaaaaaccaaaaaacctcttggggttttggagaccaagggcttccttttaaccggctgttaggcctcagcttcagtttcctcgtttgacgaccggtctgagttaacttacctccttaccaggatggaataagataaggcccttaagcacagccccaggcactaggaagccctcagcggtgcttgttgctgctgttactctggcctgtcctggggtgccaggggagggtgagggtgccacaccctcacctatagcaactctttgcttcttttctggcctcccactcttgttgcatcccggctgccttctgttctgagcccccaagtctctgcacccaccctccaccgtcctggcccctgtcaccaccctcttgatttgtgagcatcacgggggtacatgtaagtcctgagcctcctttctctacaggtcaccctgccccatctccatctcctatgagagagtgactcccaagaccccaccacttcccctgtagttaccacccaggtagagctgggggctgcagccggcaaggtgggggcaatgggttcctccgttttcgccagcaccaggaggtccggccttcctcagccttctgggtgagtttggagggctggcacgggaggggccgtgaggtcagtgtgaaagcagatgtgaagtgtggggtctcacctgcctgtacagacatctgagaccttgaccctctccctctcaggtatcccagcttaggcaggtgggaggggtgtcctctcagaactggattcagggccaggcaccgtgagtcatacctataatcccaacattttgggaggctgaatgggagtatcacttcaggccaggagttcaagaccagcctggtcaacatagtgagactcatttctatttatattaagaaagagagagagaaagagaaaaagggagaaaaagagaaaggagagagggttcagtggtggcttgggctttggagcttctgatgccactcttctccatggggtggtggtaacctgcgtcctgtcatgtcttctctaccctcagaggacagttttgtccagaattcctctccaaagacccctgcttccagatttcagataaggtgagggagtacaggctggggtctcttgagggtcaggttgagttggtgggaattgagtgccctggtctggtagggaagccactcaccttccatccttaccccctcatctttgcacaccacttcccaccattttacgactttctttccctgcagcaaaacctccctgggtgcaaatgaacctgggtgcaagcccccctcctcagagaataactaaccccccaccccgatctgtctctgcagtatctcctggccaggtgctggtctacttccagcgcgcccacctgaagctcagcgagtatacccacagcagccgttcttggccctgtgagtggtgggggcaggcagtggaggcatttgctggaggtgtcagagggacagggcagatgtgtggcctctgctccctgaccttgtgcctctgtggctaggtacctgcaaacgacatggaggaggacctggagggccccaaatgtgagatttttccatgggcccgggaaaagattggtgtttacgagtggggaaattcctgcaccagagggataagctttgggacggatgggtttccgggctgttgtgagccgccagtgctgtgaggaggtgaggctgggagcaacctggggtgtggggaaggctggggttcccaccccatttactgtccactctgctcctccaggtcatggcaaaggagccattccactgggcttggactcgggaccggcgcccccacctggtggggttcagagggtctgtccacaggtccctgttcgccttccccggggccctggccctcgccgccccactgttccccctgtggtttgccccagcactgcagcagccacttgcttagcctgtgtcatccaagtgcccttctctgacctctgaatgtcatcgccctccctcccaaattatctctcaagggtcaaaaacgcctggggtggggactttctcatcgtcttgcctccccgatgcaactggaaccaggcacctactccctccgcagtgagtgcaggatgggacaggagcgggggctggtgtgggagcttgggaggcaggagtgaggaccaacaatatgagagagagggcatgggcctggggtcgacgtgctgcccctcccgtgtgagcttggcaggtttcttctctggcctcactctttcctctccccagtcttcccaaagcctccggcacgccctgggcactgaactctgcagggtgaagaacagcacgcctgctggcccactgactgacacaccattggctgtctcccacccctgccccttcctcccagcctgcagcttgtgcccactctggtgccagtccctctaataaattcatgtccacaggacaccaactgtgcttaggtcctggcctggttccttgcccaaggttggggtggggagggggtatctaccagggttacaacatgtgagcacaggctcgtaacagcttggccccttcccattggtggccagttattctgagcctcagtttcatctcttgctatccatgcctatggatgatgagatctacacagtctagatgggattaaatgagatgggtatctgcagcccttagaagagggccagggagccgaacgtggtggctcacacctgtaacccagcactttgggaggctgagccgggtggatcacttgaggtcaggagttcaaaaacagctggccaacatggtgaaacccctttgctactaaaaatacagaaactagccaggcatggtgcaggtgcctataatcccagctactcgggacgccaaggtgggagaattgcttgaactgtgaggcggaggttacagcgagttgagatcatgccactgcactccagcctggacgacagaggagactctgtctcaaaaaaaaaaaaaaaaaaggccaggaacatattgggaaacaaaactgaatggaagacagctctttatttagtctagaaatgccttcagggccaggtttacttaggataagacttgatcccttccttgagctacagtcaaatataatattgtaattataataaacacccccctcccccaagagacatgaggactcaaaagggttaatttctttttttctttcttttttttttttcacatcactcctttattatactgatctggaaaaagatttagtacagttagctcagatgaacactggacccatgtggcagggccaagcaagtagaacatgattcagaaacagtgaaagacatacttggacaggaccaagaggcatttcactgtcacgaaacaaggcagaagggattgtaatacccacaccaggaagcactcctgcccctcagaggtcaaggagctgacctatattggtatgaggaatggcttattttctgatgactacatgtgggactatttcaacgccacgagaaaccccagaagggttattgttttgtattatttatatatactatacttcttaattaaatgtaacacataactaaattcaggattgatcccaaccttctagagccagctccctggcgtcagggaggaaacagttgtcacatcaccatgcaggttacattcatcttccactgaatgactagagccctcaggcagtggcctgactgcagacgagcagaggactggctcctgggacagacaggctctgttgcttctcctcattggtcatggcttagcatggttcctccccaaagtccttagtaaacaaagcaactcgcaaaaacccaagtcactacttttaaactctgttgataaggggagcttttccacagcttggactgagaacctgtgctctagaagtgctattctactagattgtatgaagggagtgggtgcaggagacaaaatggctaaaatgaaaatgggagcactggtccccatctgcagctacaactcaagatgtctacagatggggtcagtgtgacattgcaggtgggaggggcagagggacaagacaggcagggagggtgctcctggggacagtatctccctgctggccttcacttcttggccttgccctgggcagccacagcttccatggctttcgtaccatctcttcatcccccagaaactgcatgggcttgataggcttcaagttcttgtccattcatagacaatgggaataccagtcggcaggttcagctccatgatagcctcttcagaagaccctccagatgcttggcaatgccccggaggctgttgccatgggctgcaatcagtaccgtttcccctccttgatctggggaactatttcttcattccagaaggtcagagctctggcatagtgtccttcagactctcacaggagggtagcagatcttctgtgaggtctgcatacctcgatccttactgatgttgctatagaaaggatggttgggctccattggaggtggtgggactcataggagtgcctccagatcttcacctgggcctcaccatgctttgcagcaacctccgctccctggttcaagcgattctcctgcctcagcctcctgagtagctgggattacagatgtggtcaccacgcccggctaattttttttttgtatttttagtagcaacggggtttcatcatgtggtcaggctgatcttgacctcctgacctcgtgatctgcctgcctcggcctcccaaagtctgggattacaggcgtgagccaccgcacccagccgtgaggtgccagatttttatctttgcaaactgctaagtgggaaacagtctcttggtgaaattttaattcacatttgcttttcaggagctcaacatcttgtcatatgtttaagacctatttgtcttcttttatttgtgaacttttttttttgagacagggtcttgctttgtcatccaggctggaatacagtggtgcgatcacactcactgcagcctcgacctctgggatagctgggactacaggccaccatgcccagctaacttttgtatttttggtacagacagggtctcaccgtattgtccaggctgatctcgaactccgggcttaagcgatccacccactttggcctcccaaagtgctgggatttacttttattttatcttagagacagcatcttgctctattgcccaggctggagggaagtggcacaatcatagccactgcagcctccaactgctgggctcaagccaccctcccatctcagcctctggagtagcgggatgacaggcatgcaccaccacacctggctaattttctaatttttttatagatggggctcattatgttgcccaggctagtctcaaactcctagcctcaatcaatcctcctgtctagcctcccaaagtgttaggattataggaatgagcgaccacacccagaacatgattttttattatgtatatggagaaaaatactcctttaagatgttaattgtaaatgttttcttcagtcctcattttgacataactgtatggatttttaatgtagtaaaaaatgcaattttatgactttgggttttgtgtcatagttaaaaagactgtttccacactgagatgatacaaaaagtttctctttagctcctggctgtattttttttttttttttttttgagatggagttttgctcttgtgcccaggctggagtgcaatggtgcgatctccactcaccgcaacctccgcctccatctccgggttcaagcaattcttgtgcctcagtctcccaagtagctgggattgctggtgtgtgccccatgcccagctgatttttgtatatttagtagagatagggtttcacgatgttggccaggtggtcttgaacacctgacctcaagtgatccacccacctcagcctcccaaagtgctaggatacaggcatgagccaccgtgcccagccagcttctggctgtattttcgttttcatttttgacgtttaaatattgaaggttaacatttaatttttatttttatttatttattttttttgaacgttgtctcactctgtcgccgaggctggagtgcagtggcgcaatcttggctcactgcagctctgcctcctgggttcacgccattctcctgcctcagcctcccaagtggctgggactaaggcgcccgccaccacgcccggctaattcgttttgtatttttagtagagatggggtttcccgtgttagccaggatggtcttgatctcctgacctcgtgatccacctgcctcagcctccaaagtgctgggattacaggcatgaaccaccgcgcctggcctattttttattgattttttgagatggagtcttgctttgttgcccaggctagagtgcagcggtgctcactgaggccttgacccctaggctcaagagagcctcccacctcaggctccgaaaatgctgggattacaggtgtgtgagataccacaccagacctagagtttttattttttaatttttaaaaaaatttttattatttttttgagacggagtctcactcttttgctcaggctggagtgaagtggtgcaatctggctcactgcaacctccgccccctgggttcaaacaattctcctgcctcagcctcccgagagctgggattacaaacgcctgccacccaccatgcccagctttttttttttttttttttgatttttagtagagacgaggtttcaccatattggccgggctggtcgtgaactcctgacctaggtgatccatctaccttggcctcccaaagtgctaggattacaggtgttagccaccacaccagcctttttaaatgtttttttcattaggaacaacatattccaaacctataaattgagtcatctgtaattttttctaagatacaaattatgaatccaacttactttttttccagattctcccttttcttcctaatgtcttttattaactcatcttttctcaacagattagaaatggacttttatcatctactacattcctgcctgtatttgaatctgtttctaaatttctctgtctctattgatctctatgtgtcagtaaccctctttaattattaccttttaatgatagatttttgtgttttaatatctggtaggattagtctatactcattatgtcttttattttcagaagttcctacttgtttaatttgccatatgacctttaaatcagcttttctagtccctccttattcccaccagaagactcttaaaatttttcattgtgatacacttagagattaatttaaggaaattgacatctatatgaagcatcttcatatgaagaccaaggtgtcagcccccttgcctcgctttttggtggctagtgactcccaaatttgtacctctattttgagcacaaggtctgttctcacccctaggaatctcctcttggatagggggatcccaaagataccccataccctgatccatactgtccctccagcttagtgcattcccccttctctttaatctactcaggtgctcagccagatccagggtctgaagttgtctttggtctctcctggtgtccaagagccatatctaccagtgactaagttctatttttttttttttttttgagacggagttttgctcttgtcgccaggctggagtgcaatggtgtgatcttggctcactgcaacctccatctcctgggttcaaggattctcctacctcagcctccctagtagtggggactacaggagcccaccaccacgtccactaatttttgtattttttagtagagacagggtttcgccatattggccaggctcgtctctgaactcctgaccttatgtgatccgcccacctcagcctcctaaagtgctgggattacagggtgagccactgcgctcagcctgtggtatatttgtaatcactgatgaaccaatattgacaaatattattaattcaagtccatagtttacattaaggttcactcttagtgttgtacattcgcaggtttggataaatgcatgtcatgcatccgtcattacagtatcatacagaatagtttgctgtgctaaaaatgccctgtgctccatccctctcctacccctctgaatccctggcaacgctgatctttttaccattgctagttttgccttttctagaacgtcatatagagttattggatcatacagtatgcagctttttaataccagcctcttttacttagcaatatgcgtttaagttatgctatgtctttttgtagcttgatggctgatttctttgtatcgctaaattttaaagaattgccaaactgtcttccaaagtggtggtgatcattttaccctctcttggtgtatgacgctccagttcttctatatccttgacaacataacaacacttggtatggttgatcttaactttagccattctagtaggtgttcttttagaagcagtccttctagtggctttaatttgcattccctaagagtaatgcactcagtgttttttaatgtgcctatttgccatccagagatcttttggatgaagtgtctgttcaaatgttttgtccattttttgacaggcgcggtggctcacctgtaatcccagcaccttgggaggcagaggcgtgcagatcacttgaggtcaggagtttgaaccagcttggctaacatggtgaaaccctgtctctactaaaaatacaaaaattagcctgggtggtggcgggcgcctgtaatcccagctactggggaggctgaggcaggagaattgcttgacccaggaggtggaggttgcagtgagccaggatcgcgccactgcattccaacctgggtgtggagcgggactccatctcaaaaacaaaaacaaacaccagaaaacaaacaaatgttttgccatttttattggatttttattcaattgtaaaagttctttatacaagtcctacatcagaagaatttttacaaatattcgtcctagtctatggcttatcttttcatttttaatagtttctgcattttgagaaacaaaagcgttttattttgatgaagttcaatttattgatttcttcttcatttacactttttgtgtcatatttaagaaatctggccaggtgccaaagctcacaccttaatcccagcactttgggaggctcaggcaggaggactgcttgagcccaggagttcatgacagcctgagtaacacagcaggaccccatttctacaaaaaatttaaaaattagctgtgtgcgtggcacgtgcctgtagtctcagctactcaggaggctgaggtgagaggatctcttgagccaggagtttaaagttacagtgagctgtgatcagggcactgcactcctgcctggtcaataaagcaagaccctgcctttagaaaagaaaaaagaaatcttttcaaacccaatattgttagattgtctccatttttaaaaaaaaaagttttatggtttggccatttatatttaggtgtgaatccagtttgagttaaattttgatggtgtatcctaaatagttatcaaatccatctactctgcctgccacctctctagtttaaaccacccttctctgtccctggacacctgcgcagaagcctaggagctggttccacccatcactcaccaggttaggtatttcaggcaagtcacacctctcaggcctcagttttcctcttttgttaactgagggtgaaagtggggttagattagatagcggctcttaacttttgaggggtcgtgggccctagagtcctgggaacgctatgcagttcctcagcaaaatgcttgcatccacaacatgcaagactgcagcagctgctgggctggggcgcgagaccagcgaaaagccctgacttgggggggtctcgggagtctctgcagtctccccaccacacccccggcctccgcgccgaatcctggccccccaacttcttgcagcccgtgaagcggatctcagggtcctgggggtggggagagggggctgccgtcctgctcgcagcctctgccccctctcctgggtaaggtgacacatgggcgcttccaggtgggtgggctgagagcctggggagagaacagggatgtccacctctctaagtttccaggttcaagaaaccccagaacgttaagaaagatgggctcccacaattgcccaaccccatcccataggatgcacgcatgcggaaatcgggccgaacggggcagggacttacccaaggtcacgcagcgagcccggtccccctgcgtccccggggagcgctgagccgggacgcggcggtggggtggggaaggggagtggcgcggcctgcggggtgaggctgccgtttgctgagtgtccggcaggggtctgctcgctgccagcccgcccctcctcagagcagctgccgcagcccgaggtaatctcggccccgcgccggggctggtgggaacggcgggagcagctgcggtcgcgcggagcgaggggagctggggaccgggcgg

SEQ ID NO: 5034 - DNA, 19691 bp, Homo sapiens
tattttagaaggtaaggcggtccccaggggcttccaactggctttttctactgtaagatctcgtgttctaggggtagggtgccctctccctccggacccagctgagatgaacttgggcgaaaccacaggcagcaccttctcccacacgctccaccttgcgtgcctctcgcatgttctagtcctggagatggccacgagcgcaaagccagcacacagaggttctggtttttccccatcccgggcaacagccaaggcctgtgccagtccaaccattctatcctcccctaggccaggagcctcctgagcacccctcacccacctcccaggctccacgccacacctgaccctccctgcccgggactctcttgtcccagcagaaagcagggtgtccctgtccaggcccacctcgccctagagccagctcccacctagacagtgcagctcccagtgctcaggtgagggcgcccctcccctccatccgctcacatgacattttttgaaggccttttctctcaccccacggctccaatcccctacagccttatttccctggaaagcacctctcttctaacatactagacacttacgtgttattgttggtctagccccaccctcaactcgaaaccctgtaaagacaaagatttgtatcgctttccacctgaccctatccccagtgcctacaagacagcagggagtccctctgggccccttgggggcacggttcccacacgctgtctgtgatgacgccacccagtcacacggagggccctttgtgtgacagcgcccgtgcgtccaccaatcgccagtgagccagctctgggtaccggcaaggacagacgaggctcgctcaggtcacctgtgtgcccgctccagcattcaggcagtgttctcaggtctcggcctgtgggtcaccaagggtccctgaggttgcagctgctttcatctagtctgatgatcacggggtcttcacggggtcttcacggagctgacatgcgcactgatgggcaagacctgagcaggaacgcaggcaggccccgagccccggcgcagccctgaggggtttcgcaccgcacagctgcagtgtgaaacgccggtcacttccaaatgtccgtgatggagtgaaatggtcgagtgtgtgaggtcttgacccctgggtccacatcttttcaacgtcctgcccagcaactggaaggcgcgcctgccccacgtccacgctgaggaaatgcaggtgtgcaatggctgagctgccgtctggatctggaacacacgtatggagcacactttttactcaaaaaaagatgtgcaaaaactctggttgttcagccttgggtgtcctggcagactttttttttttggaaacgaacaaagtgagcctgtctcattcaaagaaaatagctgacagcatttgttaccaatataaaattcaagctttcatgcaaaaatcagaattctgaaagacaccaccatgagttcacacctttccaactgaaagacttttctaagattggtgatatcgccaaaagtgattttaaaaactgattaaggaactgtgtcagcatttggaatatccgcataacttagtgaaccaaaggccagcgtgtgaggtcacaaaggcatgatggacagagtccttgaagcacaagacggaccaaggattctcctgaaatgaagtagaagttcattgatagggtatcagattccacacacaaccgccagtaaaaaaccaccacctgtcggccgggctaacacctgtaattccagcactttgggggccgaggcgggtggatcacgatgtcaggagattgagaccatcctggctaacacagtgaaccccatctctactaaaaatacaaaaaattagccaggtgtggtggcgggcgcctgtagtccagctactcaggaggctgaggcaggagaatggcgtgaacccgggaggcagagcttgcatgaacccaggaggcggagcttgcagtgagctgaaatcgcgccactgcactccagcctgatgacagagcgggactccgtctccaaaaaaaaaaaacaaaccaccacctgtccagtgttgaataggatcacggaagaatataccgattatttgcaaaggttattaaaatgttccttttctttcaaatacacatctgggtaagaatgagcttctccattcactcctatacttcacaaccaaacacccccaaagtggacggacccagagcctgctgagaggccagtgggcttctcttaaccagagatttacgaccatgtaaaactatgccacacttctcccgaaaactttttgttttgaaaatatatttttcatacaattgttatttatgttaatatgtcatgggtttattgctatttgaaatgaatacatgttttctaaaggtctcaggtttaatttctaataagatattctaattgtattaatattggtcattagaactcacataagcaaaagttctttggcacttttaatgattttattttattttatttttatttatttatttattatttttttttgagacagagtctcgtctgctgcccaggctggagtgcagtggagtgatctcagctcactgcaagctccacctccgggttcacgccattctcctggctcagcctcccaagtagctgggactacaggcgcccgccccacgcccggctaattttttgtatttttagtagagacggggtttcaccgtgttagccagatgatctcaatgtcctgacctcgtgatccgcctgtcttggcctcccaaagtgctgggatacaggtgtgagccaccgcacctggcccacttttaatgatttttaagagcgttgaggggtctcagaccagtttgaggacggctgccgcagggtggcctgtctaggagtggcactgaccaaggaaatgcgtttcttcagctttaggacgggacaccaaattgctcctggaagcggctgcccacatcccaccagcaacgcaggagtctccatttcccgacgttcgtcctggcctccagcgccacatgatctcagtctgcggttccaactccccgactccgagggaggccgagcggtctctcacgctgactggccttggacttttggccccgttcttttttcatatgaatttaaacatatcgcgtccatgtcaaaaccaagaagtgatattattgagactatgtttggaatgacattataaaatgatgacattgactttggagctttcaggagtgtgcgaagtttctccagcgctcggtattatttagatttttcagtaagactgcatagttctcttcagtagaggtcctgttcctctgggttaaattcattccaactctgaatgggatatttcttcatcctcattttcaacaatttaagctggtttaaagagctcccagtcttttgtacatttggctttctgggtatacaaaatgaaatctgaaaacaaaggtaactctactttcttcatttcttatcctgcttattttattatctttttttaatttttttttttttttgagaccgagtttcactgtcacccaggctggatgcagtggtgcaatctcagctcactgcaacctccgcctcccgggttcaagcgattctccgcctcagcctcccaagtagctgggattacaggcatgcaccaccacgcccagctaatttttatttttagtaatgacgaggtttctccatgttggtcaggctggtcttgaactcctgacccagaggatcctcccgcctcagcctcccaaagtgctgggattacaggcgtgaaccaccgtcccggcttttgtttatttatcttaatgcattagctaaaaacgtcaaaacaacatgaaatctacaggtgaaaagcaagcacatctgcctggctcctgattctagttttcaatgttaacagctgctttgctgaatcttatcaaatattttagcaatggctgagatcattttttttctcctaatggaccaacaactaaggaagaaatcagaaagttgttaaggacatgctgctgatgaaggcaccaaccccacgatattctacagctgagttctgctgacatgaggcgatgctgctccgcctggagaaggtcgggcagcgcctgccccttctctaaggtgatggaagggcatgaatcctgactctgattagagagggcgagaagaaaacagaccaaaccacttctaacccaagcacgcagcgactcgcggtgtgctgtcccggatgcctggcagttactgaagtaccggtgcgtctggctgactctacagcagtttcagggtgaagaagttgctacatcatttagaacctccattgttatgtcttgtgggagcgtccagcctaaccttcctgccagggccgcgggcacccttcctctcgagggcttgtgactggctccctgttaggaggctggggaaccccacactggcccctgggagctgctagccagcctcagtggtcagcagctgggggcaggtgcctgtgtcatggcgggttcccagcatctagggtggcacaggtgtccagttggagcccagtgtgtttgttaagaaatgatttcttgggtggtgtcttgcctacgaggcgggtgggtcccggagctggaaactgctagagcaaaagctcccaaaactcaggcccgcatcagatgtgcccgcatcctctgtcccctggggccacccttccttctgcttctcggcaggtgctatggcagccacactggcttgcagagctggctctgtgcatctcttctcaaccacagggtcagcggcgtcatctggcagctgaaactggcaccgtagcgctggctgctgctccctcctcccaccactgccgccgctccttaaccctcacgacactctgcctctcatcccacagcaacatgggccgagtcctcggcacacagctctggggagatggctgaggagggtgggagctccaggaccctcagagtgaagtgaatctgcttgcccagctcccctttgggctccacagaacacgccggcctctccttcacacaggcggccgagggcaccctccacaccaccatggtccacaggctggtcccacacccagtggagtcaagctgctctcttgcctggctgacctcaagaccccctagagggtaggatgagctgctgtgcttgtcgcaggatgactgcagcactgcctggcaggatgcctgctgccacacctgccttgcacctgtctccacggcctgctcgcttggcagccagagggagatttttctgaaccctggtcaaaccatgctgttcacctgctgacccacctgccaacaaccttctatttgggcagcacttgcctaattccaggaggtgactcaaacacacctggccccagcctcctttgcagccaggcaaccagacgcccgagtcccggccaaggaggctcatagagaattcagctttgggaaagtggagcttctagaaagagtttgaaactggtggaagggccggcagtgaggtgagcttgcactgtggccgctccaccacccctctgtcccccaccgatgtcagacccagagctgcactggcaaaagactcccactaagcttgaaaagcatgaacactcctccccacgggctgcacgggctccgtggcctggctgctggccaccagcctcctagctgctcctgggcttgctccagtgtctctgcctctgggccttcgcactggccgttccctgtgtggccactgttcccagctccacgatgtctgcctccgtgtcctcaggccaacccctcccttccagcacttatcacaacctgcaccatttctctactgacccatgtgtcttccccgcatgggagcataagctccaagaggccaggcctttgtgtcatccaccatgatatctccagcacccagaacactcaacagggctgtgctgtgaacaggtgttacgacttttattagtgtcattgctaaggaggcagtggaaacacctatgctccaaacagagctgaataaaagcctcctggaaggtcgctggggttttcatcaggctcagaggccatttaaggagagacgcagaggtcctggtgagggaggacacagggttccctcaggagagagctcccccagctccagcctgccccaacccgtttccatctgctttcattttgggatccatcaatcagggcatcctcaccaagccagcaacagcaaactgtgcgttccaggaagaatgaaaaagtatacgtttaatatcaaagccacgtcaagtatcattgatagtaacgcactggagagtggctctaggacgttcttactcggagtgaaccccagaggccctggcctggtccgaggaagggcattcatgctggagactggagcctcacggtccccagggcctgggggtcctcaaaatacccctcagaagggacatcctgccagaggccaggtggaaggcggtctccctcgcggggcggcccccttgcccgcctggcctgagtggcctgccctgggtggcctgagcgtaccaccagccgcccggccccgccgccgccgccgcctgctggcctagacgctggacttgtgatgatcctctccagcagactcatcatgcgctcctgcagctgcaggctctgcacctgaggatgtgctgctggtccagcacacggcgcacctcgcggcaggtctcctccacggcgcgctcagccggcgctgctcctccaccatggcctccagcagccgcagctgcttcttctgcagtggcagctctgcaccttgcgcttcttcaccggccgctcctccgacctggaaggacagtgcggctgtggacgtgctggccacagagcctgggcacaccaggggcctcaccggaccctccgacaatcctactgggcaaatggggaaactgaggccccagggagtcaggtcacttactcaggtctcatattccatgtgcaaaggaggggccagaacccaccgcctttgacagaaagtaaaggggtggccgggtgtggaggcttatgcctgtaatcccagcactttgggaggcagaggcggtggatcacctgaggtcaggagttcaagaccagcctggccaacatggtgaaaccccattctactaaaaatacaaaaattagccaggcgttgtggcgggtgcctgtaatcccagctaccgggaggctgaggcaggagaatcgcttgaacccacgaggcggaggttgcagtgagccaaatcgcgccactgctctctgcacaagagcgagactccgtctcaaaaaaaaaaaaaaagaaaagaaagaaagagaggccacaggcattgccgtcctttgcgactagcggatgaccccaataccagggtcccaggacaatccacaccccttcggtctggaaagggtgggatgttctgggcgcagaggggcatatcctgccagggagcacccttcacccaccaaactgggcaggtgggggtcagccccagttgggggccaggggtggagagaccacccccagggagagatgaaggcagggtggggggtgctgggtagtgcagagtactcaggacccctgtagggaagccaagaccaccgccccacccggccttaggcagatggggaaactgaggtcccagaaggaagggcctgagattgagcccccttatctcccggcggcctagaaatggggccggcacaccttggtagagaggcgaaggacaggcacctagagggtgtggggcccacaagaggcctgggctctctccccaggactcagagctctggtagaggtggtgagtaaaggcagtccagccctgtgggcgcctcctgaagctctgctgctggggtaggggccacccgtggtctcagcagacctccctgaagggcaggagctgccaaaacccacagaccccagggccctgctccagtgcctgctcatccctggcccaactctgctctgagctgagagggtacagccaacctcaggggcgtgagatccgcgctttggcctgatcagggagggcagcccccacgccccagtcctgtgcaaggccccaggcagctgagctgagaactgggctcagtccacgggaacaacagccacaaatctcaggcctcctgctggtccttctagctgccagcaaaagcgtttttgtctcaggtcttcaatgagaaatcctgagtcagcagcggcccccggcatgagagggaccctcctcggagacgccttctctactaaagatattttctgacacctcctgtcagaaagacttgaagaccagggcaggggagaagctgtgactaaatccacaatcttcctgttcttgcctccaaatggccaacttctattttaccttgaaagccaccccaaatgtcccctcctcaaaagcaccttctctgggctccccaggcccaccccgcggtgtctgtcctgcatgctgcctggctcccggctgccctgtgagcatcttgcaggcacatcacgtggccagcacgggacgggtctgaggtgtgggatggatggcagaggggacgggtctgcccacggcaacacgtgatgaggtgcagcccgacaccctccccagtgctgagagggcactagcctgtgagggtggggtctgtgtgggctaagggaggccagggggcgcattctggggctggggcttggtctccctccgtgtgccgggccccatgctgcgtcttctctcctgtgatgtcccagccaccctctgagaaaggtactgatttacccccattttataggagggagactgagccagagaagtcaaggaactttccgtgcagctcaaaagtgatggagctgggagacaaaccggtctgcctgtggacactaaagccctccctggtctgaggccgcctgtccctggaggcgtgcccgcagccacggcctctgcaaccactgtggccgccgccgccagccttgccactcccgtccctttctctaaatggcgggggctgagataccccagggcaggggaaggacaagcagaacactacctgaacttaagggacagtaagctggaggagctgtcggagcgatcatcctcgagcggccttcgtaggagcactggttatacgggaagtacagaggggtggacttagcgggcgcgacagggacgcctcggtctgggacgtggagggccccggcggctggctgtccggcagttgccatcacaggactcggggaccttggccagaatcccatcaatggctaggtaatagggccgtcgggcggggcggactcgctatctgtcatgcattttaatttcctgaaacgagagacacagagccaagggtgagaaacagagctggcccagcccctgtcctgcccagcctcagcagagggcgcgccacgccggcacaggcaggagccgctctcggctggcaagggcctccccagcaaatcggccaggctccagggtcaagatgacaatggacttagaaagaagctgggcttcaggactacacgggctcagatgttaaaaaggaagcacacgtcccagtattactaaggttatctggcatgctgggaccttggggctggtcctattgcttttcccttgcttttctatagtttctaactctctgcaatgagcaaatactgctttttaaataattcattttgaaaggtagagtaataggttttattgtaataataaggtattataagatatataaatatagtgataatattttgtatataataactgtgttgttcgggagagaatgcctcagggagcgacagccactggcgttaagcacaggcttcagtgtccacagccctgagtcagtatctcatctccacactttgctgtggactttgggcaggttcattcacctctctgagcctctatttttatatcaatgacatagtgtgatcaaagtaagcccctcccccagctacagggcagatttaataaagcaaacagcaggcgggctcccatgccattcttggttgaacctacagtctgggcaggagcctagatccagcgcacaacctgcaacctgcccagaggccctggggtgggccggatgggccccttcccacactgctgatgcctcattaccactgggacccccagcacccacctactcctgcagacaggtcctgcctgagaggctaagtccccaggcctcccctgggcctcggctgccctctgggaggtcaagcaggagacacagggccccatggcggccagacagctctggccaggccagggaagaagccaaaggtgggggtggggcaggggcatctctgcctcactggacccagtacctcctaaggcccgtgcccactccccactctgcctttgagtgacagagtgccccaaggccgggctccaaaccaacctgtgctcggagtgggtgtctcctctctcctactcttgctacctgccagggtgtggcattggccgttggaaacaataagctggattctgaatgaggtgcccccagcaaacaggcaagccagatggtgagcaggggatgctgcccagggtggcacgtggctgtgaagacaccagccagagcgtgtgagggcaggcgctgggtgcccatccctaacctctgccccaggcttctcttctgccctacttgagccagcccactctttggagaaacgagaaaaggcctattctcagtgaggaggcccccaaactgtacttcaacaaaccatgctccacagaaccagccaccctctcagcttcttcagcccaacagccttaatatataaagagttcttgtaaaaaaaaaaaaaagaaaagaaaaaaaaaagaaaagcctctgctatggggagactgcgggtataaagaaaaaggacaagatcgagtcacccagccacagcttcctctgctaaggactatgtggccctgggcaagtcctctcatgctctgggcctcagcttccccctcggtgaactaaggctgactgtggcagcttgaggggctgcggtgtggaagtgcttcatcagccatgacgtgcagtgcaccggtgcagccttggccagcccagactgcagggtctggagtggaggcccccactctgctgcaccctcattctcagcctccaggaatggagacagaaaccctcccctgggactctgaagaggctttcagataaataatgaataacctggccagacaccaaccagagccagccagggaggtggtgcccggaattcctgagtcagaggggagcctgctggaacagtcgtggccacctcccactgccctcgcgtcccttcctcaccaggtgcctgagcaggactaggaggccacgggaacagtggggcccgggcagctgcctgtgtccaccgaacctctgaagatacccaggctcacacctcagccctacgtcgcaagccagccgctcaaacccaacatccgtcatgctcagcaccctaggtcccggtttggggcctgcctaggggcctttgggcagggccaggccccggacccctccttcaaggccagaaaaaatcaaatcaacgcaactgaaagcggagacctcacaggctggcggtctgtccgggccttgctgggcctcttccccactcccactagggctggggactgggggttcccttctctgtgctggaggccggctcctcgcctgaggggggcagtgggggtggcctctcccacaagggctcaggtgctctcagcctctctgccccaggctcacctgcctgacccggaggtggagcgctgagtgaggccactcccatcctggaagctgacaggctctccggcagccccaggcccaccctgtccaggccgcccacagggccgggtgctctctgctgccattctccccctgcagctccagctcttgctgccaccctcgctccgtgcaagaccctccccacacccaaaaccatcacccacacctgtgaccttcaccgcacacctatgaccttcacaccctgcaagaccctcaccgacctgtgaccttgcctgtgcctgagaccttcaccccaccatgacccctgcccacccgggccctgtcctaatgggctggggacccacgcactttaagatgctgggtgtgtgggaccacactgtcccctcctagacgccaacatctccctggctgggtggtcccctccggccttccctgaggttgccagggcaggaagggcccacctgccatgtagcaggagcagaggtggggccaggcgggagcccccacgctgggagtcctgggccagggcaggcctccacctctttcttcttcgaccgtaagccccacccatgcgctggctggtcctgcacctcacctggtgatttctggaaaaccccaccgtgaccctagggccagccccagtggggctcaccggctcatggcagaggctcgtggatgctccaagtcgcagagcactgagcctccttctcacttgcagtctcaatttcccaatgacgcagtaggcccctgaaacccctgctgagcttgggagcttggtggtggggagggactggcagccgccgcctccctatgggggagcagggtgtgaggtcagtgggcaccaccatagtgttgctgcctccgagggacagtgcccagaccgcccatacgtcctgggagccatcctgcctctgcccagcaccagccccacccctgctacccctcagctcttagactggtttcctgccttgctgggcctcagtttccccacttccccaatggaaggctgcacacacggtttccgtggccccgtctcaccccgtggggttctgcccatacccggccagaggagaccgacaggcagccacgacccacacatcgtcccgactcagagctccaagaaagtcaggagcggcccgccaccccgggcccgcccgtcctggtggggcccacactgcccgctcgcccacctgtactggaagtcatgttggtgatcttgatcttgatctcctcgcccagcctgcgctcgccggtcatctcgagagcttgctggccatcttctcgtacaccttggcgttgcgcttggtctgcttgagctcgcgaagaactcctcccagaccagcatgaggccgcgcatctcggcgtccgtccagttgcggcccgccggtgcttctccgcctggggagacacgaggtagccgggcccctcggccgccgcctgccggaggcgcctgtggggtgagagagcgcgctcagcgagggccccggcccggccccagcaccatgggcgggaggcgccgctcacgctcgctcgaaggcagctccacgctcaaaatgggcctacatctgacaggcaggaatttagttaaaagcttttaaacgggaaacgtcattttatgtcacgtttccatagcaacagagcaactgcataagctacaacaacagaaaccttttactgaaagcacaggaatcagggccgcactgacgggccatcaatattgcggcgagcgggccggcccaaacccagcggcccggctcccggccctgcctctcaccgccgcccaggcggatcgcccccagttcagtgccgccccggctcacgcaggccaagagggggcctcgggtgggaacagcaaggagaaagggggcaaaaggtgggagaaacagagaggacgagcgacgaggaggctggtcccccaacgctggccactggccctggtgggggtcctgggctgtgggacccttaagctcctcagaaggcccctgccttctgaactggggctgggccctggggctcctgggtgtcctgtcctggggtcctggggctgggccctcacaagaaccccaaacccccacccttggctcctttgcttctcttgctccagcccccaggcgccctgggccttaggtctgtggacactggaagccgggttggtcagagccaggccctgcccagaggtgcagacacagggtacacagacacgggctctggcaccggccggtgaggacagcagtgatggcaaaggtgagctctgtttgagacacggagggaatcagcccagcaagccagggggaggccacagggcactcctgggaagagccacggcatggcagggcacagtctgggtacgcagggagctgatgggcagccagattcggcacacgtgcggagacggggctcgaggcccaggctgcggggcaggcccctgtggggctgagggatgagatgcccccaggctggccggaggaccacagcctgccgagagccccagatgcagcggaccggaaccggagcggtggcctgggggttctgcccggagaagtgccgcccaagggcatcgcacccgaaacgtaacacatgcatgtcaggcagggctctgtggagcccacggcacctgtcagcatggactgtgctgggcgcggtgcccaggctaaatgccactgtggtcagcagagggcagcaggcacccccctgccctcctcaggcctgaccaactgcaggagactctcaggtgtggctgccccaagaagggcagctgagcctggaatgaggaggcatctcggcctctgcccgctcccctgctgtcctctgaggcaccttggaggtgggaccgaggctctcaggggaaggacaggcaggggcatggcgggggtgcccagccccactgtgggtgcccagcatagggaaggcgaatggggctccctcttgcccgcagtcaggataggaagtgtatggggagggccccagggatggtgaggaactcagaggggtctctgcaccccctacactgggtccctggtcaaggcctggcccaccatcagccccatgagactagtccagtcccttccatctgggcctcaggagacatcaccctactgcctggcactggggcatctccactcgactaaggtcagccctccgtgctggggctggcacagagagctctgtggagtgcctgcagatgaaggagtgactagaaggcctacctctctaggaagccctggctcctcaggaacagggttcggccctccccggtgaggtcagggacggtccgaatgccctttccgtagccatgactccaagggcagaggtggggctggctcccacatctcttggcatctcccggcacaaggggtaagcagaaaggcatggggtcccagcagtgttctgggtgcagctctagcgactcagcatggaccttagtcatgtcctccccactaaccttttcctcacctccacaacaggggtaacaggatctgactatatcacccagcatggtgctgctaagggggcacagccctcccagaaccctggggaggtcatggggcccctacgtgccctcacccccttccacaaatccaccttggagctgctggggacagcgtcaggcctactgtcctgctgaaggggcagctgctggccagtggacaccaccaccactgccgggggcccccaccggaggctctagaggaggcacctacacccctgcctgcccgagttccagtgggcgcagggaggcgggccctgcctggcagggtgccaccccacacccgcaccatcctccaggcagcattcccaggtaaaaggctcaactccaaccctctcttcccaggctcagtgcacatgggaggccctggcagggcaagctccatggcctttcccgaggcagagccctcacactgacctccaatgtgagacaagaaccaggcaggcagcagatggcagcaccaggcacccagctgctcctgcctgggaggtccccacatctgtcccctgctggggaggggctcgtaccttggcaaagctgcatggccgctgggaccctcagtcgctacggggtctcctagggccagaggctggtcaaccagcagcactgagggagaaggggcaggtcaggcctcggcaggagctgtccctggtgcagacctgggaatgggcggggccctgctgggctcaggctagaagcatgctccctaggcctccatcccttcaaataatgaggctgggcccaactagactctcatcctgctcagcatttctgggtggatttctgccctgcctgacaggccagcaggacatggggactgaccaagggtgggggcagcagggtcccaaacacagaagcccagagaggaggtgggcgtcccactgaggggcaccttccaggacagcagtggtgagcacagcctgtgcagatgggtggggatttggcagctgaggagttcaggcttgggtgaaggcagagaaccacgtggagtcctgggcccaaatcacggggggcccctggcaggctccggagcctggacttccccagagcaattggggccaggaggggaaggatgtggcaacactgccgccgctggggcagggtagaaggttgggcgggtgggctgtccagagggtaaggggccaggatccacctcaggaccagcctgtcctagcagttttgggggtagctgcctgccaagcatggagggcaggggcctgtgcacacaaggggaacccagacccacaacttcagcctctgcctccagtgatgccctgaccctgacctcacaggtccacagggcccacccagggccagacacccccgaccaggacacctggaggcctggtgtagggtggagaaagccggccacatggcgggcccccccagaggatgtggctgcaacaggactgggtcctctgtggctcaagcccttgcccaaaaggcagccaggctgctggggctgcagagcctgggggacccgcaagcgattccacatggtttcccaaaagaggtcctggtgatgacacaaggccgggtccacctctaccacagacactgtcacggtgctcatggaccagactcgtgggctcgcggaggatgcctttcccaggccccactgcaggcttccctgaggggtgcaccccacacccccaggaacggggcttctctgtcctcggttggctgtgtcacatcatgtagaggcaaggcccccctacccagtccctcagtggcggctccacccggtactcacctcaccctggctacttccctcatctgacttacatgctccacgcaccacgcaggggaagcgacttccagatcccaacaaagccagtagcagccaaatcaaataccaccgaaggcacagggcacagctcggcaaggggacagggtgtgctctcgatgaggaagaggaaggctgtgttgagggcagctctgccgtggcatggggagggactgcaagcccactcacgaggggttcaccgctgcttcccactggaccccggcccctcttctttcgaaattaccagccatgccaggtgtgctcagtgtgccaggctgtccacacctggaccaggagaagggggtgctccatttctctgaagtgaccagaatttaggtagctctgaaaggagagccactggggggccctggagcggtgtcacctatgaggagacagatttagggagctcaagtgcatgccccgccccaaatgctttaggcctgtccaccacatccctccggcagactgatcctatccctgctcagagaaagggggcccccgcacgtgcccaagaggagcaggcagcaggagtggccccttggccgactggcccccgtctctcctggcacagacagcagagcagggaaagatgggtggacgacccctgccaattagccagaaccagacgggacctcagcaaacattgactaataccctgcaccagaggaagccacagggtttttgttcttgcaggttggtaagacatctcatcccaagatgactacaccaccaatcaccaaggcttccgagaggctcgtccggagcttgaagcatccccgctgggctgagcagaggcttcttggagtaggcgctggttcagacaggaaaacaagctagaatagacggggcaggccctgcggacacacagcagccccggccacaccaaggtgggatgtgccagctgctttgggggttacctgggagcagctgggccagggacgcagtgtcaatggccaaggaggtggaagggtggtgggccctgtgagaacacagctctagtctcgtgctgggcctgatgacctgcttcagtgccatgggccaagtcctgaggcttgtgtatgtatataagcttatgatgtcacttgaccatgaaggctccagcagctccagcagctcccacactcccatctgcagggcaggaagaccacctgtactgtggtttgggaaggcccttgcagaacacccagccaggcccatgccctggggccacttcctcatccctggctacagaaaacacgggcctgtccctgctggcagctgcctgggggaccctccataatgccagatgttagctggtggacagtttctgcccctgctggagaagcacttaggagactgcttcctaagactccagctcgcaaggtctaggttctcatgaagcaaagcaagcctcacacagcaacaactgatggtttcatttttttcctttaatttggatgtacaatgtttgcagcagttaaaaaattaaatatacactctcgtcagtccttccctttgctctcagaagcattcaggtctgggtggggctccgggatcgcccatcacagccctgctggctccaggggagctcaagctcagctgacagtccctctgccacggtgcaaagcagtgagacctggacaaggaggccccacttgggtcagagcccacccccgtaggcaggtccacgttggccacgatcctccaaggctggcagttaccacccagattgagcgggagactctgctcttagaaacaactgaggggaaggcgttcctttgactgcaccaggcgtgacaggcacatgggggaagagcggcccctgaaccttccaggttgccttcagttgtatgcggcattctgagcagctccctccttcccaggaggcccaggcccggcaagcgagtgtctcgtctgagccatcctgagctctccaaggtccctcagcagctctcaagatcttccttctctcactcctacacgtgacccctctggaggacagctccaagtctaccctggccagcagcgtggtcccgggtcctccccgcagagggaggaagcgggggagggacaaagcccgatgaggtgtctgctgggaaggatgctcacaggtagcaagagaagcctgactccacccaccagacaacagaactaacctcactccaccccgcaacgggaggaagttccacctgccaggcggccaccaccgagttattgctgtctactatccgtcccgagctccacgtggggctcatctcagctcaagaggaggagctgttcattggctccgagggctctgaaatgaccccctccatgaagatggggcgaggggtgtcctttagggcacagggccttctcagatgctacattctgggtgtctgagggggttcagcttcacattttccccttgaaaggacacatgcgctggcagaaatgagggggacagtaacaaagagcacttggcagctggaaacatcacctacatagactcagctgggccgcagcggaagggaggcacattttgggaaagaaacacgcttcagtgcattgccaaacaatctaccctggtttcattaaaatctttcccgatattaccagcaggaaaacaaaagcaatcccccacagcccacccccaaaacttgacaaccaaattaatcacatttgcaacaaaatttgataatacgatgggtgcttgccacagatttttaggaacatgataaagtcttcctcccttcgcagagagctgatatggagaccatcttcgccagtgggatcctag

SEQ ID NO: 5035 - DNA, 20674 bp, Homo sapiens
acctagctgtttgaataggtttcaatttggtaattactgtatttagataattctgcctcctttcccactacccttcattaccaagaaaaccagtgcaaaaaatcaaagcatgaaaatggagacgcacattgagtcaaataggaaattgctcaactcagtggcttctgagtgcatgagcagagaccttttaagcatgtccttccttccccaggttgcaactgactttctccagggaagaatatattcccaagttgatcaaatcgtgtggatgcaagtcttccaatgtgctcagtcacaaaaatgtctgagcctgggatgtcaggtaacccacttttcagaatacttaaatcacacaaggagcattctgtttagtactgggaccacaatgcttaagctgagccttaagaagtcagaagaatcttaataagatttggacatgatgcccacagccctgatactacgtccaggcagctaaaattgcttgaggttaaacatttaagttttatacccagccaactttctcacaaaggatggaggtgatccacactgacatatgtataaaccatacatttaggatttaacatatgttaggttataatattaatccgaaattaagaaaaacagaacacaaacgctataggaaaacataacatatgaacaaagactagaagaaaacaaaaacctaagtagttgttttaggaggatgggttgtaagtaaactcgctttctcaaaaaggaatctgaatgtcattttactacattttagaacaatagaaggaaaaagttgtgtatatccagctggaaggaaacattgcaattggacattaatgcttgggtctgagctttctggagctaagttaacactttgggttatgtagcttttacgaccaatcaaagaaggtgtataagtcagttctcaaaagatagacatttttctacatttgattataaatgaattcagggaacattgggtgtagccttaaccataccacccctcatctcttctctcttgtaaggtccatatctttggcctctttgcctaggtcctacctcagaaacaaatgctttgaaaaccaaatgacaaggattaaaagattaaatcagcatgaagcttgagttgacacagttgtacattttcttaacccaatcatggacaactatatgcaggatggaatcacttctggtaccttagggagagagaaataattacaggactaaactattaagtctagccaattaaatctcaatcagtgtgctttagactgtttagagaattatctgctgatgagggcttcagtaataaaactggaaaaaacatattgctaaagtaacagtaatgaaattttgcaaaactagatctacttgcaccaggctaccaggttccaggatttggggtagggaactttgtagtcatttaaaatatttttgctagaaatcaagctataaaaagttaaaagatcaatgagatcttttcttagaaaatgtggcaaaactgactgaaagctggacttcagaaattctcattagtaacacacgcagcaaattattcttccatcttgtcttcttttcctcaaatttcacatttttgaggtaacattttggaatccgacagtattttctgaattgtttgttctgaacagcatactataactttatattttcacttagtttataaagaatattttgaagagcgagcgaaagcagaaacaacggaacttgctgcagttaatgctttaaataaagtgacttatgaatggtaatttcaaatggttccaagctgaaaaaaaattttagatttttttctagaattgactcaaagttgcacacctgaacttttgactcctttttcaaaataatttctgtgtgttttttttttaacattagagcatttgacatttttcctaaaatcagccacttttctccactggtgagcattgcagttctgttatttattctgccattaggtgctaaatgcatagggaaatgagatccttgcaatcccacctgaccacatttctaaccactctgaatttaatttccagttatagttttcagaattgtgctatttgtatcacaaggtaagcctgaataactttgcatcaattctaatttggcagtccaccattatcctaaattcccctagggaatactaataaccttctgattcccaggtaatgtaaggtaccaacgttgcatttgcattattcttttccttttcaaaagagagtatgtgaatagtttgaaaattggttttgtgttgaagcaaaagtatctttgatgacaaatagttcggagacctggcctgggataagctttatgctcctggctcacctttggagagggagtgggggcgggcacgggagtccccggtccagaggccctgcggaggtcagctgaggtgctgtcattatgtatcatgcttggcatctcatttctgaaagcaatcgtccagctccactcttgcacacccgtggcctccccgttcacctccgtcccccgactgttggggagcggggccctggctgcagttcagctggacccagggctctccgtgtccccaaggggcccaagacagcggctcagccttcagggccagctgcaggtccgaccctcacccagcgggcctgtttcccactcgcccacgtccccgctcccttgagtcacccccatatgcaggcccactgtgagctcggaggcaggagagcctcgctcccaattcccgctctctgccccctacagaaaacccctaaaggtctcgacccctcttaagccctccaccccggggagccttcccctgcagactccacgcttctgcgcggccttttgaccccattcgcatgaaatctgcagagcgaccgccccaaggaccagcgagcgctaatcagatccgttgtgtctgcagagcttcacctgaggcctgggtccccgagggcggatgagcgggccggcttcgggcccgggctgggggacccgcagtccgcggtcggcggggatggggaggggtggccgctgccgcgcggctcccgcgggccgtcgccaggtgcacggtccccctggtcccccgcaggaggacgccccctggtgcccccgccgccgccgggcctgggagctccagagcgggcgggagcggggtcggcggggctggatcttgacgccagtccaaggccgggtgactattggggtctgccgcgccgcggacgcgccgagccctctcagtgtggcgctgcccggcggcgaggggggtgggaacgaagcacggtcaagacagaaaacaaagtcagcaggtcacctggcaggttctggggaattatgcaacgaaagcaggggaatgtttgatgcgtcccactccacacccccccaaccttttttttttttttttaagctcctaggaagccggttccagtttaagggttgggtagggacgaccaagcagctcctctgatgtggttacgactttgccgaactcctcaagggcgagcttcctccccatctttctttcagtaataggaacattactctggagaaaaaaaaaaaaaaaaacatgaatggggtgaaatggtaggcttgatccaaaagcaacgccgagaatcaccctacgattccgtcaggtactgaactgaatattaggcaaaaatagtaaatgccgaaacctaaatcaacacatccaattttttttattttttttttaatctccccgggtctcaggactaagctttcaacagaatttaaagagttaacgctggccatagctctttgttttccatgctaacatttgtgcattaggactattttgttaactaggtatatgcaattcacagaatttcacggtaaattcccagaccaaatatttggctgaacaaataaacaacattatccattcctgaaaataagccataggagcggggaggatggaggaaggggctggttgctagaactggacagccacagggctcgtactggccctaggataatttgttcaagtactggagatctactggttccttttcaatgaatcgacgtttcagaaagttgctagaaattgggcaaaacaaaatgaggctgcctgagggcatctataaggggcttccctaaatgatttatttgagctccataccattaatcaaaggggcgcgacctggggggttggaggggtgggggaaggatccctttttgcggggagttttggaggactgtgtagtcttgctgcctttgcctgaggctctgatgtcttctctccacctgcgctctcggggagctggggttttggcaaccaccccgcttcaatttttattggtttccactaagctctccttttggaggagtgtaggacttcagtaattaaaaacaaaaatgaatcctgcttcaccactccactcccaggagcgtatgtaagaaagtgtgtacaagaatgcaagggtgcacacccacctagaaaaatgcaaacgccaggagtgtgcaccacacacattctttgggtgcacacacaccagcaacagcaatactaccgctcatatctacaccttcatgatggagaaatgcgctacagccttccccacagagaacatacaaagacactaaatgtttctgctccaaagggatccaagggatcttggtctgtgctggctcacttcatatgtgtgaattttctcagcacacatatgaatgagccagcacagaccaagattcaaggcttaatttagttgttggtggcaagtaagaaaagcaaaggcctctcctctgctcctcttaatccctacacccgtcattccagaaaggcattatctgcctgctgggagcccttaactgagggtacattagcatcctcctttttattaacttgtccaaaaattgagcttttccctttaagaaaccctagcacagaacatcagatctaccttttctgcccaagtccagggaagagggtgtgagggaggcagtacagagcgaaaaggagagtgacatttgactcgagatttctgtataatagtgggacaccttcacagtgcctgcttagaattctgaccctttagtatctgaccccattgtcaacccccacccagcccaatctgttgggtcctaaacttgatgaaggccttcacattgggaaaagaggacaagggaaaaagtcaagaacaatgggaaattctatcaagtggcatattaaaacagtagtcatcaaactttttgaaggtgggtacattatttgttacaaaaaaaaaaaaaagacaaaatagcagtgcatgcctgtaatccaaagaggccgaaatgagaagattgcttgagcccaggagttcaagaccagcctggggcacaaagagagaacttgtttcaaaaaaaaaaagacaaaagaaaaaacaaaagagtcctactggagaaaaaaaaaataagtttaaaaacatgccttcacacacacattatgatgttagtgacaaattagttttgatttggaaatatcacattggtacctgtaataactggagataccctaggtatcatgaaagcagaggtgggtatcatttttctagggttgagacctcatcacgctcgctgtgatacacctcaacaggtgagtgaaacagaagatgtacaaggggcctgaaatgaatctttaatctgacctacactcctttcatcccagtgtttctccaaggcatgtgtcatccaatgggagaggatactgcatccttgttaacattaaatagaaatagaaaacaattcatgctgcaattaccatctctctctgccaacagtttacttcctgtccctacaacttaaccacctcaggtaccaccttttgacttccatccagcctccaactcacctgaacagaaaaaagcctcatcaaaagagatgagcccgaaggaaaagagaaaggattaaggagaaaaaaaaatcatgattacctttaaaataatgactcattttatttttttcttttaatacgtagttataaatatatttgtcaaaatatatgatcaatatggtcaaaacatttgcacgtaaagtcataaataaggtaaggtgaatgtttagggattttttccttttttttttttttttttaaataaaagtccagcataaggaagcagtctgtgtagtgtgtgggtgagtggatgggaacgtgtgtgtgtggtgttgtggtgtgtgtgtgtggtgtgtatatctgtctatcctcaaggactgcctgatctcagcgcacccacatccctctactaccatctcctgataatttttcagtaccaccttatcatactatccaggtacagcatggagatggcactcagttcagtgggcacacaacaggctttggggaactggaattgacagaattgaccagggtctgcacaatggcatggttggttgagttgaggtgtcagccagtggaaaggggcagtccccatggcagtagaaggcctggtagcctggtggggcacaatccagtcattccagcccacatcgctgaagtccacatagagcgagtggcgccggcgttcttattcttcttcctggcccgctgtgagtgatgcttagggctacgcttggccctccgcgtcgggtcaaggcatggccccggccatcatggccaaaggtgaccaggaggggccggactgggcccaattcccactcccttgaggtaacgatcggctaatcctgacatgctggccctgtgggtccgagtctgatggaggtgagtcacctcaatggctagcccatagtttggctgctctcccgggtccagcgaaggaccgcagggctcacatcaaaagtttcccaccgtgtcacatgtggtggaccagtctcgtgtccagtagtcgtgtgatgaggtgcccaggcaccacttctgtgggggcttcataacctcataaatgtttatacggtggaagcccctttcccaatcagggcctggtccacctgctcccggaagagccgaagctctgcagaggagatcacctcgttctcaggatgctgctgaggttaaagaggaaacgaaaagcagagttttcactggtccctgggatgtctccagatgttctaggcacagttaggaaggaaggggaaaagaaaaagcatatgaactttttcaaagatggaagagtcaagagatagctcagggttgggcaatgaatggtgaattctgctatgcaggggaaacctactgggggaaaataagcataccccttaatttgaaggagcagatagtggggcagctaacaaaccagcaaaatgtagctagcatttctcaagcaccaaagacagaactatatccagcctccttgatatgtctaataatttctatgtgtcaactcctctatggcccacaatcagactcctcttttaaaccccccaccttggctttgtgtccacagttttctttcaagtggttgtaaagaaaaagaggggccaacagagcacaggcaggaggaaacatgcagaaaccaccctctccctcttccactattgagtatgttactaaacatttccccagcgatcttgaaacacagagcatgccttgttgatcatgttacagaggggaaaataaattccaacacagaatgatgctggtggattaataactcagatttactttggaaaagaaacatccgctaggaacattcagatcggattacaaggcccctattgaataaacccgacaaacacacagctgtaatttaaattcagtaggtgctttgaaaaaaacgggcagaaaacctagcagaaaaggctttgaatagcaaaaacacaccgctggggctagcccacgtctgagtgctgtcattccccttccccgaacacctccccctctgtctccaaaaaataagttcggcggcagctctgcaaattcttggggtaagcagctctgttcctcagcctcctggactggggctttgatgtaacccgaactcttttccccagggctttcactgcccctctagccagtcccaccagccctcccccacgcagactggggaagagactgaccttcgtggtggaagctcctcacggtgttggcccggctggccggggctcaggatactcaagaccagtgctgtggatctgctcttcctcctcctccccagactgagccggtaaagatcccgcatgtagtccggaatgacggcactcttgctaggctgcgggcggggcgcagcccaaacatctgcagaagtgtcgcctcgaagtcccgcaggagctcatggctcgccctgagcggcgtcctcccgcgtggccctgaatctcggcgacttttttcttccccgtccaggtatcaaactagcatggctcgcgcctcctagcaggacttggcataataaaacgacctcagcattcggttaccaggaatcatggtgtctctggggagggggaggggagtggaaggtaaagaataaacaaacaccaataaatagggagaaatagagatgtgtctgcatatgcatttgggctagaaatggaggggcaagatggaaagcaggtcagaaagatcaagtttgtgtcttcccctcacaccacccgcccacccaccagctgcagccatgcacggcctgaaagtaagaattccctgtaattacttggtctaacttgtttacagtcaaataaccccaaatcagatagcctcatcctgttaatctttttttgtcctaactgctatctgggccatgatctcagcgtggcttctgaaggataaacagttaacattgagggggtgaaaaggggtgggggagggagaattaaaaggcattgctctccactttagaccttcagcttctctcccttttcctccaccctcagagccaactttcacaacttccagttggttcagagccagagggagggaaagtgagaggcaggggcgggcgaagacagagggcgacagggtccagaagccgagaaggtggtctgggagctaaccggtggcttgagggcttattttattgtggccgatgagtttgaaatattcagccaaaagtgctgatcgtgcccgctcatccccagggaaggggtgagagacgattccggagagacctctgtagttttgacaagagagtgggaacgcgccacggagacactgggggctctcccagacaagtggataggggaagggagtggttagccctcaaggtacaaccccgggctttcatctctttagtccctcgcgctcccctttcttgcaacgctgagagggcgagtgcgcgctagcagcactttaaaggaacccgtacgcttccagcgccccggctgccgggccaagaagggagcgacagtgcgccagggagcagagtgtggatattgtaaaggaggtccgacggaagggacagccggcgagaggggtggtgagggcagagtgaattccggggagggggaaggaagaggtgtctactcactacagaaaacaaggcatataataacagtccatgattcttgacagccaatcttgaacaaactgctggaaaggctcagggaagctgcagcagtgcgttgctcgggatggcactacggaatgctcctaaaaggaatatttgaatataatgagactccaccgcagacaggctctgtttttctccagcccctcggagtcacgtgagcgccgaggcccctcccgcggcaggcggcgaaagggctgcgcgccctcccctcctccacagccccccgcccctcgcgggcccgcccctccaggcgagccaacctccgcgcccgccgcccgagcctcagcggtccgggaggagctcccggcggcgccggcagagccctcggccggtgccccgcggccgccgcgctcccagggctactggcgcagccacggagaacccggttctcggcgcggtgcgtcgtgctgggcccccgcgccgggccacctaagccagaggatttggggcgcactgaagggactgcgtctcccagctcgaacccggcttagtggggccgggagcgaggtcgggaaagtctcacccgcccaaagcctcaccaccgagaggacttaaaaaggaaagcgcagagggaccctgcccacgcgcgtgtacacacacaccccccccacacacacaagcaaacacgagctccccgccacttcctccccagggtctcctcaaggccaatattgctcccaatgacagccagtcaccccttggcgaacgcctgctaaggctccgaaggccgggccaccgatctagctcccggctgaaagcagccgaccttgtcacgcgcggggccggaatgggagggagggtgttagagggtgatcgctgtgggaaagtgagagggagcggctgtagtcattgctccgggtccattaccgagaatccccaaacctagtccgccgctgcgtggccctctccccatgcaaagcagacccccgaagaagccatgccaggctgagggacagacgccgggctcgaagctccgggcagattcagaaagaggcgtcgctgcagaaaggacgcatcacagtttcagatcttaatgtggccgaggttttacaactcccgacccggcgcagaaaggaaatccaccatgttccccggagtcgagaaaacggtgaacagctttcggcctgcgctcgacctctcgtctgcgtctctctcgcctcggcttcccttattttttaaaccaccaccacactccttccccgccacttccttcccccacccccttcctccgttgcaccagcagcagagtcgcacgcacaaatactccttcaagaattttacctacctacagttcaagcagttactgggatgtcctgctaatcgaagatgctgccgcgcgcgtgggtcgctctgcgcaagggcctcttcgaaaaccgactaggcgcaactcagcgttcagcagggccgggagcgccaggtcgtccccggggcccggccccatgactcctgccccaaagcccactccacccgacctccctttcctgaggctgttccagttgctgctttgggtcgctccggagctcaagaactcgggttgcctgccgccccactcccacgcacatacttggttttcttcttaggggcattggcaggtagactttgaggaagaaagtaaaggatcgaacagctcagccctccctcccgaccgtggatgcccggagtcgaccaaccctcaggtccgggtgcggaggccgcgggcgcccctgcgcgaccgtccgcgcccggcaaggccgcgcggctttcgcctttgctggtcccgcgccaccgctggggcgggctgcgaaagggtgggaagagcaaagggtttttttgttttgttttgagacgcagaagccctttaaaaagccggcgaggagaggtccagaagtagagaaagcagacggaggcaagctgtgcccgcggggcaagggacagtagaaggggcgggcgcccgggttccccggaaaaccctcggccccaaggaattcctggggcgggagagcgcggttctaaaaccgagaggataggaaggggaagggggagtttgtttcaatttcggattcaccaggattcatctctagtcacatttttcttctcaaattttaaatcgaaaagataaaagccaaaagaactttcatccccagagctttttattgggggaaagaatgtaactcggggtggttgtccttcacttccctactcgaatcttctcctaatgccgaatgtgtttacaggtagcctcagtttaccaagtatgtatcttttgggggtttaacctctccaaagccttcaactcacaaaccgcgatccttggaaaccatcctccaaagcagtgcttggggcctctaaggcccccggaccaactcccgctggaagaagcctgcagggactcgggaatccgggaacctttcccgtcggttccgggcctggagggccaggaagagccgcgcgtccgccttcgtcccgccaggaactccccataggacacgacaccgcaggaacaagcgtcctgggagccctgggatcttggctgtcgtctctagggaccctacaccgtgaaatgatagaggcgaggtccttgggttccgcaagtcgacgaaaatagctcgtggagaaggcgcgtcctgcaactgcattcgcaagctctcagggcgccccgccagctgggggccagattgggtgacactcccctcgcgcagcctccggagcggcgcgcactctccagaggccagcaggactgcgctctctaccgcgaacctgctccagctaggtgttctctccccatctcgccgtcgctctgccccctcactcttctggacctcagagccggttctctccttcctcctcccgcgctttccgtccggggatcgcacctccagcccgtgggcaacgcgttcagcccaagaccccacagtttttcccaacgaccccctaccaagggcttctcttgtttctgctctcctgccccgcacttcccaaaggtgagacttcccagggactgctggacagagaaggcctgggcaggggcagtagccgatatttaaaggttttcagcgccagcatccccacctccagcaccactattggaaaataattaggccacctttgcctcggtcacagcctgtgaccagcttcttccccccaaggaggctcctagaccccctctcctgtctcccctcaccaggtagccttgctcaccataggtccctgcagtagcgggctcgcagcagcagctcctggggacctctgaacggttgcagtgaacctgggcgagggccggggacgtggcgctgcaggctcgagatagcttggacgggaatcccatcggggagacaagctagatctcagccggagcagcagcggcgtctcaggctcgcgtccctcagctcggatgccacactccctagcttccgggccgggctccgcgctccttccctccctccctcctcctctgccttctccatcttccttcctcctctttccctccctcgctttctttctttccttcctcctcctcttcccggcggcccctccctccttccctcctccctcgctcgcctccctttctggggatgggagcccgcccacatcctcccctccagccgcccgacctcgcctagcaggcccgggtcccggaacccaggcagcgcccgagtccgcagctgccgtcggagctgggacgccgctgcctccagcttgggaagcggctggggctcacctggggaccacgtgcggaggtactagaaagcatgcaccactagtcgccgtaccttccaaaaatacccatgggagtctgggcttccctgagtttagtgaactgctgcccaaactgatgattaaaacactgagtaatcaccatttaccctgagtaattgagataatgaaacacctctaaaatcaggttatggagaaaggagctgttggatcggtttaaaggtggccttccataaactgttaaaagatttccaaacgttgagaaacaggctgtgtgcgaactgtgtgccagagagagatacctcttgggctgttaaaaggtgaatttccttccaaacattcttaaagtgcgttttgtagaacaccttggtgatgaccctgaggtagaccccagtaatgagctcacttccctcctccccccaaggcctaaagacagaggtggcctgcagacaggcggggccacgttttttacagttagaaaaatctgtttctagctcagaagccgtcttaagaacgacacagcagttatttttgttggtgttatggttgttgttgatttttttgttcatttttgtgtacctaagagtcctgacactctgtctttccaaggagataaccacagaagcagtaacttttaggccacagggagacaagaaaagatgccccttggtctgtttttaaaggaagagggagatgaggaattggccctttcatataaaaacattttagtaatcatattagcagggaggtgaatgtggtggcttttaaaccttcccaaacaggaactaatttcacacactgcctctgatgagctgtgagggagctatcagcctcatctctctgttttacaaacaaggaaaggaaggacaccaggttaaagggacttgcccagatctctgaagtaaatcacagcctctgctccagagcaatgcttcagggaggggttgaggctcatagcctgagctccaggtagccagaggagtgctgaagactgagcatttcctgtcctggatttctttccctgggacagacatgacactttacttctctgcaaagcatttaggtctttacttaaacagatattggccctgggtggctcatctaaaaaactttacgtttatacaccttcgatatttaaaaaacaagaactacttcctgtgtggacacagattacaaagggtgggaaatatctgagatcagagaagcaactgtcagagcaaggcaagacatcctgccatattttccatctattaggcctaggtcttttggcctaatgcaccaacaacagaaacaagctgtatggctttgggcaagtcttttcattcctatgagcctcagtttctcatctgcagaatgaaaggattgggccagatcatctgcatgctccctttatatttgaaatgatttgattatttaattgtaattttagccaaagtccgtcttccttcattttaagtcctcctgagttcactttctctaagaaccactgattaaaacagggcagggcaataacaccacccaaaaggaggacaaaatatacctgtagcttccaaatagtcaaaatcacaattaattataaaaataataacagaaaattaaaactccattaaatagttacctaatgtttctcctgcacatcaggcattgtgctcctttagcatggtacctgaagtcaggacagattaaatgctcacgagcccctaaatcaatcactgttgttttaatcattaacgaaatgtggttcttaatatttaactcagaaacaacagtgatatgctggacttaaaggcaggactttattttactttaaagaccaatgtcatttcggggtttttttaattccaaaggtttttgaatgacagctattgtctattttgctgcagcccagacactaaagtggccactgattggcccatccatgagtctgtgaactcacagtccaggagtttccaattaagctacccgacataccatgtttagacccctgattgaatcttcagatatatgacgagagaactcagctttagttctcttgggacagctttattctctccccacattttagatgggcgcaagccatctgttatcagctgcttttacccactccccttttccccccttactcatgccaaagaacaaattacttgttggttagagagctaaatcaccacagcctagtgatcagagttcgtgagaagaatcagtttagttattttctgtatctcaacttacctgtgaattttcatgtttttatagaacatggtagatagaccaaatgaaactgacccttaaagcacattgatgaagaggggaaacccaccataattcaggagcaactattgccctatgctgctactactcaatgaaaggcattcctttgttgggtttttcctggagaacataagaaagagtagctggtcaatagcctgtctgcgagcccttgggacagcctttttcaaagatgttctcaggactataagcctcagagtagggtgggggtgcagatgaaatgcagacttctggtcctgccccagatctggacccagaaatctgtatatttcacaaggttctctggtcatctgagcacactaaagcttgagagctactgttttaaaagttattttgtttccattttctagctgataagtaccattaaaaggctgataccaagacatcattaaacaggcaaagaatatgtgggcttgaactttataaactgttaaatatggcaattatagtatcactatgccctgaaccaccaaataggtctatgcaagtgaaaagataatcctatagatacagtagcccttaattcccatccccaattaagaaccacatcaggtcttcaaaccttcttggccaattaggtgtctgtgaagctacggaaggaattcccagaatcactgctaagttttgagaagcagtaagatagacaattggaattggaattcgaattcgaattggaattggaagtggtctctgaaattggctaaaatttagttttcctcttattaatatttatcatatcttatatatttgccctatatatcttagcccttacaacaacccttataaaatccctgtcctacagatgagaatctgaagtttaggacgttatgtaagttgctcaaggtcacaaagctagaaagtggtggaccccaagtccaaacatgtcagtctgtctcctctccctgggcaagtgaggggtatggtggatggatccccgagcttatcctggaagctttccccaggccaaggcaccagctgctgctccatcctggcagcatctattaccaggaatttcaggatatcttcccaagttcttagataacaaaacaaaatcaagcctagaagtttgtttcttcctgacgttactatataagcccgccttagggcaagactttttgtgacctttcctgagaaaaaggttatgatcttgagaaaggagctcattatctctgctggtccaagtttcctcattgtaaaatgtggagcttgaacagggtcctcacaggtctttctcggctctggaatacagagacaatatatcctggtagttaaaatcacagtcaaattgcttaactccaatgtccactcattatgctttgtctatatagatctgacccatgaacatagctgtgcaagataactactcactgtcaaaatcatacctactctgagcaattagtttttactaatagctgagactgaatgacatgtccaaaaagcattctccgtctgttttgcggattcctaacactctaacttttaagaattttttttcctgtccctcaagctaaaacataaactcattttcttattctgatctaaagatgaacttttaacccaattgcacaagttgttccttctctaaacattaatattgttgccaacctttgatatgcctcactcaaagtaaataatactggatgctgaattttctcatgacaaaaagaaaatccaatgctatttcagttccctatgttttaaattgcgccttgatactttctggaatatggtcctttctataaaaacccttcaatattaacatccagccaggtgcggtggctcacacctgtaatcccagcactttgggaggccaaggcaggtggaaccgaggtcaggagatcgagaccatcctggctaacatggtgaaaacccatcttaactaaaatataaaaaattagccaggcatggtggcgggcgcctgtagtcccagctactcggaaggtgaggcaggagaatggcgtgaacccaggaggcggagcttgcagtgagctgagatcacgcactgcactccagcctgggcgacagagtgagactctgtctcaaaaacaacaacaaaaacacaacaaacaaacaaaaatccaaaatggacagagacttctaaatgaacccccagtgatatagacagatgaaaagactgtttttatgtcataacatgtttaacgtggatggcagacagggatggatatgaaaagtcttttctaaggaatgatcaggatgggattggcatgcaatgacagtatttgggttttgactattctcagcttcctctcctaaaaaaatagtcgactgcactcattaattctacaacagggatgctctttgaaaataaattattttagaggatataaaaaagataaaccttgaaatttctttgttttgtgctcatacatccttctccttctctttttctgacccagtgtgtgggaacagtgtaacctgaacaagaacgtagtgtctataggatgagtgacactggaagcagaggcagagtgctacatggacacctgactgtaccaaatggttattgtgtttctcaatcagacgccaattgcggaataccagctgatattctaccctcaactcatgctaaagctttctagtctttctcaaggaaacctgtccaaagggatatgtgatcccaggaattattttgtataagtaatacttggatgtttttactaatagttcacacatttcacagccctttggggagagcctttttcgttaatgttctgttcaagaataattgcatagtatttataatcctccagggattaagtatagatgtaatacacaactcaaagatgcttgttgatgttcactttgtaaaattcatcaagttgtatacttgatatttgtgcactttctgtgttacatattttttaataaatacttatagaaactatgcttttgaaatgatttttttaaagttattttctttgaccttagttgaagcctactagcaacacacaatgtttggagccaaatggttaggcagggcaaaccagggggagcctaatctttggtcctctggtggccacagcacctgagaaactgaactgtgcttcaggaaatccactctggggccacagaagaaagaacagttgtaccaaccaaggcctgcctctggggaccagtacagcccatagcagaaggcaagatgtctgacacaatcctggcagttccttaaactcatgggagggctggtaaccactggaccagaacagaagctcctggaggatctgagacttgtgctcagctctttccttccttggcttctcttgctaagaagctcagacggcactgcaaaccatcaatctctggggcgaaatggcaaggtcatcagatatgcatttctaggatagaaatgcaggaaggtaaaacttcatccaaaacagataacagtttaagagaaagtatgggctccacccccaaattctgggagccctgggcttaggagatgggctggggaaaggttgtgatagagaaaatgggactcccaagtgactgtcttggtccctcaccacagctgaatccagccttgatgcagagagatggagctaagtgcatgtggccggactttggcccttttcaaatcttgcaaccacagggccaggctcagagattgtgcaaactcagtttcaaggagtcaggaaatcaagacaggtgttgagagcctgggctgcaagtaaagtatgaggtgaagggttgaggagggagtcctgctcttgaggagcagcccagatggacactccgctcacctcctccaggagaagaagaacaaggtgtgcacgcggggaagttcggagtccctccttgtctttctagacgcagctgcgacaacatgctggggacacgaggctcaccagccccagtacctccccacccccctcgagccagctaagcaggacaactttccagctccttatccgcattccctccctgatcggggcagactgtacttccccgatgtccgctaactaacgtaaagaaacgtccgcgtgctcgctgataccccagggccaccggaggagagcagtggggtgtgagaactaggctgtgtccatggctggtggtggggggagcggctactgcgccttccccttgggcactcctctcgggtcctgaggcgacgccctagtaagcctccacgcacgtcagcgaagggtgggtggagggtcacctgaccgcgccccacagctggctcccgcgctctgcccaccgccacgccaccttcaccgcggatctcggcactcccgcctttctcttgccctcgttatttttagttcggctgctgcacctcctgcctgcaacagctcgccccactctcagactcgttttgcaggatttgtgcccctggtgctaacctgatccacacttgaataaacagcgagcgcccgggcaacctgggcgagccaccgcgcggaatttgcatccatccgcacgagaggttcctgagacgctaagcgttctcgcctacagaacttggaaacaatggaccatccccagaatgaatgaatgaaatttttaaaacgaaaggacaggaggtcttaacgccctggcagcggcagagcggctcctgggacaattttgtcccgctccctgacgttctctccgtgaagcctaaggggacgccggggcaacagggtacaggagcccgatgatagtggcagaaaattaaatttggatagtatttgttaagcttgctttcctagtagctgccccctccactaccatttccatcttaagacaggctttccaggtggcagaggatgcttttctgatcagttaggaaaaagagcgtgctcccccaatgtctgaatttctgtgatggctgtttccacttgccaagcccagcggtggtacctgcaagcttatgcgatagtagcaaatgggatttataaggcctggaggaggtgtgagcttgccagaggccgcttcagatagtcaggcctggtgggttagtgaatcattgcagaacaacctcaagggctccagccttcctgcaagcagtcaaacaaaaagaaaacataacagagtttcctttattcagcataaagggatggctgctagctgttgaagcttttccctcagaattctgatttttattctgaaaatctgagttttgttcttgttcacctccaacaagttaggatgtcaactacagatgacaggtaaacatgcctcaaatgtgctgtggcactctgtcacatgcctagttctacagctagaacccaaggagtttgatgatccagtttatttccccagtt

SEQ ID NO: 5036 - DNA, 100000 bp, Homo sapiens
gtccattcagtcggttgggaggcttagaattttatttttgccttacagtttcccaaaactccagtgaacctcgcctctcctttagaagtgtcgtccctggagcccacgaaaatgtctgaagatctgcaagggccaccttaaagcccgtgccaccttaagcaggccccacccctggccagccaatgggctgacagcagcagtagctgctgccacagtagctgactggtcaccctgcccccagtgctcacaccctctggccagtgcctggctatggcccgactgctcaggtctgcaactgggagctgttcccctggaggggctactgctcccagaaggcaaaggtaccgggagagagagaagtcctctggagggatgaggtggggagcggggagcagggggttctgatcccaagttcctgggctctgtgacgccccagcaccaagtgacctgaccttgggcaaaagggcactggcttaccctgtggcaactgtgggtgggtgtagagtgagatcagctgagtccccactgctacatgagtggggctgggggagtcaaatggatgcccctggaataaaacacacctgtggaagaggccctgaaggaaagggcctgggttccaggccaggctctgtccttaacttggcctccattctcatctgtaaaatgggaagaaacacatcccccgccccgccgcgccccgccccccacaagggcccagaagccccaggcaacgtagagtggggagggggcagtggaagcttttcctcccctaattcccttatcaagctctgagttccctgtggctggggtggtgcttggttggcccggagaaaggaggaagtgagggatcttttcggttgctcaggctgggctggctattgaaggaccctgctgatagcctttttggagagtgaattctggttttttatttggatggctgggcgtgtggctcacgcctgtaaccccagcactttgggaggccgaggcaggtggatcgcttgagccaggagtttgaaaccatcctgggcaacatagttaagaccctgtttttattaaaaaagaaacattaaaaaaattctggtggcgtttttttctgaggggaaactttgacccccaatggcctgtttggaaaagaggcatttctggatagtgggtttgtttaaagtgggcccacctggcaggatgttgtcagcggggcgggcgcaggggaggctcactccagcctccagcccccagcccccccccgacactggggcagggctgtggccccatgtgtctttcgggggaccctggcagtggtttcttccctgcagggagagctctgcagggacttcgtagaggctctgaaggccgtggtggcggctcccacgtgtccactgccgcggtggtccgagagcagcacgggcgcgatgagtcgtgcacaggtatgggagggttcgcgggcccctcccctgtcttctggattcaaccccagcgagagagagggtgctgggttgccttcctcctcactcatctgttttggggtgctctggcagttctctgcccctcgcttgctgtagcctcaggccctgcaacacctcgggaccagagggttcacgccccgctaaatcgctgagggtctggttctaggtgcgaacctcctgatgctgtgggtggccccagaacgtggagcaggtcagccggctggcagccctgtgctatcgccaaggtggcccatcatcccattcggcaccggcaccgggcttgagggtggcgtctgtgctgtgcaggacagtggggctccctcgcccggcccgaggatggtcccagcacaccttggcacacctgtgctgcctcccccgccacacacggcaccttgggtctgctcccgcccgtgggctgcctgccttgggggtctggtctggctgctggggggacacccgcggggtgtggtccggggacgtggccggtcagagacccaggtctgcagtggtcttagcacctgccccaaccagggcggcgtctgcttaacctgacgcatatggaccgaatcctggagctgaaccaggaggacttctctgtggtgtggagccaggtgtcacccgcaaagccctcaacgcccacctgcgggacagcggcctctggttcccgtgggtaggactcgcgaacctttcctgggaccctgagggcaccgtgggagcaggctgtgtctggggttcaggggaccttcctcccccagcccgagggaaaggacctccggtcctgaggctgccttctgtacgccgccctccagacccaggcgcggacgcctctctctgtggctggcggccaccggggcgtcggggaccaacgcggtccgctacggcaccatgcgggacaactgctcaacctggaggtggtgctgcccgacgggcggctgctgcacacggcgggccgaggcggcatttccggtgagcgccctctgcggggggcccgggctctggccctgggcactgctgggggctgccctgcagagaccgggctgtgaaaagcacctcctggcggccccctggtttggcggctaggcttcctcaggctctgaagccctgtcagctgggccaaagtggatgggaccaggtttgctctccctgcctgaggccgactggctttgtggagcagaaagcactgggccagggaactgggcccgagggaggccagcccagacctcagtgcctggggtcggtgtcttgggttccgcttcggcttctggccagaaatccctcatcacacagcctggtactcaccttgtgtgtcctgggacgtaggaagagtgcagccggctacaacctcacggggctcttcgtgggctccgagggacgctgggcctcatcacagccaccaccctgcgcctgcaccctgcccctgaggccacatggccgccacgtgtgcgttccccagtgtccaggctgctgtggacagcactgtacacatctccaggctgcagtgcccgtagcccgcattggtgagctgaggatgggggcagtcagggtggctccctggaagaggccccctgggaaggccaggcctcacctggcctgccatctccctggtccagagttcctggatgaagtcatgatggatgcctgcaacaggtacagcaagctgaattcttagtggcgcccacactcttcctggagttccatggctcccagcaggcactggaggagcgctgcagcgcacaggtatgctggggtggagtggggcagcagggtgggctgcctcagtggggcccggtgtcagccccccttccccaactgcagaggagatagtccagcagaacggagccctgacttctcctgggccaaggaggccgaggagcgcagccggctttggacagcacggcacatgcctggtacgcagccctggccacgcggccaggctgcaaggtgagctggggctggggtcagatggggcccacagctcggcccacaaaccctttcctcaacccaccactctactgcacgagcagcaggctgagcctcaacaacggggctgggcctggctgagcaggcgctagaaacagggctgcagaccgccccacccagctgttcagataccgtctacagggaaagcacagttgttgctaagccctcaaaagcccttcctgtgagccaggtcatgggaacggtgcggtgctcttggagctgtacatggaaggaaggcttcctggaggaagagatgatagagagggggatgttacctaacctggggaagggaagtctgggctccaggcagctatgcaaaggctcagcagcctgggcttgggggtgggagccacaggggaggtgtggcaagcacacctgggccattggtctccgtgttgtgtcggggggaggtgagggctgaggcctagagaagagcaggattatttccttggtgaggccaagagctgaagcccagtgccctccgacccatcctcagccttgaccacggtgccccgtacacccaatcaggcaggggtaactcataggcttccctctgaccagggctactcacggatgtgtgtgtgcccatctcccggctgccggagatcgtggtgcagaccaaggaggactgaatgcctcaggactcacaggttctgcccaccctgctgctggggagaggtggggagggtcagggctgatcagagcctggggcagcaggaggcaagaggaggactgggctggagaatgttctgtcctctgggcccccaggaagcattgtcgggcatgtgggtgacggcaacttccatgcatcctgctggtcaaccctgatgacgccgaggaactgggcagggtcaaggcttttgcgaacagctgggcaggtaggagcaaagccagggaggggaagagctgagggcagaggaaaggagccccctgaggatgtctccttcctgcccccaggcgggcactggctctccacggaacggcacgggggagcatggcatcggaatgggcaagcggcagctgctgcaggaggaggtgggcccgtgggcgtggagaccatgcggcagctcaaggccgtgctagacccccaaggcctcatgatccaggcaaagtgctgtgaagggggtctgagcacttagcccacaagttccctgactacgagccggttctggaacttttcttcatgccacggcccctgcaaggaaatagatgctgaggagtcttcctgccagcgagcccactgtatctgggcccaaggccagagggcccagagagaacctgagcaccgtgttacctccctggccctctggctggccccaggagcctttggttcagtaacgacccagggtggttcccagcaaagctgcttcctctctgctcctacgcatcctgtccggcgggaagagagcgtctgggtccattcaagactctgatgacacccctccccgaggcctccactgccggggtcccaggacccttcccccttcacctggtgacaggaacactcctttccggtatggaacgtgagctcccgtgacatgatgataggtcttctccttggggcctcccccataaatctgtaataaacctgaaacccacctacagctacctggaagtcagcaggcagcactcctcccctccccctccagggtctctgtcctttggtcagtgacccctttgttttggggcttcctctgacttcttatagcctggggaggaggttggtgctcagggttcggaaaggaacccggtccctgtcccagctactccgcctcagagctgaggacctgcccacggcacatgtcactaggatgggctccccaactgggcctgaaccgggcctctgaacacactgaatgtgttcctcgcagctgccacgtctctagaaacagagatgagactatttttgcacccacctcttcatgggtgatgtatcgtaccaccagctgttttgccctcaaggtctgtccacccgagggcctgccctgtcttgggccggagcccgtcttgagaccttggcagttgttcccccctaagcccacagagggcgcccgaaatcatgaagctcagataccacgcggcatctgcagctcacgactcctcgcccagggcctgcggcactcagccctgggcaaacctcctcctagggtcaggtaagtcctgcagcctggaagccaagctagtcctccatcccctgcaggtcccaggaacctgcagtgcttctcatcttccttgcccctctagccttcggtcccttttggaaagaggcatgtcacacccacgccctccctggcctccgcccctctcctcctcccatcagctgtcagtgctcaggcaggtgctaggccttaggcagaggcagctgcgctgagacgccccagtccaacttcagttcttgaacccctcctccgtgctaatactgggctccagccgacagcagttacaccaacctgagccggaggctactcctccgtgacgtttctgtcccgtgctgccctggtggggagcagagaccggccaagggctcactggtgacaaatctcagccctctccccaaaccaccccagcacgcgtggctcatcaccgagacagccctctcgcccctccccttccagccagccagccagccacccatcttccaggcgagaatcctgcagcagctgcgctctccctcctgggtaggactcttctttatgcgccctccagtgcctggcaactaggaggcgctcagcaaatgaccatttcccacaatttttattaagaaaaattccaaacatacagaaaagttgaaagaacaagtacactgttcacgaaataccagccactgcagattcaacaatgaacattttggccttatttgctttgtgtatttggggggaactatttggaattaaattacacatttcttgaaggcattcacctatataatcagcatctatctcctaagaatgaggacattttcccatgaactgcagtaccgttaaatggtattagaggaatggttggtctttgtgagggtctcacgtccaggaacctcatcaaagcgtctaggcccttagcagagagggtagaacctgctcgccggctccctcaccttctctcccatccagaaaggcagaacaggggcaacacaggattctggagagctgtccagatagaggatcaaaacatgagctccacctgggaaacacagacagccccaatcccacccccacaacaagagcggcaacctgggtccaaattcagaggacaccacagccggcagagggctgcagcatgccagtaggacggaagtcgctgggggtggggatgagcaccagcccctagagcctggaatagcaccggcgtgggctacagccctgccccacccacctcacagctgctcggctcacccatggcacgccaaagcagcaggcttaagccgccaaggcgggcacatgaagcctccatttccaggtccggggtcaggcaaggagatctccttcagggctgggccctgcctcgccagctttgctggtgaattaaatatagcacagggagacacagttgccaggcagaagcaggaggtgctgtgaataaacagtgccctttgtggtgacaaagctatggggagcctgctgtgcatgtgccaagacctcagggcagctcccccagcccccacagggacctctgagctgcatggttttgtccccgcttacatgtgaaatatctgaagttcagatgaagtcgtttccccaagatcattctgccaagtagagagcctgaatgcacagtctagagcccacgttcctgccaccgactcacaacagccccaggtcttcaccccagacgggtcccgcgctgagacccaggctctgaaccaccgagtcttcttagtgtttctccgctggccctggctcacgtttgcccactggcctgttgtgaatgcccttcacagagtaggtgcttctggaagcatctgatggagggtgactgcggagccaggggccgtgcagcagggggatggtccagcacatcaggcgggcctgagaagggtcagagcagagaggcgtggagtcgtctccctctagagctttccttcgctggctctgcaggaggctctggaatgcgctccgggagcccgctgggcacggggacacaggccaggcctgcactgctgctccctgcccgagctgcctgcccagcccgcattttgccaacttttgtgagcctgagcagttggttctgttcaagggctctgagctggcacagccccaaaccagggcctcttcctgggcctcaatgaacatgcccgtgagtcagcactgagacgcaaactgaacaacaggcagggcgagtggaacgtggatggggagcaaaggctggaaggaggggggctgggcccacacctggaagaacccacatcttgcagcctccggtggctgcaacatcttggcccctgcagatcttttcagaggtccggccaatgactccacagagggctgactggttccatgatgcttaagaggttaggaagcttgtagaggcacgcctgacttgccactccctccacccaggcctgactatctgaggaccaattcaacacctggagccccgagtagcagcctgaaggaatgctaaggaggtaggtgagggagtgggggcaggcccttgcccccatttcttgattgtataacacttcattaaaataaaatcacgcgtgccatcttttattagacattttaataccatatcaaaacaccttgactaatgaagaaacttttctcccaagctttgaacatttttttaaacattttataagtttttttttgtattttatatataaatacagaaacctatcttgcatgggctgatgccacgtgtgaacatcaatggcaaaatgttctcaaacatagtgcctgaaaacaggggtagctgtacatatttcttagtaagctttttttgtttaagttttctgaaaaaaaaaatccacgagggcctaagaataatgttcagcatttttgcaggacacttgtgattgttaaatcctctgaactgaccggaaccaggaggaagaagggaaaagagatgggatcagtaggaagaaagttctcaatgggttgttttttggcatgaagtcaagatattagggtctcaaggggagaaaagagcaaaaaaccagccagaaaaatgagggaaaaaaccaaacaaacccaaagtagagaagttggtggtggagagggccagttgggcaggggaagagaccgtgtgctcgcccgccgtcagaaggctggcagcgaggccttagcttgttcgtctgtcactgagtgggttatggctgggcagcaaacagcaagctgtaaacatcagagggaaaacaccagtcgacactagactttttttttatataatttttttttgtaaacacttaaagacagacccacaatgcctttcaaagatgaaaaagaaaatgccctttccctcctggctgaggggtgaggggaaggatagcagttgattcattcttctctcaaacttgctctcatcaatttggtgtcctcagggaggaagggagaaccatgatctggaagtcagtgcagaagggtgccctgttcccgctggtgtcccaagctcagctctgccccagggtccggtgagcctcctcctggagcaggggcgctctgtccctgtgtggaccgtaataaataagtcgtgctccatcggccgagggctgtctgctcatcccagggcagctgcatcccaagagggcaggcggggctgggcgtctacacaggaccccagaagccaaacagcacacggggaatttgcagccatgtgcctggcaggttctactcccctgcctcactctcccccctggctctttcttctccccttgtcatagtttttgaggtggaggtaaaaagagcaaatgtccctgatttgtctgacatcatcagctttctgggagtttacttggaataaataaaataaacctaacaaaagaaaacgaaagcaagaagagagaaagggaggggggaagaaaaaggtcccaaaacctttggctgtgagatggagttggcttttggtttttatgggggttttgtctacttgtttgccagaaaaaggaaaatgccagccagaacttggaggggacaggtgagatgggggtcaggggtggatggttggcagcaagtgggtacccctgggggagaaatggggaggccagacccagcggtaagccagggggatgtgtgagtcagcacccagtgctgtgggatagagggatcgagtctggcctggaggcctcagattctctggaagcggcatgggaagaagcagtggtcaaatgatcgctgaccagcactttgcaggaacaatgcactgcccatggctgtttagtaagtgcaatgtccttatggcaacagggagtggattatccccgttaccatagaagaggcggagactcagaggtgagcgaggatgaggccaaccaggcacaaacccaccgctcaggctccttttcctgcccgtgcacattcccaggggatatcctgaactttctttaggaatgtagattgtactggtctcttccccaactgatcctaactttctgagcctgttcttcataactgtccatgttggtttgtatctcttgtccttcccagggaaatcatttccggatgactaactgctcactgatgaggtgctccttccctctgctcctgcttcttctcagtggcataagggcagcccggctccctaaactgcaggcccccaaagtgaccgaccccaagccttgagcccggagcacccccaaacgcgggctcacctttgagaggagtcacaagcaagcccgcaggtcagtccgcagggtgttccggacaagatctgttcacttcaaacacgagtctatgcagctgggaggagggggccgcaagggaaaccacgttacctgctgcccagctgctttgaaggggctctttcagagggccagattcctgagcaggagcttcctaagtctttctgaaaggaccccagggaaacacagtcatgtccccagatatccctactttctgaagccgaagaagggtgaacaccaagactagtcttggcccaggtggaggcagcagtaccggctcgggggatctggtgctgcaggaaggggcagagtggctttcagaaggaccaaagctttctggcagagcccaggagaatggcagcagccaccagtgagaaggtgagagcggtggacccctcgggcagctagtcagctgtctccaagactcccaagggcagggaagtgggaacaatggcatgcaggagggccacggctctgggtgccacagtcctgaaagagctccttcctgggtcaaaaaacagctgtgaagctccctcccagtgggtgacctcttaggagagccccaagctctacccgctcagccatgatcagctgatcagcagcatctagtccttcctgcaagaggcgggagggggccagacagtgaagccctgctctccagtgtttacagagaaaggctctctgcatcaaagaggaacagagattgccccaagacagcttcctgatttgtaaaccaacatctgggcattttcaagacaggaaccagacagataattggcataattctccccgagggccaaagatttcctttctggttctggttagtgccgccctgggacacaagcaaggctccgtgctgggagctagaccagaatctctcccaggccagccttaagcctcctctgcaccagccacactgcgtgccatgccggttgtcaccctgtgcagcagtggccctgagagtcaggctttgaaaggcctgagtgtcggaagaagctctgggctcgaggattcagcaggtgctggccccaggcagcacagtgtccttcttgggcaagagggtgccttccttccagctggaaacaaggacgaggctcacactggagcccaaggcatatctgggccctgctacttttaactgtgcccagtgctgtggccccacaggaatggctcttcctgcctcccggccctctagggagaaggccagtgcaaggcagtgggtacccctccgcctggccttcctcgcacagattgatgttctacccctgtggagcagagggaccgtagaggaagaagaggcagggagacagacggagaaccaaccttcccagtgggatccgaactcctccaacctgtgaggctctacgggtctccccatcagctcccaccacctgagccctcaaccagagcacacctctggcaactccactctgctctgcacttgggatgctcgcaccttccgccggcacagtggacacctgtctgacggcctctgcccttacccgctcggagccagaggcgggggagaggtcatcccataaccaaaggagacagaatggctggagatgggggtccgccctctgggaggtggggtgcactaagctaccttgccaacccctcctaccttttgtgatagagcacaggcagggcagcctggctatcgtgtccccctgcagcagctcctccaggcagatcaacactcacccgcgtctttagtcagcacatcatctgcaagggggacaggggagagtgcagagggttagtcaccagtggacaggtggcatggggcaagcaagggcctaggaactaggggatgcttagctgccccaagctgtgcccggctctgcaggggacacagaaccccaagagggacttgaccttaagactttcaccgtggagataatgcgtggacatcacatgttaattacccaagacaaaatgggattaatctcaacatgtgattaaccaaaagcctaggtgacagcggacgaaaaggcttggagaagggtagacaggaagcaggggcagcatgaggcaagctgtttccctcacagatgctttcctaaacacacacgtagccagtgtgctgatgtctggtttggaaaaataggtaatgggtagagtggtaggaggcaagaatgagaggaagaaacaggtccccaagaaaaccttgtgcacggaggttcacagcagcattgttcacaacagcccaaaggtggaaacaaccagtgtctacaaactgcgcaacggataaacaaaagatgatgtatccacacaatggaatatactaagccaagaaaaggaagaaccaccacatgctaaaacatggataaacgtcaaaaatatacacaaagtaaaagaaaccacctattgtatgaacccatttatatgaaatgtccagaatgatacatccatagagagggaaaggagatcagtattggggacagagggatatggggagtgctgcttaatgggtagggggttttctccccccccaccaccccgcttttatttgagatggatctcactctgtcacccagactggagtgcagtggcactatctcggctcactgcaaccccccctcctgggttcaagtgattttcctgtctcagcctcccgagtagctaggattacaggcgccaccaccacgcctggctagtttttgtatttttagtagagacggggtttcaccatgttgccgggctggtctcgaactcctgacctcgtgatccacccaccttggcctcccaaagtgctggattacaggtgtgagccaccacgcctgacccgttttttccccttttaaaaactttatttattgtggtaagactaacatatgctctatcctcttaacaaatcttcaagtgtacaatatgtattgtcaactgtaggcactatgttgtatggcagatgtctagaacttactcatcgtgctaactaaaatgttatacccattaatccaccactccccttccccccgcccagcccctggcaccactagtctactctctgcttctatgagtttgagtattttagctacctcatgtaagtgaatcacaccagaggttttcttttggggcgatgaagtgtttagaaccagataaagatggggttgtgaatgtcttaaatgctattaaattgcacatataaaaatggttaattttatggtggtttcatctcaatgtttaaaaagaaagaaacaaaagtgaccccgctcaccatcccaaaagaaggaatggaaggaagctacttgcacccatgggaacccactggtttttattaagtccttggcattctgcgtgccggcgacagtgaatagccatgatctcgggattcaagcagctcacgactagcagggatgccgaacaaggaaatcaaaaggcacagcatgaggacttccaggacacttctcacgcgcaggcccagggctgagggtatggggaaagagacctcatcaggatggggctgatctgggaaggttctggagaaggttgaggatggatgaagctggggtggggacgggaattctgggcacagggaacagccttgtgttctgctgtggtgtctggggccgacaacaagggtgcgcagcagccctgcgtgtgcggatgagggcagcgggacacacagcaggtgcctgcataagggagggtgcccaggaggaaagcatgagaaggaagggacggattctgagttgggtggaggaggcccggccagctgatggagacctccaggaggctgctgaagcctagagctgaggttggaacagagacatgggtgccaggcatggatgtgggataaagaggcagtccagggagaagttcagaccaaaatccaaagaaggcagaagacaaacccaggccgacatgaatatttgagggcaggtgaaaagaggcgacgtgaacaaaaggcgacccagaagtcctccaagccacagagaaatatcaggagagcagtgtctcagctgtgaagaaggcagagcttgtggcaggatccttctccgtcactaaaggaacttaactgtcccgaacactgccaatgacaaacacatgtgctgtcttcctttgagcatcaccatcttccaagctgggcagggcacccagtgttattctcatttgcgaatgaggatccggaagcccaaggaagtcacacacctcatgagtgggcttgtggttgtggggctgggactgggaccctctgcttaagaggccttcccattgctgtttctttgtttctcttattattttggtggaaaggcaaacacctggggcccataaaatgaagattcttcgggcccagaaggctatggcttccgctcctcaaagccccccaccaggaaccccaaggaaaagcataaaatggaaccgattcgatccttaagtccccaggcacatgagttgcgagagaagcactctcagcttcctggccaccaggacaacttgtggtcattttctgtctagaacatctgctagcccgaggacccacctgaaagggtgacacaaactgagaagggagatggcacagtctctgctgaagtgtctgtcccctcagactccaaacatggcaagtagtggatgaacacatggtgtgatccccctgcttgaaagcactagctaccatacatattcaaatgcatgtgtaggcaagatcaaagtctggaaggatgcacacactttcacagtggtagaggaaaggaggacttgggaaaaatccttttatgtatttctgtagcgttcgaatgtgcactactttagttaaaaacctgataaggaagcatactggtgtttgcattttactatgaaatgcatcagaaggataagatggttggtggatggataaacgggtctagtacactgcagactccaggtggtgcatgtgctagtaataggggcgttctctctcttttttttttgacatggagtctcgctctatcgccaggaggagtgcagtggcatgatctcagctcactgcaacctccgcctcaagagtttctcctgcccagcctactaagtagctgggactacaggtgcatgccaccacacccggctaatttttgtgttttagtagagacggggtctcatcatgttagccaggatggtcttgatctcttgacctcggatccacctacctcggcctcccaaagtgctgagattacaggcgtgagccaccgcgcccacaataagggtgttctctatacaatgctttcagctttgccgtacactgggtgcagtggctatgcctgtaattccagcattctgggaggctgaggcagatggatcacctgaactcaggagttgagaccagcctggccaacatggtgaaagtctgtctctattaaaaaaccaaaagttagctgccatggtggcatgcacctgtagtcccagctacttgggaggctgaggcaggagaatctttgaacccgggaggcagagattacagtgagccaagattgtgccactgtactccagcctggtgacagaacgagactctgtctcaaaaaaacataaaaactttgctgtgtgtttgacattttcataataaaacagagggaaaaacctcaacagagatgggaggaaaaacagcatagctagtgagggcagagtcgtcatgcagacattcttggacctgtattccccactctctttgtctggacacctcatctatgacatgagcgtatgggctatagcccttagtttcctctaaagcatccttcccctccatacttaaggaggatttcctgggaacatggcaattactgattcctaatagtttatctttgcattttctcctactgattggtaactcaactgtgagcccaagggactgttagaattctctgggtcccatacagcttcccacaccaggtgtgttctctccccatctggtcagctccaggagggcacatgtggtctccctcatcgccccccaggaggtgatggattcgggaagggagaggcaggtatgaggataaggcttaggcgctttatgacaagactggacttactctctttttgcaccgaacctcactaggggaaagggaaggggaaggggaagggggcgcagggcgattcttcttgtcctggggcggaaggcctgtgcactaaaggactcagacttgagagaggaaggttagaggcagcctttcctcaccactccacaaggcggttttatgcacagtgagtgttgtgcctttaccagctggcctgagtctgctgcactggtgggaagaactaaaatggcaggcaccccaaccaggctggcacacggcagggagcacatttcactgggaccaagagcactggctgcaaaaggccacctggaggttcccggcaataggaaggagtcagggtctttgatcagacagcatggggaagccagcagtgcccacacagagcccagtgcccagggagcagcatcttccacagcaggaggcaggaggcacacaaacccagcaagaggttgcagtgggctgagacaacttcctgtccccacccctggggctgtgggagttagtggcctccggatgtccctgaagcctagcagggaagtggaaatggctgaagctgatgcttgcctatcaactggttcctacagacttccagaagcatctgacacgaacctgctgcctgccgtcagagaaaagccatggcggggcctcgcagcacaaaacccaggcgcctggcccacacaaactgagactctgctgcagaggagtcaaatgtcccctggtatctccaggcccctagagaagaggttcaacaaatgctgcggataagaacaaagccaaactttctgccatctgggttctgcccttttcttactacctctaagcacctcccaagtttcctgacgccactgtacaaagccagccaatgtcactgcccaaggagagcttggaagtgtgtttggcctggctggggatggtgtcagtgcctgtccctctaacagaccagggaaccaaaccagaatggcgagcacggccctggagctgaaacaggagggaggatgatgcctgtgatgggctgggggtgggaggcggtggcatcttctgctccctccctgggtccaggcacggtgcttctgacagctgctatttgtcaaagcaaagatatctgggaggagggcaaaagagccttaattctctaagccagctatatgcaggtaactcctcagacacacacacatgactcctaaagcccctgtggggatcttcggataagctcatgcagctgctaagtggtatgactcccaagcccaagtttctgccacccagcgacctggccccttttccttaaaagacaggccataagggtgtcttcccttggggctggaaaacaccacccgtctcacaggcactttcatctccccctttctgtgaagtgtgtgcagaggacccaaggtggatggaggaacctggtactgagtgaacagaccagacaggagagacacacacctgccctccaccatgccaggctcggtattctgcagagttctggcaacacatcctcaagagaccctggaactgctagaagtatgaggggtggggaggctcacacagctgcagacacagatctgcacctggctgggagggaaagccgtgcagctccgaggcagcagctgagcacaggaacatgcctctccatctccacttgtgctggtggccatgaagggcccagagagaaggaaggtgggagtcagaggggaaacccctagaaatgacgcacaggctcaggttccaccccctgacctcatttccagcctaggtgcggtgggtgcctggtcctgctgcctattcagcatgcagagctgctggcccagtctgccagggacagacagggcagtgccacccatgccaggccttgtcagctccccttttgggaaatctgggggctgtgctcttcaggcaacagggtgaccttgagcagagagtgtagcctaccagcagcggccatccaactgcccagccctttgaagtgcaatgcaattgttttggtgagctgggccaccccaatgaggatagtgggggcagccaactaaagctcaggcctggagcgcttcatactttccactgaggccactacagctccctcccacagtcctctttcctgtagccacctgttcctggttccccacttgtgttagggccttgcaggcctcccctagtcgctttcgctcctcatacaccagcagcggccagtctggcagtcagtgcagccggtcagcaacagctggacaccctgggtggcagtcacctgcccctcctcgccctcctgtaggaggagtaacaggacagacacctccgcgtctgactccagcctgtccagcctgactccagcccatccagcatctaacaatggctctggcaatgccccaagcaaggctgggcaaactcctcggccagcacccggtttccccaggcaggaaagggtagggtgctttcattctgaccacagggtctctgagaggaggagacatgggacaagaattgcctgcaggcacagggcaggctatagcaggagccatttctgcttttccaggagccaggtcctctcacatttttattttatattttattttttgagacagggtcaagctctgtgcctaggctggagtgcagtggcgtgatcaagctcactgctgcctcaatctcctgggctaagtgatcctctcacctcagcctcctgagaagttggaactacaggcgcttgccaccatgcagacaaattttttgtttttagtaaatggggtctcactatgttgcccaggctggtttcaattcctgagctcaagcaatctcggttccccaaagtgttgggattacagacgtgagccacgcatccggcctcccttgcctttaaaagacagcttgtgtgacatttagcatctcaagagcttaaagatgggggcaatggcctttggcagaggggaggaagagggcatcatgacataagagctgagcatgggcttctgctcccccagaacacagctgaggggagctctccttggtgctgtggcaaatgaacctgccgccccccagattctccctgggctgaggacccctaagcttccatcaaaagcgggtcatctccacgactccacaggattacaatgctcttccgttcagagcataccaatcagacccccacctccacgcttgttctgctagcccagagactcgagggtcaaaattgaatgcgtattctttagggcaaggtccctcagtctcagagtcacaaacagagatgttgaaagggagagaaattaaaaggcccattcgggttgatccatcttacccacaaaaacaaacaacgaaccccctccctcttatacagtatcctcaccttccaggaaggcgcttaggaggaagggggtttaacattcggtgctctggagtcaaccgcccttccctgcccctccagcagggctcagcacattcccaaacttccccagccaggtgcctgtcctcggagcaccaggcactagtgaaccagttaaactagtctcgcctttcctaagttgtgttttttctaagctagcaggcactactggaggccttccaacccaccactcaggccaaccctcataataagaaaaatactacttctatctgcctcatttaggaggtttctacttttttcctttagtggttaactaaatttctcttatataaccatcataaattttctaaaaatttccgcaattggtgccaacaaccacagaagtgtgtgtgtaaatgggaagtcttcaggggagtgaccaggagttctagtgaatcttctaagaaaactcttcactaagaaagccccgcctcgccccctttccagaaagattccaagactcacacctctgactcttaagtctttttttaaattagaaaaggtaacatgcagcaggtgggttgggatgatgacaaatcatggggaatacattggagctcctgagctttggcccacggctgtgctctctctgagctggagcaggccctgggcgtgcctggggatgcccactccacatcacccccggaagcaaatgctctcctcttacctggaaggtttagggtcttcagaaaagacaagactgaacatgaggagtccataccacatgaacagggtccacagagggccggaccatttttctgaacaaagcacttcaccacgttgagacaaagtccactggaaggactggagacaatggcctctctttgcctccagtggtaaaggactggcttttgcaaaagagagccttaggtgaaagcctctagtttacacacacacacacacacacacacacacacacacacacacgtgcaacatacagaaacacatgcacccttgaggaggtggcctgcccctcaattccatgacaaggaaaaactagaaccagaaccagaggagcagtggtcatgcctcaggctggctggccaatctcccttcctctaaggggggcccggctcccggtgtggtttctgtagtcttgggtgaggctgcggtggtggggtgtaggggggtaaaccaacagcgccaggcactcaagtgctgatacagaggggacagggggacacatggtggcgtcccaggcagttctctggcagaggagctggacagctcaccttcccggttctccacagggcagtgggggtaactctgcatttgggccatgggggccaagagcactctgtcctccacggctgctcttgcaaagttcttcctgagagccaggtttctcaggctgagcccctctgaggcttctttgtattcttcctacaacaaacgcagtgtctaagagaacgccctagcaacccacaggacaaacggaggacttcatgaggtctccacacatggggaaagaagtgaatagggtttttgaggccatggctagggagggctgtgagacgcagggaggctcctctccctccctggtcccaagcggagacggcgaacagggacaaagctgagcctagcgtcctgacagcatgcatgcgacaggactgacgcgaagcctgcagcacatgtgacaaagacttagagaactggcagcagtcagcccaggagaaaggaggcgctgtcccctggggagaaaggggcttcccagaccacagctatgatgcccaggggagggccgtgcgggtcctcccactgagcatggcctaacaaatgcatggagctgagccacgtgggtaatatgcccacctgcaccagagtcttttggctgaacaagtaattaagagagaagttttcaggagacctgagtggagccattagtcagttacttcccaggaaatgctctgagaccatgatccctcctaggctcatctttgtaggggaaagagccctctgggagtgaggaggctgcagggcagagaagagtctcctaggaaacattctcgctgggctggttgcgtgatccagtcctcagatgctctcagaaatccagaactctttttccaaccactactatgacttgaatctgggaaggtgggccagtaccaggttggagtgcactcagatccactgcctggtctagtggaagatgccgttttctgatgaactggtttggagaccagactaaacactaagcatggaaaatcgagggtcagcagtggcgtggctgagcagcactgaggagaagtctgtgggctctggaaaactgcaaaaagaaacctatgaggtctcacatctttcatggcagctgtaacttcccaagcactgaccatgtgccaggctcttaccaaaggcctttatgtgccatctcttacccagttctgacaatcctatgaaccaagtatgctatccacattttacagagcagaaaactgaggctccgctaagctgagcaacttgtatagattgtagacacagagtggtagagggagatttgaactcccatcacctggactccaaagcttatgcacagcatgctaggcagatgttgacagtcattttgtttcccagaggcgtcctgtaggttagcttgggtgttttgaaatcccctgccctcagggtcctaccctctgcggtattactgttcggctctgaggcagcctccaaggtaggaggcaacatggccagggtggagcagcaggtgtcctatccgcattttcaatccccagagcgtctctatgtcacacatagtcccccgcaagctctctggtgtggactcataggactaaatcaggtgttcgtccgagttcgaacgtgcaaggagacgaccagcttcccagcactctatgcatgccaccagcacacagcccccacctcccaaggagggcgggtgcttgctctgggcccctctgctaagccgtggaggacacctggcgtcttggggccttccacagtcaagggtgaaggaaaggctgcatctcccagccaaagtcccagaactgagttgcagagaggcaggggcctaactgagcagcccgagagccttcccagactcggacctgacccctgggccttccttccttgtcccactcctcttcctctctgacctgagagcaaggctcccagaacagtccacttcctcaccaccactgaggcacacctgccagagggagggtgaaaatactgcccagaaccaccctcgactggaggctcccacaaggactggccggtcccccgacggatgctctggaggctggtgaggcaggccaagcccttaccgttgtaggagggcgaggtttgctcaaacacattataaagtgcatttccatctcgtcagaagccacagactggagcaaatggggcacttgaaacctgaaagagaggagaatgggatgaaatgttttctcagatccagtacatccacagtacatgtggacactctcgaatgacagccatgtgggctcaggtcaatgtggaggatgaccatcagaacagaccctggacctgtcctccttcaaggactcattgagcatctgccttttttttttttttttttgagacgaagtctcactctgtcgcccaggtggagtgcagtggcacgatctcagttcactgcaacctctgcatcccgggttcaagcgatctcctgcctcagccttccaagtagctgggattacaggtgtctgccatgacgcctggctatttttgtatttttagtagagagggggtttcactatggtggccaggctagtcttgaactctgacatcaggtgattcacccgcctcggcctcccaaagttctgagattacaggcatgagcaccgcgcccggtggcatttgccttttattgcagcctttgactgactgccagctttcactgggctcaccctgccttatgtgcctcgttaaggtttaaccaaggtcactgacacctgactgagttttatcttctttagaccctttctcagatgggtctggtggacaatggggtagggagcatcaaaccaaggcacctggaaacagcctttgcataacagtttaacattcttctgcctccagcctttcagccacttggttggatcaccctgggaggaatctcatccctcacccagctccagcctcagccgcccatgccaggtagcaactctctccctcacccacagccccctctgcccctttgtggcttaaggccactgtcctttgagatgtgtgtgaactgcttacacatccagatttcaactgatacagaattgtacccatactggagaattttggttgagaatctttcgagtgaactccgttaagcaaacctaatcccctgatccatttgtccatacaacacagatgaatttttctaattttttccattctactttcattgaaatgattttcaaatggatcaattcttttcatatacattctatcaaaaagatctgttgccactgaaatcttatttctctgcattaaatgtgcacatcacagtttctcccttttgtgactgtgattcctgcccgcccagcctggacttctaatgtggcacatttaacaacagctgaccctcaaacaacatgggctcgaatggtggggtccacttccatgtggattttctatcgcctctgccaccctaagacagcaagaccaacccccctcctcctcctcttcagcctactcaatgtgaacacgatgaagacctttatgacgatcccttccacttaacgaacactaaatatattttctcttccttatacatatttttaaatgttataaaaatttttttcttaatattagagatggggtcttgctatgctgcctaggctggtcttaacccctgggctcaaacagtctcctgccctcagcctcccaaagtgctaggattacaggttgagccaccgcacctggccacttccttatcattttcttaataacattttattttctctcccttattgtaatacagtatataatacatttataacatacaaaatccatcttaatcgacttttatgttattggtaaggcttctggttaacagtaggctattagtagttaagttgtggggagtcaaaagttatccacagggctgggtgtggtcgtgcatgcctgtaattccagtactctggaggctgaagccggcagactgcttgagctcaggagtttgagaccagcctaggcaacatgcaaaagcctgtctctacaaaaattacaaaaaaaaattagctgggagtggtggtgtgtgctgtagtcctagctacttgagaggctgaggtgggaggatggcttgagcccaggaggtcaagctgcagtgagccatgtttgtgccactgcactccagcctgggggacagagcaagatccgtctcaaaaaaaaaaaaaaaaaagttatatgcagatttttgactgtgtgggggtcagagctcccacgtagttcaagagttcactatactgttgtaaagactggactcttgtgttagtcaattttccatatgcagttttaattgatactagtgataaccatctgcaatatttcttttctttcttttttttttttttgagatggagtcttactctgttgcccaggctggagtgcagtgcacgatctccgctcactgcaacctctgcctcccgggttcaagagagtctcccacctcagctcccgagtagctgggattacaggtgagcgccaccatgcctggctaatttttgtattttaggagagactaggtttcgccacattggctagactggtctcaaatgcctgacctcagatgtctacctgcctgagcttcccaaagtgctgggattacaggcatcagtcacccaacatttctatgaaacagataaaaggctgaatgtggctgggtgcggtgtctcacgcctgtaatcccacactttaggaggccaaggtggggaaatcacttgagctcaggagttcaagactagcctgacaacatagttaaactctgcctctacaaaaaatacaaattaaaattaaatttttatttaatgggtgcctaactctgcatgaaaagccgtgactctggtggcccggggtgctgagagacagaggctaactgacgcaaccactttgcttaaagtcctctccaaatcctctttttttccctcattggcagtgctttgaactatgggaccaggcagaaaattcagggcctggctaactacaacaaagtggacacttgactccatggcacagtcgccatttccccaacctctttcctcagaattcttagcatctgagcatgtcacttaaaaagtcttggaaacgctaccaatccaaggacttggtggagcttcgggaaagggctgtatttctaacctctgggtggttataaatccatcataacaaagctagaagaccaggcctggtgtggtggctcatgcctgtaatcccagcattttagaggccacggtgggaggatcacttggactcaggagtttgagacctgcccgggcaacacgtgagaccccgttctccacaaaaaggacacaacaacaagaacaacaacaacaaaccccaaagactataaagaaaggaggggaattccatccagttttcttgcacagctggatctaaaccaccaggctgattattttctaactcagtttagaaatgtgcagatccagggtcacagctcatggggaggtgaggtgtgaacctgcgtctcacagatggaagatgcttttccgatccagctaagtccctctgcactcacatggggtttttttcaaccccaaagaccaaggttttgcaacctttaaataactaaaggacaactgcactttaacttggcacctgcctgcaggctgaggcttggaaggagaggagggatgtggtctaggacaggccttctgcctccaggccctgacactccactgcctagcgttaaagtgacctgtgactaagaacaaaactacaccttgcaggtactttgtttctgataactcagaacagattcaaggttatccctataatagcatcatttactccctgtattccagcgtgattccttgagtgcaggaggggagttgagttacagctaaggtactagaagtaggccacccaacaagaaggtctacaagggaatgtcaccagacattcatgtcctaaaaaaaaaggcggagactcaagtttagagcaatcccctcactgtccagatgagggaatggccctggtgaaggcctctgagtagcacactgtcacacaactgaggaggtggagctgagatagcctcagggttctctgcttcaaatctaaagtcctttccatcagggtagggagagttgccatagggttttaagaacgaggcatgttgggaaatattacctctggagaggaagcaccatggtgtaggaagaggcctacactttaactaaagcagggttagtaacaccagcatctactcctctggtgtttctgttttattttggcatagctcaagaaatagctctgggctgggcacgtggctcacacctgtaataccagcattgtgggaggccatggtgggaggatcactttagccaggagtttgagatcagcctggacaacacagggagaccccgtctctattaaaaacttttttttttaattagctgggcatggtggtgcatgcctctaatcccagctacgtgggaggttgagcaggaggatcgcttgagcccaggaggttgaggctgcagtgagccatgatcatgccactcactccagcctggccaacagagtgagaccctgtctaaacaaaaaacaaaaatgagtaagtggtgtctattatgtgagtgggaaatcacatgatgacctggcttttccatcctcgagacatggcaagggcacactggccatgggctatgcagagtccactagggggtggccagcagctccatctctgccgggtgccatcaccgtttcctttgaacctctcgagcactgtgcactacgctggcactttccatactgccaactggaaaccaacagtctctctttaacctctgcagcactactcttgcatatgataataaataatagtttgcatttattgagtcattactatggacagcatggtgctttacatgtcttctcatatacggtaggtaggtactatctatcattaacgcctttgacagatgaggacatcaaggctcagaagattacataacctgatcaagattcgcatgccagaaagaggcagagctggcccacgacacctaggaagtctgcgctcttgctcgtgtgcgtgctactgactgactagcacagaagagttacatggcagaaagaacagaaatactaccactattaccaaatactcatttatgaaccttctacactgtcccagcaatttctccttaagtccccatagtccgggctaacttgtagcctgaaacaatggacacttttttttcctaggaacctgttataactatctggagttctgctttccatttggcactgggcctacagcactggttgaagatgctgaatctgcagatgaccttttaaatggaaaataaagggtaaaaggtaagaagacagaaaaaacacggacagctagaaaagactaatatccccagcttctttcctgaaatgtatccgatgatcaagaaggattctcccagtctattgcccaaatcttttcccataagcgtcactacagccctacagaatgataaatcctgtgatatttatgaactacctgaaggttaaaaatccaggaaattttgattccattttggaaaaaagctcacaccaaattaaaatcagccctcaaaacaaaagtaaaccaaaggtctgcaaactcattcggcctgcatgattttgtcaaactcctcggagaccttcatcagcactcagagcaggtaagagatgcttcaggagacatctacggacactccctaagcctctgagagcaggctctgagcggcacaccctggaggccaggggatagccagccagcgccccagcggctccctgcacatgggctgtgtctgccgaaagtttgcactgtcagtgaagggagatgtcagtttgctcgggcttgctggccaagcctgatactggttaccgtaggcaatcatctcctcccaccagacagaggcagaggcagggaacgtaccccgggtccttgtccttttctgccagtatgttcagatgaggaaggaacgaatgacagagcattgtgggaatgtgtccttaatcacccaattctgctctgggtgggttctgccaagcaaatgcgctacaggatccctccacttccaatcaagagaagccaagagagtccttctaatggagacctgtttcctttctttctcttgtcatcagatcagctcactgtttacacagccagaagagctggcagagagttggatcagccagagtccagctgcttcctgtctttcaacaagtgccttaaggggaaatcctttgccatttggttggctgtaccagagagcagagctcttgagagaaggcagtctgcacttgccatctgtgacctcttactgtcaggtcaaagggacactcacaacatcaggtaagcccactgttaggggaaccaacagtgatcccaggaatgctgatgtggtcatgtgatcaatgttcctggaccagggtaactgggcatcccttcacccaggccctaccatttgacgagcagccgaggaaggatgggggcaactggttcaagctacaagaactctcccaatccacacaacatttatcatgcaatatcaactcgagtttttatgctctggagaccaatgcacttccattttccgaagctgcaaccttttcctttaagacctgatttctcaggacaggaccatgtctggcggcgtgttgctccagtttccctccccagccctcccttctgcccccctccccatgtgatgcgctattttaaaggctgccccagttctgcctgtctctgggatcacctaaaggtaaagaatcaaaggaagcaaccagggtaaagaaagccacgccacacagatgggaggtcctgggcagaggggtagatgagggtaactcttggctgaggagctcagagagcgcgtgccccttactttgcccttagcattcagttcttagtttccagcctcaatctttccgtcacatcctcaggtgcttagtgtcaataaaatgggacttgaataaactaattttcataaatgggatttatatgaataaaagatcaaggggtaacactgatgattttctttcacatttctaagctgtaggatcacattcttcaccctcaaagacacagactccctctctgtcaacacagaaataagtgaaacattggcacaatttatcagttgctgaggtgtgagtcagtctctcctagagaacatcctgactgggaaaggcccaggaattctggcttttgcctcttcgaaaacctctcttctggaccaacctctgcagttctgttctggggcctggaggctcacctgtttccccagaaatttctctaagcagacatcagaagacagccatactgacaaagtttaatgtatctgtgtgtgtgttacatatctgttgtgatgggtcaatttgactgggccatggggtgcccagattatttggctcacattatttttggtgtgactgtgagggtggttccagatgagatcagcatttgaaaccatgactgagtgaagcggaccgccctccccaaggtgagcaggcctcatccaatccactgaggcctgaatagaatcaaaaggcaaagaggagaaatttcactctctgtctgcctaactgcttagctgggacactggtcttctcttgcccttgaactaggacttacaccataagctctcctgttctcaggccttcaaactcgaactggaactacatactccacgagttttcccaggtctccgcttgcagatggtagatcatgggatttctcagcttccataatcatgtaagccagtttctataataaatctctacacacacacacacacacacactcactctctctctctctctctctcctctctcactctgtcggatctgtttctctagaaaacactgaccaataaatctgtctattaaataccaaacaaaaactttaaaggactagcaacaccagatgttggtaatgtcggtgaaatgtgtagcaaccggaactctcacatatgtttgagggaatataaaatgacacagccacttggggaaaggtctggtagtttcttataaaacaaacatacacctagcctgtgacccaagcaattctcatctatgtatttacccaaaagaaatgtcaacatatacctacaaatagtcattacaagaatgttcatcacagctttattcctaacaagcaaaaactggtaacaatccaaatgtggtcaacagaatggatatagaaactgtggtacatccgtggaataaaatgaaacactaccagctataaaaagcaatgaattactgatacatgcaacaacatggatgaattaaaacacgcaagtgaaggacacaaaagtgcacacatgattctaattatatgaaattctagaaaaggcaaattaatctactgtggaagaaatcagaacagtggttgtctccaggggttagggtggggcagagattcactgagaaggtaatgagagaaccttctgggatgacaaaaatgttctatatatgaggagggtttgggttacacacgcgtatgtgtttgtcaaaatccaccaaatatacactaagatttgagatttcattgtctgcaaattttacctcaaccagaaaaaaaacctgtaaaaaatatggaactgcagttaactaactgtagttaatgatctgtgtcaaggaagtacactgtgtctgcattaaaatgaaatgaacagaaacaaagatgcataagttaaacttcttccaactttccaaacgtttgaaattttaataaacattgaacaaagtgtcaagcagtgagctgtgtgtgaagaaaaagccaagtagagtgggtgggtgtgctaatttggatacagcggtcagggaagcctctgaggaggtgacaggtgagcagagcccttgatgtattagaagaacagtgagggagagcatctaggcaccgtgaggacaagggcagcgggtgacagctgggggcacactctcatccttgtatatgctcaaatacctttctttcattctgacagctgaatggatagcttgcctggtacaggatgcttgagctgcattccttttatccccgtggtctgtagatgaaattccacatcttctagcttcttggtgttgtaaataggaaatctggtgccagtgtgactcttttcctaataatttgttcctttggcttctgaaagcttgaagatttttctcttcatcctaagagttagaaacgttaccaggacatgcttagtgtcttctcttatcagttttacctttcaatatgcgcctcaagtcttccttctttagagaaattttcttctatatgtttcattacttcccctggggtaagtcatcaatgctgttcaccaaatatttctagccttcctccttccatccatatatatgactgcatgtgcctgctctcttcgaagttaagggtgggtttgtgatttgctttggccatgaaatgtgaacggaagaacgtgcacacacccaagcggactttaagggccagggcatgcctgccattctacctgactgctgcagtgaccagggagcaggtgttgcgacaaagcctctctggcttaggtccctgagtaacaatggtgagcagagtcccacctcttgacctgcactgttgcagcagcatggggaagaaatcaatgtgccgagctgagccagcaagcttctggaactggtattatgacagtataagctagtcctggccagtcctgcctcaggcacccttcctctacctttctctttctagtactcctgctgcttgtatgtcaaatctcttggttctatcttccaggccttatctctttctccataacttctctgtgcattttctctggagtgcagcctttctaacctgcctaggcctcaactgcctcccccatgcttggctcaaggaggtaaatggttggcattgaagtcaaggagttaggatatttatattctgctctttacaaatataggcttccttgtataactgcaatctaggcacttgtcattttcaatgtttgtattccatatgataatctaataaactgtgcctagccactttcttctgttgggtattaggattctcaatttttaccaactataagatcctcttagtagtgatcttcattttctactctaagcatggtagattccactccaactatctctgaggtttctgaattccacactgactggtatggaagaaagagaatcagactagcatcagaggaaaacacgctttcccaatcactagccagatggccttgtaccagctacttataatattcaagtagtgcccttcctattccagaattgttttaaagtccaaccaaggatggtgtgtgactgctctgtgcagagtaaaccattttatcggctgcatccagtactgcccaaaatactgaagcttgctggtaaatctgtccattcgaggaaattcacaaattcttcaggcaaaaaagtgaaaaatgagttgaacttacataatgtattttgtgactccaagatgccatcaatgtaagaggcatcattataaacctcaagaaagggaagaaaagctgccaacaatttttttaatatggtattccacagatatttataattttaagatgtgattatatagcacatctcgatttaaagttgttacatggtgaagtgtctgtgccttagaatcaatgaacatatgaaaaataatatatgaatatctgaaaaatcatacagactgaattccaataatagacccaatcaatttttcctggccgggtgcagtggctcatgcctctaatcccagcactttaggaggccaaggcagtagatcacttgatctcaggtattcaagaccagcgtgggcaacatggtgaaaccctgtcctaccaaaaatataaaaattagccaggcatggttgcacatgcctgtggtcccagctactgggaggctgaggcaggaggatggctggagcccagtaagttgaggcagcagtcagccttgttgggccattgtactccaacctgggtgacagagcaagaccccgtctcaaacatattccttctacttactgcaaaccagaagagcctaagtgaagacatctatctacagctaggaacaaaggaaggactgcacactgtgtgcatggaggtgagcgtgaagacatcaaacccaccctgcgtacagtaagtccagcctgcagcctgccaggtggatcctcagcaacagtattccagccaatgaagaatggggaaagcatctaccaggaacaggagctatggccattcattggtcctctccctttgaccctctagaccatttcttccaaagagaggccctcaaagggctgcttaggaagaaatgacggggaagcagggaccgggacatgatggtccaatgacctgagtccgagcagaacaagaagctgaaaactgaccaggtacagtggctcacacttgtaattccaacactttggaggctgaggcaggaggattgctttaagtcaggagttcaagaccgccagcctgggcaacaagtgagacccccatctctaccaaaaaaaagcagcagcagctgaaaacatcagcatgagttgaagtgtgaatcaagtccccaactactgtctaagaaagatgaatattgatttataactcttgtcacctggctaccatgcttgggtaagtttaggggcatttaattatgactcagaaatgtggatgtaaagtctccagggaaacacttggcttgtattttggagatgtcttatttaaggatggaccatctgttgaaaaaggagatcctctccctcttggtgcagtagcccaagaattcttctagttcttagacactagggattacctacaagctaggcagtaggatagacaggtcggccaggaaatgcccagtcattcgactgaacatcacgctctccttgcacatacatggctctccacctctgtttccaccgccgacacactgcacacctacatcccttggacccaaaaccactgctgctgctggtgtggacttctagcgtttgggcaatgccagagaacactccttagatggcttgaattcccctgcctgttcctcataaaatcagcaacaactggagccaaggaccacttccctcaagaaacaaaaacaaaggcaacaataaaaactgctctctaggtaaaacaggagttaccactcccaagggatttgtgggctgtctataaagcagaagaaagtgtcacttccccaccttcaggaggaacactgtccaagtaggaccagccatgcaggtcaggcttcgctctggcaggtgccctcagaagaccttcctagaaaaacaggactggccttggaactgcctgttgcagcttcttccctggatatagactgttttccaagtcctggagtccttatttttatttattatttgagacagagtcttgctctgtcccccaggctggagtgcagtggcgtgatctcggtcactgcaagctccgcctcccgggttcacgccattctcctgtctcagcctccggagtagtggaactacaggcgcgcaccaccacgcccggctaatttttgtatttttaatagagacggagtttcaccatattggccaggctggtctcgaactcctgacctggtgatccgcccaccttgcctcccaaagtactgggattacaggtgtgagccactgcacccggccctcatttttatttttaagagacagggtctctctctgttgcccaggctggagtgcagtagtgggatcttggccattgcaacctccacctcccaggctcaagcaatcctcctacctcagcccctcaagtagcgggacttacaggccagtgcgccaccatgcccagctggagtctttattgatgtaattagaattccaacctccaactaacttcccttttttatggagtgtgtgtggggttgggggaggtgttggaggggaaaaggggaaaaacagttagggaagggaaaaggacaatgaaggaaactttacagagaatctatacaggaccaatagttgatttctgggctcctaaaggcactgtctacctactgtccaccctactggctgataggaattttttgccagcaagaaagaaaatgcctgaaatactattagatcatgttcagcacagcatctgactcaccagcgaacagacactcacatgaagtgactgctcatatggaataaaaccatttgccttgcactgtataacttacatcagttatgccaacagcccagcctttctgtcactggaggtctgtgagaaggctccttccacggctccagcataatcctgggatgcagaatgtgtgctgctgtattcatttcatcaaaaccatcactcagccaggcacggtggctcatgcctataatcccagcactttgggaggccaaggtgggagatcacctcaggtcaggagttcgagaccagctttgccaacatagtgaaaccccatctcactaagtatacaaaaattagccaggcatggtggcgggtgcctataatcccagctacttggaggctgaagcaggagaatcgcttgaacccgggaggtggaggttgcagcgagccaagctgcgccactgcactccagcctgagcggcagagtgagactccgtctcaaaaaacagaaaaacaaaaaacaaaaaacaaaaacaccatcaactcaggctggggtcctggcacgcagctacatacaggctaccttcctgccttggacccagtcctggtaccctgtcatcagggcatcctctttcagctgcacctccaacacaggtagatggaggctggaacccagagggcacagtccagtggccacaactgtgttttgaaatggcatctaagaggaagaagccaaaagagtagaatggattgttccaaaaggtaaacagcagtgcagtgatcaatcctatccaagggaaggataaggggagagaaggccttcatacttcagtccttgcttttctctcacccagggctatggtgaccaagagaaagacatgcaaagactctagacagctgtgagggcctgaccgatgggtcaaaaggggtttcttgtttttgtttttgagacggactcttgctctgttgccaggctggagtgcagtacatgatctcggctccccgcaacctctgcttccctggttcaagtgattctcttgcctcacctcccgagtagctgggactataggcgtgtgccaccatgcccagcgaatttttgtattttagtagagacggggtttcaccatgttggccaggatggtcttgatcttttgaccttgtgaccgcccgcctcagcctaccaaagagttgggattacaggcatgagccaccgcgcccggccccaaaagcagttttctagagactctccagacagaaagcacgaacgagaaggaccatgaatctaagctccctaaaatagtgaatgacttctactcaaggcatgtaaagtatgctaccatttgcttttctttgcctctggttcaggttacttgaaccgggtagataagaatgggagaagagaaggttgggagtaaggcatggaggaggctccaacatggtagcaggaacatggacatacttgtaaatcttgattcataataacagttccaaggttaagaaagttaaggatctcctaagataacaagaaatctggctagcaagcaaaagatgtgtgatatgacataacattaaaaccagtatatgtcagtggacagaaatgttaagccaggaagcaatatctgtattggtcctcacaacaaatgtttatgaaagaagaggaccacataaatgggcaattccttcttcattttgactttcaccttgaagactaactttacattgattgtaacattctctcaagtcagcacttcaattcccagaatattggcatcagaaacataaatattgacaaataccacttattgaaatgtgggccaggcgtggtggctcacgcctgtaatcccagcactttgggaggcagaggctggtggtcacatgaggttgggagttcgagaccagcctgaccaacgtggtgaaaccccatctctacaaaaatacaaaagttagccgggcatggtgatgtgtgcttgtaatcccagctattcgggagctgaggcaggagaatcacttgaacctggggggcggaggttgcagtaagcagagattgcccattgcactccagcctgggcaacagagcgagactctgtcaaaaaaaaaaaaaaaaaaaaaggaaagaaagaaatgtatggaagagaattaaaaaaacaagcagccagatataatggaaaacagagatctgggctcagagctacagcattcaagtgctgacttctccacgcacaagtatgtgaccaagggcaatttcctgaacctccgtgaacttccattttctcaactgtaaaacgaaatcatgttaccaccctagccattacatgggaacatgtgtgcaaccagttgtataaagtgtggtaggcagaataatggctccccaaacatgtccacctccgaatccccagaacctggaatgtttaccttacatggcgaaaagcacttggcagatgtgatgaatacagaaccttatcaggtgggtccgatgtaatcacagcatctttattatggaaagagagaggcagagaagaaacatgactatggaagcagacagacagagatttgaagatgctttgccattagctttgaagtagaggaagggaccatgagccaaggaaagcgtggcctccaggagctgggaaagacaaggaatggattctcccctagagcctccagaagcagcacagcactgcagacaccttgatttcacccagcgagaccaatgcagatttctcatctccaaaaatgcaagaaaatacatttgtgtttcaaatttgtggatatttgctacagcaacaacaggaaatgaatgtaaaaccttctaagaaaatggctgttcttctaaaaaatcaactctttttttgtttgtttttttgagacggaatccgctctgtcgccaggctggagtgcagtggtgcggtcttggctcaccgcaacctctgtctccaggttcgagcaattctcctgcctcggcctcccgaatagctgggactacaggcatacacaccacgcctggctaattttgtatttttagtagagacggggtttgtacatgttggtcagctggtctcaaactcccgacctcaggtgatccgcctgcctcagcctcccaaagtgatgggttacaggcgtgagccaccgcgcccagccccagctaattttttgtattttcagtacagatgggtttcaccatgttggccaggacggtctcgatctcctgacctcgtggtccgcccacctggcctcccaaagtgctgagattacaggcacgagccaccatgcccggcctggatcaactctaaaggagagtagctggggttccctggctctgctgaaaattatgaagcaggatatcttatcagtttgagctgctgtaacaaaatactgcagactggacggcttaaacaataaacattttctctcatggctctggaggttgagaagcccaagatcaaggtgctgccaggtctgatgtgggtgagggcctctccctgatttgcaaaggtccaccatcttgctgtgtctcacatgctgggagaaagcgctggtgtctcttcttcttctgggggcactaataattccatcataaaggcacacactcacgacctcttctaaactcacttatctcccaaaagtcctccttcaaataccatacattagggattaggcttcaacacatgaattttgggggaggagggggataaaacacattagtccgtagcacatggcatcctctcttgggaaaccattgaaaactgtgccccaagagagatgccatgtgctatggactgaatgtgccacacttaaataggataagcaatcaagtcagtagtctgtctatccattcatatgtattctagttattaagttgtaaggaaaatggcaaaacaatataatttctcccctcagtgaagggatgacccattagggaagagaagaaaagaggagccacagagctctcatttctttcacatcccgaagtggctgtctagcgaatgtgtcccacaacaggctcttgacctgaaacctatggggatggacatcagcggatccatcagcctcctgaataagatgccacattctaagggagattcatagagttagatgtcaaaagtgtttgggcttgaacccaaaagttcagaaccatttatataacaagagaaagattatagatagaagattaaacatataatagatatgtcaataacaatccaaatatttgtgatttacttttagtatggagagatgggactctgaaggaagaagaaaactgaatcaggccctccagggctctatatctcagatcagggttgtttgatatttgctatggcatacaaaagggccattcagaacaagttctgtaagcatatttttcctctctcctgagtccacatatgtaagctattctctacctcacacacgctctctcaatcccacctacacctgcagcaactgccccagttccaatgaagcatctccatggccatcttcacttcctctcccagttcctcttgaacctgctccaatctctaaaaccacctttccacggttgccaatgatctccacatgacagcatcctaacatcgattcctgagcatcagcagccatgtgagaaaggtgaccctcctcctccacctttgctgcacctgctgtctgggcccccttacagtataagccccttgaaggcagagtctgtttattttactgctgtagcctagagcctggcatatgatgggctcttgaaaatatctgttggatgaatgaacatcacactcacggaaatgtgtgaaaaaggcccagctgtacaaccggaaagagataacaaattaagggagtcagcctgctgtctgagtccattcccagcagaggctaccttctaccagtcaaggttcagtaactgccataccacagcgagggttaagtaggacagtgaagcgtgtgtgagacagaagtcggttaggaacccactgcggtcatgctgcttcctgcccaacccgcagttccgataagggtgcagagaacgatcatgtgtgcatgtgcacagactgcaggcgcccctgccaccatgcgtggtgtgcagtgggcatgaagggagctacttcggctgccacctgggcaggccttgacatactgctggcaggaaaaaggtcagccctttccccctatgctaaatcaagtcacagacagtaggacagcctccaggttctcattcctcccaccaacaatgaagagtaggaggagcctctcatttactccctcccacccacccccacctggaagtgcccagagataggggggaaaagcaacagcatggtgacctgggcttatgaccccaggcaggggttggcaaagtactcaacagcctttcctggacagtgcgaacttttgggtgcttctgcactctgatacaaacatttccttaaacatttattcaatattttattattattactttttatagagacagggccttgttatgttgccaggctggcctccaagtcctggcttcaagtgatcctcctgcccaggcctcctaaagagtgggattataggcatgagccactgcactgggcctaaaaaaaactttattatggaaatttcagacaaacaaaaaaattgaatagagtgagctcccaggtactcatcacccagcttcaacatgatcaaatcagggtcagtcctatctgattttcccctgaggtgtccatgtcttggtttctgcaacaaccccagttcaagcgtgtcgtcttggtgtaattaatagctccctctttcagttcaaacttgcctgggattgaatgataaattatatggtcatctgatctttatcccaactactctccctgcaccagattattttgaagaaaattccagacacgaaataaatccacccataatattcacaatgtgatagtaaaggcttaaatacaactccacaccctttagacaccaactatgcagcactgtgccctctcctctcaaggggctgttggaagggtcacccagtaggctcgtgctacatgctggcatatggagcctcaccgggtggcatgaccccagcttagggatgggctgacacacatgcagagaagccacttatgccggcctgactctactgcatcgcctccttcatggcaccacactgcctccatacaggaggtctagcaacggtcacggacagcaggagagcgaacagactagcagtctgtggctcgttttacacatgcacgcggaaggagcagcacgagttcaatcattccaagtgaaaaaatgcaaacctcaaactgacccacagagaataaaatcccatctttatctctgctctccgggtggtagcactgcaagattctagagccaggctgaaagtagggtattttaagcaacctaccttcctgacatttacgagaaaatagcaagagaaaagggcataatcatgttttctgagtcctcagaagtgaaccggaaagttccctagtctatgatccgcaaccctatttctgggtatatttcctagcgaaatcctcacacaggtcaatcagaatacgcacgaggatgttggccacagaaccatgtcgggtagcagatgatccccaggggaacgggaaggtccccgcagagcatgtacatgatgaatactatgcagcagccacaagcaatggattaatgtgcacgtcggacagatccaaaaacagtgctgagagaaaaaaagaaacaaaagaatcgtagcaccaggccatttgtgccattttacctaagttaaaaacacatgcacacaactaaaccttagattaacaaaacccatgtatgcacagaaatgaaaaattaaaccaatacaccaacatattgacatggttggctacggcggggtggggaatggacaacaggaattaaaaaacagtcaatgtatgaatgaataaaaccaagacagcagcctggccaagaccagtgagaccagcatagtgtgtcaaacatgtaatagcattaactcaacaccatgcactggagggaggtctaaaagaaaggaaaaacaacagctattaataaaaactagcaagcaatcaacaattgtgaaaaaaaaatcttgcctcaattttatatttatgtatataaatctatgtatatagatacgtatactatctatgtgtgtatatatatatacatatatatagacagagagacagagagagagagaggagagagagagagagagagagatggggtctcactatgttacccaggttggtctccaactttgggctcaagcattcctcccaccttggcctcccaaagtatgggattacaggcgtgagcactgtacctgcctggcccctcaattttttaaatgctttctttcactaactagataaccgttgagtgtgatgaacagtagcactggggcccatcactacaccaacacagtatctgcatccagaggggaagctggaggggctcaaatggaggccttcattgtaatgcctccctcacagtagggcctgggattgctggtcacagggccacctgcttccaattgggtgagccatgtcacactctgtttacatttcttacttgcaaaaggaggggttcaatgggacaatctacacctaaattgcttcctgctctaacacttgacacttgcacaagtgtgtatgtgtttgtgtatactacacatagctaatcctatgttctaaactgtgttaatgcttaattttgtgcatacgttactgctctagtgggtggacactgaaggctgaatccactttctccaattaactgcaggttactcgtgtcaggcactggactggacactgaacagtacaaggggcagtttaagctccttcctgagcttaaactctgatgagggatccagacaagtaaacaagccagagcactaccttgtgatcgcattacgacagggacaaggcaaggtcccaaaagtaactaggagtggggcctgcactgcattttggggccagtgggttggggtgacagtgatgtgaggaaagcattcttttaagaaggaagcttaggctgagactaaaagataagcaggccaggcatggtggctcatacctgtaatccagcactttgggaggctgaggcaggaggactgcttgagtccaggggttcgagaccagccgggcaacacagtgaaacccatttctacaaaaaatctgactgcataccatgtatctgatattaaaaaaaaaaaattaactgggcgtggcggcatgcactttgtagtcccagctattcggaggctgaagtgggaggactgattgagctcaggaggttgaggctgaagtaagccatgatctgccactgcactccagctggaaagaccttatctcaaaaataataaaaaataaaagataacaaaagctagccaggcagacaaggggtaccctaggtgcaggagtcaggggtgaaaaggaagagttgcaggtcgagggggcatcatgtgcaaaggccccggggtgacagggagattatttttcaaagaactggaagaataatgatgtggttggatcagaaaggtagacacctatcagcgctcatgggtatagtagattgtattttccccaaacagccccaggactatttccgtcccaatgcacttccagaatcttgccacccttcatcaagcactggagtctgttttccctgccctgaacctgtgtgggcctgggactgttctgacccagagtacggccaaaatgctatgacttgaaggctaagtcacacaaaagatgcagccactgcctatttcaagaccctcacccttggaacttgccaccatgctgtgaggaagcccaggccacatagagaggccaccatcagcatttggttgacggcccttgctgaggtctctgtggagaaccagacacgtgagggaatgagccatcaaaggtacctgtggccaggtacggtggttcacacccgtaattgggaggccaaggtgggcaatcgcttgaggtcaggagttcgagaccagccaggccaacatggcgaaaccctgtctctataaaaatacaaaaattagccaggtgtggtggtgggtggctgtaatcccagctacttcggggctgaggcagaagaatcacttgaacccgggaggcggaggttgcagtgagccaagattgaccactgcactccagcctgcgtgacagagcaagactcagtctcaaaagaaaaaaaaaaaaaagacacctgtgcctgaccttctagttttcagctgaggtcccagacatcatagactagtgcttctgctgtgccctatgcaaatacaatacctgacccacatagtccatgggcataataatagttgttgtaggtgatcgagtttgggggtattttgttatgcagcaccagtatgagacaaatggataaagcatagtttattcacataatggaaaactattatagcaaggtgacgaaactctacaaccctacacaacaagatgggcggctcccacacatgatgtgaatgaaggaagagacacatgagtgcacgaggatcactatctgatccgatctacttaagatacaaaacaggaaggcaagtccacgctgttacaagtcaggaaagcagtacctccatgggagctgcaactggaaggggtatggtgggcggggttgggggagggttcctaggatgtcagtacacagaggtattagtttgtgaatgcatcaggatgtatgcttatgatgtaatataagcactcctttgtatgagagtaaactgcaataaataggtttccttttaaaaaatgctgacagagttgcaaaaaatgtggatgtggatgctaaagaggaaagcaggatcgggggcaaggtccattgagggtttagtgcatcattccagaaacactgcagaactgttgaacagttcagaggtggcttatatttcgaaatattactttggccatggtgcagtaaatggattgggaggagtcgaaaagcttgcaggcagtggggagttactgcagtcattcaggctatcggtggtgtgaatggagaggccggccgggctaggcggccctgctgccctgccaaacatgaaggtccctatgctcctggggccagtggctggctgcccaatgggccatctgctggacttagaatccagaagggacatctggtcaaccgactctgaacaattatttgtcttgattactgagtttttttggcatccccttatatttctgcctggctctggcagaaagtgtatggattaaaaggatttttaaagggtttactctctggacatgttattagcttagaagtcagagatttaggggtgtagaagttaatgatactcaacagctcgcttgggcaactgggtaaatggtggtttttgtggagacatgaactctacaagggaatgggctgctagaaagggggcaggggtgaagatgatgatacagtttggggcataccagttctaggaatgtgagaaacatgtaagtggagatagctggtttatctggtgtgaggggcgaggcccagggggaagatctggactggagatatggattagggtacaaacagttttaaaagtccagatgaggccatgcacaatggctcacgcctgtaatcccagcactttgggaggccgggcgggtggatcacgaggtcaggagtttgagaccagcctggacaatatggcaaaacccctctctactaaaaatacaaaaattagctgggcatgggggcacccacctgtagttccagctctcgagaggctaaggcagaagaattgcttgaacccaggaggtggaggttgcagtgagccagatcgcgccactgtactccagcctgggcaatagagcaagactctgtctcaaaaaaacaaagcccagataagcccactccaggagaatgtacaaagatccaagactaagcctgaggggaaccatttaagggaacagagttaaacacctgggcaaagatggtggatacaggaaatatagagagcagtgaagaatatttacagcagggtaagaggaaaaaataacccccctgccaaacaatgatgttcccatactggagatgtctatgtgcaaagcaactcttcttgccttcctttttttttcttttctgaaaaggcaatagtgccactgaaagattatctcctaactttggttgacaactcagatctttaaaacgatgagccaattaacgctgttcacccctttggctaaagagagcagaaagtaccatttttctgactttcttgggtccctttggtgttcttcgggcatcagttgattccatccattttctgaatgaagagagggaggagggggtgggaccctcgaatttttaatgctcccaaaataactgagtgaggaacttctggcccatttcacagaagagggagaaaaaaaaaagactcagacaagtaagggaatagatgttgggtgaaaagggaagtgtgttctgggccttggctaccagggccaaattttaagcatggatcagggcgatttcactttgtgcctagaggtggtggacctgcgtggctgcagaagtggtgaggagcttgttgcacagatgctaaccccagggccagccccagccctgctcatccactgcagcagctggtctcggaggccctccacacacctggggtagtcttcctccaaaggtcctgctatatagcaggatcactgggtcttagctttttggacaaatatttgaatttggctttaataggcaaaaccaatcaagtagacatccgtgaaaaaggagcagtagatatggatcagagtgccactcccgactctgctgtgggaaaagggattggccacagcagcacagctgctccactgcttgtgccccccgcaaactgagacctggccaggccagggttaactggttcatgatttttttgagacagggtcttgctctgtcaccaggatggagtacagtggtgtgatcacagttcactgcagcttcgacctccagggcttagcaatcctcccatctcagtctctggagtagctgagactacaggtgcatgcaatcatgccagctaatttttttttttttttttttttttttaagacaaggtctcgctctttttcaccagttggtcttgaattcctggcctcaagtgatactcccacctaagcctccccaaatgcttgattacaggcatgagccaccatgcctggccctctaatactatttttaaatttttctgaattttgaaagtttttataataatagttttttaaaactgcagtgaattataggatattcacataagcaggataaatacatgattataaatagcttcacctcagctcaagttttgctgccattgggttaagaaaaagcatttaattttcagagtgttctggatttcagatttgtagataaggacgtattaattttgtggtgttaccattctcatttaggtctttagcccttctagagtctccattgtgtatgatagtctgtgcagatccagttaatgtttctccattttaattagtcaatctcctaacattatctattaagcaatccatccttctcccattgattcatggtgccccttatcgtatattaaattcccgtatgtatatgggtctttctctgagatcattattctatttctttgtctattacctgtttttgcgcagacatcatttgcttttagtactatggcttagaagttaaaagttcccttttctcttctttctgaagtttaacttaggtaatccaaatgcatttaaaataagatttcttcaaaaaatccaattagaattctgaacgggttttacttgtagcagatgtattttccaaagatagcaccaatatatatctcatcccacatgaccttcttacaaagtatattaacactcctctatcgagacatggggtctatgttctcttgtacctagagtgacctcccacctgcctcaaccaacggaatgtggcagatgctgtgtgacttccaaggggcagtcaaaaggcaaaatggcttctacttggttctcttttgggacaagcgctgtgggagccctgagcaacctatacttagtgcagtaacccagaaggcaccacattggagagatcacatggaaaagtacacataaacagatgacggagaactgcagctgtcccagccccaaactgcttgagtctcccagaccaggcaacaggtatgtgagtgaaaagcctttgagatggtcgcagccacagccccatctgactgcaacctcaagagaggcttcaaaagccaaaaacgcttggcagagctgcttcaaatgcttggttcacaaaaactgtgagagataatgattattactgttttaagctattagttttggggtaatttgttaccccacagttactgaaatagccctgaatttctaagtcaagagaaaggaagattatcattttataatactagatctaggctaggggtggtggctcacattgtaatcctagcactttgggaggccaaggtgggcggatcacctgaggttgggagttcgaaccagcctggtcaacatggtgaaaccccatctctactaaaaatacaaaaaattagccggcatggtggcgcatgcctgtaatcccaactactcaggaggctgagacaggagaattgcttaacccggaaagtggaggttgcggtaacctgacatcgcgccactgcactgcagcctaggtaccgagcaaaactgtctcaaaaaaatcttccattgaatataatgtttgctgtagattttggtacaggatttaaaaatcaaattaaatatcccttcatcaatattttattgagaatgttaacataaaatggtactgaactcatcgaatttgttttccgtatcaaatgagataatcatgcttcccctcctttggtctactgatgtaacagggtctctgatgttgaaccagtcttgtatttgggggaaaacagtatttgtgatatatgtcctcaatacactattaggccagttatctgtactttatttggagtttttgtaacagaggtaccagggggctttttcatttgtgattaaaattagtatctgtttagtcttttttatgtagtattcagtttcttcaaagagcgagcctccaactcttgtctctacccttgaacttctggaattgaatgggaaacgagtttggagcctagtgcaaagatgccttctgaccctgtggtttggcatctcactcctaccttcccttcctagggcttggccaagtccatacactcctgctctccagaggagccctcccaacaggtgcaggactggaaaaagtcacctgagagaggagcagcagcggcttccacatacaggactttctaacatcctcttgtctctaaggttaatcgtgatctggctaataattggtggagtgtccacaggagggctaccactagccctgaaaagggtaaaacttcgatatactgacttgtccacaaattgaggggaaaaaaaagcaagttatagacacgaagaatgtgacacccttagcaaacaaaaccattcatgcttgcataagcataaggaaggatacatttctgagtgtacacacccatgctttcaagggctgcctggtcacccaagagcagggagaccagggcagaagaagggataagaccttaactttaagctttctatattgtttcattttgtgatgacgaactcaaattacttttatattaattaaaaacaagtcgccccacaccttaatccctaccctaattatccctggatctcactaaacgtcacaatagttggcactgctactacaaaggtgtaagtaacaaacggccagaggtggctctggccagaacaaaacaacaaaaccctggaggagttgaggagttgccgtgcggagtagtctaaggcacccccgtctcagggaggtgctaacacatccagccctgcaaaccccgtgcaggagcctcagccgcaggcacctcggggttgggtgattgtactagagtaagaagtaacagcctcccccaggctttcttatcatttttgcttttcctcgtcttcagctctggctgctgctatcacttgtaatactataattgccaaggcaatgggattggtataatttctcgttcatgaaaacacattcccttttttccttatttgaaagcacacgagttgctgagcaagggtacaggaacacggcctatctctcacgtgaagtggggtgagatacacccattctacattccgcaggaccaggtttgcaaccccatgcacctgccagtttgctgggccctgtgaggggcaaggacggcacatgcactgctgagggagcaggagggtgagctgtggcagggcccagcagtcgttcttccgaaaagctctctctggctttccttgatacaagacacacagggtgccaagtatagaagaagggccaggaacagcctgaaaaggtctccattctccaaagcagctctgagtcgttgctcatttagctctttcatggagtggggcaagtgagtaggaggaagaaaaaaccacgcggcagcccacatttctagagccactcctacgtgccaggcaggttctgggagatttattacattgttgcatttaatcccatgaacctctgctctaagcacgctttttttttttttttcctcggagactgagtctcactctgtcacccaggctggagtgcaatggcacgatcttggccactgcaacctctgcaccccgggctcaaacaattctcctgcctcagcctcctgagtagcgggattacaggcatctgctaccacgcctggctaatttttgtatttttagtagagatagttttcaccatgttggccaggctggtcttgaatgcttgacctcaggagttttcttgtttattaattattattattattttgagatggggtctcactctgtcacccaggttggaatgcagtgcacaaatcttggctcaccgcaacctccacctcccgggctcaactgatcctcccaactcgcctctcaagtagctgggactacaggtgcacaccaccacccctggctgttttttttgtattttggtagagatggggtttcaccatgttccccaggctggtctcaaactcctgagctcagtgatccgcctgcctcagcctcccaaagtgctgggatttacaggcgtgagccactgcaccggccaaaaccctgtctctttaaaaagaaaagaaatatcaagaatggagccccgtatttaacaaaaatcctaagccaggagactggctccatattctccaacacttctctagtgccactagcatgaggggggcagatacacacagggaggtcacagccaacccaaaaggccacttttccctcctcattgctgaacaaaggcagcgactgcactgtgcctggagttttccctcctctactccttctctgattgagtcttccactcacagagcttggtggcgggggcaggtctgcaagtgctcgcaagcattcacctcttttgacagccactgaatttcagagttcacacagtaactcacaaattcatcattcactctagaaactacccgcagtgtcttccttgatttattaattaaatacttttaagagtagatcaaggtctttaggctaaaattaaaaacatgccaacgaaaaccaccatatatttttccaaagctaaatgccatgcacacctatccacggcaaacactgatgcagcaccctggatgccaagcaggatggaggtgggagacatcagagatgaagggagataagtaaagcaggtggggcctggctggtgatgcccaccccaaatctaggctggaattaaacctcacctccaggaatgtgcacaccccacagggaggctagagggtctgctcgggcctcctgaaggcactccctgcagatcagggtaggaggaatgacctggggctttccagagtccggtgtgagcgcccagcttgctgctggcgtggcgctggggaagcggggctatgtggggagctacaacaggtacgttctcatccaggcctgtccctaaccactcgcatgactctgcaaaaatttagctttgtctcctgtttttcactcgtaaagtgaggcttatgcctctaagtttccctccattataaagcctctgaaaagttagagattattgtcatgtttctttcctaccacaggtccctcaaggggaagttctggaagaaccctgtgttcttccaccctgaagaaagggggcacttctccaggtgagcaaaaggagctgggaagccccaggcctcccacgtggtaaatgttctaaatattgtcagaactgacacctcagtttaaaaaagtctgcattagaaaaggcaagggggacttgctattcacacacagcctgtaacttagaagattcctcctcgttcctcctgtgtgttcatacggccaggccctccggacgcctctcctagcaagcaccagccccaccccatatgacctccattacccacagtggcttgacgtacagaggctctcacaaagtcatgaaagactgagaccgcaggaacagtcatcttgccgcaggcggccaagagaagcctgataagggggcgtcctgctcctcccgggtgatcctgctacacacatagatgacaaagggagctcgggggcatgggccaaagctgctgtggaaaggtaaagacacagtccatatttgcactctctttgacttactcttttaattgactctttccgataaagaattcatttcacttcagcaactgccaactttgcaaaaggtcagtgcactggccatgagccactgtcgatggaaacttctcagctgccttcgagatgccttgagaggctggtgcttgatggtcacgggcctctgctgccttcgtctcccgggctgtgctccacgctgcttcccagggagacaacgaccaggcattcccttctgacatgccttgaacgcagaaggttctaagcatgttattacaaatgagctggaacagctctgtcaaacaagttctgtaagttgtctcgattcttctgaagtgactgaacaaccatttgcttagattctcacttggcttagatctcgtagcataacaacgagaacatgaatattttttcattgacattgtgtcaagtcaaaagtgtaacctaattttaagcttctctcacagattaccttaagggaatacaatataaaccaccatcttctactgtctcggcagcaggctcttgggaaagggaactctcccagttctactacacttgggccaattgtcagtaaaaggtctcagccaggtcagaactgacgcaaagcacctggttcctcaaattagcactttaaaccaagctgctgacaagacgctcgttgtgttaagaaacctaaaggagtgaaagtcatactgtggtgtagggatcaattggaagtcccatactttttatgtcttcttccctaggtaactttgccatcacacacacatgcaaatcaaatcacaaaactgctggcaaaaatatcagagctgtccatcaacagatgaatgttaaagaaaacgtggtacatatacactatgaagtacgattcacccataaaaaagagtgagtccagtaatctgcaacaacatgaatggaaccggagatcattatgttaagtgaaataagcaggaaaagaaagataaacatcatatgttctcacttattggtggggatctaaaaaccaaacaattgaattcatggacacagagggtagaaggatggttaccagaggttgggaagggtacgggggtgtggggggaggtggggatggttaatgggtgcaaaataatagaaaaaatgaatagacctactatttgatagcacaatagggtgactatagccagttaataacttaattgcatatttaaaataaagagtgtaattgtttcgtgtgtaactcaaaggataaatgcttgaggggaggataccccattcttcatgacctgcttattatttcacactgaatgcctgtatcaaaacactcatgtaccccataaaaatgcatacctactatgtacccacaaaaaatgtattactatttttttaatcagagcttcatattaggatctgaattcgttagtgtcccctgaaggggagtcccactgcacagccttcttgagaacttccttccctattttcttagcctcctcctcctcacaagttacaaaactccagtaccctcatagtacaggggagaaatagagatgaccttggaatctaccatcaaaatcaaagctgcggccaagattaaaatccaagtttctggccgggcgcggggctcacgcctgtaatctcagcactttgggaggccgaggcaagtggatcacttgaggtcaggagctcaagaccagcctggccaacatggcaaaaccccatctctactaaaaatacaaaattagcaaggcagggtggtgtgtgcctgtaataccagctacttgggagggaggcaggagatcgcttgaacctgggaggcggaggttgcagtgagccgagatcacaccactgcactccagcctgggcgacagaatgaaactgtctcaaaaaaaaaaaaaaaaaaaaaagattttctgatctggtatgctagggtggatttcatggtcattgtgctcaaatgtagagataggatatattccctgctcctgccacaggcaaggtgggactaccctaacttagaaaactgtcggccggggcaatggctcatgcctgtaatcccagcactttgggaggcaagatgggcggatcacaacgcaggagtttgagaccagcttggtcaatatggtgaaaccctgtctctactaaaaatacaaaattagccaggtgtggtgatgcgcgcctgtagttccagctactcgggaggctgaggcagagaatcacttgaacctgtgaggcggaggttgcagtgagccgagatcgtgtcactgcactcagcctgggcaagagagtgagactcgcctcaaaaaaaaaagaaaagaaaactgtcacttaccttggtttgtaacggcaagtccaagtgctcctgggtttctacaactgagagaagctctaatatcctgggctgtaccaaataatcaaacgaggtctagtcataaaatcctagtcaaatgtctgtctgatcccctagactttgtaaaggagtgaagagagaaatgagatgaaggaactaaagaatgtaacttcaagggtcaaatgaaacaaagccggcctgaaggagagaaaggagggtcaaatccatcagcctaagacctttagtccatgtttaaattgatttatacaatttccaacattacaggtagagtaaaaacttcgaacttttggctccaaacacttctctgctcacatcagaaatggaaggatcagataagacctgagaacaaacttcaagagatagatgggagtcttttgatggctgaaaaaccggttcctacgagatctgagccatttcgtcacaaacaaaagaagaagatgggtagttttctctgatacccccactgcatctgagatttctcatgctttattgaattcattatgctgttctttttgaaaatccaagatatccagcctggctaacatggtgaaccctgtctctacaaaaaatacaaaacttagccaggcgtggtggtgcatgcctgtagtccagctacttgggaggctgaggcaggagaatcgcttgaacggaggaggtggaggttgcatgagccaaaattgcgccattgcactccagcctgggggacagagtgagactctttctccaaaaaaaaaaaaaaaaagaaaaaaaaaaaaaaagaaagaaagaaggaaagaaggaaggaaggaaaagaaaagaaaagaaaaaagaaaatccaagatatctggggccaagcctacaagggaaagggtagctgcaaagtcctgacacctactctcaaaacagtccggatggttggcagttctctggctcttcctagagcaggcaggcctgacacattctgaggcttccttcactgctccagatgctcacacagctggggatcaaggccagtatctagttgtttatattcaagtatgaaagcctggcgggtagcagccccttggaagggtaacatttggcagcagctcatcaacagtcaaggaaaacacaaggtggtcaaacactctcaactaaggcacacagaaagcccagcgcattcctgggggatgagaccgatttatttaaaggacaaacggaaaggaaccacgaggatgtgaacaactctcctgagtccaaccagcagagcaagatgagtaccaacacccactgccatctccctccacctagtctgtcatcaggttaccaaactcaacccaaatcccttttccaaagcacgtgatgaggtttgctacttactttctgcccaagtcctgggagccctgttgtccagtaggctatgattcctctttaactgatccccactatggcagtcatttctggtctagagtagtttcccatctttaacaatttatctcattcttttgagaggccttggctactctgttattctcttagttcctgctgactgcaacagtgttgggccagcaggtttggggaaataatccttgggctaacatttattgtgttattcttagagtgctccttgcaagcaaagctactgaaagccaagtagaaaaagctgcatataatggatgagaacagctcacctcaagggaccagccacagcgtcctcagatctaaacgctcccgcacagaaagcaaaggagcgtccattgtggcacatgctgtagtcccaggcaggctgaggtgggaggactgcatgggaccaggagttcgagatcagccggacaacatagtgagaccacccccccgtctctaaaataataaaataacataaaatatttaaaaaaaaaaaaaaagaaaaggaaaggaaaaagggcaggtcaagtatcagtgtatttagggaccagaaaggatggaatgcggttctctctcaggcctcatatttgttgagaaggtttaaacagcagtggtccctacttttctccacacacagcccaccatgtataaacagcaatttcgggtgggcgtggtggctcacgcctgtaaaccccagcactttgggaggctgaggcaggtgatcacctaaggtcaagagttcacgaccaacctggccaacatggtaaaatcccatctctataaaaatacaataattagctgggtgtggtagtgcacacctgtaatcccagctactctaccaggaggctgaggcaagagaatcacttgaacccgggagacggaagttgcagtaagctgaattgtgccactgcgctccagctggggtgacagagtgagactctcaaaaaaataaaaatgaaaatacatagcagtttccaaggcagaaggaaagaaccaattccatcgaatttcttgcaagcagctgttatgacgatcctgaggccagggaagatgaatcccttatttataaaaatgaagcggtcaagatagcacctgaaagaccagaatgaatctggtcactctgctacaccaaacggccaagcccctggctaaggaataaattgcttcttaaggagcttttcttaatctggcactctttatccaggaccaaatcaatatattaaaaaaaactccaagtgttgatcaaacctgggactctagcagagcaaagaagaaaacaaaactgtcaccatctgtatttgtattagaataccttactaaattccatttatattagaaatctggcatgaataagcaacaaacaagcacgtaactacaatggagtcaaaggagcagggacatgcagcaggacggcagggtgggggtattcaagatgccccggtagtacctgattctgaatgagagaaacccccaggagattctgaacaatctgaaagaaaatgcaacagcattacggtactctgtatggagaaatgtccatcaaaacagactctaaatctgtaataccaactacccaagaaactgaactagaggatgccacaggcctaatgcatcaggagaggaatctagtggcattaaaaagtcttttcctgaccaggcgcagtgctcaggcctgtaatcccagcactttgggaggccaaggcgggtggatcacatgaggtcagagttcaaaaccagcctggccaacatggtaacttcttaagttaccccatctctactaaaatacaaaaattagccaagcatggtggcacacacctgtaatcccagctactagggaggctgggcaagagaatcacttgaacccagaaggtagaggttgcagtgagctgagatcatgacatgcactccagcctgggtgacaagaggaaaactgtctcaaaggaataaaaaaaaaaaaggttttccatgaaccaagtccttgaaatgaaaatgatctatcctctcacatcatgatacttggaacttcagtatctgtatcttcagtatttttgtccaaacatacagtttccattcttgtcgaggaccaataccagatttgtcaaccaagaaaggtaaacatcaacctcacacataacataacatcatacataatcttatacctcacttttaaacctattcttttcagaaccactagaattatgagcagtactgtcattgaaaacgatggaatcttccaccatactcaaccctttcaggcctctggccagagctgcctgatgaaaatgtgaatgaacacacagtcactaggcttacagctgggctgaatagaatgaaactgatccttttacagttcaactttcttaagcccatacccttaagaagaagattccaattcatccttatggatccttaaacttcaaactatatataaaaggagtcttaatgtgatatggggagaggcacctgcagaactgaccatcagctatcaatgctaaaatgattacagtcctcagaattttctccaaaggcaaatatgccccattacatagaatacaacatgcctgctcagcaaaggaattgaggtaaattctgagcagctgagggatagctggatcactggttggcaaatgtctttatcgaggaaatactggaacagaaacattgatggtttcttagaagaccctcttggtccttcaaggatgtgcccagttggagacaaggccagcttcccaggtaatgctacttttagtaggaaaggcaataactacccccacaagactgagtgttatgctgtttttcttctgtaaaatcaaagatctttaatctctaaggtcacttggaaagctggtagggtcccgaggtcaagtctgcagcattcttatgcctttccagcagaaatgagacccacaggctggtaggaaggagctccttcttccaggcaggcagctggtgtgtccacaatgtctgtgggcaaaggaaggaaaaggcctctcatagggagacgagcaatgcctgtcatcagcctgcagtctacccaagactccaatgtttgaggacagaacacgacctactcctgggctgtagcatggaaagtgctggaaccaagttcttcacaacaaagacatccaataacttagggcctggttctgctgcaagaaggtgagattctacatcatacattggggactggaaagacagatggatacacacaaatgaaggagtggttctaaattctagtaagcctgggtgatacagcgaactccgcctcaaaaataaataaataaaaataaataagttctagtaagccagtgttgccatttatttaaacctgagaaacagttcctttagaaagcattaaaatgggagcaatggaaaggtccaaatgacgttcccacacttctcaattcactccctgcatcaatgcagcatggggtgtgcctggccctgcttgttgggagaggaaagccatctctttacaaacgaacgcctgcccaccagtctgcctgttacaaagggccgtctttctgaatttgttctagagagctgatatgatacagtaacagtttcattaggacaccctgctcctttaatttctgctctaaaacaagacagtagacaggagaaaagaccaagaagagagtcagatcctcctgtttggacttgacctgtaaaaaggctagagacaagaagggctgggatggtcccagtgatgtgggcagtgaaggccaaacaccattgccatggagcaattcccacattcctagagaagccacgctccacgtgaataggaaggccaatctcccaggaggattagtatcaggggagaaatcaagaaatgctaacacagacttagcttgagaaaacagccaggggagaacaaagtgccagtattacctgattgctaaatattaaattgctgcttaggctaaaaagcaatggttccttaggccctgaattaaaggcaccgacacagaccagcatgaggactgagaagcccacatagtgacctccactctgaccataccagctttcccccacttccctgcagaccctatggagaaatctgcccagagaatcaggcaggaaagatgagccagtgcctggcttgtcccttgagccaccaaagtcaacaaagcagacagactggcagggtgccagggaggcaaagtggcatcagcttctcccagcagggccacgcctcacacaaatggacttttagaacaagagtaccctaccctcacaacaaaggtcactgcatttatttccttctccaaagcaaaatggctgaagccaggaactgcacttctggtcaacacagttaggtccttcccactctgaaagacaaaatgcactttgcttgttgaaacacagcaggatgagattttccacatgggcttctgcctttttcacaggaaccacgaaaccagaggaaactaaggtccttgcttagggccttgggggagtacaaagggaattgtcaacaaggaaggaagaaatatctcaaatggcatcagtcctattccctgaaggggaagacacatagttcatacgaaaagaaagttttgaccatggcttgggaagactctgatcaccaaagggaatatgtaacaaagaattgcgtggccacaatgagccaaagccagcagaggtgacctgaacagggagtacaggagccaggaacaacctgggaataccctaaaggctcttttctaaagtctagactttctccaaaagtgatgtgtacacaccaaagtacaaactgaaaagacattttctgagcttgtgaggaaatactacttatgtgagtccactctgcttatttaataggtggatgtgttttacagcacggggacatctatcatgggcattagggaagctcacaaatagcccctgatagtgacagccactggcattggtgatttttttttttttttttttttttgagatggagtctcgctctgtcacagaagctggagtgcaatggtgtgatctcggctcaccgcaacctccgcctcccaggttcaagcgttctcctgcctcagtctcttgagtagctgggactataggcgtgtgccaccaggcctggcaatttttgtatttttagtagagacagggtttcaccatgttggccaggctagtcttgaaccctgacctcaggtgatccacctgccttggcctcccaaagtgctgggattacaggcatgaccactgcacccagccattggcgatttttatgtttttagctggagtcctcaagttagagacaaaaatgcttttctgaccctctattcccaccttatatgtatatttagataattgatgttaactttaaggttctagccacccacctgaaccagttttattatgtggggtgggaagtgaataaagccccctagatttcctctgcgatctataaatagagcttcaggaaggcaatcagctacctagggcaggaatttcagtccatttgctcaggaggctcctccctcacttccaatccgaggccccatggagctaagtcagagggcgccgattcacatcatgtccccagtggcagcaatgaaaaggctcagattctcctcattttcacatgggttgccagccttgctttaactctgaagtttgtgttccacagagcaaaatcacaaaagagatcatgcaatgattaagagtgcatttgtgaaatgcatcacaacagtaagctggacggacagacagatcgatggagggaaggcttatagacagtctgtgataaagcaatatagacaatgttggctgcacggttgaggtggtggtatatgggtgttcactgaacagttctctcaattttactgtctgacacacctgcctgctgaaatggaggtggccttgaagaagtgagaatggcagtcatagccctgaggtcagaggacaggtctcaccttaaacaagcctgctgacctggaggaggactttcacatccccaagcttcttatttaaaagggtagtggtcaaaatcagggacctttttacaaacatcttatgtttggaccaactatgagtctactgactcacaatgtgaggcaggtggggtaacataacattatcttttcttttcttttttttttttttgagacagggtctggctctgtcactcaggctggaatgcatggtgccatgctggctcactgcaacctctgcctcctgggctcaagcaattttcccacctagcctcccaagcagctgagactacaggtgcacgccaccacacccaggtaatttttatgttttttggtagagatggggtttcaccatgttgcccaagttggtctcgaacttctgggttcagcaatcctccagccttggcctcccaaagtgctggaaaaacaggcgtgagccaccacgccgggcacattctctatcttgatagggttttgggttttgctgatgcatgtacttgtcaaacccagtgaacatgtacttaaaatgtgtacatttctttgtatgtaaactttccaccaagagaaaagctataaagaaatacttaacaccagttaatgatgtacatattgaaatatttaaaataagtatacagatgtctatagtttactttgaaatgtgtacaaaataagaggtggatagtaaataaaggagtggatagatgaatagatttgtgatgattaaacaaacatagtttaaaaaagatgggctgtgtgctgtggctcatgcctgtaatcacagcacttcgggaagctgaggtggtggatcatgaggtcaggagttcgagaccagcctgaccaacacggtgaaaccccatattactaaaaatacaaaaattagttgggcgtggtggcacatgcctgtaatcccagctactccaaggctgaggcaggagaatcgcttgaacccgggaggtagagattgcagtgagccgagacatgccactgcactctagcctgggagacacagcaagactccgtcccccccaaaaaaaaaaggggaagatgcaggctggatgcggtggctcatgcctgtaatcccaacactttgggaggcaaggcgggcagatcacttgaggtcaggagtttgagaccaccctggccaccatgaggaaccctttctctaccaaaaatgtaaaaaattagctgggtgtggtggcacacacctgtaatccagctactcgagatgctgaggcaggagaattgcttgaacccgggaggcagaggctgcaggagctgagattgtgccactgcactccagactaggcgacagagtgagactccgtctcagaaaaaaaaaatagatgtatttggaggtgggtagtagtggagggggtggtctgtcacccgtcagtgcaatcatagctcactgcagccttgaactcccaggctcaagtgggcctactgcctagcctcctgagtaactgggactacaggcatgtgccacgacacccaggttttgtttttttttttttctttttgtagcgacaaggtctcaccatgttgcccacactggtgttaaactcctagctcaagccatcctcctgcttcagcctcccaaagtgctaggattacaggtgtgagccatgtacctggctacaagttttttttttttttttttttttttttttttttttgagacggagcttgctctgtcgcccaggctggagtgcagtggcgcaatcttggctcactgcaagctccactcccgggttcatgtcattctcctacctcagcctcctgagtagctgggactacaggcgctgccaccatgcccagctaatttttctgtatttttttagtagagacggtgtttcaccgtgtagccaggatggtctcgatctcctgacctcgtgatccgcccgccttggcctcccaaagtctgggattacaggcgtgagccaccgtgcccggcggctacaagtatttttatttttttttaatatcaggaacacacgatcgattgattgattgttgagacaaggcctggctctgttgccaggctggagtgcagtggcacaatctcagcttactgcaacctctgcctcccaggctcaaacatcctctgatctcagtctcccaagtagctgggactacaggtgtgcaccaccacgcccactaatttttgtattttgggtagagacagggttttgccatgttgcccagtatggtctcgattcctggggtcaagcaatcctcccgcctcgacctcaccaagtgccgggattacaggagtagccactgcatctgggcacaagtattttaaaaaggtcctcggatggattaaacaaaccgggtccatccataccatggactactacttagcaataaaaaggaatagactattgaaataccaagagtttggagaattatgctaagtgaagaaagccaatcccaaggattacatgccctagattccatttatatagcattactgaaatgatgaaattctagagctggagaagagactagggctgactggtattagggatggggaggagggaagagagatgggtatgactataatgggcgcattagggatctgtgaggtagtggaacagttatcttgattgtgatgttggatacataacccatatgtatgatgaaactgcactaaaccacacacacacacacacacacacacacacaatgggtgcatgtgaaagtgatgagatctgaatatggtctatggatggtactaacagcaccatgccaattgcctcattttgctattgcactgtaattatgtaggatgtaccactgaagaaaccgggcgaaggtacaaaggaccactctgtgggctagtcttactgtacagaagtaagtgaagcagcgaaatttgttttttgcattttttgtagagacggagtttcgccatattgcccggttggtctctaactccggagctcaagtgatctgcccatctcagcctcccaaagtgttagattacaggtgtgagccactgcacccagcctctacaagcaatttttaaaaactatccagtgtggtggtgcacacctgtggtcccagctgctcgggaggctgaggcaggagaattgcctagcttggaaggctgaggctgcagtaagctatgatcgtgctactgcacccagcctgggcacagagcgagacctggtctaaaaaatttttaaaagattaaagacataaaaaaaaggattcaggccgggtgtggtgctcacacctgtaatcccagcactttggggggccaaagcgggcagtcacctaaggtcaggagtttgagaccagccaggccaagatggtgaaaccctgtctctacaaaaatacaaaaagaagctgggtgtggtggtgcacacctgtagtcccagctattcaggagctgaggcaggagaattgcttgaactctggaggcggagtttgcagtgagctgagattgcccattgcattccagcctgggtgacaaagtgagagactccatctcaaaaaaaaaaaaaggattccaaattccagcaaataaaaaactaataaagaatggaaggaaggacaaagtagacaaaaaaataactaaacaatttcttgaaatgaaaaggatagtcattaaaatttttttaattaatgaatgtaaggattatccacaggttttaaaaaccaccggtcaaaggttactgggaaagagatctgcgcaccatttcagagttggcagctacagatcacctttgcctagtagagatccccgaaccaagccacggacagactgacatcatgagcttcctgataggatgcagtgggaagacacatcatcatctgtgcagtccttctgccaaaaatgcttaactggtaaaggcaggcctaatggttctattctcgagagccgacaagttacaaaagggaatttcttcaactcagtgaaggtatctagaaacccacatcaactgccacttgtaaaggcgaaattttaagagcattctttttaaatctctctatggtcaggaacaaaacaaggatgcccactttcactgctttaattagtggtgaattagagagccaagccagcattattcaatgttaggggctgaatagtgtcccccccaaatttatatgctgaagtcctaacctccagtacttcagaatgtgactatatttgaaataaggcctgtaaagaagtaattaagtaaaaatgaggtcatcggggtgggccctaattaacataactggtgttcatatgagaataggagattaggggctggggctgactcatgtctgaatcccagcactttgggaagccaaggcaggtgaatcacttgagtccaggagtttgagatagcctgggcaacagggcaaaaccccatctctacagaaaatacaaaaatcagccagacgtgcggcgtgcctgtagttccagctacttgggaagctgaggcaggaggatcccctgagcctgggaggttgaggctatagtgagccatgatcacaccactgcatgctaacctaggcaacaagccagaccttgtctcaaaaaaaaaaaaagaatgatgaggacacagacacatacaaagggagaccatgtcaggacacggagaagcggagaagaccaccatctgcaagccaaggaaagagcctcagaagaaacaaccctgctaataccttgatctcggccgccatgcctctagaactgtagaaaatacatttctgttgtttaagctacccagttggtagtacagcagccctagcaaagaacatggtaggcaaaagatttaagggcttaaaaggaggaaacagctgtgatatgattattatattaggaaaggcaagaaaatctacaaatggtaataactaacacaagttcagcaaagtgctagacgcaagatctacacacacaaaagtcaacagcactcctccacatgccaataacattagaaaacaaacagacacaaaagtgttcattgtgactctatttctaaccacggaaactggaatcaagttaactgccccttgctatgaatacaaataaataaattgagccaggcacagctcatgcttgtaatcccgactctctgggaggcctgcttgtagccaggagttcaagaccgcctgggcaacatagccagaatccatcgctacaaaaaatttaagaattagctgggcatgtggcatgcacctgtagtcctaactacttgggaggctgaagcaggaagactgcttgagccaggagttcaagattacagtgaactgtgatcatgccgctgcacaccagcctgagtaacaggtgggaccccatctcttaaaataaataaataaatctgttgaggtatatttatccacatataagggaacactataaagcagttcaaatgaatggggtggatctgtaatgaatacatctcaaaacataatgcttaattttttttaatggcaagagacagattatatccacttttaacatcacacaaaattgtggggattcttataagtggtacaagtacagagaaatccacagaaataaaaataatataaacatttcattttggtgctaacacgtagatgatcactatattattttttgtactgtcccgtatacctgaaatacttcattccgggcgtggtggctcacacctgtaatccagcactttgggaggccgaggtgggctgatcatgaggtcaggagatcaagaccatcctgctaacacggtgaaaccccgtctctattaaaaatacaaaaaaattagccgggcatggtgcagatgcctgtagtcccagctacttgggaggctgaggcaggagaatggtgtgaatccagaggcggagcttgcagtgagcagagatcgcgccactgcgctccagcctgggcgacagagcagactcagtctcaaaaaaataaaaaaataaataaaaaataataatagaagaaaacagctggtgtggtggctcacgcctgtaatctcagcattttgggaggccaaggcagcagatcaccgaggtcaggagttcgggatcaacctgggcaacatggtgaaaccccgtctccactaaaaaacaaaacttagctgggcgtggtggcacatgcctgtaatcccagctacttgggaggctgagtacgagaatcacttgaacccaggaggcagaggttacagtgagctgagatcgtgccactcacttcagcctgggtgacagagcaaaactctgtctcaaacaaaacaaaacacaaaatgaacacccaactcattgaggcctatataaatgcaaacatttggctgggcgcggtggctcaccatgtaataataccagcactttgggaggccgaggcaggcagatcacctgaggtcaggagtcgagaccagcctggttaacatggtgaaaccccgtttctactaaaaataaaaaaaattaccaggcatggtggtgcgtgcctgtaatcccagctacttgggaggctgaggcaggagaatgcttgaacccaggaggtggagattgcaatgagctgagatcgtgccattgtactctagctgggcaacgagagtgaaactccatctcaaaaataaaaataaaaaaaaaagcaaacattaattctaaatgacagcgggacacagtggcctgtagtgccagctatttgggaggctgaggtggaggatcacttgagcccaggaattcgagactgcagtgagccatgatcatgccactgcacccagcctgggtgaattagccctgtctctggaaaaaaaaaaaaaaaaaaagacgaagaagagattcagctgagcaagttaggtttactggcaccagatgcaggttcacactcaaagtcagaccatgctatggccatggcaggaggccagcctgggcaacacagcaagaccctgtctctaaaaaacaaacaaacaaacaaacaagtctattactatggatggctcagataaagccagcattgacactgtcatagcatctttattgctaagttaaaaaaaaatattgcacccagcacatttgcactggtcccacctctacttattagtagtaatcttcacagctcatccatcccctcctatgcctaaggtaatgactcaagcttctccttcccagccttttcctaatagaaaaaaatggtcaagagcacctaacaaaaaaccataatgcaaatgcaaaagggcaggcagagttcagtatttaattttaggtctgttactaggtttttcttgagccctggccagggttattctggcctggcatggggaacatagtttgcatgggtgtgggttaaattaaaaacaaacaaacaaaaaaactctcacatcaagtgctcaaagaacatgtccctaggctggatccttgaggcagccgacaagcaccacccacgatccaaccaggacacctgccagaagatcctaagacgaagttttttcccacattacagaaaaaggacaggggcagcagctaacacaataattatttcaaacatctaccacctccttcttctggtggaagtattatgcaacattagagaaaggaattccacttgaataggcccatgggtgacagagcaccatactaagctctccttagggaattatattaataacagataagctgcttaacatattatgttacttcacttttaagaattccattcatggtcatttgttataaacgcagtcccttttccaagggaaaggggtatgtccatcaaataacttattaaaaatatggccatactgccttgtgaaattagtggcagagaagtcaacaggatgagaagcctgaaagtcaagagcttgggctgggtatggtggctcacatctgtaatcccagcacttatgaggcaggaggatcgcttgaggccaggagttcaagaccagcctgggcaatatagcagacccccatctctatttaaaaaaaaaaaaatggctgggtgcagtggctcatcatgccttaatcccagcacttttggaggccgaggcaggcagatcacttgagatcaggagtttgagacagcctggccaacatggcaaaagccagtctctactaaaaatacaaaaattagctgggcaggtggcgcatgcctgtatgcctatagtcctagctatttgggaggctgaagtgggaggatacttgaacccaggaggcagaggttgcagtaagctgtgcaattctagcctgggcaacagaagagactccgtctcaaaaaataaaataaattttaaagaaagtcagagctctatctgtccacacctagggaaggtgacatctaaaccactctaagaaattccaaagtttaaattctgaagtcaagatcacattttaaaagtacaaagcagctgggcatggtggctcacacctgtattccagcactttgggaggctgaggcgggtggatcacctgaggtcagcagttcaagaccagccggccaacatggtgaaaccacgtctctactacaaacacaaaattagccagtactacaaatcaaaattagccgggtatggtggtgcatgcctgtaatcccagctacctaggaggccaaggaggagaatggcttgaaccagggaagtggaggttgcagtgagcagagatcgcatcattacctccagcctgggcaacaagaacaaaactctgtctcaaaaaaaaaaaaaaaaaaaaaaaaaagtacaaagcaagaatggctggctcctgatatgcaacaggtttcgtggaaaaccagtatccacccaacccaggatcccccatgtctcttacatgctatatatacctgtgtatatatgcatatactgtctcttttatcagagtttatcagattgtgagctctatgagggcaagaacctgtcttatccatttctgtgtatctatcaggactgaaaatgattccttgcatatattatattaaatgttctgtaagtattagctgggtttgagtgaatccagcacaaaaaggcctggtgggtagaaggaagataagaactgtacagttttggaaggcagcctgttcaaaacaaacacagtctaaaatgtaaaagaagaacagccaaattttacaagaaagagaaaaaatgttccttaagtaaaactgaggaagggaagcaccagtttcctctcacaagcttctgaaaagataaaacatgtctggtttcagtgataatgtgttacaggcttaggcaagaacaggtgaaaaaaatctataaatgcaatcaaccatgaagctggccacagctcagggctgagggaaccagacttggcaggctgcttagaaactcattggtataaatacggctttaaaacaaaggaggctcaaaaagggagagatgataaatgcatcagtctcaacttgttctttattgtagacagtctcccactttattcaagtatttttggagtgccaactaccagtgagacaaggaggtgggatgacaccaatataacaccaagggaagcactcaagggtcatctttaccgtcccggagctggccttggccgcgttcccactagctgttaaacccaacatgccaaacctggaagaacgctaatacatcaacattggtgtacagcaggccttcgcttattataacctctaaagagcagtgagcacatttcggccctctgtgagaggtcacaaggacctctgaatgaaaaaatatcaggattcaaaaaccttctgcagaaatcaacaggctgatcctaaaacgtacatggaaatgcaaaggacctaggaagtcaaaacccaacattattttgaaaaagaggaacaaaaatggagactgtacactacccatttcaaaacttatcataaagttacaagtaaccacaatagcaacagacacataaatcaaggaacagaattgaaagccgagaaataaaccactacatttatgaccagttgattctgccagggaattcaggaagaaaggatggtcttttcaacaaatgatgttgctacaactagaaatagtgtgtttacaaaaaaaaaaaaaaaaaaagaaagaaacagacactccctccctcatacctatccaaaaattaactcaaaatggaacacagacatatgtaagagctaaaactataaaactctagatgaaaataggagaaatttttgtaaccttggtctagacacttttttttacatatccaaaagcatcattcataaaagcaaaaaattgataaattagacaaccaaaattaaaaattttgctcttccaaagataccatataagcaaataaaagcacaggccacacattgggagaaatagttgcaaatcatatctgacaaaagacatattcataatacataaactcttacaactcctgacaaacaactcaatttttaaaaatgaggatatacagaaaatcattggaccttcctctaattttgctgtgaacctaaaactgctctattaaaataattaagtctttgttttttgagcggagttttgctcttgttgcccaggctggactgcagtggcatgatctcagctcactgcgcctccgtctcccaggttcaagtgattctcctgcctcaggctcccgagtagctgggattaaggcgtctgccaccatgcccagctaattttatatatatatatatttttttttagtagagtggggtttcaccatgttggccaggctggtctcgaactcctgagagaattaagtcttaaaacagaaaacaacaagcaagcaaagatttgaattgacatttcaccaaaaaagataagtgattgttaaacacatgaaaagggatcatcactagctaacgaaatacaaattaaaatcacaggaggactgggcacggtggctcacgcctgtaatcccagacctttgagaggctgaggcggggtatcacttgggtcaagagttggagaccagcctggccaacatggtgaaaccccatctgtacaaaaaatacaaaaattagccggatatggcggcatgcacacgtagtcccagctactctgaggctgaagtgggagaatcacttgaacccaggaggcagaggctgcagtgagctgagatatgccgttgcactctagcctgggcgacagggtgagaccctgtctcaaaaataaataaataataaaataaattaaaatcacaatgtggtaccactacatacctactagaatgactataaccgtaagtcaacaatacacggtgttggcaaggatgtggcaaaactggaactctcaaccatgcccatgaaaatgtaaaatgtacagccactttggaaaaggctgccagtttctcaaacgttaaacacaaacttctcatatggaatcttatgtccacataaaatcacgaacatgaatgtcacagcagcatcattcataattgtcttaagctagaaacaatccaaaagtctatcagctgtgaatggatagactgactgtggtaaattcatataatggaatactatttagcaataaaaataccgatgtcagcacaaactactgatacatactcaacacatatgaacttaaaaacatggaagtgggctgggcatggtggcttatgcctgtaatccctgcactttggaaggccaaggtggtggatcacctgaggtcaggagttcgagaccagcctggccaacgtgatgaaaccccatcctactaaaaatacaaaaaattagctgggcatggtggcgcgcacccataatcccagctaccaggaggctaagccaggagaatcacttggacccaggaggcagaggttgcagtgagccgaattgcgccactgcactccagcctgggcaacaagagcaaaactctgtctcaaaaaaaaaaaaaaaaaaaaaaacccacaaaaaacaaaaacaaaaacatggtgagtgaaggacaccaaaagaaaataatacatactgtatgatttcatttatatgaaattcccagaaaaggcaaatctgagagatagcagttgcccggtggggagcagagattgactaaaaacaggcataggaacttctgaagtggccctttcagatgtggtggttcacatccgtaatcccagcactttgggaggaaaagtgagaggattgcttgagcccaagagtttgaggctgcagtgagctacagtctcactctgtactccagcctaggtggcagagtgacacccttgttttaaaacaataaaaataaaaaaggactttttgagagatggaagtgttataaaattggattttaagccatgcgtggtggtgtcgcctgcagtgccagctacgtggaaggctgaggaaggaggatcccttgagcctagaagtcaaggctgcggtgagctatgaccatgccactgtactgtagcctgagtgacagagtaagctcaaaaaaaaaaaaaaaaaaaaaaaagaaagaaaagaaagaaacaaaagattttagtgtggtttcataactatatatttactaaatctcattgtacatttataatgtatgaatattaggtatgtcaactatacctcagtttcaaaacagtaacaaccaatatcccacaacatctggggatccctaactgcaggttcctatatacagtgaaaatcttttgggatactttctggtagactgtagttttctggcaaagaactatgaaagggatttctctattaacagtgcttcttcacaacagcacacgtaagaatcacctggaacacctgttgacagaccaacccctctcttcccctggattcagtaggtctggggtggggcccataaatctgcattcctaaaagctccaggacagtcattaaaaacagagatttcaaagtctcaccagagatgtattatatccaaatctctacaaaggggaacctgggaatctgtacctcttacaagtatcagggagaatcttatgattgactcatggtttagtactccatgagctacaacactctcgtataccattaactccaaggattttataagtagtttcaagagtaaaatctgtgtgttcctgggttgaaaatgaccaagtaaatatctgtattttaagtggttctaaagtctttagggttctgcctttggcctccctaaataagcaatttgcaggaaagcaacttatatttattcacagtattctaaatatgcttccacataaaaaaaaaagttttccaaacaaattaaaaataataaataaaacagaaagtttttgccataaaaacatttaggccacttttcaagtttagtctaattttaaatctgttcatttcaaaacacattttttctatatttttaacaggggtatgtaattgttagatctataggaactattattctgcacaattctgataggcactgagaacagcagcaacagtgccattttcaatggttcattcaaggatttatcacatacctactggaatgtaatgctgtgcttaacacagagattaacacagaagaagatatggttcttaccaggaattcaccagtgattataaaacaatagtactaacatcactgtatactggagcagatggggaaattttacagaagtaggactgtgtcctagaaaaaaaaataacagcacttaaattattttcaatttctcttatcagtatggctcaaagggtgggaggactcatcatcttgcacactggaatgccatgttgtatgaaacagaaagagccgactgcagatcgtgcttagaagaacacacacacaggacttcctggagagcatcttactgttcttcagagattcttatttaactggcttacagtggggctcaagctccccaaggaaagtttctgtggtaaattatgtttctaaagatagttgcaacaatagtgtccatcttaccagctttcagcaatgtcccctctcctgcccttccccttgtcacaatgccaaaccaaattcttgtttgaccaacggaaggtggagaaagccacatcatgtaacttccaaggctagtaggccctagagaattacagcttctgcctttgctgcctggtatgctcacttttggaatttagcttccaataacaaaagccaagctagtcacaactagggagacagccacagcgagagagagaaggcttgcctcctcatcatgcccaccaacttgccagatgtgtgaatgaagccatcttagccattcagtcactgactacaatgtcatgagacaccccagctgttagtcacatagagaagaaccaccagctgagccctgcctgaattcccaagtcatagaattatgatcaaatataaaatagatttgttttaagccattaagttttgaggtaggttttgttgcctaacaacagacaacaaaaaaggcttcaagtctgccctagaatattcttctaggtaaatgatatgcaatcatagtcaactatatgaacttggtcactacatctcaggaataagagaagcttgaaatctagctaccagaggaagaaaataagtgttcacaagcaagatccaatccacttcctcatcatagacttttcccatttgtcagcaaaaggttttgttgcttcccaaattttgtattaggaaaacaggttatagagtgctttaactcctttctaaaggccatgctaactaaaatcagtggttagtgagatgtttcagctcagtactctcctgcctctaagcacattctattcatagatttggggtccagaaccattttttacaatgttaaaggagatggaagaaaaggtgaattggagagaaggtctgggtgggggagatctacccacaaacaagaagagtgggccaggaatgctggctcatgcctgtatcgcagcactttgggaggcctaggtggcagatcacctgaggtcaggagttccagaccaggtggtcaacatggtgaaaccccgtctatactaaaaatacaaaaaattaaccaggcatggggtgcacacttgtaatcccagctacttgggaggctgaggcatgataatcgcttgaacccggaggcagagactagattgcgccactgtcctccatcctgggtgacagagggagactgtgctccaaaaacaaaacaaaacaaaacaaaaaaacaaaagagtgaagaccaagtgacattaaactgagtacttcccggctgccttgtttaataaatgaggcaaaagactggcattgcacactatctactgatgtagttccaatcttaagagtttgctgaaacaggaggaacaaaagatctggatgaatacagatctcaacagtatcatccattctgctcatcatgaaagcttcaaaagtgctgctggaatcgacagattgaaattctagctctgtcaattcccatctgtaagatggaatagtttatttccacctcttgggattgttgtgaggaaaaaaataagagcatgtgtaaagactaaccaagtgcctggcacagaacaggcacacaagaactgtcaagttcatgctcacctctctcttctctcccaaatcaacacaactggacctataaaagtgctgcatagtccaagcacttctcgaatatactctaagcaaacataataaagaaatgaaatcacatatggctcaattagagtggccgagggaattaaacatacgtgtgtataatacatacatacaaacatataccaccaggtgtaatctggacaaatctttacccagttatcacaaaggtattagtatcccttttaacatttaaagtttgaacagctgagaaagaaaatgaatgaagttgtttctacatttagaaggttgtccacccggccaaaaaaataagaacttttcttaatccaaatgaaggaaagaagagagggaaaaaaaaaaaaaaagaaacagatgaaagtattggataggaaacaaataagcagataattaatttaaattcaattatattgatgactgcattaaatataaacattccagtttggggcaaagactgtcagtctggattaaaaagcaacatcaagcccggtgtagtggctcacgctgtaatctcagcactttgggaggctgagacaggaaatcacttgaggttcaggagttcagaccagcctggctaacatggtaaaaccccatctctactaaaaaatacaaaaattagccggcatgctaggcaacatagggagagctcatctctacgaaaaataaacaaaaattagctagtgtgatggcacatgcctgtgatcccagctacccaggaggctgaggtaggaggatcacagagcccaggaggtcaaggctgctgtgagctgagattgttataggaggtagctagtaaaaatgagcagagcaggagaggtcccctcacacccccaaccaggaatgtcaggtgaccatcagtgatggtcaggcagttgttaagctgtccccctaaaataataattggtcgcaactggtgcagagaacggtagtctcccagtagatagaaaaagctgaaactggtgatcccaataagctttaggagttgggtgagtgggctcaggcatgagcactaagaggcaaaatggcagagtttactagtttatgacctttctctaggaacacttagctggtaaaggaatgcctcaagtgggcagtgcacaatttcaggaagcacactgtgcatggggcccctcccaagtgttggcggccactcgcatgcggacagccaaccccaagagaagaatcgagggagaagtaacacaagaccccgagcatgccaacatataaaaccccaagtcaaagggtcaaaccgtgcatttgatctctcaagtgcccacttggccctcttccaagtgtactttacttcccttctttcctgctttaaagcttttaataaactttcactcctgctctaaaatttgcttcagtctctccttctgcctatgctctcagttgaattctttcttctgaggagccaagaattgaggttgctgcagagccattcggattgcgggtggcaacaagatcgcaccattgcatgatcactgcagttgggtgacagagtaaatgtctcaaaaaagagaaaaatcaaatgtatactttctataagaaaaacattttaaggccagtgcagcggctcacgcctgtaattctagtactttgggaggctgagacaggaggatcattgagcccaggagttggagaccagcccaggcaacatggcaaaaccctgtcactacaaaattacaaaatatagttgtgcacacacctgtagtcccagctacttgggaggctgaggcagggaatagctcgaacctggggagggggggtggagggtggggattgcagcaagcatatgaagaattggaactcacgcactgcactgttagtaagaatgtaaaatggtaaaatggtgcagttctatgaaaaagttatggcagttcctcaaaaattttaaaataaaattaccatatgatccacaatttcacttctgggtatatgtatccagaagaactgaaagccaactggacgcagtggccacacctgtaatccaagcactctgggaggctgaggctggtggatcacttgaggccaggatttgagaccagcctgggcaacgtggcaaaaccctgtctctactaaaattacaaaaattaccaggtatagtggtgcacacctgtaatcccagctacttgggaggctgaggcataagaatacttgaacccagggggcagaggctgcagtgagccaagatcatgcactgtactccagactggtaacggagccaggcactgcctcaaaaaaattaatcaagttaaaatcaaaagaacggaagcagggtcttaaaggatgtttgtatattcgtgttcacagcattgttcacaatatccaaggcagaaggaactcaagtgtccataaatgcaatgcatgaatggggacaaacaaaatgtgtatgtacataaaaaggaagtaaattctgacatttgctccaacatggataaatcttgagatgttacgctaagtgaaataagccagtcacaaaaagacaaataccatacaattttgcttaatgagttattaagagtggtcaagctcatagaaaataaaatggcggttgctgaggggagaggaaatggaaagcagttgtttaatgggtacagagttatagtttggcaagatgaaaaagtctagggattggtagcataacaatgtaaatatatttaacactactgaactgtacatttttaataactgagggtaattttttgtttttgtttttgagacggagcctcgctctgtcgcgagctggggtgcagtggcacaatctccgctcactgcaacctccgcctcccgggttcaagcaatctcctggctcagcctcccaagtagctgggactacaggtgtgcaccaacacacctggctatttctttttttttttttgtattttagtagagtcggggtttcaccatgttgcccagactgtctcaaactcctgagctcaggcaatctgcccaccttagcctcccaaagtgctaggattcaggcgtgagccactgcacctggccaagggtaatttttatgctaagtgtattttgtcacattaattttaacaatctttaaacaacatcaaagaagaatcattcagaggtaaatattttaaatgtgcacaagacttttattctaaaactataggccaagcacaatagctgacgcctgtatcccaacactttgggaggccgagggaaacagatcacttgaggtcaggagttcaagatggcctggccaacatggggaaaccccgcttctaccaaaaatacaaaaattagccaggcatgtggtgtgcctgtaatctcagctacttggaggctgaggtgggagaatcacttgaacttggaggcagaggttgcagtgagccaagattgcgccattgcactccagcctgggtgacagagcagacgctgtctcaaaaaaaaaaaaaaaaaaaactataaaacactgatgagaaaaattaatagcacttaaatgaagctagagaaataccgtgttcatgaattggaagttgcaatattgtaagatgttaactttcctcaattttatccttaaattcaataaaatcccaatcaaaattccgcaagcattccttttttttttttttttgtagaaataaacaaggtgattctaaattttattggaaatttgaaagcctgagaataccctaaataagaatttaaaaaaagaataaagaaataaataataatatttgatttcaagacttattataacaccacagtaatcaaaggaacatggattggcttaaggacagacgtataaagaaaaacagaataaagtccagaaatagactctactgtattgccaatagtacccttaaaccttccatggtaatccagtggagtcttgctctgtccccagatggagtgcagcagcatgcttacagctcactacagccttgaacaccttggctcagtgatcctcctgcctcagcctcctcagtagctgggactacaggcatataccaccatgccaactaatttttaatttttgtagagacagggtcttgctgtgttgcccaggctggtctgggctcaagtgatcctcctgacttggcctcccaaagtgctggtattataggcatgagctactcatctggtcctttgtaaattttttaattgaattgtttgtcttttggttgttgagttgtagacatttttatacattttagatatactaattccttatcagaacatgatttgcaaaattttctcccattctgtaacttgtcttattattttctagatagtatcctctgcagcacaagtcttaattttctttgtgttgttgtttgtttgttttttgagatggagtttcgctcttgttgccaggctggagtgcaatgacaattgacaaagtcaattgacaaaggacttgcatagacattctccaaggactatatatgaagacccaataaaaacaagaaaaggccgggtgcagtggctctgcctgtaatcccagcactttgggaggctgaggtgggcagatcacctgaggtcaggagtcaagaccagcctggccaacatggtgaaaccccatctctacaaaaatacaaaacttagccggcaggatggcaggtgcctataatcccagctactcaggaggctaaggcgagacaattgctgaacccaggagacggagggtgtagtaagctgagaccgtaccactgcactccagcctggcgacagagcaagactccgtatcaaaaaaaaaaaaaaaaaaaaaaacctcacaagaaaagtgcccaatatcctttgcaaatcaaaactataatgataccacatcagaaccactatgactctattatcaaatagacaggtaataataagtgttggaaaagatgtggagaatcagaaccctatatactgttggtgggagtataaaattgtgcaattcctttggaaaacaggctggcaatcctcaaaaagattcaattaaagttacccagcatttctaccgggtagatccggcagaattactcgacacagtagaactgaccgagcaattctactcgtaggtatatatagccgggtgtgtggctcacgcctgtaattccaacactttgagaagccgagatgggcagaatgcttgagttaggagttcgagaacagcctgggcaacatgccctgtctctatggaaaatacaaaaaattaccaggcatggtggcaagcgcctgtagtcccagttacttgggaagctgaggtgggaggatactcgagctttggaggtcaggctgcagtgagctgagatcacaccactgctctccagcctggggacaaagtgagaccctttctcaaaacaaacaaaacaaacaaacaaacaaacaaaaaccttagaaaaaaaaattttttttaagtaaaacaagaaaatgtctacacaaaaatttggaatggccgggcacggtggctcccctgtaatcccagcactttgggaggctgaggcaggcagtcacgaggtcgggagatagagaccatcctgaccaacatggtgaaaccctctctctactaaaatacaaaaattagttgggtttggtggtgcacgcctgtaatcctagctacctgggaggtgaggcaggagaatgacttgaacccaggaggcggagattgcagagagccaagatcgcgcagttcactccagcctgggcaacagagcaagactctgtctaaaaaaaaaaaaacaggtgggcgcagtggctcacgcctgtaatcctagcactttgggaggctgaggtgggcggatcatgggtcaggcgttcaagacgagcctggttaatgtggtgaaaccccatctctactaaaaataaaacattagctaggcgtggtggtgcacacctctagtcccagctatttaggaggctgaggagaattgcttgaacccgggaggcggaggttgcagtgaaccgaaatcacgccaccgcactcagcctgggtgacagagcgaggctccgtcttaacaaaaaaaaaaaaaaaaaaaaaggaaaaagtgctgcatgctacaatgtgagtgaaccttgaaaacattatggtaacttaaagaaacagatgctaaaagctatgcattatatattatcccatttatataaaatgtccagaataggaagtttacataggcagaaagtggattagtggttgtcttgggtaggggaaaatggaggaaacagagctactgctaatggttatggggtttctttttggactaattaaaaaaggttctaaatttattatttttctcttgtgttgcttgtgctgttggtgtcatatttaagaaactactgccaatgcaaggtcagtaagatttccaactacatttccttctaagagttttatagttttttctctttttctttaaatatttctctcttttttttttcctccagctactgcagatcaaagtttagttcttatatttaggtctttgatccatttggaattaatttttgtatgtggtgtgagtaggggtccaaaccacattcttttccatatggatattcagttgtcccagtagcatctatgaaaacactattctttctctattgaatggtcttgacacccttgttgaaaatcagttgacatagatgcatgtgtttatttctgtactgtcatgagtatggtaaatgtggtgatggttgacaattctcagaatatactaaaaaccattcaactgtttactttgaatgagtgaattgtaggtatgtgaattatttcaataacaggtttttttttttttttttttgagatagcatcttgtctgtcaccaaggctggaatgcagtggtgctctctcaggtcactgcaacctctgcctccgggttcaagcaatcttccctccttggcctcttgagtagctgggattacaagcattcacccaacacaacacctggctaatttttttttcttcacctggctaatttttgtagttttagtaaaatgggttttcacaatgttggccaggctggtctcgaactcctgacctcaagtgatcagccacacccagcctcaataaattttttgtttgtttgttctgagatggagtctcgctctgtacccaggctagagtgcagtggcatgatcttggctcactgcaacctccgcctcctaggttaagcgattctccaagctcagcctcagcctcagctggggctacaggcacatgctaccatgatgactaatttttgtatttttttgtagagatgggttttcaccatgttggccaggctggtttgaactcctgacctcaagtgatctgcccgcctcagcctcccaaagtgctgggattatagtgtgagccactgagtccagccaataatagttttttgttttgttttttaagaaaaggtcgccgggcgtggtggctcatgcctgtaatcccagcactttgggaagccgaggcaggcgaacacaaggtcaggagatcgagactatcctggctaagatggtagaaccccgtctctactaaaatacaaaaaaaattagccaggcatggtggtgggcacctgtaatcccagctacctgggtgctgaggcaggagaatggcgtgaacccggaaggtggagcttgcagtgagctgagatggcccactgcactccagcctgggcgacagcacgagactccgtctcaaaaataaaaataaaaaaaaaataaaaataaaataaaataataaaaaagtcaagactgcagtcaagctggagatgtgcaaaaaaaaaaaaaaggtcaagattgcagtcaagctggacatgtagcatacacactgttttacaaccactaatattaatgacttcaccaagtttgtgatatataaaaagagagttggtcaaggactaagccttcgtgcctttcaacatttgaggtagagagataaagaggaatctgaaaggagataaaaccaatgagagagataggaagaaaactaagtgagcatcgtattctagagcagtgaagacagtgtttcaaggggaaggaaatgaccagctgggtaaaatgcagccactttcccaaactgagaactgacaataggctactggatttagcagtacaaaggtcctcagtaccttgataagagctgtttcaattgagtgatgagggcaaacacctgagtggagtggattaaggaggatggaagaagaaaaatcagaaaaccaagaaaagagaattcttgagaacttttgtcttaaaagaagtagcaggggccgggcacagaggctcacgcctataatcccagcacttgggagcccaaggtgggtggatcacttgaggtcagaagttcgagactagcctggccaacaggtgaaaccccatctctactaaaaacacaaaaaattagccaggtgtgatggcacatggtgtaatcccagctacttgggaggctgaggcaggagaatcacttgaacccaggagacagagttgcagtgagccgacatcacgccattgcactctagcctgggcgtcgagtgaaactccgttcaaaaacaaaaaacaaaaaacaaaaagtaccagaatggactagtatctgtaggggaagagaatcatgataagttaatttgttattcctgttttcaagatggaagaaatagcagcagtagtatgccaataggaatgtaccactagagcggtaatatttagcagagagcagaggaaggtggagcagcactctggatggactcaggaagtgggaatgaaattttgtttgcaaatggagtattggcccttgcaaggatcatgtacaactcatacctagttacaggaaagggggaaaagcagatatacaagcacgtgggtggatacggtggcgagtgccattgttttctcaatgaaatggaaggtcatcaacaaaggctaagaaaggtgtttttaaaagagaggagaaagtatggaaagtcctctaggaggctggagaatgaaggaactgtggaaatacagcaggattcccagacacattaggggcctgtttaaggttagtaatcatgaattaagagtgaggacagcgaatgtgccagtgtttcttctaacccaggggcacacccacaaagtaggcagagatttggatttaaccgagttgtgatttagccaagcaagtgtgacaaggcaaaagaggggaagaggattgagagttagtacatgaggcagtcattataatgactgaccatggaatttaagttgtttaaggagaaagtacaggcatgagggcgtgagggaaagggagaagaaaataggttcaatgggctgtagtcctgctggagtcaaagatggttgaaaggactgatattataaacagcagataaatggagtacagggggcaactcttatggctgacaaggtaagaaaatctactccaccattttacaaaatacaaagaatgtcataggcccagctatagggctaaaaaggattcccacaattcaattttgatggccaaactgattgcaatttaataacaacatgagataccatttattagagccacagacttttattttcttttttttttaagagacagggtcttgctatgttgcccaggctggagtcagtggtgtgatcacagctcattgcagccttgacctcctgggctcatgcaatcctcctgctcagcctcccaaagtgctgggattacaggaaggagccactatacatggctagagccacccactttctagctatgtaacactggctgagttccctaaccgctgggtcttggtttcctttctgtgaaataggaatgttaacaggaatcacctcaaggggtgaggattcaataattgaagttaagcatttagaactgtgccgggcacttaataagatgaaataaatgtctgttattaggatattctttttctttctttctttttttttttgagacagtctcattctgttgcccaggcggagtgccgcctctgggttcaagtgattcttgtgcctcagcctcctgagtagctgggataaaggcacgcaccaccacgccaggctaatttttgcatttttagtagagacggggtttcacacgttggccaggctggtctcgaactcctggcctcaagtaatctgcctgcctctgcctccaaagtgctgggattacaggggtgagccactgcgcctggccagaaatattcttattacaactactgttacgatctactttgttgtatatatttttttaataaccaagaaaaactgctagaaagcaaaagtctcagtagggaagagttcaaacactgaagtattaagcctggctaaggtcaaatcattacagaatttttccaagtacttttcctaatctgctcctgtttctccacttctagaggcatgaaggaaatgacacgtcatccaaaagggctctgagctcaggggaacgcttaaacattgaccttgctgttgggtaatgggttcaacttcattctaaactcttgtttccagttctatgccagtacttttactcttgcccacacagttgctcagtcacatgtaacagcaaagcttaaaaaaaaaaataaataaccttagaatgtttttcttttttaggaatattttaaagttcgtttaaacacagatgagagttcttttacaactcaaataagatgcttagttattggcatttgattattctgcagatcactagaagagggaggaaaattcaggcccttgctgaccttcacctgactcaaactatggggttattggatcaatcccacacaagacccctctgtgggacctatcccagacagatgtataggcctcaccagcatgctgcctatttaacggtttctgttgcagcaccccaaggaagcaaaagcaccaggctgagtgcagacccatgactagctgcctctgcaggcctgacttaaaatcccacccaccccgtccccccactgcctggtgttttcttttgagctctcagatgtcgatccaagataaaaatttcttatgctctagtctagccattggcaaagcaatcatcccatcagaaagaaaaatggaaagaaacagtgaactctgaaacaagttaacacattcagattcttcagaacagagggctgggaaagagaaagtggggctcctatgaatccctcttacgaaatgtcctctgcagtgggggtcgagctctttgctggcttattatttaatggtccctaagaacaaactaagtttataggaggggctatacgatctttcctgtggtagtttataacaactcatagagaaattgtggccaaatggtagatatggtccctaacaaagagcaaacaggtataagcattttggggcacaattttggggggatagtcagggagaagtgtgcttgaatagatttcacttccaggtacaagtttccagaaattacaacagaaacaaaaacaaataaaataggccaggcgtggtggctcagtcctgtaatcccagcactttgggaggccgagagggcggatcacaaggtcaggagatcgagactatcctggctaacactgtgaaaccctatcctactaaaaatacaaaaaaattagccgggtgtggtggcgggcgcctgtagtcccagctatcaagaggctgaggcaggagaatggcatgaacccgggaggcagagcttgcagagagccggatggcgccactgcactccagcctgggcaacagagtgcaactctgtctcaaaaaataaataattaattaattaaataaaataataaaatccacacatgtacatggaacaacatgaaacatgaagaggacattaaataagaaagagaagttgtgaaacaagcataatgtgctttctacgctttacacacacccattcatccagaggcaaaaatttggagacatatacaccagagggacatgggggaaacttccgctttctacattaatgtttaaaatcttcacagtgaatattctgttatttttgtgaccacgaaagaagcaggaagaacttttgtttcttaaaagatttgcttaaagacagaaaatactgatttggaaaccacaaaggtctgttgtcttctgcttctgcacagatgtgcgagttcagcctttccaactccctcacctgctccagggctttccttcttttgtacttcttcctcttccttctgcaaatgctgcctctttctaaaccccttcctgtcatcttacagccatcttttttgtttgagattaatttcctgcagaaagtcaatcccaagccactgctgcaactctacaaaaatcaccagaaagaagtaacccaactcttttccaacacaaactaccttatctttattcctatgattactgtacttcttcatgtgtatatttactgaacttttactagcacctaactccgtatcataggtaataaacactcacaatagactttttaaaaaaacgtttcaactaacatatttggctcatagtaagtactctgcaatcagtaacaatatgccttctctaacagtaaactccgagcctcaattccctaagccaaggacagtaaacaggcttagtctccacatcaactccagcagttagtatggactgtgggcacttggagtactgtgttaagaaggttctgggctgggtgcggtggctcatgcctgtaatctcagcactttgggaggccaaggcagtggatcacctgaggtcaggagttcgagaccagcctggccaacatggtgaaaccccgttctactaaaaataaaaaattagccaggtgtggtggcacgcacctgtagtcctagctactgggaggctgagtcaggagaatcacttgaacccaggaggtggagattgcagtgggccgagacacaccactgcactccaacatgggtgacagagtaagactctgtctcaaaaaaaaaaaagaaataaaataaaaaaagaaaaggatctgagcccctgtagggctccataataaacagtgagtaaattataacagtgtcagccatggccaaagaaaaaggttgggggtcagtggctcttcctcctacatagcttgttggggcccaggctggtgtgacctttttttttgttttttttgttgtttgtttgtttgatggagtttcgctctttcacccaggctggagtgaagtggcgtgatccaggtcactgcaacctccacctcccgggttcaagagattctcctgcctcagcctcccgatagctgggattacaggtgcctgccaccacgcccaactaatttttgtatttttagtagagcggggtttggccatgttggccaggctggtctccaactcctgacgtcaggtgatccatccccttggcctcccaaagtgccaggtttacaggcgtgagccactgcgtccggcctggtgtgctttcttaaccttggtgtatctggagtccagtcactgttaaatgatgctttatttaaagaggtgtgggtatgtgaatgtggggggtaaggtaggggaaggtatcttttcttgagaatcttaactgttctatagcaactcaaaggagaatgagatggcaatttaagggggtggagagaaagatgagttaattacaaggaatttccaacttgagtcaaatttcaagtcataagaacttagctgtttttctccagtcacctcacaaacccatcctctctagtctcagattaaacagagtgcataaaatcaatgtagaaatttttctccattttccccaaagcgtattcaacattggggttcctgcttacctggtttctcctcttccaattaccaaattacaggaaagaaaagtcagttgggatcaccaatgatcccataaatcatcctaagaatgcaacaccgtctctgaattctcctaaacatagttgatgcagaatggtatcatgctaaagagaacctcctagactctcagccaagggcaagttcacttgatccattttctgaaattacacatttaccgattctctctgtatataagagcactacggaagagttttgagcagcactgtccaacagcactttctgcaatgaggaaatgttccaatgacagcagtcactaaccatttgtggttaccgagcactgaaaatgtgctagagtaactcagaaatggaatttaaattttgttcattaattttcactaatttaaattatttatttattttaattaatttgtgttttttgttttgttttttttttgagacggagtccgctttgtcgcccaggctggagtgcagtggcacaatctcggctcactgcaagctccgcccccgggttcacgccattctcctgcctcagcctcctgagtagctgggacttcaggtgcccccaccatgcctggctaatttttttttgtatttttagtagagacggggtttcaccatgttgccaggatggtctcgatctcctgacctcgtgatccacccgccacagcctcccaaagtgcgggattacaggcgtgagccaccgcgctcagccaattaattattttttaaaaaaatttttagacagagtctcgctctgtcacccaggctggagtgcagtggcatgatctcatctcactgaacctccgcctcctgggtccaagtgattctcctgcctcagcctcccaagtagctgggatacaggtgcccaccaccatgccagcccactccagcgtgagcaacagagcgagacggatggtggacggacggaaggattagtgtactgaaaacagagataaggaattacccatagtaaagatataaagaactggaaaatacaaaagagtttaagaaacaggaaggcagacagaaggcccatataaaatttctaggattttcaaaaggagggatgggaaagaataaaagaaaggtaaaattgaagagataactagatgataatttcttaggtgctgtgaaacacatgatatttgatatcaaggacaaatagcaaacagatgtataaaaataaattaaatccggaacatatgacagtaatttggagagcaccatgagtaaagacaagataaagcagccaagagaaaaaaacattaacctaagagttgagaagacttttcaaatgcagtaatatcaaaagctagaagataatgaaaccaataacatcatctaattgctgagaaacagtaaatgccaacccagacttttataactagtaaattatccaatggttatgacaaataaaaacacttttaggtaagcaaaaagagtttagaccaatagactctcactaaaaaacagtgttaaagcctacctctggaagaaggaaatttactcaaaaggatgaagtatgataaaagaaggaagggaaggcaaaaaagttggcaagcagggagtgaattcaaataagcagacttcatcaaataagaatagcaacaactaattccagggttaaaagcaaaggggaaggccaggcgcctggctcacgcctgtaatcccagcatcgtgggagccgaggcagatggatcacttgaggtcaggagtttgagaccagcctggccaacgtggtgaagagtctctactaaaaacacagaaattagcccggcatggtggcacacacttgtgatccagctacttgcgaggctgaggcaggagaatcacttgaacccgggaggtggacgttgcactagctgagaccgccccattgcactccagcctgggcaacaaaagcaaaactccatctcaaaacaaacaaacaaacaaaacaaggtagaattgtaataccgatccacagcaatgtgtaagaaaactgtggatttctatttgggaagagagtagagatattgatttaagattttaatgaagatgcaagccaaaaatttaagagtagcctgtaacagaactgaaagtttccaaatggtagataatgaaaccctttctaagaaaagactgaaggggccgggcgcggtggctcacgcctgtatcccagcactttgggaggccgagggcagcggatcatgaggtcaggagatcgagaccttctggctaacacggtgaaaccttgtctccactaaaaatacaaaaaaattagctgggtgtggggcgagcgcctgtagtcccagctacttgggaggctgaagcaagagaatggcgtgaacctggaggcggggcctgcagtgagccaagatcgcgccactgaactccagcctgggtgacacacgagactccatctcaaaaaaaaagaaaagaaaagaaaagaaaagactgaaaaggagaaaatgcaaacaaaacatggtcaatagcacaaagtaagatatgaaataataatgtatttaatatattaaataaattacataaggtatcaaatgagatattaagataatacacaattgctatataatacttttaaatgggttaaacatgccaatcaaaagacagtctcaaaataggctggaaaaaatccaactatatgtcattcacaggagatacacctaagacattaggacatagagaaaagaaaagggataagaaaagatgtagcaggcaaatatttacaaaaagaaagctgacattataccagacaaaaaaagaccatgagaaaaagtactgttagggataaagatgctctctacattctctaggaaacaattctaaagagaacttcaaattatatgcagacacgtttgacaaattatgaagagaagttcacaaattcagtcattaaaaaaaaactttaacatagttctctctgaattgttaaatcaagaacacctggctgggcgcggtggctcacacctgtaatcccagcatttgggaggccaaggtgggaggatcgcctgagcccagcctgggcaacatggcgaaccccatctctataaaaaacacaaaaattagcagggtgtggtggtgtgtgcctgtggttctagcactcgggaggctgaggcaggaggatcgcttgagtccaagagtttgaggctgcagtgagcgcgactgcaccactgcactccagcctgggcaacaaagcaagaccctgtctcaacaaacaacaaacaaaacaaaacaaaacaaaacaaaaatcaaaagttggtaaaatatggaagatttgacaacataactgataagcttgatgtaaggacatacagaataaaacttcacccaacattttatttttctgcgttccccaaccccctcacccaacagttgttatacaaacttctaaagtcaaatgaaatatttatgaaaactgactgtgtagtatgccacaaattaagtataaataaaacgaaacaatcagtatcatacagactgttctgtgattatcatgcaattaagttagaggcaacttaaaaaaaatttgaaaatactacagttatgtctttgcactccagcatgggaagacctgtctcaagaaaataaataaaaagctgtattttgtccaggcatggtgactcatacctgactctcagcactttgggaggccaaggtgagaagatcgcttgagactgggagttcacgacagcctgagcaacacagtagtctctacaaaaaaaaaacccatagtagtctctaccaaaaaaaagctatattaatctttttgtttgttttttgagacgtctcactctgtctcccaggctgaatgcagtgacaccatctcagctcactgcaacctccgcctcctgggttcaagcagtcatctgcctcaacctcctgagtagctgggattacagtcacgcgccaccacgcccggctaactttatattttcagtagagacagggtttcatcatgttagccaggctggtcttgaactcctgcctcaaatgatccgcctgcctcagcctcccaaagtgctgggattacaggcgtgagccacaagccttgccttattaatcttagtaagagaagaaaaagacagtataacaaaattatgaggaaattttatgacatatgtgcaaaaatccaaaggagaatattaacgtattaaatctggaatgtattaaaaaaatacatcacaaccaagcaggattaatttcaagaatataaggataattaacattagaaaatctattaacataattcaaatcatttacaactgaaaggagaaagcccgatgatcatctgaataaatacaaggaaaactgttgataaaattgctgtttgtgataattagcaaagtaggaataaaagagaataaaggcaatataccaaaaacatatgtgatgcttccaaagcaggaaacattccctttaaaaaaaagcaggagaaaaataaggattcccatgatcaagattctaatacgatttttactggaggaactagccagcaatcttaaaataagaaagaaagtaacacaaaagaggattacaaaagaggaaacaaaacagtcattatttgcaaagggtgtattctctgaattttctgtcgatatttctcattaaaactatgaaacctacaagagcataaaagaaacccgaaacaattataaacaattttaaaagctactattaacagtaaggaccaaactatagggtatcctaacaaaaggaattcaagatcttcaaaaaaatcataaagctttatcagtgacattaaatattaacagcttacattactgatcacttactacctgctgggcactgtgtgagtgatgtggatatgctacaaactcatttgattcatatgagtcctatatgatagacctgttattattgttagcttcactttagaggtaaagaaattaaggcacaggttgttaggtacttgcccaagcttccaaaaccaaaaattagcaacactgggattcacaccaaagacagttggtgccaagcctgtgaccttaactactaccctatactgtctctcccaagagagggtgtccattcctccaataaaggcatctctggctcagctgagccaaacttccagaagccattctgtgtcatcctgatgccaacttgatttgaattatctaccctacaactgtctaagaagccctctttcaacagattggatccaagcaccttgggagcagagagtggcagtggatttatttcgttcacataaggatacagaccaacaatgattaaaggagatctcagttttaggcctagtcaagtgacaccatgtcacttttaagatcacatggctctccaattcccaggagcagatcaaatagatttcttaaacttgaaaagttgtatttattaagatcttaagctgctttccagactaagaacataatggatgtcaatgatttatctttctgataacctttgagaattctgggagaggatatgtaatatttatttgtataagttctgcaacttttctgtaagtctgaaattatttcaaaaattttaaatgtaaataaaatgtttaaaatttttatttttatatctgtaaatcaatctatcagattcatggataagcccaaatttacaaaaatggcttattgataaactcaattaattctaataaatatcctaacagttttttctcctcacagaaagttaacaaagctgattcaaaatttatctggaagcacaaagtgccaaaaatagctaaccagtttttgttgtttttacgttgttgtctgtaacatacagaactgtttactctgctgtttgcaatacaaagacatcagaaatgttattgtttgtgcaatatagtagggaaaaaaatgaaactgcccattagggtgggttgccagatgtcctatcattaaaaaagaataccagctttaaacagagcagttcctggtatctgtacttcactgtgtttattctatctggattcccttatttgtcccttagaaagattcgttagccaacacagttttgcccttccatgtagcaagacctattacaaaacgatagtaaaaaaacagtaggccggccgcggtggctcacgcctgtaatcccagcactctgggaggccgagcaggtgaatcacctgaggtcaggagttcgagaccagcctgaccaacatggtgaaacccatctctactcatacaaaaaaaaaaaaaaaaaaaagccaggcatggtgacagacgcctgtgtcccagctactctggaggctatggcatgagaattgcttgaacccgggaggcagacgttcagtcagtcgagatcaggccactgcactccggcctgggtgacagagcaagactctgtctaaaaaataaaaataggctgggtgcagtggctcaagcctgtaatcccagcactttggaagccaaggcaggcagatcacttgaggtcaggagtacaagaccagcctggccaacatggtgaaccatgtctctactaaaactacagaaaattagtagggtgtggtggcgtgtgcctgtaatccagctactcgggaggctgaggtgggagaattgcttgaacccgggaggtggaggttgcatgagccgagataacgccactgcactccagcctgggcgacagagtgagactccgtctcaaaataaaaaaataaaaataaaagagtattagcggccgggcgcggtggctcatgcctgtaacccagcactttgggagaccgaggcggtggacgggtcacgaggtcaggagatcaagaccacctggctaacacggtgaaaccccgtctctactaaaaatacaaaaaattagctgggtgtgtggcaggcgcctgtagtcccagctactcgggaggctgagggaggagaatggtatgaaccgggaggcggagcttgcagtgagaggagatcgcgccattgcattccagcctgggtggacaagcaacactccgtctcaaaaaaaaaaaaaaaagaaaagaaaagcgtattagcacaaggaagatgactttactactcctcaaatgctgctgagagagctggttattcacatatggaaaatatatatatccctatcttgccccattctaatttaattataggctgggagctgtggctcagtctattatcccagtactttgaatcagtcggatatggcggtgcacacctgtagtcccagtacccaggagactgaggtgggaggactatctgactccaggagtttcaggctgcagtaagggtgatggcgccactacagtccagcctgggcaacagagtgagatcctgtcttgagactaatacacgatttttttttaaagacagaatttcactcttgttgcccaggctggagtgcaatgtgcaatctcggctcaccacgacctccacctcccaggttcaaacgattctcctgcctcacctcctgagtagctgggattacaagcatgtgccaccacgcccagctcattttgtattttagtagagatgaggtttgtccatgttggtcaagctggtctcgaaccgcctcggcctcccaagtgctgggattacaggcatgagctacctcgcccggccaataaaccttttttttaattaccatggattaaggatttaaatacaaagtgcaaatttttaaaacttttagaagaa

SEQ ID NO: 5037 - DNA, 16658 bp, Homo sapiens
ggccaaactaactttgggaggaacttataatttagctttgaaacaaagatgataacagtcttttccaaaacaaacactattgcctatagaccggactgcctaaagccacaagatgagagttatggtaatcttactaaatttaagatgtagctatttttattaaaccaatattaatgtttatttattaaagatttgttaaatatagtgaactccaagtttctcttcaaagaatcagttgtcagtatgttcagctctcttattctttgattctccattttaaagtttagcttcctggtctctttgccccctagcttctagtttcagtaaacaactttcccgccagtcctaatcagtgttcacagctgttcccctggtcacctgctttgacctgagtcactcttggtcacctactcgtcctgattcatcctgagccaactgttctgtaaccgcccttactgctaaactactcacctgccactccggctggtactcctgctctttttaaaatagtcaattggaattagcttagacgtgcggtccaaccctatccaataggggaacgacacagcagtaggggctacctgcatgagaataagaactcctgcccctcccctgtccaagtgtgctctcaccattgtttcatctgcgagggcaccttttctgcagaaagtgaaaattgccttgctgagaaaactaaatttatgtttggtgctatttctttgtggcactggggaataagcattttgcatttctaacaagcttacacagcaaagatcattctgttttgggctgggtatatagttttgtaacccctatgagaaattttacaccttatagtatttggcagggataagtatgaaactgctggattaatatgcaaacaaaatgtatgctggcaattcttcagacatttctaatattactttaccagtaattttaaggctgcttatttattaataattttactgagttacataaacttgaaaaaatatttgacgagtctttttcctgataaagcatttcattcgagcacttttattttcttaagccagttaattagagtcttttaagcattttcagtagtgaagcattgtgtacacaacacataaatacatagacgtttaggcatgctgatagaagtacatcttatggatacactcagattattgataacctgcttacaaccctaggcagttgtcagctaactagccttatgtttgcatattaaaggaaacaactaggtgaaaatcaaatagcaaaatttacatcataaggtacagagagaaaaagtctgatgggccagagggagatgaaagatgaatgccaaatcaaacataaaattaaagaaatttgccggtgtggtggttcattcctgtaatcccaacactttggggggccgaggtgggcggatcacaagtcaggagatcgaaaccatcctggctaacacggcgaaaccccgtctctattaaaaatacaaaaattagctgggcgtggtggtgggcgcctgtagtcccagttatgtctgtactctctgagtacagagatcaccccactgtactccaacctgggtgacagcgagactctgtctcaaaaaaaaaaaacaaaaaagaaatttatcataggattgtataaggagactagttttatttagaaaagggactaccttttaagtggatctctgagctctgggcagagcccacactgaatcctggtctccaagaagggacacttattatgaggttagaacacgtgatgcttttacagtgcacttttaaaaaacttcttttaaacaaagacatttctaagtgtctaaaccatagtcttccttaaaacccaagggtaggctgggtgcagtggcttatgcctgtaatcccagcactttgggaggtgaggcgggcggatcatgaggtcaggagatcgagaccatcctggctaacacggtgaaaccgtctctactaaaaatacaaaacaaacaaacaaacaaacaaacaaacaaaaaacaagctggcatggtggcgcttgtagtcccagctacttgggaggctgaggcaggagaatggcgtgacccgggaggcggagcttgcagtgagccgagattgcgccactgcactccagcctgggcgaagagtgaaactcagactcaaaacaaacaaacaaacaatacaaaaaacaaaaaacaaaaaacccaagggtaacctctgttgcaataactattttagtcaaaaaaaaaaacaaaaaaaaaccaaaaaaaaaccacaaacaggtaacaacaatacaaaagtaagcagttgaagagacgagcgaacttgcctgtttacactctggggattgcataagaaaaaacaggtttctcccttaaaggagcctggtgccttctctgttctctttaaggaaccccagctattataaactattttagtccctcatgcagcagagggtgcaagagaaaggagatacagccgaagtaaatgaagaaaaagaattcagtcaactgagaagaaaaaaactttcgctcaaaaaaagacaagattcttggaaaaaacaaaaacaaaaacatgaagtccttttaaatacaaacacacacacgcacatgcgccacacacacacaccacacatacacatgcacatcttcgatgttagcttttaattaagctgcttttaatcattgagctcctttaaaaaaatcttttaaaatctcattaccatatttcagcaggacaaattgctgctatttcagaagcacagccattgctctttcagtttggcctggctacaaaaaggtggcctcgttgtgtaactaaagccacttagtagtcaaaataaaaaatctttcttttttttttccttttgctggctgtttttcaccccctatcacatcatcctttgtgtattgtgtgtgtgtgaatttagccacttcagaggccttgttccccataatttgggacttccttgtatttgatcaagtcagatagagttgatcaaacccaatgggaaaaagactgaaagaacacaaaaagagaaatgaacaacaacaaaacagttaagcaaaacaaatgatcacacaattttatgattactaagctttctagtggtaaggagaaattaagaccagctggttgtaatcttactttagccaaaacaaaccccaattcagttacttacctagggatgggtttcaggctgaagctgctctctaccatcctagaagcagggaaaaaccctcatcttccctgttggttgcgagccaaacaccataaaggagttacctgccttccatcaacatggaagcaggaaaaatttgcctccttgtgttagaagcaagtaaaactccaaaaaaaaaagaggagttgtacaacaaaatgactttagatcttgaccagattttgaaagataaggtattctctggagggtgtgcttccgggctcagcaaattgtcctattggtttgagccataaagatagctcaagctggtaccaagcacgatagctttgtcaaaggtcaggggcgcctccagtcagaattcttctgtggttaccaaaaatgaaccccccaaatctgagaaaggtctcagttaatttagaaagtttattttgccaatgtgatggtgtgacacagcctcaggagatcccaatgacatgtccccaaggtggtcagagcaaatttagttttatacattttggggagacttgagacgtcactcaacatacgtaagatgaaattgtttgggtctggaaagacagggagggggcttcccggtcataggtagataagagacaatgtttgcattcttttgagtttctaattatcctctcaaaaggaggcagtcagatatgcattagctcagtgatcagaggggtgactttgaaagaatgggaggcaggtttgccttaagcattcccagcttgacttttccctttagcttagtaattttgggggctcaagatatttcccttcagacctcttcagtagaattctttcttctgatgaggcaagcattgagttttatgtagactgtatggatttcccaccactcacatgaagaccatgacctgtgacacattccctggaggtctgagaacatgtacccaaggcagttgagttacaactggttttatacagtttagggaggctcagacagtaatcaatataagcagggtatgcattggttccttctgattgagggaggagctacaggtcataggtgaattcaaagacttttctgattggcgctgggcacggtggctcacattgtaatcccagcattttggggagccaaggcgggtggatcacttgaggtcaggagttcggaccagcctggaccaacatggtgaaaccctgtctctattaaaaatacaaaaattagctggcatggtggcactcctgtaatcccagctacttgggaggctgaggcatgagaacagcttgacccaggagatggaggttgtagtgagctgagatcacgccactgcctgagcaacagagtggactccatctcaaaaaaaaaaaaaaatttctgattttcaattggttgaaagaagttatttccaaagacttggaatcttggtatacaacaacaaaattttttttaaataaaaaattttaaaaagacaacctggaatcaatagaaataagcatctgggttaagataaggagttgtggagccaaggttctttttttttgagacagagtctcgctctgtcgccaggctggagtgccgtgggcgatctcagctcactgcaacctccacctcctgggttcaagcgattctcctgcctcagctcccaagtagctgagactacaggcgtgtaccaccatgcccagctaatttttgtatttttgtagaaacggggtttcaccatgttggccaagagggtctctatctcttgacctcgtgatctcccactttggcctcccaaagtgctggcattacagatgtgagccgctgcacccggcccaggttcttattatgtaacatagatggtaaatgtctaaggcgttaaaaggtgccagactctagttaaatctcccttagatcaggataaaacctggaaagaggctggacgcggtggctcatcctgtaatcccagcactttgggaggccaaggcaggtggatcacgaggtcaggagttcaaaccagcctggccaagatggtgaaaccctgtctctactaaaaatagaaaaattatctgggacagtggcaggcacctgtaatcccagctacttgggaggctgaggcaggagaatcgcttgacccagtgggtggaggttgcagcacgctactgcactccagcctgggccacagagtgacttgtctcaaaacaaaacaaaacaaaacaaaaaacctggaaaggggaggggattctctacaattctagattttccccacaaaagacagctttttggagctatttaaaaaaaaaatcagagaatatattttgggggtaaaatacattgatttctttcagggcctgctatctgtcaggtgagctagagtcaggttggaatttggtatcttattgctacaaagagtctgttttgtgtcttagatcagaatgccttaaggtctctgttttaatgttaatgctggtcagttgtgtctgaatttaaaggaaggagggggataatgaggcttgtcctaaacctcttcccatcacagcctgaataatttttcaggtttattttggaatgccctgggctgagagggaggtccattcagtcggttggaggcttagaattttatttttgccttacagtttcccaaaacgtccagtgaacctcgccctcctttagaagtgtcgtccctggagcccacgaaaatgtctgcaagatctgcaagggccccttaaagcccgtgccaccttaagcaggccccacccctggcctagccaatgggctgacacagcagtagctgctgccacagtagctgactggtcaccctgccacccagtgctcacacccctggccagtgcctggctatggcccgactgctcaggtctgcaacctgggagctgttccccggaggggctactgctcccagaaggcaaaggtaccgggagagaagagaagtcctctggaggatgaggtggggagcggggagcagggggttctgatcccaagtttcctgggctctgtgacccccagcaccaagtgacctgaccttgggcaaaagggcactgggcttaccctgtggcaacgtgggtgggtgtagagtgagatcagctgagtccccactgctaccatgagtggggctggggagtcaaatggatgcccctggaataaaacacacctgtggaagaaggccctgaaggaaaggcctgggttccaggccaggctctgtccttaacttggcctccatttctcatctgtaaaatggaagaaacacatcccccgccccgccgcgccccgccccccacgaagggcccagaagcccaggcaacgtagagtggggagggggcagtggaagcttttcctccccctaattcccttatcagctctgagttccctgtggctggggtggtgcttggttggccctggagaaaggaggaagtagggatcttttcggttgctcaggctgggctggctattgaaggaaccctgctgatagccttttggagagtgaattctggttttttatttggatggctgggcgctgtggctcacgcctgtaccccagcactttgggaggccgaggcaggtggatcgcttgagcccaggagtttgaaacctcctgggcaacatagttaagaccctgtttttattaaaaaagaaaacattaaaaaaattcggtggcgtttttttctgaggggaaactttgacccccaatggctctgtttggaaaagaggatttctggatagtgggtttgtttaaagtgggcccacctggcaaggatgttgtcagcgggcgggcgcaggggaggctcactccagcctccagcccccagccctccccccgacactggggagggctgtggccccatgtgtctttcgggggaccctggcagtgtgtttcttccctgcaggagagctctgcagggacttcgtagaggctctgaaggccgtggtgggcggctcccacgtgtcactgccgcggtggtccgagagcagcacgggcgcgatgagtcggtgcacaggtatgggaggttcgcgggcccctcccctgtcttctggattcaaccccagctgagagagagggtgctggttgccttcctcctcactcatctgttttggggtgctctggcatgttctctgcccctcgctgctgtagcctcaggccctgcaacacctcgggaccagagggtgtcacgccccgctaaatgctgagggtctggttctaggtgcgaacctcctgatgctgtggtgtggccccagaacgtgagcaggtcagccggctggcagccctgtgctatcgccaaggtgtgcccatcatcccattcgcaccggcaccgggcttgagggtggcgtctgtgctgtgcaggtacagtggggctccctccccggcccgaggatggtcccagcacaccttggcacacctgtggctgcctcccccgccaccacggcaccttgggtctgctcccgcccgtgggctgcctgcctctgggggtctggtctggtgctggggggacacccgcggggtgtggtccggggacgtggccaggtcagagacccaggttgcagtggtcttagcacctgccccaaccagggcggcgtctgcgttaacctgacgcatatgaccgaatcctggagctgaaccaggaggacttctctgtggtggtggagccaggtgtcaccgcaaagccctcaacgcccacctgcgggacagcggcctctggtttcccgtgggtaggaccgcgaacctttcctgggaccctgagggcaccgtgggagcagggctgtgtctggggttcagggaccttcctcccccagcccgagggaaaggacctccggtccctgaggctgccttctgtcgccgccctccagacccaggcgcggacgcctctctctgtggcatggcggccaccggggctcggggaccaacgcggtccgctacggcaccatgcgggacaacgtgctcaacctggaggtgtgctgcccgacgggcggctgctgcacacggcgggccgaggccggcatttccggtgagcccctctgcggggggcccgggctctggccctgggcactgctggcgggctgccctgcagagccgggctgtgaaaagcacctcctggcggccccctggtttggcaggctaggcttcctcagctctgaagccctgtcagctgggccaaagtggatgggaccagggtttgctctccctgcctaggccgactggctttgtggagcagaaagcactgggccagggaaactgggcccgagggagccagcccagacctcagtgcctggggtcggtgtcttgggttccagcttcggcttctggccgaaatccctcatcacacagcctggtactcaccttgtgtgtccctgggacgtaggaagaggcagccggctacaacctcacggggctcttcgtgggctccgaggggacgctgggcctcatacagccaccaccctgcgcctgcaccctgcccctgaggccacagtggccgccacgtgtgcttccccagtgtccaggctgctgtggacagcactgtacacatcctccaggctgcagtgccgtagcccgcattggtgagctgaggatgggggcagtcagggtgggctccctggaagaggcccctgggaaggccaggcctcacctggcctgccatctccctggatccagagttcctggataagtcatgatggatgcctgcaacaggtacagcaagctgaattgcttagtggcgcccacatcttcctggagttccatggctcccagcaggcactggaggagcagctgcagcgcacaggttgctggggtggagtggggcagcagggtgggctgcctcagtggcggcccggtgtcagcccccttccccaactgcagaggagatagtccagcagaacggagcctctgacttctcctgggcaaggaggccgaggagcgcagccggctttggacagcacggcacaatgcctggtacgcagcctggccacgcggccaggctgcaaggtgagctggggctggggtacagatggggcccacagtcggcccacaaaccctttcctcaacccaccactctactgcacagagcagcaggctgagctcaacaacggggctgggcctggctgagcaggcgctagaaacaagggctgcagaccgcccacccagctgttcagataccgtctacagggaaagcacagttgtctgctaagccctcaaaacccttcctgtgagccaggtcatgggaacggtgcggtgctcttgggagctgtacatggaagaaggcttcctggaggaagagatgatagagagggggatgttagcctaacctggggaaggaagtctgggctccaggcagctatgcaaaggctcagcagcctggggcttgggggtgggagcacaggggaggtgtggcaagcacacctgggccattggtctcctgtgttgtgtcggggggggtgagggctgaggcctagagaagagcaggattatttccttgtgtgaggccaagagctgagcccagtgccctccgacccatcctcagccttgaccacggtgaccccgtacacccaatcggcaggggtaactcataggcttccctctgaccagggctactccacggatgtgtgtgtgccatctcccggctgccggagatcgtggtgcagaccaaggaggatctgaatgcctcaggaccacaggttctgcccaccctgctgctggggagaggtggggaggtgtcagggctgatcagacctggggcagcaggaggcaagaggaggactgggctggagaatagttctgtcctctgggccccaggaagcattgtcgggcatgtgggtgacggcaacttccactgcatcctgctggtcaccctgatgacgccgaggaactgggcagggtcaaggcttttgcagaacagctgggcaggtggagcaaagccagggaggggaagagctgagggcagaggaaagggagccccctgaggatgctccttcctgcccccaggcgggcactggctctccacggaacgtgcacgggggagcatggatcggaatgggcaagcggcagctgctgcaggaggaggtgggcgccgtgggcgtggagacatgcggcagctcaaggccgtgctagacccccaaggcctcatgaatccaggcaaagtgcttgaagggggtctgagcacttagcccacaagttccctgactacggagccggttctggaactttcttcatgccacggcccctgcaaggaaatagatgctgaggcagtcttcctgccagcggcccactgtatctgggcccaaggccagagggcccagagagaagcctgagcaccgtgttactccctggccctctggctggccccaggagcctttggttcagtaaacgacccagggtggtcccagcaaagctgcttcctctctgctcctacgcatcctgtcctggcgggaagagagcgttgggtccattcaagactctgatgacacccctccccgaggcctcccactgccggggtcccggacccttcccccttcacctggtgacaggaacactcctttcctggtatggaacgtgagccccgtgacatgatgataggtcttctccttggggcctcccccaataaatctgtaataaactgaaacccacctacagctacctggaagtcagcaggcagcacttcctcccctccccctccgggtctctgtcctttggtcagtgacccctttgttttggggctgtcctctgacttcttatgcctggggaggaggttggtgctcagggttcggaaaggaacccaggtccctgtcccagctctccgcctcagagctgaggacctgcccacggcacatgtcactcaggatgggctccccaatgggcctgaaccgggcctctgaacacactgaatgtgttcctcagcagctgccacgtctcagaaacagagatgagactatttttgcacccacctcttcatggggtgatgtatcgtaccacagctgttttgccctcaaggtctgtccacccgagggcctgcccctgtcttgggccggagccgtcttgagaccttggcagttgttcccccctaagcccacaggagggcgcccgaaatcagaagctcagataccacgcggcatctgcagctcacgactcctctgcccagggcctgcggcctcagccctgggcaaacctcctcctagggtcaggtaagtcctggcagcctggaagccaactagtcctccatcccctgcaggtcccaggaacctgcagtgctgtctcatcttccttgccctctagccttcggtcccttttggaaagaggcatgtcacaccccacgccctccctggcctcgcccctctcctcctcccatcagctgtcagtgctcaggcaggctgctaggccttaggcaaggcagctgcgctgagacgccccagtccaacttcagttcttggaacccctcctccgtgcaatactgggctccagccgacagcagttacaccaacctgagcctggaggctactcctccggacgtttctgtcccgtgctgccctggtggggagcagagaccgtgccaagggctcactgggacaaatctcagccctctccccaaaccaccccagcacgcgtgtgctcatcaccgagacaccctctcgcccctccccttccagccagccagccagccacccactcttccaggcgagaatctgcagcagctgcgctctccctcctgggtaggactcttctttgatgcgccctccagtgctggcaactaggaggcgctcagcaaatgaccatttcccacaatcttttattaagaaaaatccaaacatacagaaaagttgaaagaacaagtacactgttcactgaaataccagccactgagattcaacaatgaacattttggccttatttgctttgtgtattttggggggaactatttgaattaaattacacatttcttgaaggcattcacctatataatccagcatctatctcctagaatgaggacattttcccatgaactgcagtaccgttaaatggctattagaggaatggttgtctttgtgagggtctcacgtccaggaacctcatcaaagcgtgctaggcccttagcagaagggtagaacctgctcgccggctccctcaccttctctcccatcccagaaaggcagaacagggcaacacaggattctggagagctgtccagatagaggatcacaaacatgagctccaccgggaaacacagacagccccaatcccacccccacaacaagagcaggcaacctgggtccaattcagaggacaccacagccggcagagggctgcagcatgccaggtaggacggaagtcgctggggtggggatgagcaccagcccctagagcctggaatagcacccggcgtgggctacagcctgccccacccacctcacagctgctcggctcacccatggcactgccaaagcagcaggctaagccgccaaggcgggcacatgaagcctccatttccaggtccaggggtcaggcaaggagtctccttcagggctgggccctgcctcgccagctttgctggtggaattaaatatagcacaggagacacagttgccaggcagaagcaggaggtgctgtgaatagaacagtgccctttgtgtgacaaagctatggggagcctgctgtgcatgtgccaagacctgcagggcagctcccccacccccacagggacctctgagctgcatggttttgtccccgcttcacatgtgaaatatctgagttcagatgaagtcgtttccccaagatcattctgccaagtaggagagcctgaatgcacgtctagagcccacgttcctgccaccgactcacaacagccccaaggtcttcaccccagacggtcccgcgctgagacccaggctctgaaccaccgagtcttctttagtgtttctccgctgccctggctcacgtttgcccactggcctgttgtgaatgcccttgcacagagtaggtgctttggaagcatctgatggagggtgactgcggagccaggggccgtggcagcagggggatggtcagcacatcaggcgggcctgagaagggtcagagcagagaggcggtggagtcgtctcccttagagctttccttcgctggctctgcaggaggctctggaatgctgctccgggagcccgctggcacggggacacaggccaggcctgcactgctgctccctgccccgagctgcctgcccagccgcattttgccaacttttgtgagcctgagcagttggttctggttcaagggctctgagcggcacagccccaaaccagggcctcttcctgggcctcaatgaagcatgcccgtgagtcagactgagacgcaaactgaacaacaggcagggcgagtggaacgtgggatggggagcaaaggtggaaggaggggggctgggcccacacctggaagaacccacatccttgcagcctccggtgctgcaacatcttggcccctgcagatcttttcagaggtccggcacaatgactccacagaggctgactggttccatgatgcttaagaggttaggaagcttgtaggaggcacgcctgacttccactccctccacccaggcctgactatctgaggaccaattcacacacctggagccccgatagcagcctgaaggaatgctaaggaggtaggtgagggagtggggggcaggcccttgccccatttcttgattgtataacacttcattaaaataaaatcacgcagtgccatcttttattaacattttaataccatatcaaaacaccttgactaatgaagaaagcttttctcccaagcttgaacatttttttaaacattttataagtttttttttgtattttaatatataaatacagaacctatcttgcatgggctgatgccacgtgtgaacatcaatggctaaaatgttctcaaacaagtgcctgaaaacaggggtagctgtacatatttcttagtaagtctttttttgtttaagtttctgaaaaaaaaaatccacgagggcctaagaataatgttcaggcatttttgcaggacattgtgattgttaaatcctctgaactgaccggaaccaggaggaaagaagggaaaagagatggatcagtaggaagaaagttctcaatgggttgttttttggcaatgaagtcaagatattaggtctcaaggggagaaaagagcaaaaaaccagccagaaaaatagagggaaaaaaccaaaaaacccaaagtagagaagttggtggtggagagggccagttggggcaggggaagagaccggtgctcgcccgccgtcagaaggctggcagcgaggccttagctgtgttcgtctgtcactggtgggttatggctgggcagcaaacagcaagctgtaaacatcacgagggaaaacaccagtgacactagactttttttttatataatttttttttgtaaacactttaaagacagacccacatgcctttcaaagatgaaaaagaaaatgccctttccctcctgggctgaggggtgaggggaggatagcagttgattcattcttctctcaaacttgctctcatccaatttggtgtcctcaggaggaagggagaaccatgatctggaagtcagtgcagaaggggtgccctgttcccgctgtgtcccaagctcagctctgccccagggtccggtgagcctcctccctggagcaggggcgcctgtccctgtgtggaccgtaataaataagtcgtgctccatcgggccgagggctgtctgccatcccagggcagctgcatcccaagagggcaggcggggctggggcgtctacacaggacccagaagccaaacagcacacggggaatttgcagccatgtgcctgggcaggttctactccctgcctcactctcccccctggctctttcttctccccttgtcatcagtttttgaggtggagtaaaaagagcaaatgtccctgatttgtctgacatcatcagctgttctgggagtttacttgaataaataaaataaacctaacaaaagaaaacgaaagcaagagagagagaaagggagggggaagaaaaaggtcccaaaacctttggctgtgagatggagttgggcttttggtttttatggggttttgtctacttgtttgccagaaaaaggaaaatgccagcccagaacttggaggggcaggtgagatgggggtcaggggtggatggttggcagcaagtggggtacccctgggggagaatggggaggccagacccagcggtaagccagggggatgtgtggagtcagcacccagtgcgtgggatagagggatcgagtctggcctggaggcctcagattcatctggaagcggcatggaagaagcagtggtcaaatgatcgctgaccagcactttgcagggaacaatgcactgcccaggctgtttagtaagtgcaatgtccttatggcaacagggagtgagattatccccgttacctagaagaggcggagactcagaggtgagcgaggatgaggccaagccaggcacaaacccacgctcaggctccttttcctgcccgtgcacattcccaggggatattcctgaactttctttagaatgtagattgtactggtctcttccccaactgatcctaactcttctgagcctgttcttataactgtccatgttggtttgtatctcttgtccttcccagggaaaatcatttccggatgctaactgctcactgatgaggtgctccttccctctgctcctgctttcttctcagtggcatagggcagcccggctccctaaactgcaggcccccaaagtgacctgaccccaagccttgagccggagcacccccaaacgcgggctcacctttgagaggagtcagcaagcaagcccgcaggcagtccgcagggtgttccggacaagatctgttcacttcaaaccacgagtctatgcagctggaggagggggccgcaagggaaaccacgttacctgctgcccaggctgctttgaaggggcctttcagagggccagattcctgagcaggagcttcctaagtctcttctgaaaggaccccaggaaacacagtcatgtccccagatatccctactttctgaagcacgaagaagggtgaacacaagactagtcttggcccaggtggaggcagcagtaccggctcagggggatctggtgctgaggaaggggcagagtggctttcagaaggaccaaagctttctgtgcagagcccaggagaaggcagcagccaccagtgagaaggtgagagcggtggacccctcagggcagctagtcagcttctccaagactcccaagggcagggaagtgggaacaatggcatggcaggagggccacggcctgggtgccacagtcctgaaagagctccttcctgggtcaaaagaacagctgtgaagctcctcccagtgggtgacctcttaggagagccccaagctctacccggctcagccatgatcagtgatcagcagcatctagtccttcctgcaagaggcgggaggggagccagacagtgaagcctgctctccagtgtttacaga

SEQ ID NO: 5038 - DNA, 24675 bp, Homo sapiens
atctgcactgcaattattccctacctttaatcaagactggcttaaatgtgtatgtcggcgagtgcagtggctcatgcctgtaatcccagcactttgggaggccgaggcaggcggatcaaaggtcaggacatcgagaccatcctggctaacacggtgaaaccccgtctctactaaaaaacaaaaaaaaagaaaattagcagggcgtggtggtgggcgcctgtagtcccagctactcggaggctgaggcaggagaatggcatgaacccgggaggagcagcttgcagtgagccaagatgcgtcactgccctccagcctaggcgacagagactctgtctcaaaaaaaaaaaattgtgttgtaatgtgtgtgtatatatatctgagtgcatacacacatgtatatgcataataggtattatgtatatgcaaataaaattgcaaatacctttcaagaaagtgttctccaaagctatctaaattatccacacggtaatttctccaagtcaagcaactgccttggggcctctgagtgatctagcaagagtacttctcagtcctcctgcatttttacttttccagaagcctgacagtaaggggtagtttctctacttccaatggagtggtttaaaacgttaatacaacagaagatacagaacatttttgttttatttgagcatgatcccagtaaaactgaaataacaattacttgtctgagttccagaaagggcatgctctaggatactcaccttccttggtagatgctggaataataaataagactgacagcatacccatttttggaatatatgtattgaaaagtggagcaagaaagagtctcattgatatttgttttactaattgtagtactctacttttcctttagctgtggccccctctctcccacctctaccctattccccaacacgtgcacgcgcatgcacacacaccacacacacacgcatatgtgcatgcacacacacacacgcatacgtgcatgcacacacaccgcatacgtgcatgcacacacacacacacgcatacgtgcatgcatacacacgatcaccttatgttccttcgctaaaaacctcatgtccttggtttgcatatgttattttttccctagcgcatgacaagaaaaacaggtggataatatttacttcctcatttccccagggttggactgatgatttactgatggttaggtagagtctcttgtcgttttgtggctgtctcctatccagtacacgactggactccatatcttactccagcgcaatcttgtcaccagggccttggccaggcttgtgtctggccagaacggctccctttctctcctgctgtcattttgtgttgctctctgctattgtgggcatcaggcctcaccactttatgtgcacttctcacagaaaaccttgaatgtgctggacacgtgtgctaagtccaataagcacagcaaatgcacatgctgggctgaggctcccctgacgaaggacttccttccttctgcctgaaatgccttactcactactcctttgctggctgttgcagtaatgaatgtcttcttttttctttttctttctttctttttttgagacaaatcttgctctgttgcccaggctggagtgcagtggcacaatctcagctcactgcaacctcacctcctgggttcaagcaattctcctgattcggacgagagtcccagcgttgcggtggctcctcattggtctccctgggtgggtctcatgactcggttcctgccaggctcagcccttcgggcgatgtcctgaagcagcaccactctaatctgtcacacccgtgtttagaaatattcagcagctgcattaccttccaagccaagtccaaatttctcagtttggaactcaatgtcttcacaattgcttcccaacttacccttacagttcactcgctctccacctcttgggcaaacaaaaattgataagttaagtgctttacatttcatcctaatgatattcctataagatgtgtgtattatccttgtttttcagatgaagaaattgaggcacattaagattgacttgccctaagtacccaatgtatttagtttcttggggctgctgatattaccataaactcgatgacttaaaaaacagaaatgtatcctcttccagttctagagtatagaaatccaaaaatcttgatgttggggggccatgcatcctctgaaggagttagaggaagatccttccttgtctcttcagctctgtgcttgtaaacattccttggcattgcaaccccaatctctgcatggccttcttccctctggtcccctctgtgtcaaaatctctcttctttctcttataaaggcaccacatattggaattaggttcacccttaatccaggatgatttcgttctgagatccttaactagtacatctgcacgaccctatttcccaataaagtcacattctgaggttcaagtggacacaaattctgggggagactgtttaacccactacacccaacaagtaagaatttgaaactaaatctctcaggctataagcatcatacattaacaccttcacttaacgcctcccagaaagctcccggccaaattggcttctctcatttttctatatagatttttccctttcctgcctctctgtcattgctcatgcattttctttacataggccagtttttccctttttcttcctttcaaccaatcctacctgtgaaatcttgtgtagtcttcaagatgaagctcaacatcacttcctctaagaagacatccatggccagtgcagtggctcacgcctgtaatttctgcactttgggaggccaaggcaggcagacacttgaggccaagagttcgagatcagcctggccaacacagtgaaaccccgtctctaccaaaaatacaaaaattagccgggcgtgttggcacctacctgtaatcccaaccactcagagctgaggcaggagaattgcttgaacccaggaggtggaggttgcagtgagctgagatcatgcactgcactccagcctgggcaacagagcatgattctgtctcaaaaaaaaaaaaaaagaaaagaaaaagaaaaaaaaagacattcattactgcaacgccaagcaaaggatttttcttccccaaagctaaactgccttacagcacatgtctccgatggcccatattatcttcaacctcagttctaggtttctgtgcagttgtctccattccctactacatctgcttcctgccactgttactatattacaagcaccttaaaggcaaaactgcctcctcccaccatgtgttctccacagacttttcttaagccggagctccacaaatttgcccaagtgaatttagaatcatctgcatcttctctgcattgaatagttcatgtatttgtaagcaaaaatgtaggatgcttaaaaactccctttccccaatgctcccacttttcccaactggaattttttaaatggcccaattttctttccacatctaactcaatcatcttaacaaacgttttcatcatttgaattttatctaatgataaaaattgagtcccttcctggtataatcctctcacaatttctttattttcttcctatcccagtgctacctcctttggcttttcaggacaaatttattactcttgagatctctgaggagaggataatatcttagccatcattatattcccagcagctgttagcacctgggtgtccaaaatatttgaagaatgcatgaatgtgtgaaggtgtggatgctgcactagagcaggcagagcagtgctgtccctgagatgatgacataacttttgcaggtctcacataatccttaccacaccctatgaggtgggcattcttcccatgttacagatgggaaaactgaggctatgagatagaaagaacttgactcttggccacacatccagtaagtgatgaaaccagattgaaacccaggttgtctaaccctggagctaaagctcttaaccaaaaatcctcttggattggattgcagccgcattatcctgccctgcttcaagccaagggaatgtgatcatgacaaccttgaacataccttaaacctggagccttggcatctgttggccatttggttgggaaggtctaaaagaagtgagaggaagcttgagattgtgagaaaaatagtgtaaagaatatatatgcatttttgtgtgttgtgtgtgtgtctgtgtattctgtgtataggatgatacctggggatgaaacaggctgtgttataggaaagttttggagataagaatatacaagtgaccaggagtcacaggtggacctcgtcctagctcagacacttagcatctgaacaaacttggacaagtcatttatccacctgaatggtttgctgtgagatggcctattgacctcacataggtgttgggaggatctatgaagctaagaagaaagttcgtaaaatcccagtatatgcagtgcgctgcactgatgagtagaagggaaggaggaacagagtggtggtccctgattcaaaggagtttccattcaaattaggggaaaagacatgtaaaactaactctaaatgatacagaatagaaaatgtgcaaccatgaaaaggagatctcttgagctctttactgtatggcaggttaaaagatggtaatctcacaaagatgttaccttaccaagtgggtattattagcaatcccatttggtagatgagaaaactgatagctaaaacctttaacctttactccaaagccatgttgctaaattccacagccaaaattcaccccgatctatgtaacctgaatctttacttgtatcatctccccatgctattgccttgagcaatctaagatgcaaagtgcagagagatgggaacctttgtgctcaacttggaaaaaggggagaagggcaatgaaaacagagcagacaccctttaaaactgcgtggctttaaggccaggcgtgtagcttgtggctgtaatcccagcactttgggaggccgaggcaggcggatcacctgaggtaagagtttaagaccagtctggccaatatggtaaaaccctgtctctactaaaaatacaaaattagcctgacgtggtggtgcacgctgtagtcccagctacttgggaggctgtggcaggaaatcgcttgaacccagaaggcggaggttgcagtgagccgagatcacgccactgcactccgcctgggtgacacagtgactccgtctcaagaaaacaacaactgtgtagctttagggaattctgaagtcccatgattgtcaccatcagtgtgtgtctcactacaaactcaaaaagctaggagaagagagtgaaatagggtgcatatagggccagagaagatgtgaagggagaacaccaaagttccattccagcaaaagggctgcatacggccgctggatagatgccaagtgattaattcaagccatattaatgtcagagaggagaatttggtgaaagctttgcctggctagatctcggctggaaatcactagcttcctttattttatttccccctaatcctttataacttcctctatgccttagtcaagcttaagaccatcagcctccagggagcaaagtgaagcccatctgttagtcaggcatttgccagaccaaagtaaaaggtcaatctggcttttcctataacagcattagatgaccccaaatacttcccaacggtatcagccaaaaacaactttgcattaccgtgaacgtgatttcaaagcagagatgtcagggatatcctttaaaacggataatgactgggctatgctagtgagaaaaagaaagaaaacaataggcatatgtctctttggaatgtgcttgctctaaggctgtataaaaataatcctaatcatcttgtttggggaggaaaatcaatcaagaatgcttttttcaaatattttatttcttttattataagacatataggtaaaaacttgcatatttgaaaaagatagaaaatggtaataaaatggatatttttcttattaagaaatatgttcataatatgctttatcaaatgttaaaatggttattttgcaaaataataataaatagagcagactgtgacatacaagggtcaaccaaagtactggaagtttttatgctatatgttttataaaattcagacttctgattatacattaaaaattgacattttgcactacagggtatcaataatctgattttaaaaatatttttatgatggctccatgaattcaaaaataataaaacataaaagtggtttgactaaatagaatctgattcaaataatttccccctaaataagaaattgtaagtataatttttgagcctataagggacacatgtatcagttcccaattctatatgtctcggtggcattgaacaaaaattgtttgctaagcctttgtttccagcaaggtccacatcatttctttcacagtttgatggagcaataatagtcacgattctgatgagcctagttctacaattctgctccatggatcttagattcgtagaaagttttccctcctttgaagaaactcattgacagtttcttatatttgtttatgactcattggcctcaaagtcacatatcagaacactgggaaaatttttaatgatgaaaagttcttgttctaggcattctttgtaagctttacttctctacttccaaaatagaagaaacacatgtgaacaccaaacacatcctctaaagagtcttgggtgtcaaatagcaaggtcaggcttttcctggaaataaatactgactttttacaaaaatctttctttcccatgcatcatgttgcccacaaggctaatacgctagctccctgctacaatgggggaaccacatctaacttaagtattcaatctaatatagattattggtcccaatggccttcaaaacggccatcaaagggacatctgggtgaccctgggttcctagagtacagagaggtcatgcaggatttggacttgagcttgaaggccatattcttgttgtttttggccacgatcttgcccagaagcgcctggctttcctgggcatgctctccttccttttctggtaggccagccgccgtcattcttctccttgctgtcccgccgaaggcgcacctgtcgcacaatgccctcaaacagtccttcacgttgtgctggacagctgcagaggtctcgatgaacttgcagtcaaacaccacgcacaggctctcccttctgggaaggaaagaaagaggtcagagggactgcagagcacagtccacatagcacacagtcaagctggatggttcttcgaggtaacactaagtcagctgtatagcagtggatagaggatgctgctgcggcatgggcctcccagggcatgaatagaaaatgtccactggagggtccctggaagtaagggagatgggctttagatctgatcccccataaattcctgtctgaaggtcccatttcatcaaatatagtgatattagttataacagtaaaagccatcccttaatttactgctgacttacaatgtgccaagaacaaggctaagttctttataaacatgttttcaatgtccacaacaatcttggaaaatacattattatccctgtcaaatacatgagaaaccgaggggagtctcctctgcaggtgaagttcacacagcctgtaagtggcagtgaaccaggtctgctcagttctcaagcccatactcaactctttctcctgacccagtttccagattggaaataagaattctactgcttagctttcctctcttttaaaataaaaataaaaataagcaataatgagatatcttgggaaaaaattgagaattttacaaatgtgtaatacagttaattatacaagcttttctgggacagtctcaatttcaagtatttcattgcattcaatgaccagcatcaagttttggtttggaaaaaaaatgattactgtagacagttgtgtcctagtaggagacattcccaaactagtgtgtacattgtctttatcaggtgtctttcctcctgagcagggctggcaatgtagtattttagttttataattgtaccagggatcaaatctgaattaggccataaaatctcaagggctataaaagcacttggctgcccactcagcagatagagattttcccgagctaagtatgaagaagaatatgtgaccccatcagactgatgcctcaaatgaaatttcgaagccagggatggggagtaggagagtaggacagtgtttctagggctcacaggaaccaggtcagccagagtagaattctttttcctcaatgaaactctttctcacagttcccctaaatagagttccctatcctccttgcatgaagatgctactttcatttccctgtactcttgggaatccaggaaactccttaaaagcgggaggattagtatcctgcaggtagaccagatggacaaggagaacaactagtgtggaggagacccactgggactgtaggagtctgagaaacacacctaaatttcatatagcatcttaatgagttcctagatccagcctcgtggaaggagggaagaaccgtgtctgaaggaaaacacatgtgatccagcgattgtttctacagtattggctctgctctcttacctgatacagacacttctcggcaccgcactaagtcacttttgttgccaaccaaattatgggaatgtcctctgtctgccgggccctgcggagctggattcgcagctcagatgcttctcgaagctcgctcggtctgtgattgagtagacaatcaggtatgcgtccccgacctgatgcagtggtcatggagccattcattttccccctaatgaaacaataagatcttctgtgattcagttaggcctggggaataaagcatcagtttgcaaagaaacaatatgtgtatcctaagtacacttgctgataggaaaaataggaaaaaggaagaaaatcgcttccaactccctaaagcattggtcttctatgcctataagatgtctggtggctgtaaagattgctagcctgtccatatttatgccaaaaagttttcacttttcagtatcttctacagcttgatttgataaattaacaacttctctgccaaacagcatttccaatttctatttaatctaccaaaaatgagcctttctgacttcccaaaaactcccttttgccttttccaagtgatgagattaagaacactttttgggactaggagggttttcaattaacagaagtctagcacataggttctgaagctttttaaatctttaaaaagccaatgttgaagactggtattgagaatctcaacttcatatgagatgatgtatgttatttaaaataacagtcaatgcctgtttgtattttccctaaaacaaataaatttttgggtgtgttttttaatagaactaaaggcaagtcactacaacttgcttgttattcgaactcatctgtgaacgacctgttccttagaacagtctcattcttcagcagtatgctttaatcaagaaaatgagcccacctcatctggaacacctactatataggacaaggtcaccctgcaccaaacaacttgttgaaaggaaagccctaaaggaatttagagagctacaggctctgataccttattttcccacatatccaggagtataatcgttgcactttccccatcaaccatcgggttcgttcatatgtatcttctagagaagaaagaacaaagatattggagtcaggcgaaatgcaacacttctccataagagggtcaggtagaaaattgtgctagaacataaacttactaatatgcaattaattatgtaagtatacagatattttcaaaggcaaattactattttttgcaccttcaacaacattctacatataattcctccagtccttatccagcagaacgtctctccgaacatgtgtcactaaaccacatggagtaaaaggcatttgtttgcatcattcctggacttttgtatggcaaaatcatttgtgaggataaacttactcaagagcttttgactcagattaatggttaatgctatgaggaaacattaaccacccagtgaaactgtaagccacattttcaaagtccattgtacctttcagtgggtagttactgaatactcactagcaatttcaggagcttgggctcagagacattgctcctcttcggacaagtgcaagaatgaatcttgagactctcctgttttggctgtagttttcttcctttttttaaaaaaaatgctgttccctaggaataagtggcttgtttttccatcttgagtataatagaaatgcagcctccagctctacttggtaatgaaactttcctccctgcacttgagcccagatcttgtgtaggtgaagggtgaacacagtacgtacaatgggccaaagcagttccagcctggaaaatccatggggggcaggcgtagaaaagggtacagtgggatttttgcaagtgggatttccctcatcccaataccattgagcccatcccactctattttcacaatgaggtttcctgttttgaatttcatcttttgaaaattatgacttcataatgatttatcatttttcttctgttctttttgtctagaatcttttccctcaaataccacaaggcctgtttccttacctccctctgggggaggtgcttcctggccatccatttaaattgcaacacttctatcccacaatattccttctctgctttatgtttctccatctcacttttgccacctaacatacaacacatttaacttacttattctattattttctgtccctcctgccctctcgtaatgttagggcagacatttgcatctatgctgtttactgtgtcccccagcaattggtacattgctggtgcacaataaagtttgtacagtgaacgaatgataaatatagcatgtggctgtgaaaacaagcaaacctgaattcaaatccaggtgccatcccttatgaactcgggggtctacgcaacttaggctctctgagcctcagttttcttcatctgtgcaatgggatgataatagtactcacaccttagggctatgtgacaattacctgtattaagcctgggcacaagtagaaactcagtcagtgttagccattatcacttcttcaggtgaaggaagctggttctgccatactcagcacttcctcactacagataaatcctagcttaagagagctacgttggaacagggcacttcttgttttacaatagcgagcagtttacgaaaaacactgctcctggtttatgcttcatcatctaagaattggaatcaggagaggtttcccttccttagagaaggaaaactggacaaataagaagagagttaaccaggcatggccctgtctttctgtgagtttccccactcccacagcgtcattcttctaatcagtaagtgtttgcccttggggaattaaaactctgttcgcccatcgtgtgcctgctcacaatatgcagaaggaatgagatcacagtgggactattggattaccaggggtagaacctcacaacctcaacctgtaaattagacaatgcaagggagatgtcagagcctgagcagcacagaacggggatggcctgactgctgcttcccaccacagggtcttagctcttctctaaaacccctccctgcactcagacaactccttcaatgatggaggactttctcagcccaccactcaggtacaggggactcgcttgagtgcccagtcattcaaataaaacatactgtgttccaatcgctgacggaaaaggaaaacccaactttctcctggcttaaagatatcagaacaagtctagagaaaaagtggactaaggatcacagccatgaaagtaaaacatgctttcccgttctagaagcttcctgacaggatcattctgtctgatcttacctttgctgaaaattacggtgttggaggcctgggaggctaaaacaatccatctcctccctgctcagacgtgtgctccccactttaccccccaccccagtacatgagtttagatacggcctctggcgtgtgcaccaggacccttccagcacacatggcatcccgactgaaggctctcccctaaccggtgcaagcctgggagtaaccagagctccaggtttctcttcatctaagttgctcagctctcttttatccttttcaagtgctaatcaggtgagaagaagggaaggaaaagaataccagatctaggagagctctttgaaatctgcttccagtaaaggtgtggagaaaggtttggatactattagtctctgtgaggcttttccgtaatctgggtctggagacacccctacttctccagtcactggaagaaagctggggtgtctgtgcacactctatgtagcaaaagaactcatgctgaggggacagacagacgttctataaggggtgatggtggtcagtagccactttctctagaccgtttgtctttcctcatttgatccccctgacagactctctccctgaccaaactttagtcagctcctctgaatcctcttctctacccggcctctccctgggcttccgtttccatcctggcgaattcagctttagcaagaatcctgctaagtcagtttagtgagaatcccccaccttcaaatctgatcaaattcctcacccaccacctctgatagtctaagtccttggcctgacttcagaagaatccccctaaccttgacgtctcctcttagtaattttccatcctctgaccccctccacctgctccttggcctgacttcagcaagaatccccctaaccttgacgtctcctcttagtattttctatcctctgaccccctcccacctgctccttggctaagtgcccacttgttcttctgtacttggaattgagccccatctctccccactattgggatgcctactgcaatggccctaataaagtcttccttaccatgttaataattttttcgttaacactccttgtgcttggaaggaggccccttctgcccaagactggctcaagtgctgtgtgtgtgtgaaacccgcccaagtttctctcactgccagaactgactcctgcagcacctctaaagttctgagactccagcatcctctccctgaaaactttcaactgcttccagctttcatagctcaggggatcccaaggaactcagaagaaatgcctgctctacaaatactgtcctctactctactggccccggtcccctcggacagctccacgggccccagccaacagtgaccaaagtggacaggggccacaagcaaggaaccaccacttttgaaagataagcacatcaaaaggaaatggtagattcagaatcagctcaactaatgctcatttcgtacttactatgtgccaggcaccatgctccatgctcaacatgtatatcctttaatcctcgtaacaccctatgaaggaggtattaccccaattacactaatgagcagcttgaggaggctaagtggcttgtccaagagcacccagccaagtcagtgtcagagcgcgtctaaacccatcatcaaaccccaagcccaatgagacttccgtactttgctatatattgtggtgtgccttcccacctagctcagggcttccaaatcctagttgtccctagggtccattcagagaccatctcttccatgaagcttttatttattttatttattttattttattttttttttattttattttatttcatttttgagatggagtttcacttttgttgcccaggctgggtgcaatggtgagatctcgactcactgcaatctccacctcccagattcaaatgactcgctgcctcagcctcctcagtagctgggattacaggcacatgccaccacgcccggctaatttttgtatttttagtagagatggggttttaccatgttggccaggctggtcttggactcctgcctcaggtgatccacctgcctcggcctcccaaagtgttgggattacaggcatgagccacatgccgggccaaccatgaagctcttaaatccacagtcagaggtaatcttttcgcctcggattcccacagcactctccttacaccactttcaagacatttaccacatcctatctcaattctacttggtgtatacattatgctccattgcatactgtgagcatctccgcagaagaagcccatgactctttgcatgtccccagagtgcctcaccaagctctgtgctatacattcagtaattcttaggaatgaatgaatgaattaatggcattcagtgtatacagagagtcataagattctgtagtgtaactgtaacaatatccatctttattaggagaaatcattatgagaatattagtcgattttttttcttacagtgaatgctgatttaaaaaaaaaaaaatgtaggggtgtgcttagaaaaccttcctcttgggaaacaaaaccaactagtgattccagcaggtcctacagatctctgtgtaagaagctagggaaaggattccctttctctcatgattgaacccaaatccttgtcttttcatggtcccctgcggccccaggatcagccatatgcctgatgcccaatgtgcgtcatattgggcatctctctctctctctctcaacaaagaagttcccaaaatatctgggaggctacctttccaaattccaggtatgagtcagtcttcttaacattttatgcctatgggatattaccctctggatacatacaactccattctaatggacaaacatttttgaaagtctacatccactaacttttttcaattcttccctcttaaaaacaaaaaacaactcccagtccatccttccttatgtcaacgcccaaagcactgtatcgttactgcttaaaatattagttaatgtaccctgctctgcaacatagcaactaacacttagctcattactagggggcatggtatacccatccatcgccttgtatcccagagcttaggccagagccaggtgtgtggctgatgcccaagtgctgtcatacttagtatttggaagctaaatcctggggctgcagggggctatgaaaagcacaggatttgggttcaatcacaactagatttgaatcctggtcataccatgtactagtttttcaccctgggaaagtcacttgactttgtaagcctccatttcttcacctgtcaaatagtatattaatgccagattgattcaagtattatcaaaaatatgtgtgggaagtatttaacaagtgcctggcacatagcaagttccccagaaatggtaaaatgaactgaactaagatgataaatcccaaattctaaatccaccttccttattgggtgattctggataaggcttttgatctcctgagacttagtttactcatgagtacaagaactttgtgaagaccaaaataaacagcagaaatataaggcacctaacaaagtgcctctcccgttgcaaacattcactctaaatgttagcccttcctcccgtttctctttcctagcaagtcacctggcagcctttacaaagaaagaggaatcaattgtacaacactggccctatttctccctttactcttctgagattccaggagtgggagagaaatcaatgttacaacaatgagtcattatttatagcccagttcctgagctgcccatgaggcagtgaactccttgacactgagacaatcaagaagaataaaacctccagatgaatgggctgtgggtagtgaggaataacattaatatgcatcaatgcaggggagaactgagtatcgctaagacacctccctactctgtgattcagttgtgagtcgcgacagaacacagacctgtgacttggggaaacactgagcagtgcttcctttatttctgtagctgcaaatagggactataactaccctggtcgcatacgctcagactgaagctgtggctgaaagacactttatggtggcattggctatcaggatcctcatattacttagcagaacatagggctgtgctttaccctagctgaagaatacatgcattttgagataatgtcacctcaaaacagttttggaaataggcaggctccaatcaataaatagatgaaattgtacagggaaaattgtcttgaaaagctgtcgactctatagaaagtttcattgttatacttcacattttaaaaaattattatgctatttcaatacagattttgaactatttaacacccacaaaactttctaatattggtggaagcaaacgatcaagccatcctaacagcttttccaactggcttgttttaggtataaccatggaaaaagctgtgtctatactgagttccgggaagaatgttcaagtcagagtcagcagaagtcaagtgggcgctgaccctctggctctgccctctctaatcagccttccccaacccatttagaattgaatctgaagaattccctttctggcccaggatcaacagattttggtcctgtctacaagcttttcattttcttgcccgaaagcctgtgcttgggcttttctagagactcagctcccccacaattgtccaaaatgcctaacttcagctcccaactctgtgggtaaataagtcacccacctcactctttcttcctgggccacccctggtggaaagaagcccactggggctgggacacctcctcccagcacctcgcagtcgctgtccatgctgtcatgcacacctgcaaagatgttggcagagtggacttgcccaccccctgctcccctatgagcaccactcggtagtaggtgttcccgactcagaggagatgactgagtctgtggagtcagaggaccagcttcggcggcagtggtctcaggggtagcagaatggcggttgcggtggctgtactggtggggctctttctggaccatagatgcctgccatcagctgggatgctccagcgctgctgctgtggctgcatgcccacagtccctggcgcatggtgacattattcagagtcatcgttgagtcctggggagcaaagcagccagatggcagcattagtaagcatgagtgagagctccgctcaaatacatggtcagtcatcataatattttattagatgagatgagaagcaagtatccctaacataaagaccaccaattaacagtcccccaaaccccaacaagacaggctttcaactggacacacacatgctgcccacacgtcagtaaccagctcctcaggcagactatcatttgcatgggaaaacaaatacggttaactcacccactgcccatgggcttcccccttcctcaaagcagacttggatgaaagaagagctcactcagagctggcacaaaggcagctggaaagaaccagcagactccaaagatggcttgaaagcaacaagttaatgttgctggggaccagctggtcaggttagctgctcttgtctaaactggctcttaattgcaccagtgtccagcaggttttgtgcctcagtgggaaacacgtggcatgacatcaccctcccctcccctgcccactgcaaccctggctggactggacaggcacttatggaacttccatgtttagtaaagttgccttgatgctctccagctgcctggagagcatcccctgccattattgggggtaggggggaaattttctgtttaaagtttatgcctcagctgtgcctcttacccacagataccacttttaaaacatcccggctccaaacctagacaccctggcgagaaatgacctgctcatgttcagacctatgaaatttgcagagaaagtgcctcattcttaaaaaccacatccattctcaagagttctttaattcaactcagattccttttttgagtcaggtcttgctctgtcacccaggctggagtgcagtggcacgatcatagctcactgtagctacctccaactgccaggctcaagagatcctccacttcagcctcccaagtagctgggactacgacctgcactaccacgtccactagtttttttatttttatttttattttttggtagagacgtggtctcactaggttgcccaggctggtctcgaactcctggggtcaagtgatcctccggctcggcttccgaaagtgctgagatcacaggcctgagccaccattctcagatccccttctgaagcaaatcagaaggctgaagactcccctaaatgatattcaacaacttctctacaacttccctttgcagactgcctcccctagccgggaggtctgtttttccggctactggtgacaagtataagtacttacgttgcaatcagcaagatgcacaaacactcctctcccaccctcaccccacactccgtaccccaacatctcgccactaaccaggacgaccagccggttttttagtccaaaagcagcacctcagttggcagacttacattcaaacaacaaatacataaagcatcataagggctgccctctctgaccactcgatctgtagagggaggtgacccttctaccgaattgactaaggaacctgctgatgagaagcgacatcctttgcacttgaagctctgacccctaccgaaaatcccagtgctgagcgcacgttccaggggttctcttctcaacttcgaaagttctggggctgggaaactcccactctctcccttctccgtctcgggccgtcccccttacttggctggccggatcggcgtcggggcgtcagcgtatcgcgtgggtccgcgctgggatacccgggcaacgagcggggagtgctgcgctgtgcccgccgtccttgcccgccgcctgcagccgccgcgccgggcggtttataaccagcccagccgacccgccgcggggcttttccgtgacgtcagccccccgccgggagggggcggctctgcagcaaactcggagttgcagccacttggctaaatagttactcgcagtcatgtgaccccttctctctccatttaaaaaataatgacagttcaatctgggcctcctttattttgttttattttctttttaccagatgaacacaggaaaatggaaaatacactaagtgacacttaatcctccttcccagcaaagcacttgcgagctgtcgggataaggatggaagggagaggcaggtttgagttgagaactcagttttgccaagaaaacagagtcaacctggaatgcgcagagactttagcctccaggatgagactgcagccaccttgaataccaaggcttgttttaaccacatcttctgcaacgaagacagccttgtcaccttcttctggtagggggaagcagatggagccccacaaggctttgtttcccttctctggcaaggacccaggagaaggggccagaaagaggtgaggaaagaggacaagaccttgaaaagggcagtttggaaaacaatttaattgaggatccaagcagattgtgctaaatattgctggccctcctgctctggccagaatgctgaggctcctcaatcagggaatttaatcagcatcccaatcagcagcattctgtaccaggctccctggcaaggctacgccttgggcatgagccaatacagcctggccaggggaggagcactgagaccaacacccctgtaagagactcctgtgaacaaagggcacaggtaataactactactaccatttattaagtacctctgaggacctctgcttagtaggtactgtaggcctcctgggaccttaatccttactatacttctgcaaggtggctctatttctaccccattgtatggaggaggaagataacatagggccagagaatttgcccaaggtcacaccgctgtataagtggcagggtcaggactcaaagcctggttttcctgagtctctgcactgcaccacaagtgaaggatttcaatgacctctttctggggacatgggtatttcccagatgctgtgttagagatgatgctggcctctccaacatatctgcttttccagccagcttcaactctgggtggctggtggctccgggaagcagccaaaggcaccagcatctattgaagcagctggactctctgtgattagagtcaattcacagttatcctgcaggcatttatctgctttgagaattagcacatgaccagctgctgagacctgccaggtcccaagctagcaaaggtggaatccgtagagaatgaaaacttagaattcctttagtctcaggtgttgtggccccaatctcctacttatctatacataagaaacctgagacccagagaggagatgaccgcttaggacatgacagaactggactacaacctggggatcataattctctggatgccctttgcttctgtcaagtttttcttcgggtttcgctgacaggaagtggctacagatgtggggaaaggaaaaggagaggagatgggggtgggggagatcatctccaagagtatatcactgactccattctaaaacacatgtaattatgaataatccatgtttcaaaatgatccatgctttttccatactgacactcctactctgcaactggtctcaacagaaacatcataggagtaaaaactaagaagaaatcagtttataagatatgatatagttcctcagttctacttttgccgattgataagaatctaatacttcacattataaaaacctaattctggccaggcacagtggctcacgcctttaatcctagcactttggaggctgaggtgggtggatcacgaggtcaggagttcaagaccagcctggccaacgtaatgaaccctgtctctactaaaaatacaaaaaaatagccgggcatggtggtggatgcctgtaacccagctactcaggaggctgaggcgggagaatcgcttgaacctgggaggcagaggttgcgtgagccgagatcgtgccattgcactccagcctgggcgacacagcaagactccatctcaaacaaacaaacaaaacaaaacaaaaaaaaactaattccatacctaggcaatatctactagaactatttgtcattggtatatgtgaaacatacaaaagaaaatgaactccagggactgggaaagggaaggggcacacagcaatgttgtgtttggataatagaacaatttttaaatttttaaattgtctgtctcacaagaagccacatgaacacaaagaagaacactacttaagaagatcttgactaaaagttaagtttgagtaattatttagagaaaaatcatagttatacttcacaaaagcacatctgagcgccaaatctcatctagccaagtctcagatccctcgaccgggatccagctcactgggatcatcttgagggtgtggagctggagagaaaaggtagaatcagggctttgggtaagtggcaagttttgaagaggaaaaattggcagaaagttgtcttttgttctagaattattctctccatattctttctgccagcatttgaaggcttcctcagtttctagctaaatgagtagctcaagagtatagcaaagaggcagaattcaaagcaacaaaaataactcactttacttaccaaaatgcatgcctatctcagctaatccgcatcacccctacagttacccaattctatggggaaaggtgctgaggaatgagggttaaataaccagcccagggtcacagggggttaggtggcagatgtgtactctctggggccacagtcttaactgctgttctatttagataggggatatacgtcagtcctcattcccatactagccccaccttggcctaccaccttccaaaaccctcaaaggagaagtttttgtctgattggccaaagcccatgaccttcactgggcacctgttcctagtgggccgagttactctacttaaaggcatgagccatcctttcctctctttttctccacatccctgccctagggcagaaggtgaagttggggtctgtttggggactctcctactactctgccactgtcactgtcacttagcatgtagacttgagcaaccagttcccagatttcaaataggatgagaaaggaaggaaagacgtagggaaagaataggacctttgaccgggttgtaaataagggcatctgggacttgcacagacattaagataatattactttgaatccatgtcttgaaaactctaagagaggagagatgatgggtaggctcaggatctgtacatgctgggtccattatactattctaaaagctgtaattctattctaaaagcaacagaatctaaagcaacagaatcatctatactatagacttactacaaccaaggtcatgcttgcccaagcctcaagtaaatgctactcagtggtaaaggggacaccatgcaaacgttctccctttcccaaaaggaggtagattatagactaaacactgagtaagaaataaattaaatgggttttttcctttattttttaaatgtttctttttttctttctttcttttttttgtatgttttttgagagaagaatcttgctatgttgcccaggctggcctcaccactcccaggctcaagtgatcctccacttcagcctcctgagttactgggactataggtgctgggctctgttttgcattttaatgctttaggcaaagcatgccggccagtttcccacaatccttactaatccttaatatattctatccaagcagtttcatttatactatctacctggcccctaaaggcatttgactttgggatcttgcctgggctgaaagaaatggtaggggatttaacatcagaaaaggaggttcaaatccagcctttcctcttatgcatgtgatgctggggatgtcaccaagccccagaggccttggctttgctgttctgaggactaaagagctatggaatgtggaagtgcttgttaaccacggagcacatgtcaataagagtgattatgattatgacgcaggagccaaggattgaagcttagccaccgccctcggttttgctgcctcttaaggctccagctaaattaatccagcagaattcaagaccatggggtggagggaggatgggcgagaaatatgctcatattagatgttactaggaaaattcattagcaaggaggttgttgtaaacaagaagatggaggccaaatacccagcacacatctaggtctccaccagccacaaaaacattcaggggaggagctgggtgggaagcaatttgcaagtgtctgagcacaaaaagaaccacccaccaactttgggaagtctaaagaaggaaagaatactatatggaaaatcattgctttagagaagggggataaaaaagccttcaatcgcaaatcaagagaggcctgattacaagaaaataaagacagaagaaaagatggctaagaataacgttcagcatccagaggcctgcgagatccagatggacagcccctccagctgcatcctccccaaccagcccccagcttctcatcagactcctgctgagcagattgaattttccattgaaaaattcttagctatcacccctccttccctccattggcccagcctgctgcaggcctggagagtccagtggcagagatagctagagcccttccttctaaaagcttgcagagtaagtgcagaattatcttagtaggctgggaggagcctcctaaagaaagcaaatgttttcttcccaggctcctccatccatccacattcattcattaaacaacagataactactgagaatctacgttatgtaagacctgttctaagggttaagaatatgatccttacattcacagaacttctactctggtggagaaataataaataaagaaataaagtatcaccatgttcagtcattcatgcactcatttttctctgagcatgcgaccctttagcctccattttctcatctgcaaatagggaatgatatactgaaaggaagtataaagtagggattaagggcatacccattcagaggtctgacaacaccaggtcagtgaaaatgtaaagaatggaagctctcatgcccagcaggtgggagtgtaagtcgtaaggccactttggaaatcaactatcaacacctaagatgtgcatatcctttgagatcagcaattccacttctaaatgtacatcttatatgttacagaaaaaacaaatacaaggatctcatgaaagcactgtttgcaatagcaacaatcagaaaccaactaatggccatcaatgataaatgcattgtggtatatttacacaatgaaatagtatacagcactgaaaatggatgaatagatctacttgtatcaacagaagtaaatgttgagaccatatggtaacttgaagaagcaattgcaggatatcaacagggtaatacactatataatttttacataccacactagtgtttatggttaaatacacagttagtaaaaggatagaaacgaggatgagaaaaatagacatcaattcagaatagaattatctcaagtgaaggaggggaatgacaattagatggacagaagactctcaaaaacaaccgagaagccaggaaatacttgcataataagatgaaagtgctcagtgaaataattgttaatgtggaattttatgcccaactaaactgtagttcaacaatgtgagctaacaggtcaggtgcagtggctcacacctataatcccagcactttgggaggccgaggcgggagatcacttgaggtcaggagttcaaaaccagcctggtcaacatggtgaaactctacctcacaaaaaaataca

SEQ ID NO: 5039 - DNA, 39762 bp, Homo sapiens
catggtggtgggcacctttaatcccagctactcaggaggctgaggcagggagaatggctgagcccgggaggcggaggttgcagtgagctgagatcacgccactgtactccagcctggggacagagtgaaactccatctcaaaaagaaaagaaaagaaaagtgaggctcagagaagcgagtgacttgtagcagatatgtgacctcagccctccctccagctgcctccacacgggcaggccggggcctctcttacctgctttctccccttctcggtccagcaagtgctctcagaagagagattgacgagaacttcaaggccctcttcaggcagctggcaggggaggtaggttggggatggcaggttgggaggggcctgtgaggggcagccctctcctggggcaggtgccacctccctctctccccaggacatggagatcagcgtgaaggagttgcggacaatcctcaataggatatcagcaaacgtgagtccccgcggggctgtcccaccaccccaccatttcttccacatcaaatccaggctcctgctcacacattgagctgaacctcatcccttggtctgcatgagtcgggaatcctccagtttttctgagcccagttccctgccatttccatcccatactcctcctccgacctgccatcctgataatccctgtgctcgggtgctgtgcctttgtgggattagcagcgagcctggccaggcacagtggctcacacctgtagtcccaacactctgggaggccgaggcagagtcgcttcagcccaggagttcaacaccagcctggacaatatggagagaccctgtctcgcaaaaaagtacaaaaattagctgggcgtggtggcatgcacctatagtcccagctactcggaggctgagttgggaggatggcttgagaccagggaggttaaggctgcagtgagctgtgtcacatcagtgcactccagcctgggcaacagagcaagaccctgtctcaaaaaaaaaagcggagcagcaccttagtgccaaagaaaagtctacctttcctcccagagcctcctgggccagctgagtggcttggggaacaccacgtgactggcttcactccccagggcagacaactgctgcctctcatcccctcccctcccctttgctgccactgacctccatccacacggtttccttagcagagcttttctcctcctcttctctgctagtgaagcactgcttaccctcctagcctaagcaagccctgccctgccccatctttctacccaatttctcgctcttctgtttcacactctttctttttactttggactaattgtggctgttgggactttggcttgattgctaaaatacttacttgtacttcctgatgatacaaacaatcctgcccacttcctctgccagatattgcaccactcgtcaggatttgtgcgtccttgactctgccccacccagtgctcccagcaggggcggtgcaggaagctcactaggtggagatgttggaattggtttttcttgcagacaaagaccgcggaccaagggcttcagcctagagtcgtgccgcagcatggtgaacctcatggatgtatcttccgtttgcttttgtctcctgagtggggttttgggtggaggtatcggtgctgggagactgtcccaggacagcacagagaacaggacagagccatgcggagtgtggacacacagtgcccatgctcagatgtctccctggacgtcttcctgttggttgggagggagaaactgaggcaagacctgtgtcaagtgaaaggtggagcaagacctgggtccccattgaccctgaggctgggctatttctgacccctccccagcccactccactgcagcccagctcagagaataaggcaacccggctgtgggctgactgtacatggcttttgctgcttctcctcacccagccccaagtcacttgccggctcggcggccatctccccttctgcacagttgcccactctcccatgactggctaagtgatggaatttccttcttaacggccacccagcgtgatggcaatgggaagctgggctggtggagttcaacatcctgtggaaccgcatccggaattacctggtaggttgtccccatcacctcagtcatgcaggtgcgggccgggcaggtgggaagggccgggtgactcagcctgccctcaccctctgccgccacctcagtccatcttccggaagtttgacctggacaagtcggcagcatgagtgcctacgagatgcggatggccattgagtcggcaggtgagactccaaggcgacggcacctgtggggcccaggacaggtagccccactgctcctatgccccaggcccttgccctggggtgctagtggtgacatggtaacagccatcttgtccttttccccacggttactgcaccctgcctagccccagccccctcctggggacccaacccctcccccatcctgttgggaggggctgcgcctcactgaccttcactcactctcctggaccaggcttcaagctcaacaaaagctgtacgagctcatcatcacccgctactcggagcccgacctggcggtcgactttgaaatttcgtttgctgcctggtgcggctagagaccatgttccgtgagtgtccccaactgcccccaccctccagctccgtcccaaacgcgtcccccaggagctggggggaatgacagatggtgaattagcagatacaggccagtgctgtgggtgtgtgccagagaggcctgggtctgggttggggggccctggctgagtgccaggagagtcggggagggagggagttgacagtggcttccaggcagcaggaaggggtgaagcttcccagcttcaaggggtgtcagcttgcggtactgtgggaggtagagagggaccaggcaggaagggggccaggcctggccctgcgtgaatatcccctgagttttcagccctgtatcaccttttcttgaacacacaggatttttcaaaactctggcacagatctggatggagttgtgacctttgacttgtttaaggtgggaacctccctgggccatggttggggaagagttccaggcgatcgaattttcttatctggccagtgttccctgtccttcctggaaatgagcctgggcctcagagccaaccctgaagcccgggccacctgaatcctaaaggctggggtgggggtgtctggattctgggaaaggagcaggaggggaggtccaggccttggaggcccctatgggagcagcactctggtttcccaggggtggaggaggtaagaaagtacccctccatgaggttcctgaggtggctcctgagacgtggagttgggggctggacctgggtttgggtggggaagaagccagggagccatttctgcggccccagctgacctgcctgttccccgcagtggttgcagctgaccatgtttgcatgaggcagggactcggtcccccttgccggctcccctccctcctcgtctgccaagcctcgcctcctaccacaccacaccaggccacccagctgcaagtgccttccttggagcagagaggcagcctcgtcctcctgtcccctctcctccagccaccatcgttcatctgctccgggcagaactgtgtggcccctgcctgtgccagccagggctcgggatggactccctgggccccacccattgccaagccaggaaggcagctttcgctgttcctgcctcgggacagccccgggtttccccagcatcctgatgtgtcccctctcccccttcagaggccacccactcagcaccaccggcctggccttgcctgcagactataaactataccactagctcgacacagtctgcagtccaggcgtgtggagccgcctcccggctcggggagccccggggctgggaacgcctgtgccttcctgcgccgaagccaacgccccctctgtcctccctggccctgctgccgaccaggagctgcccagcctgtgggcggtcggccttccctcctcgctccttttttatattagtgattttaaaggggactcttcagggacttgtgtactggtttgggggtgccagaggcactaggcttggggtggggaggtcccgtgttccatatagaggaacccaaataataaaaggccccacatctgtctgtgatgtgtttctccccagcctactgcctgagggcacctgcaggccccggcccatgggggcagctcgtggcctcagctcacccctccctccaacccctccatctccttccccttgaccttgaagcttgaacccctactggagtactggtatctgggcaagaccacccctggccctgggaggttgggaaggaggggccctagctgcaggacagggccacacagctgaggtcccacatggctctgctgatcctacatgccctccccgcgcccaggaggcctgacccctacctttcttgcacacttcggcccgttgaggtgaggctcggctgaaattcaaacctctacttagcacacacccggccccccagagagctcccccgagccagagccgccttcaggtccctctgtggggagcccctgtgacccagacacctgcacttactaagccgctccagggcctgctgggatctgggattttcttaccagagataagagtggtttggggaaggaagaggggatggggcgaagctgcaaatgcagagcagaggccgaggtggggggggtgggagttggctgctgtcagctgctgtgggccccagcgttggggtggagatggaggggaggcccctgtgtgccccatggggaaggctgcccgcacactgctatcttgagcttgcgtttgcccttgtcacctcctcactgggagtccaggtcctgttgggctcagagtcttcagcgtgagggcagtggctcagctcttcctgcagcttgggctggtgtgtgaggggctggagggaggagggtctgcagggccctgccatcttgctcaaacccttacttgctctctggattgggtttatttgatgtggggatgggaacaccacgtctggatgacctgggaccctaacctctcaaaactctgagtcactgaggtagaggtgggaagagcagggcttcttcctgactgccctattgggctttcttgctttgtttctttccttcctttctttctttctgatggagtttctctctgttgcccaggctggagtgcagtagcgtgatctcggctcactgtaacctccacctcccggttcaagcgagtctcctgcctcagcctcccaagcagctgggattacaggtgcccgccacctgcctggctaacttttgtatttttagtagagagagggtttcaccatgttggccaggctgtctagaactcctgacctcaggtgatcagcctgccttggcctcccaaagtgccaggattaaggcatgagccactgcacctggcctatttgggcattttaaaagggctttttcccacgtgcacctgtgcagccaagtccctgctttctcgggaagtgggggaagggtaagcagctgtaacactgcatcccattattctgaactctcagcacttaaggctccagctgtgatttggagccagagacagggactgtgtcccatgtgccaaagccagaatcggggctcccgaacatgcctcgtgtcctctggaggaaagggaaggtgatggtgctccattcactgctggggtcctgtcgggagggcagtgggcagggcggccagacctgcggatatgggtggtaggctgtgactcagcctcggggtgagagatggagagagctagagaaagggcatgggggaggggagccctgcagattggggacacctgaaccctcctatggggtgtaacctgagccctccgacacagggtgcacagatgtctgcagtcctcacccctggcctgttcctccccctcccagggcccctcccggccttctacataaagccgggggtactgggcctcaggtcaggcctatggccatggccttcacagcctgctggatgctctgggcagcatgggccgcttccagctcaaccacacagccctgctgcgctgccctgcggcctgctggcctgccacaacttcctgcagaacttcacggccgctgtcccccccaccactgccggggccctgccaaccacactgaggcctccaccaacgactcgggggctggctgagggccaccatacccctggaccagcttggggcccctgagccctgccggcgctcaccaagcctcagtgggccctgctgagccccaactcctccatcccgggcgcggccacgggggctgcaaggacggctgggtctataaccgcagtgttttcccgtccaccatcgtgatggggtcagaaggggctgggtgtgtgggggggctgctgccgaggcccagtctgaagcgcccagtcttccctgcagtgggatctggtgtgtgaggcccgcactctccgagacctggcgcagtcgtctacatggccggggtgctggtgggggctgccgtgtttggcagcttggcagacaggtagcccgtggggataagggccccagccacccagtgcgggccagaaagcctaggcctctgcttcatttttctttgttacagttgatttgtgcattttaaacagataatacatatagtacatcacatggtttcaaatcccgaaaggcacagaagagtctgccggggatcacccctttcctctctgcccctccttgcagtaatccccagagggcagcctgctttctatgccttttaccaggacattttatgattctatgcagtcaagcaagtgggtgtatatgttccattcccccattttcttttcctgttttgtatttgttttcttcttcatgtgcccccatttttttctttgagataggtctcactatgttggccaggctggtctcaaacttctacggtcaagcagttctcctgctctgtctcccaagtagctgaggtgacaggcctggtcatcctttttttgtgcaaatgctgcatacaccccacgtggtcctgcacccggctttttcttcgctttggaggcctctcctattcttcagaaagagctgtcccattcctcctagtctttacactacatcccactgtatgaatggccctaacttgttccccgttattttttagaggtgaggtctcactctgtcacccaggctgagggcagtggtacaaacatagctctctgcagcttcaaccttctgagctcaagtgatcctctgcttcagcctccccagtagctgggactacaggcacgcaccaccgcacccagctaataaaaaaaaattatttttagtagagatcggggggtgggggtgggggggggtgtctcactatttgcccaggctggtctcgaactcctgggctcaagcaatcctcctccctctacctcctaagtgctgggattacaggtgtgagcactgcacctaactgacccctattgacagacgatgtgagccagctcatggctctgaagttggctcctacgtctctctctctgcacctctttcccctcctcctcttcgctctctctcccctctcccttctcctctgcccttcttctctcagttcagtttggggggccctcccggactccaccccacactctggagtgtagatggctccctgtgcccacacctcaggccctcatcacaccgtgtcatgatacaccctggtctttctacatgtgagttgtgtcttatccagaatgtcttgtttgtcaccaaccctcaactcaggcctgtcacttaaggtgattaatgatcaatgaacattgtgtcacaatgaatgagtgaatgaaagaatgcataagaaatgaagaaacgagtgagtgagtgagtgagcaggcgagtgagtgggcgagcgagtagtgggcagatgagtgagtgagtggactagtgagtgagtgagtgagccggtgactgagcagtgagcgggtgagtgactgagtgagcgggtgggcgagcgagtgagcgggtgggcgagcagtgagcgggtgagcaagcgagtgggtggataagcgggtgagtgggcgagtgagcgggtagcgagtgagtgggcggatgagtgagtgggtgagtgagtgggagagtgagtgggtggatagtgagtgggcgagtgagtgggtgggtgagtgagtgggtgggtgggtgagtgggcggatagtgagtgggcgagtgagtgagtggatgagtgagtgggtgggtgatgagtgggtgatcggcgagtgagcgagtgagtggatgagtgagtgggtgggtgagtgagtgggtgagcgagcggtgagcgagtgagtcagtgagtgagtggatgagtgagtgagtgggtgggtgaatggatagtgagtgggtgggtgggtgggtgagtggatgagtgagtgagtgagtgggtgcgtgagtggtgagcgagcgagtgagcaagtgagtcagtgagtgagtgaatgagtgggtgggtgggtggtgggtgggtgggtgagtgggtgggtgaatgagtgggtgggtgggtgggtgagtgagtggtgagtgggtgggtggctcggtgggtgagtgagtgagtgcatgagtgagcgagtgagtcgtgagtgagtgagtgagtgggtgggtgaatgagtgagtaggtgggtgggtgagtgggtggtgagtgagtgcgtgggtgggtgagtgagtgcgtgggtgggtgagtgagtgggtgggtggtgggtgagtgagcgagtgagcgagtgagtcagtgagtgagtggatgagtgagtgggtggtgagtggatgggtgagtgggtgggtgggtgagtgagtgggtgggtgggtaggtgagtggtgggtgagtgggtgggtgagtgggtgggtgggtgagtgagtgggtgggtgagtgggtggtgagtgagtgggtgggtgggtaagtgagtgggtgggttggtgggtgggcgagtgagtggtgggtgggtgagtgagtgggcgagcaagcgagtgggtcatggagtgtgtggagaagaaagctgcctgtcttcttggcctgcttccctgctggccaagttgaggctgtgcgctctggcctggaccctcatttgcaaacagggcagatcaccctgccatcctgtccttgggcccctcttggcatggcaaccctctggtccacataatgactccaccctggctcctgctcccacaccaggactggccaagggctcacccgctgtgagttctggttcgaggcctccctccagccacagagtgctcaggtgacctctccccacctgccacacgcccctctggggctttgcagaatcccgcctttcctcgagcccggactaaatctcctcgccagcttccttctacactatgtccctcgtctgtgaccaacctctgccacgaagcctgggtcccagcagtttcaagtttctgttttgaagggtggctttcgcggggtaccccatcttccccgggactgccttgataatcccctgctgggtgaaaggggcaggcgtgggctgcccatttgttccttgggggatgctgctgctgcctccaaaaccctaatgcctgtgcccattctctggactcaggctgggctgcaagggccccctgtctggtcctacctgcagctggcagcttcgggggccgccacagcgtatttcagctccttagtgcctattgcgtcttccggttcctgatgggcatgaccttctctggcatcatcctcaatccgtctccctggtgagtccagccgaggagaggccaggaagggcgggggctcctgaaaggcagggcgggggcggggggacaggggggtggcaacgtcgagggtcatcggacatttttccatgttgttttgttgggattctcatccagcaacctcaactcaaagcctcccgccagagtctggacctgggggacctgggctcccgggtagtggtggccctgctggctgtgggtggggatccctggatggcctttcccaggtctgggctttagtgtactcatctgtaaattgagagggtaggtttattttatttgtgaattagccaacaataaccacttactaagcacctattgtctcaggcttagtgtggggacacagaggccactgggacacaggagaggagtgagccatgatgtccccagggcagcagccagccctgaaattgtatgactctatgaaggctggtgattcctcgcttcatggtggagacctggctcctggatgccagcttggagtgttgcgcccccaagtgaaagtggcaggctcagtcctcactctaggctggttctgggcagcccctgggtggtcctagagaaagcatcacggggcagaaggaagcccacccaggacacaggcctgccacctacctattttcattttaactacttagcttgctcctggggacaccactgggcacggaaactgctgccccatcagctgtgcaaagacaggatggatcttttatatcaggggtcaggaagaaatcttggaccagagaaccaggacacctgacctcccctccctctcccagcacacagcgggatctcaccaatcccagcctacacagctcactctgcagggtgggcatccagccatggcttgaaacagtgtctgaggtccacctcgtgctggaatgggctctaacacctacacagacacatacagaacacacagacacatacagacacacatacacacgcatcagagactgcccagcctcttaaccttcctgaggctggagaggccgggcactgtctggggacatctccgcctgtaaagacgacttgtagagattccatcgagtgccctggagctcccaccacaggccatgccctgcctcgggcccaccgcacaagtgtggtgaccctccatacatatatgcctcccctcatgtttgttcctcgcacactgttctgtatcttgattctttcacttaaccaagctgtcactggtccactgccgatagagagcctcctagtgccaggagaggctctagaggttgcggtgaacacagccctgcccttggagtccatgttctagcgaggcgagatatcaccagcatgcataacgaatcgtatatatgttcgaagacagtaagtgctacagaggaaaaccgaagcctggaaaggggataagaaggccgggttggccaggcgcagtgactcatgcctgtaatcccagcactttgggaggccaagcgggcagatcgcctgaggtcaggagtttgagaccagcctggccaacatggtgaaacccgtctctactacaaatacaattagcccgagcatggtggcgggcgcctgtaatcccagctatcgggaggctgaggcaagagaattgcttgacccgggaggtggaggttgctgtgagccgaatcgcaccactgcactccagcctgggtgatggagtgagattctgcctcaacaaaacaaaaaacaaaaaatcccacaaagaatggccaggttggaggggaggggtctgcagttttaattgcgtggtttgggaaagactcactgaaaaggggtcattttgagcaaaactggaaggagttagggaatgagccctgcaggtttctggggtagaacattccaggcagagggaactgccaggagaggccctgcaggggaaagtgtgcccagggtgaagagcaaggagggccctgtggctgagcagagttgggaggtgggcgacaggtgaggtcggggagggcagttctgcaggaccctgttccagcgttctaggacttcagctttgtctctgaatgagacaagagccaccggaggatttgaccagggagagacctgatctgatttaggatttgagatctgataagatctatgtggctgcatgtgacaccaggacggaagcagggaggccggttaaggggctgctgctgtcatcaagcagagaccaggttgaactgggccacggtggcagcagcagaggcagtgaggagagcttagatctggcttaattctgaaggatttgctgaaggactggacgcacaggcttcttgcccattggaagaagcttcctcattaatttgttacagctgcctcgtaagggtgtgtcatcattacttaccagtcccctacagatggacattcaggttgttccaagttttgctatttataaaaattatattttctgtctttgcatggggttgagcacctctgcccattttccttttagcttgttggcgttttctaattgatttgtgaaaactctttcagtattagggaaattagtctttctttctctttctttctttttttattttttgagacagagtctttagctctgtcgcccaggctggaggtagtggtccaattcatttcagctcactgcaaccttcgcctcccaggttcaagcgattctgtgcctcagccactcgagtagctgggattacaggcacacaacaccatgcccggctaattttgtatttttagtagagacggggtttcgccatgttgtccaggcttgtctcaaacacctactcaagtgacccgcccgactcagcctcccaacgtgctgggattacaggagtgagccccgcgcccagcccaaaattagtcctttatctgctagttgggttacaactatatttttacatttttgttgacgttatggcttgacttacggtgttttgttttgttttattccaatgcggacttttttatttttacgactccaagtttgtcaacctccccttttattgcctctgggttttggactttcttggaaaagcctttccctactctaagattataaaataatctaccatgatttctctggcattgttgtggttttattgtttattgagttctttgatccacttagaatttatctgagtgcagtagggacacctttgcctgtgtctcagagggtctctggaatgagtttaagtgtcagaatcataagggggggtgtggtgaattaaccacatgggtagctgaatgccgctgaagtcactgttttctccccagttgtggagtggatgcccacacggggccggactgtggcgggattttgctggggtattccttcaccctgggccagctcatcctggctggggtagcctacctattcgcccctggcggtgcctgcagtttgccatctctgctcctttcctgatctttttccttattcttggtatgtcctgaacagagtggggtgggggagggtgcacctgtgtggccgagtttcacctggccctgtgagaggttggggtgtgcagtgaccggggcttgctggacttgacagggacacaaaggatggcaggcgttcatggaggctgcaagctctcaagtcctcacgaatgctactgggacgctctggtaaaatcccttgcattagtgtggggccctggaacgtcccaaggcttttgccttcatcaactccttcgcatccctcaacacttcataagtactctaagtgctataaagttataagaatataactggggcatatataagagggtaatgaagcacagcccagaagggcccatgactcacacaaggccacacagctggggtcagaaccagattcaaaaccgggctgggataggtgtggtggctcacgtctgtaatcccagcactttgggaggctgaggtgggagatcacttgaggtcaggagttcgagaccagcctggccaacatggtgaaaccccatctcacaaaaaaaataattaaataaataaaataaaattagccaggcatggtggtgggtgcttgaatcccagctactcgggaggctgaggtaggcgaatcacttgaatctgggaggcagaagtgcaatgagccgagattgctccactgtgctccagcctgggcgacagagtgagacttggtcaaaaaaaaaaaaaaaaaaaaaatgccacgggtctgttgaaatcctaagtcctctgtagtttgtttttttttttttggttttttttttgttttgagatggagtttccctctgttacccagctggagtgcagtggcgcgatctcggctctgcaacctccacctcccaggttcaagcgatctcctgtctcagcctcctcctgagtagctgtgattacaggcacacaccaccatgcccggtagttgttttgtatttttagtagagatggggtttcattatgttggccaggctggtctcaactcctgacctcaggtgatccaccctcctgggcctcccaaagtgctgggattacaggcggagccaccgtgcctggccaagtcctctgtagtctttaaatactgttcagtgagtctctgatgatgtactgcaaaaaaagggaagctggcatggcccccagacttcctgatgctacagaaggaggacaggtcatcttttttgggtctgaaagaaggtagacaagggggtattgggtttgggaatagaatgagctctacccagccccagatccttcttcctcctctcggtcccaggtgcttccagagtcatcccgctggctcctcctgcatggcaagtcccagttagctgtacagaactgcagaaggtggctgcaatgaacgggaggaagcaggaaggggaaaggctgaccaaggagtaagcgagctgggaggaaggaagggtgggaacagtcttcagtcttgctggcaacctccgttgtactagaatttagcaacttcccaggactcacgtgccatccaggtgtagacattggaataaacaggacaggcagagttctcatgtgcgaaagatgttgtttaggtattgaatgatgtgtgatttaggataaataatttaactgctttgctcatcagtcaatccacctttgtaataggaaataaccctattaaccttgacatccagttgaaattttaataaaataataaactaaattattaaaatagcaaccacacagtaaaattactggggaatcaataacaaaagcaccatataaataccatttattataagatagttaccatttattatcaataagcatcatttctcaaccccatgccgggcactaggctgagagctttatgtatgtaatctcatttcatgtctcattttgacaaagaggaaattgaagtggggacaggacgggtaacttgcctgagaacacacagtggaagtggcagaaccacttggaacccctgctcttatctgactcaatctccgagtctatacaggaatggggtgggaggccctccagaaccgcagaacctcagtagtgttggagttcgtgtggagcttctcaacaccctggaaacagtgtgttggcacttctcaacacccctcaagtgcatcagtccttggacggagcggagacaagggccagccacctcaccaaagacctcaaccccgctctcctccacacagacgaaggggttcccagcagggatgtggggtccgagctccctcgtttccctgagcagagtcttcttacctaggtgatgagctcctacatccaaagcgagtttgaagtgtctgcacctccaactcaatcttggacctcttccgaaccccggccatccgcaaggcacatgctgtctcatggtgatttggtaggtgacaggctcatgcccaagactttcacctgggcaggggcatgctctctgcccccactgaaaaactctgttctgaaatactcttaatgcatgagcaggtgagccgtgtgaactcaatctcttcccacaccctttttccagcactcggccctgctggatgctgagatgtggtgacagatgagatatcatgctaacccaggaaccccactctgggcagtgggtctcacctgggtgggaggactattggaatcaccaaggcagcttttccgaatgtaatttgtcccatcctgatatgccctttgggctggctctccagtggattctgggagtgtcgcactctggaaaaaacacttctggatccaggaggggatagacaggaaaattgtattttcatgcagtgagacaagtatcctaacagcatttctgctagctggggctgctgacgcttcaggcaggagatagcatttagactgcttttaaaagatggttaattggctgggtgcgtggctcacgcctgtaatcccagcactttgggaggccgaggtgggtggatcatgaggtcagagattgagaccatcctggctaacatggtgaaaccccgtctttaccaaaaatacaaaaattagccgggcatggtggcgggcacctgtagtcccagctactcgggaggctgaggcaggaaatggcgtcaacccgggaggcggagcttgcagtgagccgagatcatgccattgcactccgcctgggcgacagagcaagactctgtctcaaaaaaaaaaaaaaaaaaaaaaagatggttatcaagtttgcaaggtgggcaggaaggaatacctaacaggttcacaggcatgaagatgtaaatggacaaaaatacaaaggcagcccatatgcagtagcaccaccagctgcaagctgacaatcctaaggggaagggctgataaaaaacaaccgtgttgatttcattccactggatttctgcacatttaaataattggtattgatacttatgaagcagggagtgcaggcaatgaattatatctccttccttccttcctctctctttctctttctttccttctctccttccttccccctcccctcccctcccctcccctcccctctcctctcctttctttccacggagtctccctcttcttcaggctggagtgcaatggtgcgatctcggctcactgcaacctccgcctcccgggccaggtgattcttctgcctcagtctcccaagtagctaggactacaggcacatgccaccaacccagctaatttttgtatttttagtagagacgggaactatctgttttctgtagcagactgggagtctcttttagtagatatcagctgggctctgaggccagactatccaagtgacctggcaagtcagggagcccagcctcctggggcctctttcctacttctgtaaggtccttgtgagatccagagttaagacatgaggccagcccgggtgactcatgtgtgtaatcccagcactagggaagcagaggcgggaggattgtttgagcccaggagttccagaccagcctggtcaacaagggagacgcccactacctgggggtggaggggtatgtatacctgtggttccagctacttggacgctgaggtgggagaattgcttgagcccaggagtttgaggctgcagtgccctgtgatgcaccactgcactccagcctagctgacagagcgagatcccatctcaaaaaaacaaaaaaaaaaccagttaaagcacgtaaagcacttaaaccacaggttgccccctgggaagctctgggtatagagtctttcctccggtttggatttggggctgtgacccctgtgtactgggaagagggacggcccccaactctgggaggctgtgaggccttctgtccccaacagcgtggcaggcgcgcagttccggctctggggagcaagggggctcctgcgaacccgagtccaggaatgggctcttcctgcggtagcccctgccggcctgggcttgcccttcgtccaccttcctctttccggagggagaaacagatcctgagttcaaaattccagagctgaaagtcctctcttggatcctctggaaacagtaagcaaaagcccgtttttgctgagaaagtgactcggcagctatccggactctctgcctgcaggtggggccattctcctatggagccgacccgacccgctcaaagctgcccgggaaccgcaggtttggttcgcgcacgccgggacttgccaaccgcacccgaaaaatggggccatgtccaaatgtttcgcttcgctgccggcagggagccgcgccgggctcgctccgggatcaactgcacagtcctggctttggggagcgggaggcggtgagcctgcccgcccccgaccccttcctcaccagtgtgtctggggtgaggtggggatggggagtcctggggttcgaaaaggatgggggaggagaaagaggaagtgttaggaactggtgaactttcacaaacttcccaaaccctattgtaaatgccttcaattaactgggatttttttctttactggttgattgattaagacaaggtcttgctcgggcacccaggctgcagtgcagtggcacaatcatagctcatgcggcctcgacctcccaggctcaaacgatcctcccacctcagcctctgtagtagctagactacaggtgcctgccaccaagcccgggctcatttttaaaaatagagatggggtggggtttgcaatgtcgcccaggctggtctagaactcctggactgaagcgatcctcccccttggttcccaaagggctggaataacagggttgagccaccttgtagtttttttctaaattctgagagcatgcatactcattgttaaaaacattttttccccaaacaatccagaaacaggcagtgagttcattggttaagaagcaggactcgaacgtactcctttggtttgaatctcagctctgcacttactggctttgtgatccttgacaagttacttaaccgctctgtgcctcagtttctcatttgtaacatgggcatcataatagaacctaccacataaggctgttgtgaaaattagtcgtaaagcaggtagaacagtgcctgaatatgagttgttttctgttatcaggtacataagtcatgtccctctcaacctactctcccttccacctctgaacatctcccatctcccatttcttcaggcatgaatttgtatccttgcagctcttagtacatacatgacacccacatacttaccacacacacatacacacgttcttatagaaatggatttaataggggctgggtgtggtggccatgcctgtaatcccagcactttgggaggccgaggtgggcggatcacttgagtcaggagtcgagaccagcctgtccaacatggtgaaactccatctctactgaaaatataaaaattagcaggtgtggtggcacgcacctgtagtcccaactactcaggaggctgaggcaggcgaatccttgaacccgggagacagaggctgcagtgagccaagatctcgccactgtactccagcctggcaacagagcgagacagagtgtctcaagagaaaaaaaaaaaaggattaatactctacccttctgcttttgtttttttaataacttaatcacatctgtaaaaacttttacaacattactgtaaccagcttccggcatgtgatagctttgcaataaatatttgatgagtgaatgaaccatgagtgaatgaatgaattttagaatattgtgagccacagaattataagatgaaaaggatcttagagaatgtctggtccattctccctgccactgccaatctcgcctgagtggcaatgtggctagtcgtggtccagtctctctgggaagactccgtttctagagctcacattctcagagcctttcccccttctttcctcctaggtgagcagacacgttaacaagcaaaagaactgatgtaaaactggtggtttttgactgagtgtccctcaaatttctcaatggccactttatttttgtgaatgttatagtcttatattgcttataacaaatcaccataatttagtggcttaaataacacccatttatgagcttacaattctgcaggccagaagtgccagctgggttctctgccaggctcttaggaggctgaaacgaagcctcctttctggaggctctggggaagaattcacgccaagttcatttcaattgttggttcgatttaactgcttgcagctgtaggatttatgtcccatttcctcacaggctgttcataaaagccacctacattcctggctaagtggcctcctcacctcaaaggaatatcttcctcatatcaaatctctcccatgctttgaatctccaactccagtctttgacctctagacccagatttaaatctcatgttattagatcaggccctcccagaaaatctctgttttaaagttaagtgatttgggaccttaattacatctgcaaaatcctttccaacacctagattagtgtttgaataactgggagaaggtttgtgtacacccgggccaggatttgatggaccatcttggagttcttcttcccacatacaggtttatttgtttttttgttttgtttttgtttttgttttttcaaggcagagtctcactctgtcacccaggctggagtgcatagtgccatctcagctcaccgcaacctctgtctcctgtgttcaagcaattctcctgcctagcctcctgagtagctgggactacaggtatgtgccaccatgcccagctagtttttgtattttagtagagacgggttttctctatgtgggccaggctggtctcgaactcctgacctgaaggatctgtctgcctcagcctcccaaaatgctgggattacaggcatgagccaccgcacgtgcccacatatactttttattgaagtataacacacatgcaaaaatgcacaaggctcagctgacaaattctcacaaactgtacacacccattaatcaacacactggtcaagaaacagaactgatcagcctccagaaaccccgtccccccatgtcttcttcagtcattaccctcccctatggaatcactatccttatttctaatgccacagattacattagcctgtttttgggctttattaacttgagctacatagtttttgtaatttataccgtttgtgagatgcactcatgttgtctatgtaatttagttcgttctttcttcgtgtataacaatccatggtacgaatatactactgtggtagacagaataatgacccccaaagatgtttgaatctttatagcttttctgtaaattatatttattacaaaataaaaattatttttaaaaagcaaggtatgcagtagaataagatcttgcagaaaccaatatccaacaaaaaaccatatccagaaaatatatctacgtctatattaatgtatatatattactagaaatcaataagtaacattcgtccccatcctaatccctggatctataaatatgttaccttctatggcaaaagggactttgcagatgtaactaaggatctgaaggaggattaccctggatcatctgagtgggcccagtacgatcacaagggtccctacagtggaagaagaaggtcagagtgagagagagacctttggagacgctgtgtgctgctggcttgaagacagaggaaggagccacaagtcaaggaatgcaggcagcctctagaagctggcaaggcaagcaaacagattctcccatggagtcttcagaaggaacacagccctgcccacactcgacattagctcagtaacacacgttaggcttctcacttccagaagtgtaagataatacattgtgttgttctatggcactaaatttgtggtaatctgttacagcagcaattggaaactaaacagaaacgttaccaatttttttttttctgagacggagtctcgccctgttgcccaggctgagtgcagtggcacgatctcagctcactgcaacctcctccgcctcctgggttcaagcaatctctgcctcagcctcccgagtagctgggactacaggcgcgtgccaccacgcccggctattttttgtatttttagtagagacaggatggtctcaatctcctgaccttgtgatccgcagtctcggcctcctgaagtgctgggattacagtcgtgagccaccgcgcccagtctacctatttattgctgaagaacattgggcttttcccaggttgggctgttacaaatactgctgctataatattcttgtacatttctcttggtgaaaaaacacacttgtctgtccttccttccttcctccttcctttcttcctttccttccttcctttccttccttccttccttccttccttccttcttccttccttccttctttctttctttctttctttttctctctttctttctttccttaatatggagacaggatctcactatgtcgcccaggctggtctcaaattcctaagctcaagcatcctcccacttcagcctcccaaagtgctgggattacagatgtgagccactgcactgggccacgcttgcgtttctgtcagatacatacctaggattggaactgctggatcataaagtatggtgtgtttctctgtaatagaagcaagcagttttccaaagtggttataccaattcacacctcattagaagcatatgagttcaacttgttccacatccctagtaacacttggtattgtcgtaatttaattttagccattatagtgagtgtgtagtgatactgtactgtgatttccaattgcacttctctgatgtctaaggaatgtaaaaatatttgcatgaacttattggtattttgatggcttttttttaatgaaatgcttatccaagacttctgccaatgtttctacagggttacttttttcttatcgccttacataagaattttttttttcttggccaggcgcagtggctcagcctgtaatcccagcactttgggaggctgaggtgggcagataacttgaggtcaggagttgagaccagcctggtcaatgcagtaaaaccccatctctactaaaaatacaaaattagctggcgtggtggtgtgcgcctgtaatcccggcaacttggaaagctgagacaggagaattgctgaacctgggaggcagaggttgcagtgagctgagattgcgccactgcactccagcctgggaaaaagagtgagactccttctcaaaaatatatatatacattttttatatatatatataccacacacacacacattatatatatacattatatatatacattatatatatacattatattatatacacacacacatataaacatgtatatatttttttctggataaaatttattttctgatattggttttcttaaatatattctgttagcttaccttcataaaattttggaataaattgtatttattcttctataaatgtataattatagaaaagttgcaaagatagtacagagagtcctgtatccacttcacccagtttcccctcatattatcatcttaaattaccttagtacattgtcaaaagtaataatttaagattggtaatttactattaactaaactagagatttattggatttcaccagctggtatatcccattacatttagttattatgtcttcttggtctccttgatctgtgactgtttcttagtctttccttatttgtcatgaccttgacagttttgaaaagattggtcaggtattttgtagaatgtccctcaatttgaattttttttttcttttttgccccgttggagtgcaatggcatgatcttggctcactgcaacctccgtgtcccgggttcaaggattctcctgcctcagcctcccaagtagctgggattacaggcatatgccaccacacctggtaatttttgcatttttagtagagatggggtttcaccatgttggtcaggctggttttgaatcctgacctcaggtgatccactggcctggcctcccaaagttctgggattacaggcatgaccactgcacctggcctcaatttggatttgtctgatggttctctcatgactaaactgggatgtggatttgggaaaggagaaccatggaggtgatatgaccttctcatcatatcatatcaatcatatgagggcatatatgatgtcaacatgactgattactggtgattttgaagttaatccttggttaaggtagtgtctaccaggtttctccactgtaaagttaataaatgttctcttccatattcttgttttacttttcaattttaatctatttatttattttgagaccaggttatagactggcgaatttttgtacttttggtagaaatggggtttcaccatgttgccaaggctatcttgaactcctgggctgaagcaatccacccacctcagcctcccaaagtgctgggattaaagtatgagccaccatgagcagcctctttccatatactattatttgaaagtgagtccagccacactcaaggggagggaaactaagtttcatctcctgaaggaatggatttttttgttttttgtttgttttgttttgttttgttttgtttgagatggagtctccctctattgcccaggtggagtgcagtggcgcgatctcggctcactgcaacctccgcctcccaggttcaagcaatctctgcctcagcctcctgagtagctgagattataggcgcctggctaatttttgtattttagtagagacggggtttcaccaacttggccaggctggtcttgaactcctgacctcatgatcacccgccttggcctcccaaagtgcttcgattacaggcatgagtcaccgtgcccagcctggagtggagtatttacacacattgtttggagttcttctttaagaaagacttatttatgaatcatttatttatataggctcatgtgtaaccatgtagtttatactttgggttataattcacaacgtttttcctttatttagtagatactacattctttaccttatttcccaaattgctcagctttggccattgggagctcttccacattggctcctgtgtcctttgaccttcctccacttcttctctttttattttttagcactgccttaatttcggcgctgaggtgggtactgcaagaaaagcaaacactccagaacccatgcactggatccaggagtgggtggtagaaagggagtggagggaggggtctgagctctaatactaaagacagagacttaggagactgtgaagggtgtttatggaaagtcagggaattttacctccccgaggagaggaatcctgtgtcatccactttgtgtcccctcccctgggctcacaacagtgaaccatggggtgaacaaggaccattccctgcctctcccaggttctccaactctgtggcttactatggcctggccatggacctgcagagtttgggctcagcctatacctggtgcaggccctgtttggaatcatcaacatcccggcctgctggtggccaccgccaccatgatttacgtgggccgccgtgccacggtggcctccttctcatcctggccgggctcatggtgatcgccaacatgtttgtgccagaaggtgagtcaccccttctgcccttgctgcacaccaagaactgggagcctctggggtctggtagacaacaaattcacatggcagcaaggctgaagggtatgtctccggatctgaaaagaaagcaactgttagctgggcacggtggctcacgcctgtaatcccagcactttgggaggccaaggcgggcaaatacctgaggttaggagttcgagaccagcctggccaacatggtgaaaccccgtctctacagaaatacaaaaaaattagctgggcgtggtggtgtgcacctgtaatcccagctacttgggagctgaggcagaagaatcacttgaacccaggagacggaggctgcagtgagccaagatcgtccactgtactccagcctgggagacagagtgagactcaaagaaaagaaaaaagaaaaagaagcgactgttgattactagagtttgtattaagcacttagtgcccagtggcaattagtggaggtggaggtcttgagccttggccctcagagcttctactgtgtggccagggaggttagaaggtgcacctaagcagctggagagcacaggggctggctcggtgtggccagcagtgtgtgggccccccgaagtctgagcaggcagcatgtccaagggttgagaagttaggattcaaacccagctggactggccctggaacagtggtttgcaaacctggctaaaatgaccttctcctgggcgctttgaaaactcccagggcccaggtgctccatgccagcgccctgggaatctcaagggtggaactcaaccctcagtattttacaaactgtccagtgagtccagcaagatgccagggtgaatagcagcgacatagagcatgggccaaaccatgtgcccattgtgactgcagccttgccgtgggcaggttgtccaacttctctgtgccttagttcttcacctgtaaaatggataaagttattattggtgtcttgacctatttcattccaatcttttttcctatttatagatttgtttcagcatagttgagatattttatatgtttatacatacaaaaatataaataggatacatcatatatatgtatatatgtgcatgtgtacatatatatatatatatatatatatatatattatatagtgcccttatttcattatatgttgaaacatacacattcttttccatgttagcaaaatgtttcatggacctgatttttttttttttttttgagatgaagtctcctttgttgccaggctggagtgctgtggtgctcactgcaacctctgcctcctaggttcaagtgattccccgccttagcctgcagagtagctgggattagagatgcgtgccatcatgcccggctaattttgtatttttagtacagacggggtttcatcattttggccagggtggtctcaaactcgtgactcaagtgatctgcccacctcggcctcctaaagtgctgggattacaggcatgagccactggcctggcctcatggacctgattttttattgctatgtgatccttccctccctccctccctccttccttcctccctccctcccttcttcctttcctcccttctgcctttcctccctccctcttttctttcttcctttctttttctttcttttctttcttttttaagacagagtctcacttgtggctcaggctggagtacagtggcacaatcatggctcactgcagcctcgacctcccagctcaagcaatcctcccaccttagcctcctgagtagctgggactaccggtgcattccacacacctggctaattttttgtattttttgtgtagagacagggttttgccatgttgcctagctggtctcaaactcctgggctcaagcgatctgcctgccttggtctcccaaagtgctgggttatagacgagagccactgcacccagcctagataatatttcatctagattgatgtttctactctggcctcacaatagaatctcttggggacctttaaaaaatacccaaatttgagccctccccagtaggtcttgctagagtggacattgagtaagacccaggtgtgagtgttttataaatctccccacctgattccaatgtgcagccagggctgccacccagccagagaaggcacctcatttccttgactgctgtcctaatgttggatgtttgaataggggttttgctacttataacaacagcgggagaagcatattgaaaatgaggacaatgggccgggcgcggtggctcatgctgtaatcccagtactttgggaagccaaggcaggtggatcacctgaggtcaggagttcggaccagcctggacaatatggtgaaaccctgtctctactaaaaatacaaaaattagctggcgcggtggtgcacacctataatcccagctactcaggaggctgaggcaggagaattgcttaacctaggaggcagagattgcagtgagccaagattgtgccactgcactccagcctcagtacagagagactctgtctcaaaaaaaaagaaagaaagaaagaaagaaaatgaaggcaatgcaaacatttaatgggcactttgcacccctggcattgtgtccagcttacgccaaccccataagcaggtgctgctattttccttattttacagatgaggacagggaggtgcagagtgggtagaaacactgacctaggtcagccagcggggtgagagctgcaatttgaacccaggcctgatctaaagcacctgcctacccagcaggacttggtgacagatgcaaataaaggagcaaggaggagaagtcagagaagggcagtcaggggactcctgggtcctaggaacagttgggaagggaggtggtggaaatcctggttctcctctgggttctgagtgggctctgcctcttccccccactcgccctatcccctcctgaggctccacccctctccactacaccctgggcctccctctctcccctcctcctcagctgcaccctactcccctgtctaggcacgcagatcctgtgcacagccaggcagcgctgggcaaaggctgcctggccagctccttcatctgtgtgtacctgtttacggcgagctgtaccccacggagatcaggtgggtgcatggggggagatgctgcaggttgaacctgttgggctcaccgaggcaggacccctggtccctcctgccctgtcctctgacactcgggcgtggccctcttgggcccctaggggtgcaggttgctgcactgacccatccccatcccacacctcccacaggcagatggggatgggctttgcctctgtccacgcccgcctcgggggctgacggcgcccctggttaccacacttggggaatacagcaccatcctgccacccgtgagtttggggccaccgcaatcctggctgggctggccgtctgcttcctgaccgagacccgcaaatgcccctggtggagaccatcgcagccatggagaggaggtgaggggcctccagcaccaaaggccgaaagttacaggaaataactggggggcaaatggggtgccctccccactcctgcgatcggaaatgtcctggccagatgcaccagagctgtgagatgcctcccccacctccatctcactggcttagctttccccaagaacagacccaatcacgaaggtagaaaagaataaaccggaacaaggaaacacgtgggttggaagtgagacgtggcagagaagtgaggagaggagagcgaggaaagtgaagcaaagacaggctcccatggttgctgtgcaggcttcaaatttggttcgggcttcttcacaacagaaagggagaccccattcatggctgctcttggaaaggaaaacaataccagtccctcaggagagtgaagctttccttagcatttagcactaggagaggtttctttcactgcttggccccccacccctcttttctttttttttttaagatcatcttggcttcagtgtgggtctcattagaaaggtcactaaggtgacagcaatgtcctggacaatgtttctaaacaaactcaagaggggacttgatctggctgcttcttgcagcatttctcagcaacagtggctcagggaagacccttagtttgcgggaatggtgacaggaacagtagccgcgcccgtcttaaccctctctgaaggtcagcttgatcccaaaggtggacccatctgtacccagtggccttataggtgctgtgtttgcaaccctgaaataactcccataaacattccatctctaacctggccatgggccaaggctgaactgcaagagatcaaggatatattctttggcaagtcctatctttcttttctttctttttttttttttttttttgagacattgtctcactctgtcaccccgctggagtgcggtggtgcgatcatgactcactgcaacctccgcctcccgggttcaagtgatctcctgcctcagcctcccgagtagcagggattacaggcgcccgccaccatgcccagctatttttgtatttttagtagagatggggtttcaccatcttggccaggctggtcttgaactctgaccttgtgatccacctgtctcggcctcccaaagtgctgggattacaggcgtgagcccggcgcccagcccaagtcctatcatttctgcctccagaatagacttaaatctgtcattcctctccagccctgtgtccatggccctatatcaagccaccattgtctcttgtctggacaatacgagagcctcatatcttcccctgtccctgtccactttattccctgcaggccaagtggggaggacagtcttcatctgggtgctgagcagggcttggagaggatgagggtatgggaggggagtgttaaagtgcatgtatgggccaggtgcagtggctcacacctgtaatcccagcacttgggagactgaggtgggtggatcacctaaggtcaggagtttgagaccagcctggccaaatggtgaaaccctgtctccattaaaaatacaaaattaggctcttgctacttccttcttccgctgccgggaacacaagcaaaacgttgagggctgcagcagccatctttgaccatgaagaaccttaagaaaggaagccattctccctctccctctccctctccctccctctccctcccctccctctccctctccctccccctccccctccccctctggtctccctctctttccacagctccctctcatgcggagccgaagctggactgtactgctgccatctcggctcactgcaactccctgcctgattctcctgcctcagcctgccgagtgcctgcgattgcaggcacgcgctgcacacctgactggttttggtggagacggggtttcgctgtgttggccgggccggtctccacccctaaccgcgagtgatccgccagcctcggcctcccgaggtgccgggattgcagacgggtctcgttcactcagtgctcaatggtgcccaggctggagtgcagtggcgtgatctcggccgctacaacctacacctcccagccgcctgccttggcctcccaaagtgccgagattgcagctctgcctggccaccaccccgtctgggaagtgagcagtgtctctgcctggccgcccatctctgggaagtgaggagcccctctgcctggctgcctagtctggaaagtgaggagcgtctcgcccggccgccatcccatctaggaagtgaggagcgcctcttcctggccgccatcacatcaggaagtgaggagcgtctctgcccagccgcccatcatctgagatgtggggagcgcctctccccgccgccccatctgggatgtgaggagcgcctctgcccggccgcgaccccgtctgggggtgaggagcgtctctgcccggccgccccgtctaagaagtgaggagaccctctgcctggaaccaccctgtctgagaagtgaggagcccctccgcccggcagctgccccgtctgagaaggaggagcctctccgcccggcagccaccccatctgggaagtgaggagcgtctccgcccggagccaccccgtccgggagggaggtggggggggtcagccccccgcccggccagccgcccctccaggagggaggtgggaggtcagccccccgcccggccagccgccccatccgggagggagtgggggggtcagccccccgcccggccagccgccccgtctgggaggtgaggggcgcctcgcccggccgcccctactgggaagtgaggagcccctctgtccggccagccgccccgtccagagggaggtcggggggggtcagccccccctgcccggccagccgccccgtccgggagggagtggaggggtcagccccctgcccagccagccgccccgtctgggaggtgaggggtgcctcgcccggccgccccgactgggaagtgaggagcccctctgcccggccaccaccccgtctggaggtgtgcccaacagctcattgagaacgggccaggatgacaatggcggctttgtggaatgaaaggcgggaaaggtggggaaaagattgagaaatcggatggttgccgtgtctgtgtagaagaagtagacatgggagacttttcattttgttctgcactaagaaaaattcttctgcctgggatcttgttgatctgtgaccttacccccaaccctgtgctctctgaaacatgtgctgttccactcagggttaaatggattaagggcggtgcaagatgtgctttgttaaacagatgctgaaggcagcatgctcgttaagagtcatcaccaatccctaatctcaagtaatcagggacaaaacactgcggaaggccgcaggttcctctgcctaggaaaaccagagacctttgttcactgtttatctgctgaccttccctccactattgtcccatgaccctgccaaatccccctctgtagaaacacccaagtattatcaataaaaaaataaattaaaaaagaaaaaaaaaaaaaaagaaggaagccatgtgctaagaatggtggagaagaaaggaggaagtgcgtgatgaatttgtaacatccctggactacctaattccagacttttttaagtagagaaaaataaacctctagttatatataaaaaaaaaaatacaaaattagccaggtgtggtggtgggtgcctgtaatcccgctacttaggaggctggggcaggagaatcgtttgaacccgggaggtggaggttgcagtggccgagatcgcaccactgcactccagcctgggcgacagagcaagactccatctcagtgggttggggtgggggagttgggaagattaagccaatcgactaaaatattataaatagaagattaaaaagcaaggatagaaacatagataaaacagtatgaatgctggaaaaaatccaaaatggaaacagcttaaagtagacaggagaaatgggcaagatatgaaacgattaaaacaagagataacagcccaggcgcggtggctcacacctgtaatcccagcactttgggaggcagaggaggtggatcatgaggtcaggagttcgagaccaacctagccaacatagtgaaaccctgtcctactaaaaatacaaaaattagccgggcatggtggcacgcctgtagtcccagctactcagaggctgaggcaggagaatcgcttgaacccaggaggcagaggttgcagtgagccaagatgcaccactgcactccagcttgggcgacagagcaagacttcgtctcaaaaaaaaaaaaaaaaagaggattaaaaaaactaagataattccgtgggaaaacagttatcagtgtccacaatcaaaaataaaaataaatggaaggaattagaacataaatcatttcaaagactagagggttttttttaaggcgataggccaggcatggtggctcatacctgtaatcccagcacattgagagttgaggcggaaggattgcttgagccccggagttcaagaccagcctgggcaacatagcagacccccatttctacccccccatcaaaaaaggcaaaattggatcttgtcaagtgatagaagccagtggggtagcctcgggctatttgggactgagggggcctcaaagtccaggcaagcccccaccaccctcaacctcccctgacttcttcaagagccaaccagggcagggcaggagtgctcagagccctaatctttgtccctccctgcctcctggggtgggagaagaagggtgctatagtgcccagtcgctgggggtgtctgctggcccctgttctccagccaagtgaccttgggatgtgtccaccctctaggtcctcatctgtaagactctttgttgaacttcttgaccctgcgctctcccaagtctgtttccagacaggccagcctctgccagctgcaagaccccagggatgagcaaggagggagctggaggaacaataggagggtggccaccagggtgcccaagagaatcagaggaggggccactgcagcatccacctcccttctggcttcaggagggtggagctgcacctgtgcatatggcaccaccctccccatgacatgcacaccacctgcccctcaccactgcttctgccttttcatttctacagggtcaaagaaggctcttccaagaaacatgtagaagagagagtgaagaaatttctcttcagcagctgagagcatctcccctcaaagagaccatctaactgcctggaacctggtgcttgctagcagcacctgagccgatgtccagacggccccctggggcttctcccaggagcccctggggacactggtgctgaactggaggaaaggtcgctgaaacatcatggctcctatagacagccacccacaagccagggctgcttggagggaaaccccacagaaacagccaatctgtgttacaaatgcatagaaagccaggagaagccagtcccagggacaaaggagagactgttttcctttcccatccccaatctgccccttaaaatgtctctgtatagtccattcttgcactcctataaagaactacctgagactgggtcatttacaaggaaaagggtttaattgactcacagttctgcagattgtacaggaagcatggctgggaggcctcaggaacttacaatcattgcagaaggcaaagaggaagcaagcacgtcttcacatggctggcagagagagagaaagtgaaggggaaggtgccgcacactttacaacagccagatctcgtgagactctttatcacgagacagcactaggggggtggtgccaaaccattagaaaccatccgcagatccaagcaccttgcactaggccccacctccaacaccggggattacaattaaacatgagtttgggtggggacacagagccaaatcatatcactgtttattcttgttccacttgagaatctgtgtctttgcagggttagggtgatatctctgccaaagggttgtccctggaatagcccactcatccttgagaaacgtggagaactcattctattccactcacccggaaagagtaaatctcttctgccttatgggattaaagctctttcccccgtgtgtgtgtgtcttacctccttgcaggaaaatgtctccatagcaggcattcttgcctacctttgtagctccagcagcccctctagtggccttgcagaagctgcatgtttaataaatagttgatgaagaaatgatcaaaacaactcccgcaatagatggagacctttgtgcgttgtttgcattcctagcaataccactttgagaactgggatatggttcttttccccagaagccttcttcaggtgtgtgccactatgatcgctattttttttatttcatagcaatagggtcttgctttgttgccctggctggctttgaatcttggcctaaagcaatcctctggcctcagcttccccaaatgctgggattacagagagggaaggcctagtttggcacagcatcccgctggcctcagatctatttccagcccaggtgttgccatgtatccctgaccttaaccttcactggaattcagattagatttataagggattcgatcttggcccattgggttgtcttggccaaattttcttgtctgatcccttcttcctggagtaccagataatccaacaagatcaattctcagtcccctacagcccaaagaaaggcacaattagggaagaaacaagactatcacagtctgggcaggaagcatggcagcttgccgttttgcaagattagtcttccaacagcttggagcagaggtggaatgtgactcccccaaggacttgtccaaggccctgttattgatgcactgaatcctcagctcctccccagggatttaacctcttttgaacatgtcagggaacacctgtgtgatccgctacatgagcttttccattcgagttgtctccacccacagccctcagcaaatcagtgatttcaataggcagagggctgctgtgcctgccatgctttgagattcaccttgggggttacctcttccaggcagctttcactgaccacactgcctacctctgcgtgctgctccactcccccgcaccacccccatccctcccaccccagctgctgccccatgccctctattgcaatctccttattgcactttcccattgtgttgtgatggtccatttacatgctgatctctccagtggctcctcaaaggcaaagttaaatcatcttttttgacctggcctgcacatggcaggtgctcagttcatgttgccagagtgaatgactttttttttttttttgaaatgaagtctcactctgtcgcccaggctggaggtcaatggcgtgatccagctcactgcaacctctgcctgctgggttgaagcgattctcctgtctcagcctcctgatagctaggattacagacgtccaccaccaagcccagctaatttttgtatttttagtagagcggggtttcaccatgttggtcagactggtctggagctcctgacctcaggtgatccacctcctcggcctcccaaagtgttgagattacaggcttgagccacagcacctggccgtgaatgctattattttatttatttatttttgagacagggtctcactacgtcacccagggtagagtgcagtggtatgatcttggctcactgcagcctcgacttacctggctcaagcaattatccccctcagtctcccaagtagctaggactacaggtgtctgccaccatgcctggctaatttttaagagcagggtcttgctcttttgtccaggctggtctcaaactcctggactcaagtaatcttttgccttggcctcccaaagtgctgggattacaggcatgagccaccacacccagccttatttttatttttgaagaaaatttagaataatggttctcaatcttggaatcacctgtgagtttttaaaaaaaaataccaggccgggcgtggtggctcacacctgtaatcccagcgctttggaggctaaggcaggcagataacgaggtcaaaaaattgagaccatcctggccaacatgggaaaacctgtctctaccaaaaatacaaaaattagctgggcatggtggcacacacctgtaacccagctactcgggaggctgaggcaggataatcacttgaacccaggaggcggaggttgagtgagctgagattgctctactgcactccagcagcctggcgacagagtgagaccccgtccaaaaaacaaaaaacaaaaaaaccagtgctagagcccactccaatccagcagataaggtaattataacaagactgtgacctcatagttaatgagttacttaccatggagttagtaagcaatttgatttccctgcacacagacaatacatacttttaagtgaacaaactagattttcttctttttctttttctttctttctttcttttttttttttttgagactgggtttcgctcttttgcccaggctggagtgcaatggcgtgatctcggctcatcgcaacctctgcctcccggatcaagcaattctcctgcctcagcctcctgagtagctgggattacaggcatgtgccaccagtccagctaattttttatttttagtagagatggggtttctctacgttggtcaggctggttcgaactccggacctcaagtgatccacccgccttggcctcccaaagtgccgggattacagcgtgagccaccacgcctggccacaaactagattttcttgaagaaatattctgaccatgagtttcctatgacaagtataaatgatcttgaggttacaggtttcaggccacggaatcaaccataaagcctttgactaccattgtccttagccaaaaacactggccaggaactattaaaaaaaatgagtgcccaatgatgacatatagactgggctgtttaaataggattccacatgctggcaccttttataataatctttatggtaactggcaaatcacctccagacttcttttctttccatctggaaacactgaatagtcagtacattttattttcaaaatctgtgataacaagttaggcacagtggctcacgcctgtaatcccagcactttgggaggccaaggtgggaggattcttgagaccaggagttagagaccagcctaggcaacatcagaagactccatctctgctaaaaaaatttagctgggcatggtagtgtgtgcctgtagtccctgctacttgggagccctagtgggaggatcacctgagcccagggaggttgaggctgcagtgagctacgatggttccagctgggtgacagagtgagactttgtctcaaaaaaaaaaaaaaaatatatatatatatataatatatatatatatatatatatatatatatatatatctgtatatatgaatgacaaccttttactgaaatctctatacatttccaagtattattaggccatgtggctatgtggctgcaagagacggctcaaggtcaaggtgcccggaggattcaggataccagtgattgcctgggcctgttcacaggcagatcagctaaatgaaagaccgaaggtgtcctgggccattgctgctgtgagccctcaaggaagttgctgacaactgtgtgtggaaaagagaactctgcttaatctgggtgtggtgttgccccagaaaacagcagccagaatgcaccttgttacatcgtcacccaccctgaccacactggtcagacctgtgcagccaggcagcaggtatgttcaaaagatggactttgcctttaaagtttagctctaaatgcaggtgtctccccggaggaatgccccccaccaactaaataattgtttgattacgaggttggggaggagcaaggaggccgagactggctggatgaaccaaaccacataactcacccttctccctcttctgctttctttccatgcctactctgggaaacaggctactggactttcaagtagcaaagaagagagtgagtgctgaggacggggagtctaacctcatgcttcttttgcagccactctggttgctggatttgggcaattatggagacaatgataatgatcatgaacatgaggtgacagctcccaatgtggacctggcatggcccacgtcaggcagcagatgttttagaatagtacaaggtgaagccgggcgtggtggctcacaccgtcatcccagcactttgggaagccgaggtgggcagatcacctgaggtcaggagctcaagccagcctggccaacatggtgaaaccccgtctctactaaaaatacaaaaattagctgggctggtggtaggcacctgtaatcccagctactcaggaggctgacgcctgagaaccacttatgctgggaggcagaggttgcagtgaactgagatcgtgccactgcactcgagcctgggcgaagagcgagactcagtctcagaaaaaagaaaagaaaagagcgagactcagtctcagaaaaagaaaagaaaggaaaagaaaagaaaaaagaaaagaaacgaaacaaggtgtataaggagaactgcctggcctcctaggcacaagtctgggcaaatggtatggggaagacctggcggagatagaaaaagggtgaagccatcgctgcaggaacttgtcatggggaccctggggctgtggaggagaacgggatccacagctggagggaaggaaactgggaggtcaggtggagacagggacactgagctctttcagctcctgtccataggatgttcagccagttcaacccagactgccacgccacctcaacttgagcactgaccaatgaagaatcttaatcagaagtttcccaacatgcggacgtggctcacgcctctaatcacagcactttgggagacggaggcaggcagattgcttagcccaggagttcaagactagcccgggcaacaaggtgaaaccccgtctctactaaaaatcaaaaactagccatgtatggtgacacatacctgtagtcccagctacttgagaggctgagtgggaggatcacctgagcccaggaaggccaaggctgcagtgagctgtgatccagcctggtgacagagcgagactacatctcaaaaaaataaatgagctgggctcagtggctcac

SEQ ID NO: 5040 - DNA, 42060 bp, Homo sapiens
tgttgccatgggctgcaatcagtacacgtttcccctccttgatctggggaactatttctcattccagaaggtcagagctctggcaatagtgtccttcagactctcacaggagggtagcgatcttctgtgaggtctgcatacctgcgatccttactgatgttgctatagaaaggatggtgggctccattggaggtggtgggacatcataggagtgcctccagatcttcacctgggcccaccatgctttgcagcaacctccgcctccctggttcaagcgattctcctgcctcagcctctgagtagctgggattacagatgtgcgtcaccacgcccggctaattttttttttgtattttagtagcaacggggtttcatcatgttggtcaggctgatcttgacctcctgacctcgtgtctgcctgcctcggcctcccaaagtgctgggattacaggcgtgagccaccgcacccagcgtgaggtgccagatttttatctttgccaaactgctaagtgggaaacagtctcttggtgaattttaattcacatttgcttttcagtgagctcaacatcttgtcatatgtttaagacctattgtcttcttttatttgtgaactttttttttttgagacagggtcttgctttgtcatccagctggaatacagtggtgcgatcacagctcactgcagcctcgacctctgggatagctgggctacaggccaccatgcccagctaactttttgtatttttggtacagacagggtctcaccgattgtccaggctgatctcgaactcctgggcttaagcgatccacccactttggcctcccaagtgctgggatttacttttattttattcttagagacagcatcttgctctattgcccaggtggagggaagtggcacaatcatagctcactgcagcctccaactgctgggctcaagccacctcccatctcagcctctggagtagctgggatgacaggcatgcaccaccacacctggctattttctaatttttttatagatggggtctcattatgttgcccaggctagtctcaaactccagcctcaatcaatcctcctgtctaggcctcccaaagtgttaggattataggaatgagcgccacacccagaacatgattttttatatatgtatatggagaaaaatactcctttaagatgtaattgtaaatgttttcttcagtccatcattttgacataactgtatggatttttaatgtgtaaaaaatgcaattttatgacttttgggttttgtgtcatagttaaaaagactgtttcccactgagatgatacaaaaagtttctcctttagctcctggctgtatttttttttttttttttttgagatggagttttgctcttgttgcccaggctggagtgcaatggtgcgatctccaccaccgcaacctccgcctccatctcccgggttcaagcaattcttgtgcctcagtctcccagtagctgggattgctggtgtgtgccaccatgcccagctgatttttgtatatttagtagaatagggtttcacgatgttggccaggctggtcttgaacacctgacctcaagtgatccaccacctcagcctcccaaagtgctaggattacaggcatgagccaccgtgcccagccagcttcggctgtattttcgttttcatttttgtacgtttaaatattgaaggttaacatttaattttatttttatttatttattttttttgagacgttgtctcactctgtcgccgaggctggagtgagtggcgcaatcttggctcactgcaagctctgcctcctgggttcacgccattctcctgctcagcctcccaagtggctgggactacaggcgcccgccaccacgcccggctaattcgtttgtatttttagtagagatggggtttcaccgtgttagccaggatggtcttgatctcctgactcgtgatccacctgcctcagcctcccaaagtgctgggattacaggcatgaaccaccgcgctggcctattttttattgattttttagagatggagtcttgctttgttgcccaggctagatgcagcggtgctcactgaggccttgaacccctaggctcaagagagcctcccacctcaggtccgaaaatgctgggattacaggtggtgtgagataccacaccagacctagagtttttatttttaatttttaaaaaaatttttatttatttttttgagacggagtctcactcttttgctaggctggagtgaagtggtgcaatctcggctcactgcaacctccgccccctgggttcaaaaattctcctgcctcagcctcccgagtagctgggattacaaacgcctgccacccaccatgccagctttttttttttttttttttgtatttttagtagagacgaggtttcaccatattggcgggctggtcgtgaactcctgacctcaggtgatccatctaccttggcctcccaaagtgcaggattacaggtgttagccaccacacccagcctttttaaatgtttttttcattaggaacacatattccaaacctataaattgagttcatctgtaattttttctaagatacaaattatgatccaacttactttttttccagattgctcccttttcttcctaatgtcttttattaactctcttttctcaacagattagaaatggtacttttatcatctactacattcctgcctgtattgaatctgtttctaaatttctctgtcttctattgatctctatgtgtcagtaaccctctttattattaccttttaatgatagatttgttgtgttttaatatctggtaggattagtctatatcattatgtcttttattttcagaagtttcctacttgtttaatttgccatatgacctttaatcagcttttctagtccctccttatctcccaccagaagactcttaaaatttttcattgtatacacttagagattaatttaaggagaattgacatctatatgaagcatcttcatatgaaaccaaggtgtcagcccccttgcctctgctttttggtggctagtgactcccaaatttgtactctattttgagcacaaggtctgttcctcacccctaggaatctcctcttggatagggggtcccaaagataccccataccctgatcccatactgtccctccagcttagtgcattccccctctctttaatctactcaggtgctcaagccagatccagggtctgaagttgtctttggtcttcctggtgtccaagagccatatctaaccagtgactaagttctattttttttttttttttgagacggagttttgctcttgtcgcccaggctggagtgcaatggtgtgatcttggctcacgcaacctccatctcctgggttcaagtgattctcctacctcagcctccctagtagtggggctacaggagcccaccaccacgtccagctaatttttgtattttttagtagagacagggttcgccatattggccaggctcgtctctcgaactcctgaccttatgtgatccgcccacctcacctcctaaagtgctgggattacaggggtgagccactgcgctcagcctgtggtatatttgaatcactgatgaaccaatattgacacaatattattaattcaagtccatagtttacattaggttcactcttagtgttgtacattctgcaggtttggataaatgcatgtcatgcatccgtattacagtatcatacagaatagtttcgctgtgctaaaaatgccctgtgctccatccctccctacccctctgaatccctggcaactgctgatctttttaccattgctagttttgcctttctagaacgtcatatagagttattggaatcatacagtatgcagctttttaataccagcctttttacttagcaatatgcgtttaaggttatgctatgtctttttgtagcttgatggctgattctttgtatcgctaaattttaaagaaattgccaaactgtcttccaaagtggtggtgatattttaccctctcttggtgtatgacagctccagttcttctatatccttgacaacataacacacttggtatggttgatcttaacttttagccattctagtaggtgttcttttagaagcatccttctagtggctttaatttgcatttccctaagagtaatgcactcagtgttttttaattgcctatttgccatccagagatctttttggatgaagtgtctgttcaaatgttttgtccatttttgacaggcgcggtggctcaccctgtaatcccagcaccttgggaggcagaggcgtgagatcacttgaggtcaggagtttgagaccagcttggctaacatggtgaaaccctgtctcactaaaaatacaaaaattagcctggtgtggtggcgggcgcctgtaatcccagctactgggaggctgaggcaggagaattgcttgaacccaggaggtggaggttgcagtgagccaggatgcgccactgcattccaacctgggtgatggagcgggactccatctcaaaaacaaaaacaacaccagaaaacaaacaaatgttttgtccatttttattggatttttattcaattgtaaaattctttatacaagtcctacatcagatagaatttttacaaatattcgtcctagtctatggttatcttttcatttttaatagtttcgtgcattttgagaaacaaaagcgttttattttgagaagttcaatttattgatttcttctatcatttacactttttgtgtcatatttaagaaattggccaggtgccaaagctcacacctgtaatcccagcactttgggaggctcaggcaggagactgcttgagcccaggagttcatgaccagcctgagtaacacagcaggaccccatttctaaaaaaatttaaaaattagctgtgtgtcgtggcacgtgcctgtagtctcagctactcaggggctgaggtgagaggatctcttgagcccaggagtttaaagttacagtgagctgtgatcaggcactgcactcctgcctggtcaatgaaagcaagaccctgcctttagaaaagaaaaaagaatcttttcaaacccaatattgttaagattgtctccatttttaaaaaaaaaagttttatgtttggccatttatatttaggtgtgtaatccagtttgagttaaattttgatggtgtatctaaatagttatcaaatccatctacttctgcctgccacctctctagtttaaaccaccctttctgtccctggacacctgcgcagaaagcctaggagctggttccacccatcactcaccagttaggtatttcaggcaagtcacaccctctcaggcctcagttttcctcttttgttaactggggtgaaagtggggttagattagatcagcggctcttaacttttgaggggtcgtgggcccagagtcctgggaacgctatgcagtttcctcagcaaaatgcttgcatccacaacatgcaaactgcagcagctgctgggctggggctgcgagaccagcgaaaagccctgacttgggggggctcgggagtctctgcagtctccccacccacacccccggcctccgcgccgaatcctggcccccaacttcttgcagcccgtgaagcaggatctcagggtcctgggggtggggagagggggtgccgtcctgctcgcagcctctgccgccctctcctgggtaaggtgacacatgggcgcttcaggtgggtgggctgagagcctgggggagagaacagggatgtccacctctctaagtttcaggttcaagaaaccccagaacgttagagaaagatgggctcccacaattgcccaaccccacccataggatgcacgcatgcggaaagtcgggccgaacggggcagggacttacccaaggtacgcagcgagcccggtccccctgcgttccccggggagcgctgagccgggacgcggcggtgggtggggaaggggagtggcgcggccctgcggggtgaggctgccgtttgctgagtgtccgcaggggtctgctcgctgccagcccggcccctcctcagagcagctgccgcagcccgaggaatctcggccccgcgccggggctggctgggaacggcgggagcagctgcggtcgcgcggacgaggggagctggggaccgggcgggcccggggctgcgggaggcggcgccgccgcacaatgccccggaatgcccgccagggcgcgcgtggggtgcggccgtccggccctgcaactcgagtgctgcccctggttaaaaataccccttgcccgcccctccccctcgtttccccgcgtgccttccgccgcgccccagcccccgcatgtccccccgcgctggcccctccccggggactgcttgccttttactaatttgtcctctcgcggaattggcccccggctgcggagggaggggcgggagacaccgtgagtaagagatagtcagagaccgtgccggagagataagggagagccgagggaagcggggtaggagccccaggaggaggaggaggagaaggagagagggagggcggaggcggaggggcggcgggaggagggcggggaggagcgctcttcctggttgggccctgccctggctgccaccgggaagccagcctcagggactgcagcgacccccaaacacccctcccccagtaagaagctgggtagccgagccgggattccttgaccctggccactgctcctgggctgagggctgccccagcacggtcccttctcgggggcctctgcgttcctggagcaggggtgggggtggcggagcggcacagcccaggcgcctgtcccagcctggctcaccgctgtccccaggggtgggctagggcccaccagctctgatatcgagcctgctgcgggggcctgaggagggggacccgaccgtctggggttttcagcccacggcaaggggccggtgcaccaggagcttggttagttggggagggggttgcaggcctgtgaacaggatcaaagaggccttccctgctgtgtccccctgcccagttccttgtgctgtctggaggctccgccctgccccacctgacctgctggctactacagagctgcaagcccctgacaatgggatccgggaaaggagaggtggccggcacgctgggaactgggaaatccctttcctggattcactgggagcaccgggaggtggctgagaacctacttctgtgaggggagcagtgaggcagggaaaccctaggtttggggatggataagcagggcaggagagcagagcttgcaggcaggagcccaggttctagtcttgggaaggcctgggtctgagcaggcccatctgtccggcaggatgtcggaggagatcatcacgccggtgtactgactggggtgtcagcccaagtgcagaagcagcgggccagggagctgggcctgggccgccagagaatgccatcaagtacctgggccaggattatgagcagctgcgggtgcgatgcctgcaagtgggaccctcttccgtgatgaggccttccccccggtaccccagagcctgggttacaagacctgggtcccaattcctccaagacctatggcatcaagtggaagcgtcccacggtgagggggccatcctgggtgggactcggctaagccagatcctggatgaggagtagggatgggatccatgtccctggtggggaatggggtctggggtggcctggtgccaatttctgggaggggtggccgaggaacaggactctgggtctctcgtaggaactgctgtcaaacccccagttcatgtggatggagctacccgcacagacatctgccagggagcactgggtaggcccccagggcgcgggtcccgggtattttttccacagtagttccccattcccgctccttcaggctctgcccaacccctccctcttgcaagcccaggcaggatctggctatcagcgctggggctggtttgccagattcctgggtcttttctgcaagctgaggggagttaagtggcaccctggccaaggaacccagattctccctagcacccgcttccccccccggggcaggttggtagagcaggctaattgcatccctcctgccccaggggactgctggctcttggcggccatcgcctccctcactctaacgacaccctcctgcaccgagtggttccgcacggccagagcttccagaatggctatgcggcatcttccatttccaggtgagggctcccctggggaggaggggcagcaggcactggggagatgcggaaggatgacccacaatacctgcagttagggccacaccctgtggggccagcctccctctagcaggtatttgacctctcagtgccatctcgggtctgtcatgtgtgaagtgatgggctgggcaggtatttcggctggcagttttcctaggtggttgtatgtatcaggtggaagtgcttgaaagaacagaaagacttttgtgttatatcctgtgggacaaattccactcctccggaggtcggtctcagttgccccatctgagaaaggagtgttcgctggggaaaacagatagcacgtgtggccttctccacgtgtcaagcctcctatcccccaactcctcctgcgctttgcaaggtctgactgagcccagcagaaaagaaagactcgggattaagtctacgtaaaccacttttcctgacggtgtgcccagggcccatttttcaagtcacaccaatcaattctcaatggctgcctttgggagggacatgcccagcaaccctggatgagactctccagccttggaggcccagccctgcccgaaggactcttgggtgttccctccttctgcctggttagagagcccctaccctactctgtccttgcccgccttgcgcgggtggaggtggccctcggaacccagggtgggaacccacagtgcggatccactttggcccagcgccacacccacctgctccagtctgcagggcgcagtctcgcccccttccctcgctcctccaatccgctcctccctggcctccgattgccagttcagtacccgccacccacactctccgcaacctgggctcctagggccgcctccacccgccccgccccccgttgtcctggccccgacccctcagatggtacctcgagtccttggcgcttctgaccccagacgccttcggccccgaccctgccctgggaaacgtggcctttgtgcatctcagaaacaaagcccgtgattgtgagaaccagtcctgcccatcttgtggttgtagatctggatgccacattttcactgctcatccaatgacacaggtgcccctaacccccttgatagggagggaagagccagggggccatggcctaaaagggggctagttccggaaagcccagccccagagcttttccacctctccgtgcctgaggaggaaccctgtttgttcagtgactcctaaaggctttgcctgtgctcttgtttaagtcttccgtgaagaaggcaccgctgctccttttatggatagggaaactgaggctcagaggcgataacttttccaggatcatgtagctagttgtctcgagcatacatgtacatatcaagtatacacatgtctatatgtggtatgcatgtatagtatacagcaaatatgcaggtatctagtatacattgtacaggcaaaggaaagcatcccttagccctctgaaggttcactgaaaaatcaactcacaaaaggaggttagtaggagaaaggcatacaaattgattagcctgcagcgtggggtcgggaaccacagagtgttcaccccagcccacaatgggtacagaagcctatataccatcctgaggttacaggaagaatgggggctcaacatggccaaaaccagtttctggtggtaaatcaggttatagtggcaagacagactatgaagggggagaaaagggggcctgggtagcaaaggcagtcttgttatgtagatgaaacctccaggtagcagccctcagagggaatagatggtaattgtttcgttcagacctttaaagggttcaggctctcagtctgacaagggaaggccttagagaaagcctggctacatcaatgcagatttctctacagatgcaaatctcccccacaaaagacagtattacagggctacttctgtttcagaccctctgaacagctatctcaaaatatgttgaagaagtatatttcagggtgaaatatttgatttccttcaatacctagatacatgtatctagtatatctgtagcatacatgtatcagaggtacacatgcatctagtatgtatctagtatatgtgatttagtatacatgcatctatatgtatctggtatacctgacctagtatacatctagtatgtatctaatttacatgatttgtctatgtgtatctagtatgtatctgggatgtagaatcctgcatctaggaaggtaggggaaggatggagctcaggtccgggggattccaaagcaggtactcaccgtgcccctcccccaagctgtggcaatttggggagtgggtggacgtggtcgtggatgacctgctgcccatcaagacgggaagctagtgttcgtgcactctgccgaaggcaacgagttctggagcgccctgcttagaaggcctatgccaagtgagtagcggctgagggggcaactccagcttccagctcccccaggggtgggggctcatgactgtcttctcagagggtcctgcttgatgccagagtgctgactggagctgcccacagggtaaatggcagctacgaggccctgtcagggggcagcacctcaggggctttgaggacttcacaggcggggttaccgagtggtacgagttgcgcaaggctcccatgacctctaccagatcatcctcaaggcgctggagcggggctccctgctgggctgctccaagacgtgagtgtgcccggccccgatgctttggtaccctggaaccctggtatcctgaccttcacattttctaaaatccccacccaggctccgctccagaccctgtcctgcacttaagctcatctctggatgcataccctgcctcatccatcacttccaccccccatgcctggtgtcgccctgtcctcacctacccactcctcccccaaaacttcacacctcagctctttcctgtgctgttttcccgtctaccatgctgtttccctcattcctgtcatctcaatccatgccatcctcgtccagttcaccagcctcagatttcatctcctggtctcagttcccacccatccctagcccaatcccacactcactccattcccacccttccctgctcctctgttcccacactcaactcgctccccagtcctcaacgccagacttgaccccagtatcactgccatccgcagctctaacccagctcccattcccatttctaactgactcttctgtcctcacgtccttctccgtgaggccactgagggctgtgtggctctggtgggctgtgcacggctgtgtgtgtgcacatgcatgtcgcacaggttctggtcagccctggccagtagcagtgtcagcggagtgcctgggctccccgtcccagtggcagcattggtggggtacccaggctacccctctccaaaagagcagcatcttatgtgggggtgtctataggtgggatcggggtccctgcttgcttctcctagcaactgtttatgtgcaagtgggaacgtccaagaccctgagtgctgggggctcatctgatagggcgggggacctagccactgaccacagtgtgtgcctctttctgcagatctccagcgttctagacaggaggccatcactttcaagaagttggtgaagggccatgcctactctgtgaccggggccagcaggtactgccctgggtggggccttccctgaagggcggttcctgccccctggcctgtcttgcctctctggcacctgaccagggctgtggaaggtgctggctcctcctttcccctcctcagcaccttatctctcttctggggacacccatctgagatgcctatcatgtcctgccctgctgactgtagttcatgtgtgcagctgcctgcctgggctgtgaattccaagaggacaggctcatctgggtgctgagcagggcttggagaggatgagggtatgggaggcggagtgttaaatgcgtgcatgggccaggtgcactggctcacacctgtaatcccaacactttgggaggctgggtgggcagatcacctgaggtcaggagttcgagaccagcctggccaacatggtgaaacttgtctctactaaaaatacaaaaactacctgggtgtggtggcaggtgcctgtaattccagtatttgggaggctgaggcaagagaattgaattgcttgaacccaggaggcggaggttgcatgagctgagatcgcaccactgcactccagcctgggtgacagagcaagactctgtctcaaaaagaaaaaaaaaaaaagtgcctgctggaagctagcactgacaggagctctggcaaatagtgaactaccgaggccaggtggtgagcctgatccggatgcggaacccctggggcgaggtgagtggacgggagcctggagcgacaggtgaggggcagtgggcactgtctggagtgccttgggaaactgttaggtgccccgacatttctgctcgggactctaccaggccaggctggactaggattgagcagaggggcccatcttcgcgcgactgggtctgggggactgctctgacaaactcaggccgtgcgggcccctgtgcccagccgtcgggtgtgtgcagggcatcagactggcctgatgagaccaccccctagaagcggaaccttggcgcttgaccttgaggaggccacctggctgggccgggggaagacaggccagggtagacaggccccagggacagaggccaggcaggcagtgcccaccagccctggcagagccctgctcctcacagctcctcagagtggaacaacgggacccatatgaacgggaccagctccgggtcaagatggaggacggggagttctggtgaggccccctccccttctaccccacctctccacccctacacatcagctctgtgccctgacggctgtgcctcacctgtgtacctcccacctcaggatgtcattccgagacttcatgcgggagtcacccgcctggagatctgcaacctcacacccgacgccctcaagagccggaccatccgcaatggaacaccacactctacgaaggcacctggcggcgggggagcaccgcggggggctgcgaaactacccaggtgcacaggggcgggctctgggtcttgctgcttcctggcttaggggcccagaaggcacgtcatcttactgagcctccgtttcctcacttgcaagatataggctgattcttgaatttgctttgaggagtaaaatattaaatgtcctagtaaattttaaagaggcatcttgactcaccgtcttggggcctgagcccagggtgctcatgaggggcaaagatcttgtgccatccagccacctgcctgtcactcctttcctgggcccttccctcctgccttcgctttttttttctgagacagagtctcactctgttgcccaggctggagtgcagtagcgtggccttgctgactacaacctccatctcccggattcaagcaattctcctgccttagcctcccgagtactgggattacaggcacctaccatacccagctaatttttgtatttttagtagaggcagggttctccatgttggccaggctggtctcgatctcctgacctcaggtgatccgaccaccttgcctcccaaagtgctgggattacaggcgtgcgccactgtgccaggtcccttcttgccttccttgccacctttccctgggcttctagatccatgtggctgatgtgggccacagcctggccctcagttccttgtcactctcactgcagcacgctttttctctaccttagctcagcccccacatgagggcaccagagctgccttgtcttgcaaacacccgctctctgacctccaccttcgctctttccactcccttagtcttcaacccttcgaccaagccagtccgttgaacccatcactgcgtaccatcctgcctctcccatcttgccttctctccttacctaggttagagctatcatttaatcttgttcctacaaacactttcagttccctggcccctgtctcccatcatctggccaaaacccatctccactggcttgggaaccattgagtgtggcaggagagaaatcacataacgatgccatattttccctgtaaattcttagccacaaatctcaaatgagcattttccatatccccagcaattccactactggttagtaacatttccactctcacctcgatatctccccatgttactctcaccttcgggcctggccttgcacttcactgaaaagatagacttcatcctgaggacaccttgtgttcccacctccaaatcccccagccttctgcacctgtgcctgtgtcccatcgcctccccacctgcgacagtggcagaacagtccctgttcatggggacccccacgttgctccagatcccattctccctcacctctgaaagcatttgctccttcatctgtcacctcctctccagtgtcattacggagagtcctctgtcttaacacaaagcaaccctctcgacccccttccctgttcatttctccgccctccttcaaagcacaatttatcaggaattaccatactcctatttcctttctcacttctgcttcattgcttaacccttcccagtccagcttcatcccaccatgctgctaaaaccaccctctcaaaggtcacttaagctttggccttgccagatccgcgctgctctgtcctcctgtgctgcatcctcagcacggctccctgccctctgttttgaagattcttctcccttgtagggatccaatttcagtctttccccaaatagataaccaccgttcctgtaccatttattgagaaatacatcatctcgtctctccccagcagcactagcgccctcagtagtcctgaggtatgtgttggtctgtttctggactcaccattctgtccctgggtctaccctctgccgataacacattgaatccattactacagatgtgtaagtcctgctgttggacgggcaaattccttcttcaagagtctcttagctgttttttttgttgttggttttttttgttttgtttttgttttttgagacggagtcttgctctgttgcccaggctggagtgcagtggccgatctcggctcactgcaacctctgcctcctgggttcagatgatgcttctgcctcaacccctgagtagctgtgattacaggtgcccgccaccacatccagctaatgtttgtatttttatagagacggggtttcaccatgttggccaggctggtttcaaactcaagtgatccacctggttagcctcccaaattgctgggattacaggcgtgagccactgcatctgtcttagctgttctgacctctgtttttccaaatgaattttagaatcagtttaccaagtcttttgaaaaaccatttgagattttaatttggaattacatgaaacctatagaccaatttggggagacttgacattttataattttaagtcttatccaaggatatggtgtatctcttcatttattttggccttaatgtctttcaatagaatgttgtattttttatcataaagaatttatacatctcttgagattaatgctaggtacactataattttgtttctattataaatagtatgttctttaaaattaatctcccaagtgatcttgttgctcatacgataacatgcatttgaccttttagatgtagttttatatccagcaaattttttaaaactaattaatcttactgattcatctgtatgtatttttggcacgatcttagctcactacaacttctgcttccctggttcaagtgattctcgtgcccagcttcccgagtagctgggattacaggcgtgcggcaccacacctggctaatttttgtattttattagagacagggtttcaccatgttggccagggtggtctcgaactcctgacctcagtgatctgcctgccttggcctcccaaagtgctgggattacagtgagccactgcgtccagcctttttggttttctaattaggaatatagcatctgcaaataatgacagattgtttcttctttctaattcttacaacttttgttactttttcttgtctaatatgctgcctagaactgtaagcttcctgctcttgttcctcccttttttttattcttatttttaggagcaaccctattactaagcctcactcttaaaggggaagttttcaccactaagtacctttctaatctaggtttttgtggataccttttatcagactaatgaagtttaatattgttaaatactttgaattgtcatattatgatgatagtatgcttttttcttttatttattaaaatggtcccaggaatttgtaacagcttgggcaatacagtgagacctcatctctacaaaaaatttaaaaaattagcctgtatggtggcacacacctgtagtcccagccactcaggaggctgaggagggaggatcatttagccagggaggtagaggctacagtgagccatgtttgcgccactgcactccaccctgggcacagaacatgaccccatttaaaaaaaataaaatggtaaattgcatttgttgcttttctacgttaaatcaactttacattcttgagataaaaacaacatggtcacgagtgacgtttgccgttattttcctttcttatactaaccatactggtatcagtgctatgttcttcctgtacaggaggtgggaagtatcctctctttttctgtttcctagaagagtttacctaagatgggagtatttgttgcttgaatggttggtagaacttgtctgtaaagctgtcaggcttgcttttttcttgtatgaagattaatgatattcagtattgaaagttaaaggttatagaattgttcagatttctgtttcttgagccaattttgatgagttgtattttcttttgttttttctttttcttttctttctttttttttttaagagagacagggttttttagagagaggttactcactgcaactcgaactcctgagctcaaatcctgcctcagcctcctgagtagctgggactacacaggtggagcctctatgattggctaattttttatttttatagagatgggggtctcactatgttgccaggcttatctcgaattcctgggctcaagtgatcctcccaccttggcctcccaaagtgcgagattacaggcatgagccactgtgcccagccctgagttgtattttctaataatttatttttgcatctgttttcaaagttattagcacaaagttatccttaatatactctttttttttttttgagacagagtcttgctctgtcgcccaggctggagtgcagtggtgccatctcagctactgcaagctctgcctcccgggttcacgccattctcctgcctcagcctcccgagtagctggactacaggtgcccaccaccacgcctggctaatttttttttttttttttgtatttttatagagatggggtttcaccatggtctcgatcatctgaccttgtgatcctcctgcctcggctcccaaagtgctgggattacaggcgtgagccactgcacccagccccctcttaatatactttatgtctcgtgtataataatgtcccctttttatgcatgggattgctcatttgcattgttcttttgtctttattaatcctgcaagaagtttgtcaatataaatctttacaaataaatgcttttggccagctgcactcaggagatcgagaccatcctggccaacacagtgaaaccccgctctactaaaaatacaaaaaattagccgggcgtagtggcaggtgcctgtggtcccagctcttgggaggctgaggcaggagaatggtgtgaacctgggagacagagcttgcagtgagccaggtcgcgccactgcactccagcccgggcaatagagcgagactctgtctcaaaaaaaaaaaaaaaaaaaagacttttgactttgttggtcctttgtatagtatttctttttcttttatatttttacttatttatttagagatggggtcttgctctattgcccaggctggagtgcagtgcacaatcctagtcctctgtgatcctaggtcactgcagcctaaattcctggctcaggtgtcctctcacttcagcctcccaagtggctgggattatacgtgtgtgccacagtgcctggtgtatttttttcatatatcattaatctttactgtttattatctcattccttctactttcttggattgattttttttttttttttttttttttgagatagtctcactctgtcacctcggcggagtggtgcgatcttggctcactgcaacctccacctcctgggtttaagcgattctcttcctcagcctcccaagtaactggaattacaggcatgcgccaccatgcccaactaattttttttttgtatttttagtagataccaggtttgaccatgttggccaggctggtcttgaattctgacctcaactgatccgccctgctgtgggctcccaaagtgctaggattataggcgtgagcaccacgctcggcctggattgactttttgactttattttatgacttcttaaattagatgttatttcgttaatttagatttttaaaatttaagcaactaaagtgataaatttccttttagtacatcgttaattaagttacacaattttgatacatagtgtttttgaaaatcgtgaatggtataattcacacaccagaaaatttgcacttttaatgtgtgaaatttagtggtttttaggtacccacagcgttgtgtaagcattgccgttatccagagcatttcttcaccgcccccacccgaaaatcccgtaattattggccatcactttctatccctttctccctagcaaccatgatctactttttgtctctataaatttacctattctggacttttttgccttagcataatgtttcaagcttcatttatggtgtagaagtacttcatctcttttttatggcagattaatcttcatgatatggatataccacattttgctgattcattcatcagttgatggacatttgtgttattccagtttttggctatgtggagaatgttcctgtgaacattcatgtgcatgcgtttcaaatatgttttcagttctctggggcctataactaggagtgaaattgttgggccatagggtattccatgtttaattttttgaggaactgccaattgttttccaaagcagcagcaccatttttatccccaccaacaacatgtgagggttctgatttctccacatcctcttcaacactagttttgctcttctttttgattatagccatcctagtgggtgtgaagtggtatcactgaagtttttgggggttttttttttttttttttttttttttgagtctggatcttgctctatcacctagctgaagtgcagtggcgccatctcagctcactgcaacctctgcctcccaggttcaagtgttctcctgcctcagcctcccttagtccctagctgggactacaggtgcacactgccacaccagctaatttttgtagttttagtagagacagggtttcacccttcagaccagccgtgttgtcaggctggtctcaaactcctgacctcgtgatctgcccacgtcagcctcccaaagtgctagattacaggtgttagccaccgcgcccggccaattttctgaatttttaaaatcatgaacgatgtgctttttgtgcatcaattgagatgatcattttgaggtttttttccccttcattcattaatgtggtatattacattgatcaactttcctttgttgaactacccttgcattcctggataaatcccacttcatcatggtgtatattccttttaatatgctgttgggttgggttcacgctttttttgggagggggtggatttttgcatctatattcataagtgatattggtctgtatcttctttccttgtggtgtctttatctggctttaaggtaatgctggcctcctgggatggttaggaagtgtcccctcatcttcagttatttagaagagtttgaggattggtgttaattgtctttaaatgtttggtggaatttcgaagccatctggtcctggacatttctttggtgagagttttttgttgttgttgattcagtctttttattattataggtctatttagattttctattttcctaggtcagttttggtgctttgtttctttctaggaatttgttctttttgtctatttatctaatttattatcatataattgtctatagtgtttccttgtaatctttttatttttttaggctggtagtgatgtccctctttaattcctgattttagtaatttgagtcctctgtctttctcctgtttaggccaggtaaagaattgtcaattttgttgagcttttcaaagaactatggttttattgatttttctttattgtttattctctatttcatgtatttggactttaatctcattatttcttttcttctgcttgctttgggttcaatttgcccattttcttttttcttaatcccaagaaccagtgaaagttcattttctagtttctttttttaatttaataaatccatttttatttcatatatcatagtgggacatatttttggggtacatgtgatattttgataactatacaatgtgtaatgatcaaatcagggtaattgggatccatcgcctcaaacatttatctttctttgtgttggagacattacaattcttctagctattttgaaatatacagtaaactatgttaactataatttcccctgccttactgtcaaatactagaacttattccttctatttactgccttttctagtttcttaaggtggaaggttaggttattgatttgatagctctctctttaatatatgtacatttttcatggccatgctatgtaatttctcattaccattatcatctcttccgataaactagttattttagaagaatgttttttaaaacataaaaaaatttctaactaattttctcatagtaaaaaaatgtgacctacataagatcatagctttgaagtgaacagagctggtgctatggctcagtgtatgatgaattttcataaaggttccttcgttcttgaaaaactggctaacaaattgtgactgtaggtgaagcactcctaagtattttaaatatgataatagcttaactcacactgagcctatgaggcaggaactattattatccttatcttagggatataaagaaactgaggcacagaaagatttaagcaacttgatgaagtcactgatctatgaagggcaaaactgggatttgaacccaggcagagggatcctgaagtctgttctctcagccagtcgctattctctgagtactagggggattgttctataattgtccattatatcaaacttattttttgtctgcttaatctatcaattactgaaagaaagaaagaaagatgataaaaatcttaaacatcctaatggctttgccaatttctctctgtatttctatcaattatttttcattataattttgagctatgatatttggtacatcacatttagaattcttataagcgcctagtgaataaacattttttaaaatctagtgaccaccttcatctctaataattatttttactttcaagctatttcagccaatgtttctatagctaattcagggtttttttttgttgaatttttaaaaatatctttttatactgtttgatgtccaatctttctatagcccaatgttttgttttcttgaaacagcactagccagctttttagtaatccagtttgaaaaattttgtccacgctgggcaagtggctcacgcctgtaatcccagaactttgggaggcccaggtggacggatcacctgagtcaggagttcgagaccagcctggccaacatggtggaaccccatctctaccaaaaatacaaaattagccgggcaaggtgggtaggtgcctgtaatgccagctactagggagactgaggcggagaatcacttgaacctgggaggtggaggttgcagtgagccaagattgtgccattgcatccagcctgggtgaaaagagcaaaactctatctgaaaaaaaaaaaaaaaaaaaaagacaaggaatattttgtcctttgactagagagtttagttcatttacactcacagtgattaatgtgtatttatttcagctgacttactgtgtttacttattttctgcttgtcttcctgtcatgtgccttttgtgttgagttcctgcttttctctctactaatttttttctctgtgagtttgaagacataagagtttgcttaatacatactaaagttagttaatcagtgtctttttttttttctctgagacagggtctggctctgtcacccaggctggagtgtggtggcgtgatctcagctactgcaacctctgcctcctgggctcaagccatcctcccacctgagcttcccgagtagctagtggtactacaggtgcacaccaccatgcctggctaatttttgcacttttttggtagagtggggttttgctctgttacccaggctggtctcaaactcctagctcaagccatccacctgctcggcctcccaaagtgctaggattacaggcgtgagccactgtgcccagccctaatcaagactttaccctcctcgtgaacaatgcataaaccttagaaattcagcttgaatcaccccttcctttgtatattatgctatggtgggctagtattttaattctaaagtttttttttcctgcataatttaaacatcatcatgatttgagatagcccatgttatttggattacccacaaataaagtatttttgttcagcattctcagacctttcatctgagatcattttccatccacccgaacatatccttttgtatttcctttgttttgttttctttttgagcaggcttgatctcctgtctcaggtgagcctcccacctcagtgtctcaagtagctaggactacaggcacatgccacatgcccagataattttttttgggagggttggggggcagttgacggagtcgcgctctgtccccaggctggagtgcagtggcgcgatctccactcaccgcaacctctgcctcccaagttcagcgattcttcttcctcagcctcccaagtagctgggattctaggtgtgcaccaccacatcagctaatttttgtatttttagtagagatggggtttcaccatgttgaccaggctagtctgaacacctggcctcaagtgatccaccctcctcagcctcccaaagtgctgagattacaggatgaagtaccacacctggccctttttgtatttgtatttttattttttagcaagggtctgtggttataaactttctcagtgtttgtctaaaatgcctttatagtgtgcttattcttgacgttctctggatatagaattctggcttgacattattttcagcctctcaaagacactattatcctgttctgcttccatcattgctatgtgagccaggagtctgtctaccttgccttctggaaaaatcttaattttttttttctttcatactatacgattcaccatgatgtgtggaggtaggatttcttttcattctgccttgaatgtattgaacttcctggctatgaattgataccttcaacaattctagaaaatttgtagtcatgatctttgagaatatcacctccttcccactcttgtatattctaataaaatctaaactggaccttctcactcaatcctctctttctcttaacttgcttttagatttcccatctcttagtgtctctggattgcattctgggttgttccttcactcctttctcagttcactaattttcttttttgctctgtcaaatctgttagttatttcttcaagaacttaatttcaattttaaaaattttgtttctagaagatgtaatggatcttttcaatctgttcatttttgctcaaattttcaaacttttcatctatttctttaaacatagtaagatagtcttatattctgtgtctgataaggtcaatatctgaagtcttagtggtcagttttttccactgtggctgctgctcagttatcacgccttgtttgcttgtgagatctctgccccgtagagagttctttgagtcctcagataaagttaaattgctccggggtgtttctgctagtcactggaatgccaccaatccagaacacctttttcgttcttttttatttatttacttatttttgagacacagtcttgctccggctggagtgcaatggcataacctcagctcacttcagcctgacctcccaggctcaaggaatccttccacctcagccttcccagtagctgggactacaggacacaccaccatgcccagctaatttttgtagagatggggttttaccacctcgcccaggcagttttgagctccaggactcatgcgatctgtctgcttcagcctcccaaagtgctaggatacaggcgtgagtctgagtcaccatacccagctttgttctttttttttggagatggactccactctgtcgcccaggctggagtgcaatggtgtgatctcggctcactgcaacctctgctcccaggtttaagcaattctctgcctcagcctcctgagtagctgggattacaggcgtgtgcactatgtctgactaattttttgtatttttagtagagacagggtttcaccatcttggccggctggtcttgaactcctgacctcgtgatccacccaccttggtctcccaaagtgctgggttacaggtgtgagccaccgtgcccggccgccttgttctttttttgagacagtgtctcatctgtcacccaggttggagtgcagtggtgcaatcatagctcactgcagcctcagccttctggctcaaactatcctcccaagtagctgggactatgatagagacacacaccacacgcccactaacttcttacattttttggagagatggggtcttgctaggttggctaggctggtgttgactcctgggctcaagtgatcctcccacctcagcctcctgatttacctgggactacagatcatgccaccatgcctggcttttttttttttttttttttttttttttttgagacggagtcggctctgtcacccaggctggagtgcagtggcgcaatctcagctcactgcaagctccttccccgggttcgtgccattctcctgcctcagcctccccagtagctgggactacaggtgcccccaccacgcccgggtaattttttgtgtttttagtagagatggggtttcaccatgttagcaggatggtcttgatctcctgacctcatgatccgcccatcttggcctcccaaagtgctgaattacaggtgtgagccaccacgcctggtcgtctggctcattttcttactttttgtagtgtggggtctccctatgttgcccaggctggtcttgaactcctgggctcaagcagtcctccccctcggtctcccaaaacactgggattacagtccatcagccactgtgcctggtgcaggaccttttaagactaaattatcttcttaaggtttcacaggcagtgtgaattaaaactgaaagtcatgtgaagcctggcttgaggttattttttccttccctccagggaggtttaattttcttctttctttttttttgtttttgagacggagtctcgctctgtcgcccaggcttgagtgcatggcgcgatctcggctcactgcaagctccgcctcccaggttcatgccattctcctgcctagcctcccgagtagctgggactacaggcacctgccaccacgcccggctaatttttttgttttttagtagagacggggtttcaccgtgttagccaggatggtctcgatctcctgacctctgatccgcccgtctcggcctcccaaagtgctgggattacaggcgtgagccaccgcgcccgcttttgtttttgtttttttttttttgagacacggtcttggtctgttgcccaggctggatgcagtggcatgatcttggctcactgcaacctccacctcccgggttcaagcgattttccgcctcatcctcccgagtaagtgggactacaggtgcccaccaccatgcctggctaatttcgtattttttcagtagagaatgggttttaccatgttggccaggctggtctcaaactcctgcctcaaatgatccacccgcctcggcctcccacagtgctgggattacaggcgtgagccacgcgcccagcctaattttctttcatacttcattgctgacattcctgacgggggttccagttaattgcaggaacttcctgttggattctctacctcaggtagatgtttatcatctgcttcataccctggggttcaggggtctacagaagccctttagcattatttaccttgcagggttctactttctattttttaaaaatatctttattgatacttaattcacataccatacaagtcactatttaaagttgcaatttaaatatactattaaatatacaatttaaatgtactgaagtaattacgattttatttatttatttatttgtttgtttgtttgtttattgagatggagtctcctctgtcacccaggctggagtgcagtggccagatctcggctcactgcaacctctgtctctgggttcacgcaattctcctacctcagccttccaggtagctgggattacaggcacctgcaccatggccacctaatttttgcatttttagtacagacggggtttcaccacgttggccagctggtctcaaactcctgaccttaggtgatccagctgcctcagcctcccaaagtgctgggttacaggtgtgagccactgcacctggccatatattacgatttaaatatactattaaataacaatttaaatatactatttaaagtatattcacagagttgtgcaaccatcaccacatcattttagaacatttcattatcccaaaaacaaatgaggtactccttagccatgactccccaccctcccagcagccctggcaaccacaaatctacttcttatctctatggatttgcctactggatatttcatgtgaacaggatcatataatacatggtcctttgtggctggcctttttcattagcataatgtttgcaaggttcctccatgttgtagcatggatcagaatgttgttcctcttgttgccaaataatatcccattgtttggctccatattttgtatattcactcttcagttatggataattgggtagtttcatccactcagctgttataaataatgcagccattaacatttctctttttttttttaaatggaatcttgctctcttgcccaggctggagtgcagtggcacatctcggctcactgctacctctgcctctgggttcaagcgattctcctacctcagcctccgagtagctgggattacaggcatgtgccaccacgcccagctagttttgtgggttgtttgttttgaaactgaatcttactctgtcgcccaggctggagtgctgtggcacgatctcagctcctgcaacctccgcctcccaggtttaagcgattctcctgcctcagcctcccaagtagctggactacaggcatgggccaccatgcccagctaatttttgtatttttagtagaggtggagttcaccatattgtccaggctggtctcaaaactcctgacctcaagtgatccgtctgcctggcctcccaaagcgctgggattacaggtgtgagccaccgcgccctgccacactcttatgaaaaggctttgcatggacacgttttcatttctcttgggtatagagcttggagtggaatttcgggtcatatgaagctctgtgtttaaccttttgagaaagtgccagaatgttcttcggagcgctgcaacattttacattcccaccggcatcctgtgaggttcccatccctccacatcctccccaagttgttattatctttattattattattattattgtcaatggagggcaggggatgagtggcttattagtgcctttaaaaataagttttgcagtttaccgttctatcccgcactggttgttttagtcaagaaggttctttaggcagcaaaatcacccaactgccagaaatgcaacccctgccttcccttgctggctggctgtggcctcctgtcggacccctgctttttctcttccttcttctaagctgttgtccacgcagcactcgagccaccttttagagtcctaatgcagcacatgcctcctcgctgcaagctgtgggagggttcttaccctttgcttcagtccacacgcctagtccctggccggctcctgggagctctgcggcctccctgggtctccgtgtttcctaagcctccgtaagtgctccctgtccgcagatgcgtggggcccttcctcacctctgctctgggtgccctccgcctggcttctgcttctcagcagcttcccagggcagccccttcgggtctagcgcataggtcccctactctgatctactcctgcttgcttttttttgcagttgctctgccgctaacctaacggacttgctcagacttaagcctctagtttccaaatgcaggccgtgaggcatggaccgagcctggcccagcctgcccatcaccctgcatgttccaggtgctcaataaatttgttgaatgaatgaatgcgtgcacagggacgtgctgaggaggcttgggggccaattgctctgccccgccctgcctctgatccccgcctcctcacctgcccgcagccaccttctggtgaaccctcagttcaagatccggctggatgagacggatgacccggacgactacggggacgcgagtcaggctgcagcttcgtgctcgcccttatgcagaagcaccgtcgccgcgagcgcgcttcggccgcgacatggagactattggcttcgcggtctacgaggtcaggagggtggataccggtggatctcactgagcaggcagaggacctggcgcccccgacccgcagtgcaggcggcttccaccagggggcgccagggaccatgcccttccccacaaattcccctccactcccccaccatcctgagggctgggaaatctcagcctccaggaggcacctgctgaggccctctggcgaaagagaggaagggggttggctcagggaagggagattctgggattcacctcacgcttgagggcggcctgctgctcttggaggagggagctggctcagctgatgcctgggagtactggccctccgtcttggaagctgtgagcagaagctggcaggggaaagataggggatagggaggcctgtcggccaaggtgaggctgtgccagtcgctctgggattagaactccttgctcttgcctgtatctgccctgcttcacacactgccctcaagacagggagagaaacttctggacctcctggtcgcagtcttggcccacacccaaaccccctggcagcagcctgcggtggccctttctgtccctgggctttggaacattgcagttggccaccccgggggctggcctggagcctctactcagaatggagtcctagggcaagcattcccaggaccaagaggaccctgcctgagcccccctcctggggccctgctgtggtgcagggaccagatctgggtccccagggccctgcctttgcctccttatcccatcagtcccgtctaagaactcaagacctctgcccagcatgcactggaccccgccctgggacaaacacacatctctgacttcccctgtctctctattgcaggtcctccggaggtaggtgtggcaccatgacccacctgcagtcacacacccctgatggtgccagggggagcaacccagtggcaaacccaccctggcctggagagctaagaagtcaccttgtttactgcttgaaaaatgcttctccccacctgttcagtgggcagagcaaacattgctctcctagggtcagcacaggtagtcagtgagggagctggatttgagccctggtcctcagagccccgtctgacatgtacacatgaggcttttcctgccttgccatctacaccaagtaagtgccaatagggcggtccagcaatgtcaggagcagggcattagacaggctgagagttctgtaccctgagcagttgcttaagctccgagcctgtgtttgtgtctgtaaaatgggtgtaacagcagacagcaaatgaggtgccgagtaccctgcagtacctgacctggggaaagctcccagtgatataatgacagtgttattgaaacacatgcctaatctgcaatccggtgctcctctcctctacctctgcagtgagtagggttgttacattttacagatgaggaaactgaggcaaaatgtcttttagggtcacacaggctgtgagtgagccatgccccagctctccagccccttggccaggaaaggagcctggagtctgggtctgggggtggcccctgagggtgggctgagtgggcagctgagccctgctccctcctccctcccaccagctggtgggccagccggccgtacacttgaagctgacttcttcctggccaatgcgtctcgggcgcgctcagagcagttcatcaacctgcgagggtcagcacccgcttccgcctgccacccggggagtatgtggtggtgccctccaccttcggcccaacaaggagggcgacttcgtgctgcgcttcttctcagagaagagtgctgggactggtgagtcatggactggcccctgccactctcccctctcccagcctcccctctcaggcccttgctgtccccctctgactggctcctttcctccccactctctgcagggagctggatgaccgatccaggccaatctccccgatgaggtgcgtggtcccaccccaccaggccccgtcctccctcttcctcacccctgggtgtgtgatggggacccaggtgtcctgtcccctgagttcctgtaacagggaagatcccctcctggtggaagccataggagtagtgctaatccctcatccgccagcactttacagtttgcagaggacctgtgatactaatggcacaggccctgagctctcaccggtggcgggtttgtgctgagcacttcacctgtgttacctcatttcctccccacatcaccctgtccgggtcttgttaccatacctcctctgaatgggaaattcaggttcacagaggtagggaacttgcctgaggccatacagtagggatccaaactcttgcctttttttttttttttttttgagagagtctcactctgtcacccaggctggagtgcaatggcgtgatctcggctcctgcaacctccgtctcctgggttcaggtgattctcctgcctcagcctcctgagtagctggattacaggcgcacgttaccacacctggctaatttttgtatttttagtagagacggggtttgccattttggtcaggctggtttcaaactcctgacttcaagtgatccacccacctcggctcacaaagtgctaggattacaggtgtgagccaccgcacctggcccaaactcttgcctttactcactgagctgaacagcatccccttcatttaggtcacatgagtgctggatatggggggggcagggcagggcaggaacgagattcccttttcagattagaaaagtgagactcaagcgggctcagtggctcacgcctgtaatcctagcactttgggaggttgaggcgggcggataactgaggtcgggagtttgagaccagcctggccaacatggcaaaaccccgtctctactaaaatacaaaaattagccgggcatggtggtgggcacctttaatcccagctactcaggaggctaggcagggagaatggcttgagcccgggaggcggaggttgcagtgagctgagatcacgccctgtactccagcctgggtgacagagtgaaactccatctcaaaaagaaaagaaaagaaaatgaggctcagagaagcgaagtgacttgtagcagatatgtgacctcagccctccctccagtgcctccacacgggcagggccggggcctctcttacctgctttctccccttctcggtccacaagtgctctcagaagaggagattgacgagaacttcaaggccctcttcaggcagctggcggggaggtaggttggggcatggcaggttgggaggggcctgtgaggggcagccctctcctgggcaggtgccacctcctctctctccccaggacatggagatcagcgtgaaggagttgcgacaatcctcaataggatcatcagcaaacgtgagtccccgcggggctgtcccaccaccccccatttcttccacatcagaatccaggctcctgctcacacattgagctgaacctcatccctggtctgcatgagtcggggaatcctccagtttttctgagcccagttccctgccatttcctcccatactcctcctcctgacctgccatcctgataatccctgtgctcgggtgctgtgccttgtgggattagcagcgcagcctggccaggcacagtggctcacacctgtagtcccaacatctgggaggccgaggcaggagtcgcttcagcccaggagttcaacaccagcctggacaattggagagaccctgtctctgcaaaaaagtacaaaaattagctgggcgtggtggcatgcactatagtcccagctactcaggaggctgagttgggaggatggcttgagaccagggaggttaggctgcagtgagctgtgatcacatcagtgcactccagcctgggcaacagagcaagacccgtctcaaaaaaaaaagcaggagcagcaccttagtgccaaagaaaagtctacctttcctccagagcctcctgggccaggctgagtggcttggggaacaccacgtgactggcttcactcccagggcagacaactgctggcctctcatcccctcccctcccctttgctgccactgacctcatccacacggtttccttaagcagagcttttctcctcctcttctctgctagtgaagcactcttaccctcctagcctacagcaagccctgccctgccccatctttctacccaatttctcgtcttctgtttcacactcatttctttttactttggactaattgtggctgttgggactttgcttgattgctaaaatactttacttgtacttcctgatgatacaaacaatcctgcccacttctctgccagatattgcacccactcgtcaggatttgtgcgtccttgactctgccccacccgtgctcccagcaggggcaggtgcaggaagctcactaggtggagatgttggaattggttttcttgcagacaaagacctgcggaccaagggcttcagcctagagtcgtgccgcagcatgggaacctcatggatgtatccttccgtttgcttttgtctcctgagtggggttttgggtggagtatcggtgctgggagaactgtcccaggacagcacagagaacaggacagagccatgcgggtgtggacacacagtgccccatgctcagatgtctccctggacgtcttcctgttggttggagggagaaactgaggcacagacctgtgtcaagtgaaaggtggagcaagacctgggtcccattgaccctgaggctggtgctatttctgacccctccccagcccactccactgcagcccactcagagaataaggcaagcccggctgtgggctgactgtacatggcttttgctgcttctctcacccagccccaagtcgacttgccggctcggcggccatctccccttctgcacagttgccactctcccatgactggtctaagtgatggaatttccttcttaacggccacccagcgtgaggcaatgggaagctgggcctggtggagttcaacatcctgtggaaccgcatccggaattactggtaggttgtccccactcacctcagtcatgcaggtgcgggccgggcaggtgggaaggccgggtgactcagcctggccctcaccctctgccgccacctcagtccatcttccggaagttgacctggacaagtcgggcagcatgagtgcctacgagatgcggatggccattgagtcggaggtgagactccaaggctgacggcacctgtggggcccaggacaggtagccccactgctctatgccccaggcccttgtccctggggtgctagtggtgacatggtaacagccatcttgtcttttccccacggttactagcaccctgcctagccccagccccctcctggggacccaaccctcccccatcctgttgggcaggggctgcgcctcactgaccttcactcactctcctggaccggcttcaagctcaacaagaagctgtacgagctcatcatcacccgctactcggagcccgactggcggtcgactttgacaatttcgtttgctgcctggtgcggctagagaccatgttccggagtgtccccaactgcctcccaccctccagctccgtcccaaacgcgtcccccaggagctgggggaatgacagatgggtgaattagcagatacaggccagtgctgtgggtgtgtgccaggaggcctgggtctgggtttggggggccctggctgagtgccaggagagtcggggagggaggagttgacagtggcttctcaggcagcaggaaggggtgaagcttcccagcttcaaggggttcagcttgcggtactgtggggaggtagagagggaccaggcaggaagggggccaggcctgccctgcgtgaatatcccactgagttttcagccctgtatcaccttttcttgaacacacagatttttcaaaactctggacacagatctggatggagttgtgacctttgacttgtttaagggggaacctccctgggcccatggttggggaagagttccaggcgatcgaattttcttatctgccagtgttccctgtcctttcctggaaatgagcctgggcctcagagccaaccctgaagccgggccacctgaatcctgaaaggctggggtgggggtgtctggattctgggaaaggagcagaggggaggtccaggcccttggaggcccctatgggagcagcactctggtttcccaggggggaggaggtaagaaagtaacccctccatgaggttcctgaggtggctcctgagacgtggattgggggctggacctggggtttgggtggggaagaagccagggagccatttctgcggcccagctgacctgcctgttctcccgcagtggttgcagctgaccatgtttgcatgaggcagggctcggtcccccttgccgtgctcccctccctcctcgtctgccaagcctcgcctcctaccaaccacaccaggccaccccagctgcaagtgccttccttggagcagagaggcagcctcgtctcctgtcccctctcctcccagccaccatcgttcatctgctccgggcagaactgtgtggccctgcctgtgccagccatgggctcgggatggactccctgggccccacccattgccaagcaggaaggcagctttcgcttgttcctgcctcgggacagccccgggtttccccagcatcctatgtgtcccctctccccacttcagaggccacccactcagcaccaccggcctggccttgctgcagactataaactataaccactagctcgacacagtctgcagtccaggcgtgtggagcgcctcccggctcggggaggccccggggctgggaacgcctgtgccttcctgcgccgaagcaacgccccctctgtccttccctggccctgctgccgaccaggagctgcccagcctgtgggggtcggccttccctccttcgctccttttttatattagtgattttaaaggggactcttcaggacttgtgtactggttatgggggtgccagaggcactaggcttggggtggggaggtccctgttccatatagaggaaccccaaataataaaaggccccacatctgtctgtgatgtgttttccccagcctactgcctggagggcacctgcaggccccggcccatgggggcagctcgtggctcagctcacccctcccctccaacccctccatctccttccccttgaccttgaagcttgacccctactggagtactgggtatctgggcaagaccacccctggccctgggaggttgggaagaggggccctagctgcagggacagggccacacagctgaggtcccacatggctctgctgacctacatgccctccccgccgcccaggaggcctgacccctacctttcttgcacacttcggccgttgaggtgaggctctggctgaaattcaaacctctacttagcacacacccggcccccagagagctcccccgagcacagagccgccttcaggtccctctgtggggagcccctgtgaccagacacctgcacttacataagccgctccagggcctgctgggatctgggattttcttacagagataagagtggtttgggggaaggaagaggggatggggcgaagctgcaaatgcagagagaggccgaggtgggggagggtgggagttggctgctgtcagctgctgtgggccccagcgtggggtggagatggaggtggaggcccctgtgtgccccatggggaaggctgcccgcacacgctatcttgagcttgcgttttgcccttgtcacctcctcactgggagtccaggtcctgttggctcagagtcttcagcagtgagggcagtggctcagctcttcctgcagcttgggctggttgtgaggggctggagggcaggagggtctgcagggccctgccatcttgctcaaacccttattgctctctggattgggttttatttgatgtggggatgggaacaccacgtctggatgaccgggaccctaacctctcataaactctgagtcactgaggtagaggtgggaagagcagggctcttcctgactgccctatttgggctttcttgctttgtttctttccttcctttctttcttttgatggagtttctctcttgttgcccaggctggagtgcagtagcgtgatctcggctcacttaacctccacctcccgggttcaagcgagtctcctgcctcagcctcccaagcagctgggatacaggtgcccgccaccatgcctggctaacttttgtatttttagtagagagagggtttcccatgttggccaggctggtctagaactcctgacctcaggtgatcagcctgccttggcctccaaagtgccaggattacaggcatgagccactgcacctggcctatttgggcattttaaagggctttttcccacgtgtcacctgtgcagccaagtccctgctttctcgggaagtgggggagggtaagcagctgtaaacactgcatcccattattctgaactctcagcacttaaggctcagctgtgatttggagcctagagacagggactgtgtcccatgtgccaaagccagaatcgggctcccgaacatgcctcggtgtcctctggaggaaagggaaggtgatggtgctccattcatgctggggtcctgtcggtgagggcagtgggcagggcggccagacctgcggatatgggtgtaggctgtgactcagccctcggggtgagagatggagagagctagagaaagggcatggggaggggagccctgcagatgtggggacacctgaaccctcctatggggtgtaacctgagcccccgacacagggtgcacaggatgtctgcagtcctcacccctggcctgttcctccccctccagggcccctcccggcctctctacataaagccgggggtactgggcctcaggtcaggcctaggccatggccttcacagacctgctggatgctctgggcagcatgggccgcttccagctcaccacacagccctgctgctgctgccctgcggcctgctggcctgccacaacttcctgcagacttcacggccgctgtccccccccaccactgccggggccctgccaaccacactgaggcctcaccaacgactcgggggcctggctgagggccaccatacccctggaccagcttggggccctgagccctgccggcgcttcaccaagcctcagtgggccctgctgagccccaactcctccacccgggcgcggccacggagggctgcaaggacggctgggtctataaccgcagtgttttccgtccaccatcgtgatggaggtcagaaggggctgggtgtgtgggggggctgctgccgaggccagtctgaagcgcccatgtcttccctgcagtgggatctggtgtgtgaggcccgcactcccgagacctggcgcagtccgtctacatggccggggtgctggtgggggctgccgtgtttgcagcttggcagacaggtgagcccgtggggataagggccccagccacccagtgcgggccaaaagcctaggcctctgcattcatttttctttgttacagttgatttgtgcattttaaacaataatacatatagtacattcacatggtttcaaatcccgaaaggcacagaagagtctgccgggatcacccctttcctgctctgcccctccttgcagtaatccccagagggcagcctgcttctatgccttttaccagagacattttatgattctatgcagtcaagcaagtgggtgtatagttccattcccccatttttcttttcctgttttgtatttgttttcttcttcatgtgccccatttttttctttgagatgaggtctcactatgttggccaggctggtctcaaacttctacgtcaagcagttctcctgcctctgtctcccaagtagctgaggtgacaggcctggtcatccttttttgtgcaaatgctggcatacaccccacgtggtcctgcacccggctttttcttcgcttggaggcctctcctattccttcagaaagagctgtcccattcctcctagtctttacactaatcccactgtatgaatgggccctaacttgttccccgttattttttagaggtgaggtctcctctgtcacccaggctgtagggcagtggtacaaacatagctctctgcagcttcaacctttgagctcaagtgatcctcctgcttcagcctccccagtagctgggactacaggcacgcacaccgcacccagctaataaaaaaaaaattatttttagtagagatcggggggtgggggtggggggggtgtctcactatgttgcccaggctggtctcgaactcctgggctcaagcaatcctctccctctacctcctaaagtgctgggattacaggtgtgagcactgcacctaactgaccctattgacagacgatgtgcagccagctcatggctctgaagttggctcctacgtctctctcctgcacctctttccccttcctcctcttcgctctctctcccctctcccttctcctctgccttcttctctcagttcaggtttggggggccctcccggactccaccccacactctggagtgagatggctccctgtgccacacacctcaggccctcatcacaccgtgtcatgatacaccctgtctttctacatgtgagcttgtgtcttatccagaatgtcttgtttgtcaccaaccctcactcaggcctgtcacttagaggtgattaatgatcaatgaacattgtgtcacaatgaatgatgaatgaaagaatgcatgaagaaatgaagaaacgagtgagtgagtgagtgagcaggcgatgagtgggcgagcgagtgagtgggcagatgagtgagtgagtggactagtgagtgagtgatgagccggtgactgagcgagtgagcgggtgagtgactgagtgagcgggtgggcgagcgatgagcgggtgggcgagcgagtgagcgggtgagcaagcgagtgggtggataagcgggtgatgggcgagtgagcgggtgagcgagtgagtgggcggatgagtgagtgggtgagtgagtggagagtgagtgggtggatgagtgagtgggcgagtgagtgggtgggtgagtgagtgggtggtgggtgagtgggcggatgagtgagtgggcgagtgagtgagtggatgagtgagtgggtggtgatgagtgggtgatcgagcgagtgagcgagtgagtggatgagtgagtgggtgggtgaggagtgggtgagcgagcgagtgagcgagtgagtcagtgagtgagtggatgagtgagtgaggggtgggtgaatggataagtgagtgggtgggtgggtgggtgagtggatgagtgagtgaggagtgggtgcgtgagtgggtgagcgagcgagtgagcaagtgagtcagtgagtgagtgaagagtgggtgggtgggtgagtgggtgggtgggtgagtgggtgggtgaatgagtgggtggggggtgggtgagtgagtgggtgagtgggtgggtggctcggtgggtgagtgagtgagtgcagagtgagcgagtgagtcggtgagtgagtgagtgagtgggtgggtgaatgagtgagtagggggtgggtgagtgggtgggtgagtgagtgcgtgggtgggtgagtgagtgcgtgggtggggagtgagtgggtgggtgagtgggtgagtgagcgagtgagcgagtgagtcagtgagtgagggatgagtgagtgggtgggtgagtggatgggtgagtgggtgggtgggtgagtgagtggggggtgggtaggtgagtgagtgggtgagtgggtgggtgagtgggtgggtgggtgagtgaggggtgggtgagtgggtgggtgagtgagtgggtgggtgggtaagtgagtgggtgggttgggggtgggcgagtgagtgagtgggtgggtgagtgagtgggcgagcaagcgagtgggtcatgagtgtgtggagaagaaaagctgcctgtcttcttggcctgcttccctgctggccaagttaggctgtgcgctctggccctggaccctcatttgcaaacagggcagatcaccctgccatctgtccttgggcccctctgtggcatggcaaccctctggtccacataatgactccaccctgctcctgctcccacaccagggactggccaagggctcacccgctgtgagttctggttcgagcctccctccagccacagcagtgctcaggtgacctctccccacctgccacacgcccctctgggctttgcagaatccctgcctttcctcgagcccggactaaatctcctcgccagcttcctctacactatgtccctctgtctgtgaccaacctctgccacgaagcctgggtcccagcagttcaagtttctgttttggaagggtggctttcgcggggtaccccatcttccccgggactgcttgataatcccctgctcgggtgaaaggggcaggcgtgggctgcccatttgttccttggggatgctgctgctgcctcccaaaaccctaatgcctgtgcccattctctggactcaggctggctgcaagggccccctggtctggtcctacctgcagctggcagcttcgggggccgccacgcgtatttcagctccttcagtgcctattgcgtcttccggttcctgatgggcatgacctttctggcatcatcctcaactccgtctccctggtgagtccagccgaggagaggccaggaaggcgggggctcctgaaagagcagggcgggggcggggggacaggggggtggcaacgtcgaggtcatcggacatttttctcatgttgttttgttgggattctcatccagcaacctcaactcaagcctcccgccagagttctggacctgggggacctgggctcccgggtagtggtggccctctggctgtgggtggggagtccctggatggcctttcccaggtctgggctttagtgtactctctgtaaattgagagggttaggtttattttatttgtgaattagccaacaata

SEQ ID NO: 5041 - DNA, 76427 bp, Homo sapiens
ctgaccctgactgactcccacctgaccctgactcctcccacctgaccctgactccgaccgaccctgactcctcccacctgaccctgactcctcccacctgactctgactgactcccattgaccctgactcctcccacctgaccctgactcctcccacctgaccctgactcctcccactgaccctgactcctcccacctgactctgactgactcccatctgaccctgactcctcccactgaccctgactcctcccacctgaccctgactgactcccacctgaccctgactcctccccctgaccctgactcctcccacctgaccctgactgactcccatctgactcccaccctcacggagaccacctccttctgcgctgctgccccctctggcgtagcctcctggacttctgcgagctcagcagaccctcgtgcctgccggccaggtgcgcgtctgcaggaggccaactatgcctcctgaagagccctctccacctgcaaggtgccaggactgggagggaaagtccagggccccccaccctccccaccaccctccgccatcagcctgcctgggccagcctgcctcctggcctaggatctccctggggcaggaagtgggtggacttggaggaggaacggcaagggccggtcccacactcttgctcctcctgggcatctggggacaggaacacctctcagggtggccaagagggcttccttgggaccagtgtaaggaagttctgctgtccctgggaagtctcagaaccaggaggaaaccctgtggaggctgccctttgacctttggacgccacctgtaatcactctggatgtgtctgtggagttcaggtttattttctatttaaatgaactaaaagccagcatcctgccggcgtggtggctcacgcccataatccagcactttgggaagccgaggcgggcagatcaccgaggtcaggagttcgagaccatcctggccaacatggtgaaaccccgtctccactaaaaaacaaaattagctgggcgtggtggcgggcgcctgtaatcccagctacttgggaggctgagcaggagaatcgcttgactccaggaggcgcaggctgcagtgagctctgatggtaccactgactccagcctgggtgacagagcgagaccctgtcttaaaaaaaaaaacaaaacaaaaccacatctgttactggaacagagacctcagcccaagctcaggacaaggaggcctccctgggaagggggcctttctcccaccatcaccgcctgtgtccttcaggggctgctggagggcagccaaagccaggggcccaccccgccccaccccaccccaccccaccctctgaaatgtgaaaagctgcactcttcctgtgggctgcgcagtgggctcgggggttggggggtgccggggcgatgttccaccctggactgagtgttcggggcagcctgctcggctgtatgtttctcgcacgctccccgcttcagtgcggctctgtccctgctgccgcctccagtcctgagggaggggcttgcccaccttctacattccaatttttatatctttgaattatgtgattagatattaatttaatgtaaaaccactctgaaagctcttctcacttctgggtgtttgaggtctggctggggggcaaagtggatggtcactgtgcttggtacgcagttgtggaggctgtcgagggcctactgcagacgctgggcgcaggggcgtggggagggcggttttgggacgcggccgtggaggccgtcgaggcccactgcagagcgctgggcgcaggggcgtggggagggcggttttgggacgcggccgtgaggccgtcgagggcccactgcagagcgctgggcgcaggagcgtggggagggcagcgacccccctgcagggccggtgtctccggctgcctgtgtggggaggggagggccgtgcctggttggtggggacaagccacagctccagagctgctccggtgtcaccaggctggccaagtccaagtccctgaggccaccagccttgactgtcctgctggtcccacttttaaagctgctccccggaccccctggccgctgtggactggggtccctccgcacctggcccatttgtggctgcgtcacaggggctcctgtggcctcccagagccagctcgggggtcagatggtcgcgggggctaggtcactgtgggaaaagaggttctgggcatctgtggagggaggggtggagcatggagtcccaggactgtggccccgttggtgtgctggacgggccctgccttgaagaccatgtctattttggaccgtcatgaaataagagtagttctgcaatagcttgagaagtgcctgcagagaggtgagaaggcgcctctaggaagggggacttggggacctcaccagcctgcagccagggaagcttctgggaggaaggggcagctgcggccctgaaggtgagcggtggggggacgcaggggcggacgcctagcaaaagcagctgatcctggaggagagagggagctcagggccgggaaggccttgaggaacaaaaggtggggcggggcatggaggggcacggctgagctgctcacagccaggatccccggtggtgctgctgcctcctcgggcgggcgtgctgatgagcactcgaggctggcaggggatggtgggaggcatcacggcctaggagtgtcattccctgagggagccccacagccagggaggtgggtaaggaaggccggagcccggtcacggtgatgggggtggtgaggagggcgggggctaggaccgcagaggccccgtggagcagcttttgtcgtcgtcgttggaccctaggtgtcaggggctggtacttcttgctccaggctcagctgtcttgggaggtccggccttggctccccctgggaaagagcaggagcagaaggcctggggcttggcatgttttgagccagaaaaacactggtggctgctgcctttaaaacataaataggtttgcttctttaattccattgtgcatttacactcttctttattagtggataaatattagaaaatcatctctcagacaggtggctgagggcgggcccctccaggggctccggcttggtgtgcagggtgaggctgtcccccagggctcgtacaccagcgtggaggtctcggccctcttgatggtgaacttataggatcgttgggcagcaggtttcggacgtcgaaggtgcaggcagccacggggatgacgccacactggcgcactcctgctgtgtccgcgggtccagcagcctgaagcgcaactcatactgctccgtgtggctggctggatggtgacgaaccagcgcagccgggcccagtcctggtgagccgccgcgcctttcggtcaaacacgacaggcatcttggtgctcagcatgagccagatgtgcgggacttggtggcactgacatcagacaccaggcggtgcttgacgtgtagccgccccggcaccacatggtcaggaagctgtccatgacggccgacacgtccgccagccgccgctccaccagcgccagtcggccaggaagggccgtgggtctggcgaccggagcagggcatccagctcagcacgccatggtcgagctgttccaacaggtccccgagcagcaggagctggatcttggtctgagtgtgcccaccttcttcatgcgctggaacttccaggggtcgatgagctggaacaaggcgcaggcagcaccagcgggttctggtcgcccagggccaggtgcttgggcaggacctcgatgtgtaggagcacttacgcagcagctgcatgcgggcgtggtggcgcttgagcaggtgcggaccaggtccgaggtcaggaactcacgcagggcattgcggcgctcggtgtaggtcttccacgctctggttccagcagctgctggtcatctgcctcctcctggtccaggaaggactggggatgcccagcttcatcttgtccaggcccaggcctgccacatgggtgctcattatccgggagcggggggagggctgggtgtcagctgccaggcaggctggcctcccctgggctgtggcatgtcgggggatggattcagcccactgaccccatgctggacctctgtccttcttcgggggcacactcgatgggaagaggctgcctggagggctggatgggcagcctacagatctggacacagttatactgaggggcaaaaacctctactgacaaccagtggcctgtgggacaggacagggagaactaggactgcggacttctggccagaaccgcctgacctgtggccttgcaagggccccgttcctaaccctgctgctgaaaggggttgctggcacccctcggggccgtggagaggggaggcgtggtcctaagcagcacaggatccccctcggggacattcgcgggccatcctcccgcccggttctccctggggacgctccacgcctcaccgcagttgtagggcacagagacaggcccaccaaagacgaggccagctggctggtcagcatgggaggagggcgcccaggcctgggccggaggagcagccctcctcccacgctgtgggccctcgctgtggacccgggatcctgtcccggtgagctcatggactccacaagtgacactccatttcccagatggagcctgaggctaagagcttggttcttgttctcatccagggcttgagcccagtgctgagccgagtctgaccctcgtccgtgggtgcaccggctgagtgcagctgtggccccaggctctgccgcagctccctgggagcaagccgcacccctggttgctgccccggctcccagcaaccctggagatctcaggtttcacagccacttgggccttggacgacccacaaatgagagctaagcagttgctgagttcccagggccacacaggtacgtggtgaagtcatatctgcccgggaagggttgcccttttggggtgaggcagatatgacttcacgagcgcactcctcgggaatccctcgagaacaggcccctggggcagcagggagtgtgtctggggtgaggtgccagctgagagcaggaccccaggacccaggcctaagccctgctcttgctggaggctggggcggatttcaccgctggagggaaaccggcctctgtgacgtgtgagggatgttttctagtctccagcagctgcccaggtggaacaccagagaggctggtcgtgaacccggaaaggtggttctgagcccctcgctgcttcctacacgcccggtcccaggcccgcttccctgagaccaccaggtgcccgcactctaccccctccacccactccccttggctcccctggcccgggcccacctccccggccgctctgcctgccccttacttctcgagacccccagccctcctctcccggcccccgccgccgccccaggaccgcgccccttgccctgcctctgaagcggagccgcgcgcggacttcccagagcccagcctccctccgactccgcgggttgccctggggaccagcggcctttgtgacgctgcggcccgggggcgggggggggtggggacccgggaccccgagccgagtaatcttccatccgcttcgcttcctggaggccccagacttctgggggcccgcgtccccgactgaggggccacggcgggtggctggtccagagccaggctccaaggggggttcccgtcccggagcccttccgcgggcgcaccactcccacgcacccccggcttcgggcggggcgcaggagcctcgggtgactgggagggagttcctgtcaaccccccagtccgagcgcactcctcgggaatccctcggaggaatttgggagagaggagtggccggtgaccaggcggatggaccacccagcgcctggacagaggagaggggcggctcccccgccgcgggctctgcccagcaaggccccgcccattacagatgccacccattacagctcctcccaccgcaggctccccccaccgcaggctcctcaaccacaggctcctcccaccagggctcccccctcccccgcaacggcccctcccatcataggctcctcccaccgcgggctcccccaccacggcccctcccaccacaggctcctcccagagcaggctcctcccaccgcgggtcccctactacggcccctcccaccacagggtcttcccaccacaggctcctcccagcgcagctcctcccaccgcgggctccccccaccacggcccctcccatcataggctcctcccactcaggctcctcccactacaggctcctcccaccatgggctccttccacctggggctgcccagctcaggcaccgacctgactctggataaatggggtctccatagctccagggagccccgcggggagctctgaggccatctggtcccgtctgtatctgttcagttgggctcagggcctctggatccccccgttcccccacagcacaccccagctagctgggggtctcctggggtcacaacttagacaccccaaggtgcccctccttcaccttcaggaagatgctggaggaagacacccttccatcctcctcatctccacccccacggaggtcagtgctggggcctcttccaggatggcgtctttgagcccctaccaggctgttctgtaacttgagcctcccccctcctcccggtgacccaccctggaagagctttcccttggtgcatggaggccccaggggttaggcctggcaggagtgggtggatgtgggtggttttttttttgagatagcgtcttgctctgtcacccatgcgcagtcttcacccccggggctcaagtgatcctcccacctgggtctttctgatccttccggttacaggtgtgagccttgcacccagtcctgttgggtgctgtttctgccctgccctccctcctgggctggaactcaataaatgccagctattgttattgttatttagggctccaggggaaaagccggggttgtttggagaagggggtgctgtctgacgcggagggttgggaagcagtagagttagaccccttacccccggccctgcagcccactgacggagaagcggggtgggggcaagcagcctccccttctcttttggggccaggcaggtcctggatgtctcccctctcctgggtccaccctaccccctttctttcaatttctgatttctaatctaattttttaaagttaaactttggccaggctcggtggcgcaggcccataacctcagcactttgagaggccaaggtgagggatcccttgaggccagaagtttgagaccagcctcggcaacacagggagacccctgtcttacaaataatttgaaaaattagctgggtgtggtggtgtgcacctgtggtctcagctactggaaagctgaggccggaggatcacctgagcctgggaggatgaggctgcagtgagccaagtggtgccactgcactccagcctgggtgacagagggagaccctgtgtctctaaaaagaatataatggctgggcgcagtggctcacgcctataatcccagcacttcgggaggctgaggcagcagatcacctgaggtcaggagttcaagaccagcctggccaacatagtaagacccagtcctactaacaatacaaaaattagctggacgtgatcgagaccatggtgaaaccccgtctctctaaaaatacaaaacactagctgggagtggtggcaggcgcctgtagtcccagctactcggagactgaggcaggagaatggcgtgaacctggaaggtggagcttgcagtgagccgagatacgccactgcactccagcctgggcgacagagcgagactctgtctcaaaaaaaaaaaaaaattagctggacgtggtggtgggcgcctgtagtcccagctactcaggaggctgaggcagggaatcgcttgaacccaggaggtggaggttgcagtgagccgagattgtgccactgcactcagcctgggtgcaataagacagaggcctgtctcgaaaataataataataataataaagttaacttttacttttaagataagtatagattcatctgcagttgtaagaagtaacacagaggcccgttaccctctatccagcatccccagtggtagcatcttgcaggactgcagtgcagaacacgccaggaccttgacgtcgatacagacgcaaggcagtgccacccccacgggaccctgcatgttctttacagccacgctgctccctcccacctctccctagccctgcaaccactcattctccggctctgtctggtcatttcaagaatgtcctatcagtgcaggctttcagtatgcaccttgggactggcttcttgcgctcagcatagtcccctctgtgcagggtcaacagtcactctgttcactgctgggcaccaggggccagtttgtgctcagtcttgctcaaccctgtttgtgccaccagggcacgggcagtgaacactttggatctgttgtccctggtggggacaagctccttccctgggccctgaggatggtgaagcctgggggtagtggggccagtcttgggggagaaatgcacgctgaccactgagaccctcagagctgtgccctccagacacataaacccggatgggggtggcctgatgtggcagagctcctgccacaagcctccatctgaacaccaggaaggccctgcaccccatccccctggtctgtgtcctcactgccattgtaagctcagtgctcttaagatggggaaactgaggcacagggaggttcagcactgtatgcccaaggtcatgtggacatgagtctgacagcaggattccagccctggtcatttttatttttttgagatggagtcttgtcagccgcccaggctggagtacggtggcgcgacgatctcagctcactgcaaccactgtccccagattcaagtgattctcccgtctcagcctcccgagtagctgggattacaggtgcccccatcatgcctgactaacttttgtattttagtggagacggggtttcaccatgttgcccagctggtcttgaactcctgacctcaggtgatgcacccgccttggcctcccaaagtgctggattactggtgtcagccaccgtgcctagccttttctttttttaaaaaaatagagatggggtctcactatgttgcccaggctggtcttgaacccttgggcttaagcgatcctcctgcttgcctccccagatgctggtattacaggagtgagccgcctcacccggccaagccccagactctgaccccgtccagactgatcctgtacccaggcccctttcctcactcccctctgtgccaccacccggttagggctgagggaggaggtgaggtcatgtggggggggcacagcaggcagggaggggctgctgacaccgacacctggcaggggccctatgctgggctgtgttgcgcctggtggtgaggtgaggaaggggtggacgggcgggcacaacttggagggcagcgggacagggcactgggcatgcggggccggggattctgaggaccaccggggaggagctggataaagccggctcggctgcctgccgaccacactcaccctggcatgtgtgcggtgcaagggcagcaggtgcaggagggggaagatggggcagacgtggggagctgatctgtgggcaggtggggcggtggggtgagacacgccggggcagaggcccaatggggccctaaccctgatggccaggcctgccttggttccagctgggcatggaatgtgctgagtcctgtgccatgatcccgtggctctaagggcagggagtgtctgggaggaatctgcattcagtgccctgaacatctgaccctggtgtgggggcacaggagctttccatggcctgaggaggcctccctggggctctgcggccttggcgtctagcggggaagagtcacgtcctagggaggatttgggagagctggtagccacacctgtatcccagcactttgggaggcaggaggatcgcttgaggccaagagttcaaaaccggcctggcaacatagtgagagcccatctctacaaataataaaaaatttatctgggcatggtggcgccacctgtagtccggcaggaggacggcttgagcccaggagatcgaggctgccactgcactcagcctgggcgacagagtgagaccctgtttccaaaaaaaaagtaaagaaaagaaatggtggcaaaagcctcacctgcacgtgaggagacggcggtgggtgtggggaggagacggcggcgggggagtggaggggaggagacggcgggggtgggttgtggggaggagacggcgtcggggcgggaggagacgggcagcgggtggggggaggagagggcggcgggggcgggaggagagggggcggggggaagcgcgggaggagaaggcgctggggcccctcgaaggccacccccaatgtgtatttacaattctccacatttctcaacaccccccaccacccccagcagggcacctctcggtgcagagcctgccctgagcctggcgatgtccagtctcccagggcccctgctggctccggctatcagcccggacacagcttggctgctggggtgccctgagagccaggccacgggtgcactgccaccccacaatgcacacaccagtccccagacgtgaggtttctgagaagcccattgtgactccagggcaggcaggtgcgaggggcttgtcattggctggacactggtcacgccattggagggatgcattcagccacacgcatgaagtgggggcatggatgcgtgtgagatgtggaaaggggcgtgaggctccctgaaggccacccaggtgcggaaggggctgctgggggagccggcaggaggagtgagagactgcagatggcctcaccccacccccgtgcctcaggacccgaggggaggtgggaggagtgagagactgcagatggcccccaccccaccccactcaggaccggaggggatgtgggaggagagagagactgcagatggccaccaccccatcctcctgcctaggaccctgtaccgtgctgctgggttttgctgggatttgctcccccagtcctgccccgactggggacctacctgagcgggcagagtttgcttcagcatgcgggggcttggcgctgtccgggagagggtgggaggtccccagccagggactcacccgccgccccttctccgtgtgctctccccctgaactggggccaggcgtccgcagcctccacttccccgcagtggcctttgggttggcctgggcattgactgactcagaagccggtcatcgggcagcatggggcatctgggtgctggcctgcggccgagctccctgcaatcagcatctcgttttactgcatgaaagccgggggctgagagccccctcactcgcctgtcctcagaatttactgcagaggccggaggctcggccctggtgcagggttaatgatgttaaaatatctggccaacacttaaataagcaggcaattttcacctgagtgcagctcaggcttggcaaccactgcaggtgctgaacagcagcgcttctcgtggaacccccacttctccgtgggcacgggcggctgttggactgtggtgcccttgggctgggccaggcctgactgggcagagccattccgcctgcctgggccttgcagagggcgggaagaggctggccctgcccaccccgccctcctcgggcccctcctggagcccgcccccgcccagcccaagctgccctctgccgtcgggttggggaggggacggtgcactccagacgccaagaggtcgaggacaggaggtgctgtcggtgtgcctgaggcagggggtccgccctgcgcccccccagccccaacgccagcccggacgccggtgggaaccgtgtgcctcctggatccaggggcctctgagtgaccgcagggccggggtcccctgtcaccccacggccagggcagggagcgcggacaccgggtcccaccggccctgccagttcctcttccgggctcgcgggctcccatggcctcgggcccagcgtggtgaccccgggggatggagccgttcctcaggaggcggctggcctcctgtccttcttctgggacaagatctggccggcgggcggcgagccggaccatggcaccccgggtccctggaccccaacactgacccagtgcccacgctccccgccgagccttgcagcccttccctcagctcttccttgcgctctatgacttcacggcgcggtgtggcggggagctgatgtccgccgcggggacaggctctgtgccctcgaagaggggggcggctacatcttcgcaccaggctttcgggccagcccagcgccgggctcgtgcccatcacccacgtggccaaggctttcctgagacgctctcagaccaaccgtgagtacctcggcctcggagtcagagcctgcctccccccagctggggagtccagaacaacggcaggattttgagttggaaatcgcatgtccgtgctatctgttcattcattcgttcatccacgcattcattcagggacagctgatgggccccggccggcaggtgtggtaggaaaacagcagtgtccgctgtgggctgccgagagggagaggggctccggcaggcgtggtcaggtcctgtgggggggagcatcagctgcaccagctggacaccagcaggcggttcctccaggaccctgcctggctggccaggccctcccgccctcacacaggagtccagtgttcatggatcggtcactgcttggagggcaggggctgggggctgggaggaccagatgacaggagctccaggagctctgggtgacggcaggtgagcaggggctgggggcgggggctgagacaggggcccatgctccaggaactctgggtgagggcaggtgagcaggggtgggggctgagacgggcccacgctccaggagctctgggtgaaggcaggtgagcaggggcgggactgggggctgagacaggggcccacgctccaggagctctgggtgagggcaggtgagaggggttgcagaggcgcctagtccagatgcccagtgcggctgctctgagcggctgccttgtctggcatccagctgggcaaggcctgagccctggagaccttcggggtcagccttgctcgggccacttccagcctcctgggggccctttggcactcacacatcgtcctgggggttgcagggcgggtgaagccggagtcacaggaaggggccttctgaggggccccaggccctcacccacacctgccccgcttgtcctgagcagtggttggggggcaagcagcctttgtgatgggaagggctcacagtcaccccaggtgtggaggacagaccccttcagcagttcctggagggcaggctcgtggtggagcagggcggtccataggcaaagctaatgactatttgcctaggctggaattaaaagactaaccacactcaggtgtcattagctccagacacctggccccacgccccaggagagacctcagacacatcctctgcatctcaggatcccacaggggctcacctctgaccccaagccctgatgtgggcttcagaggaggctggcgatgttttggggaaacacctgtgtccatccccacaccccacggtgctgggagggacctgagtccctttacacgtgagagggttggtctccctgccagcagaccccagaaggcaggggccctggctgcaggaggagctccatggcagagcgtccatggagtcagtgcctcaggccgctgcctctctgtccctggtcccacacccttcctgtctccatcttcattcccttcaacttaagcccagccccacggccctggtcatgcagtttctattcctgctgcccccattgccccctaggtcaccggggcaggggtgccagacgtgtcctccgtcttgcccagtcccagtctgccaggatggcatggccgtgccccagccccaatcttgtgttgactctgaggcccacctcgggtcctctcctagtcccgcttcccaggtgtttcagccccaccctgacaccggctcactctgcttcttcctcctggtgcttacggggtggccctggggcaggggagtggcaggcatccctctccgggtcccaggaagctccaggaagtggaggctccagggtgggaagctgagtcaggtgtggagtccccgccttggacttcagcagagagttatgcagacggggtggggctgggagcatttctgtcttccttccaaggatgcctcggctcccaggaatgagtagatgtgacctggtgggcggcccacctggacaggggagacccgccggcccctctcccgacacccggtgtgggctcctcgtgtgtgggcatctgaggagtggcacctgggagctccctgccaccctgccaccgtgttcagagaggtctcacctgcacctggttttccgagggggtgtctgtgcgaacagacgccagtgggcttagggccgtcctgtactggcacaactctccagcatgggatgcaggatgctttgaacgttcgcacagcaacccccctgagccgcccactggctgcccctcctgacctcctgcacagcctggcttaggctgcctcctcggacacagcttgcatgggccccctccactaaccaactgcctgaggcaggtgggccgtgccagccaggtgatgcccatggccctgtacagccacgacagcccagcagtgcttccgggcactcaccaggccgtcagctccatgtctgtgcaggggctcagcgaagccgagtttggaggctatggcccatggccagggctgactgttaacctgtggctggggctggcggtcactatgaaagggaactggaggtcacgcccagcagggctaacggagagcccacggccaacgtgaggatctcagggctgagcaggaggatgaggccggcactgggggctgaggcagtgcagaccttgactgggactcaaagtccacggggtggaccttctccctgaggcggtgggacagccgggctcgccctgccggcaacacggaggagagcatgtggggccactggctgaggggcctgcaaggtactgccgcacctgctgtttgcagctggtactttagcggggtcagtcggacccaggcacacagctgctcctctccccacccaacgaaccaggggccttcctcatccggcccagcgagagagcctcgggggctactcactgtcaggtacctggggcggcccctcctgcctctgtcccccccaggtcagtggcccttgaccttggggtggttggtctctaggcagtgctggctcctgatcacacccggcgccactgagggcccaacagcagatatgctggtcacctcctgcacttgctactcacccatttattcattcattcagtcattcacccactcattcattcagtcactcattacttgttcattcattcctcactcactaattcactcattcattcattcatccattcatctattcactcgttcattcctcactcactaattcactcattcattcatccattcatccactcttcactcgttcattcgtcactcactaattcactcatttattcactgatttgttcactagttattctttcactcatttgcttattcgttcattcattcattcacttttccttctttcctccttattccttcattcattcactgactcatggactcattcattctacaagtatttattagtgcctactctgtgcacaccgtcagcagaaaagctccaacctgggccgctctcgctgcccgccccagcctgtggctgcccacactccctcctccacacagctctgaccatctcagggtcccagctaggtctgagccagaccccttagtgggttgtggccagcatcctctggggtggggggtcggggcagctggcagccaaggcaggggtctccatctctgaacccttcctagtccggcccaggccaaggtctgccactaccgggtctccatggcagctgatggcagcctctacctcagaagggacggctctttcccggcctggaggagctgctcacctactacaaggccaactgaagctgatccagaaccccctgctgcagccctgcatgccccaggtgggcctgtgcctgccagctgccccatgctgggcccgaggcatggccctgttctaggtgctcctccccaccccgtacaaaacccctggggctgtcagaggcgcagctccagggccctgcccaggcctgggagcacggagcatcccagcggttccagcacattctgctctctgcgggtgcctctgagggttgttggattcctggggtcctagggggctgggagtggggaaaggagacctgtagcagtgcccagtctgcaggggagcagccaggagggtggggccagtttggggaaggcactcaaggctgcccaggccccaagggcggaaggtgtgggaggagaggcagatcacaagatgctgcacctgggcggagacactggatcccggggactgtccccgatgtgagccaccctgccgagggccagggcgcagtctggtttctctggtctcataatgacagcgcggccaggggcagtaatgagcatgttagacggatatccggctggggcaaaggtgccacttaggcccccagagcaatgagctccccggggctgggccgggcctccaagcctggcacccactcccctttgtcccagccagggtgggtgagtgtgtgctggggacaggggtgcccgccagaggcctggtgtggggggctgtgcctggacagagcacaggggcccacgctgaccagcctccctgcccaccctccctgcagaaggcccgaggcaggacgtgtgggagcggccacactccgaattcgcccttgggaggaagctggggaaggctactttggggaggtgtgggaaggcctgtggctgggctccctgcccgtggcgataaggtcatcaagtcaggtgaggccccgagatcctgcgccacggccgggccccgcacctgtgtccaaccctcaagccccagggcagtgatgttcgtggcgtgggccggtcctggagccaaccctctctcgcagccaacatgaagctcactgacctcgccaaggagatccagacactgagggcctgcggcacgagcggctcatccggctgcacgcagtgtgctcgggcggggagcctggtacatcgtcacggaactcatgcgcaaggggaacctgcaggccttcctgggcagtgagtccctccctgctgccacgtggccctgacgcgcctgcgaccgccccttccctcctggcgcaagctgaacctgcggggtttccgaggtgaaccgggcctctctaccgggagcaggtggcccggctgcagatcccatccctgtctggtctccagccaacagggggctggcgtcaggtctggccaggccagagccttgtggctccggggctggagctggtgttcgggggcggtggggggcgggtcccatctgggtcaccagccttggtctaatgtgacatagacccagcccagcctctggtcttctctgccctggtctttgtcgggggcctgggccggctgccgggtcactgtggtgagacaggaccctcgccctgtctcacttggggcttcccgtggccttagccggccatgccatctcgccacgtcttagagatgaggaggctgaggcatgggggaaggtgacgtgggtggacgcggcctcaccggccgttggccccgtgccctaaaagaccccgcgctgtctcctgcagccccgagggccgggccctgcgtctgccgccactcctgggctttgcctgccaggtggctgagggatgagctacctggaggagcagcgcgttgtgcaccgggacttggccgcccggaacgtgctgtggacgacggcctggcctgcaaggtggctgacttcggcctggcccggctgctcaaggtagcggaggctctgggcccctgacccagagggggtgggtgaggggaccccggtccacctgcctaccaggggccttccctcgcccccaggacgacatctactccccgagcagcagctccagatcccggtcaagtggacagcgcctgaggcggccaattatcgtgtcttctcccagaagtagacgtctggtccttcggcgtcctgctgcacgaggttttcacctatggccagtgtcccttgaaggtgggtccccaggcagccagagggaggatgcaggctctgcccaggagtcactggcccgggcctggacgctgtcggcaaggggttggagggtctggccaagggcaggcagatgaatggggggctacaggaggcctcctccatagggacccccaggcagaatcgaggcagctctgccccgcgcctcccagggatgaccaaccacgagacgctgcagcagatcatgcgagggtacggctgccgcgcccggctgcctgcccggcggaggtctacgtgctcatgctggagtgctgaggagcagccccgaggaacggccctccttcgccacgctgcgggagaagctgcacgccatcacagatgccacccctgagtcctcacgtgacccaacgctctgggctccagccaggccagccctcctccctgcagagcgccaactcgaagggatgccggtctgccggaccgaggagccttggctgtgggcctcaggccctggcgtgcacacatgttcgtgcaccaggcagacgtgcagcggagggctggggctgacgtcccccgtgcagtgtgactcgtgcagacggagggctggggtgacgtcccccatgcagtgtgactcgtgcagacgaagggctggggctgacgttccccgtcagtgtgactcgtgcagacggagggctggggctgacgttccccgtgcagtgtgacacgttccctggcctctcaagagagacaacggcacaggagggtgggtagaagcctcggaggctcgggtgaggaaccctgagccctgtgtgtctcctgcctgggtcccctggactccctcccaggtgaagagccaaaggcccagttctctccctagtcccagcttgggtttgtggaaatgaccgtgctgactcccaggcagaccgtggtgttgaccccactggatgtgtggtatgtaggcacgggtggcaccgtcacctgcccctcacagacacgctggcggcctgtgcacaaacccactccgcacacagcactcagtaagctgggactgacccactcagacacgcacacaggcgcacatacacacaggctcagccccccaaacccagacccaggagctggagcgtacgggtccacgtgctagaaaatgcaggttggagcggcccccatgccgcccggacccccagcccaggacatcaggtgcccagagagcgtgagccccaagggcattggcaggagctgccgattccatctccctggtgggttccaggtggcacaggaagggtgggccgggaggcttggtgacctgggagctgccttggaggctatttccaggggcctcagggtgggccgtgggggatttggagtcttctgccgtgcagggtcaggcagggtcggttgggggctcggaggtagatgccatggtatgctgggcgcaagtggctcaggaagcctctgggtgtgagtcctcgggggtcaccaaggcaggaggggcagggatgtgcagggtccgccctcgtctccccacgtctggctcagggaagcttctgctcggtcttcgtgaaacacgtcaagaagcaagggggccggtggggtctgtttgtggcccccgagaccctgccccccaccctcctgggagcccaggttggcagctgtgcccagaaggctttcgggacagaaagtttggagacaagttcaggcctgactgagtccttgtcccctagagttgggtcagctctgtacctgctgagccgaagtgctgatggctgccgtccacaggccccggccaagcctggctcaggagggagctaagagatgagactcccgtgtgcagagacaggtggccccgggaaggaagaggccactcggaggctccgagaacggaggcagcgcgggggcttcctgggcccgtgcatcggaggaacaaggccaagcggagggaagcagcaggaaccaggacccctgcgatggtggaggcaagaggctttatctgagcctttgggaccctggccacctgcccagctcatctgcatgggagaacctaggggaggggctggttctggtacctgggcccactgaggcctgagctgagcttccagttctggcaggtccccagcacagcagcctgggggctcctctggcaagaaggcctcgccctctgtgctctctgcagccgccactgggattaaggggaccaggtgttctgtggcacctgtgccctcctaggcatctcgccagccaccagctgaacaggtttggtgtcctgggtatctgggaggggctggggacgttcctgcctcctggtgtggcttagactgaagtcctgcacgtccgaactcagggatactcgaggcttcctggacatagactcacgggcccgagtctggccgggctctgagggacgctgcccggccaggtgccccggcaccctccttccgattccccaccccccacccctccccctgcatcctccccaaccgaccccagacagagctggagggcctgagggacactgcccaggccggcaccccgctgcccctccccaccttggtcagcctgagctgggctgcccagaaatctatgagcctgttaaataatccagattattgttcttatctcaaaacaatgagtggaaggtgccattatttctctttgcaataaaaataaaagttgaatacgcagtttagggactttccttaccaccccttgcagactttgaatttcccttcccgcccttcctgcccccttgtggctgccagtccaggtccctgggttggagctcccgggtggaccagtagggtcagtgggagggtggggcggggaggggcctccagggagggggtgtcccgagctcaggggctggggggcaggcggccgtcgggtgcaggtgggggtcacggcagggctcaccaggcatgagtcgggagaagggaggccagctggaagggggcaggggtcctgcgggctggcaggaggaggcagaggctggaggcgggaggggctgcctgggagggacctgtggccttggccccagcgccatgggcgcttccaggccgcactcacggtccttgcctgccccctggcgtcgtgtggaggaaggcagtgcccgtttcttcagccgtgggtgcccctggctctgcctccccgggatcccccaaaaccctcgggccctcctcttccgggaagtcctccgggccgacccacaagctgtcgctgccctgattccactccctcttccctgcttggcccttacccgagggcgggctgcccatgaggccgctctcaggacgcctgcccacagcagctcctgacattgggccctggctcaggggtggagtctggggctgggtgagggcaccgacgggtggaggggaagctgccgaagcggggagagaggcggcccccacctgtgcccccgcagctctgagggttgggaaggcacgcctgcagccctcaccttcctgccctcaggctgcgaggcttgttcccagagggccgttgcttccctgagtgcctgagtgtccataagttggacccccaagaagccccaaccgggaggcctcctccccctctcctgcgctcaggccggccctggcggtgcttgcccagtgggttccctagtgcgggcgctaagtgctcagatgggccccagtgggcctgaggacttgtggggccggtgggccctcaggaggagccggggtgctctggagcgcctgtgggtgctgggtgtggctgctcccggcctgtcatgaggaagtgggacggcccgcctgccacgcccagctctgggtgctcagctgggccacagcctggtcctgccgctgcgcccgcccgccatggtgtcccgggaccagctcacctgggccccaagtatgtgggcctctgggacttcaagtcccggacggacgaggagtgagcttccgcgcgggggacgtcttccacgtggccaggaaggaggagcagtggtggtggccacgctgctggacgaggcgggtggggccgtggcccagggctatgtgccccacaactactggccgagagggagacggtggagtcggaaccgtgcgtgtcctaggctgctgggagctttgcacaggccaccctctaggcacaggggagggacagggctctgggctgctcagggaggccaagaaggtggggaccccggttccatcttcctgcaccccaaagtccaggctgggcatccccttgatcctccctgcaggccccatgcgctggcgcccaggagtgcccaggactgtccctggggagttggagcacgggggtcagagggcacggcccctgccttgggctcatccttgtcacgctcgggggtggacgctgcattgccgggacccagggaggacagagggtccagggtggactctggggcccggtggccagtgacaaggtctgtcggagcgttccagggcctttgggggaacgaagcttgaagcttgcccagtttccaaagtgccggaaccagacacacgacctagttagggagcgggccggctgccgggcaaacttcctgcctgctgtgccctgcggggaaccagacacagctggtgtggcctggccctggcttccacagctgcccggagctcaggctgaggagggtacgctcctgagatcccgcgtttctcatcagtgattgggcacccactgtgtgtgtgcgtggtcacaggctgtgtagggttagctcccgggggacccaagcaacaagcaggggaggctgtaagaggccgtcgggcaggggcccatggtggagacccctctattacgtgcagacccacgactcgttagcagggtcacgcgcagacccacgacctcgttagtgagcaggggtgcaggggtgggtctggccggaggctggtcagctcccaggtgcaaagaccctgagtcctgagaactcgccaggtgagaagtggggaggaggccaggtgaggagggggtgggaggccaggtggagggggagcgggaggctaggtggggggggctggaggccaggtgagggggggcgggaggccaggtgggggggcgggagaccaggagaggaggggacgggaggccaggagaggagggggcgggagccaggagaggagggggcgggaggccaggtgaggagggggcgggaggccaggtgagggggggcgggaggccaggtgaggggggtgcgggaggccaggtgaggacggggtgggaggccagtgaggggggggcgggaggccaggtgaggagggggcgggaggccaggtgaggagggggcggaggccaggtgagggggggggcgggaggccaggtgaggagggggcgggaggccaggtgagagggggcgggaggccaggtgagggggggggcgggaggccaggtggttggaggggcaggggggcagtgcttccaggtgtgcggaagtggagggggtggaccccaggggctccatgctggccgtggtcttctgtgtggggtttgtgttccagtgacctgagggagtcagacacacaaaggcgcaggtcacctggagcttctgcaagctccacctggaagtccacagtccagggctggccacaccccgcagccgggagttagtgcgcgcgagtggctgtgtgtgcgtgcgtgtgagctgtgggcaagtgagcacacatgcgcgtgtgtgttcaggtgtgcgggtgaactgtgcgcagtgtgggggtttgtgactgtgtgtgtgtgagcgtgcgtcacacatgggtgtgtgcaggcgctctgggcagccatcctgctcagctgccctccccagctccaccctaggctctgaccccagactcgggccactcagggcagggtgtggtagcgcctgcccctgcccccgccgggtcctaggggcctgtcctggcctttcgggacattcagggcgtctgggtcagcgacagctcctgaagcagctgtggtcagggctgggagcttgaggtggcaggcaagggcggctggggttccagcgggcaggctggggccagcgtggggtccacgtggggtgggcccaggtccgcgtgttctcgactcctcccctgcaggtggttctttggctgcatctcccgctcggaagctgtgcgtcggtgcaggccgagggcaacgccacgggcgccttcctgatcagggtcagcgagaagccgagtccgactacgtcctgtcgggtgcggccccggcctccgagcctgtgcttgcctgcgggggccctggctctaagccctcccagccacgtggtgaacccggctcgctctggctgagacggggacatgggctcctctccagggagctcccatcccctccgcccacctggcccgctcctccctgggcctgggtcactggctgctagggtagtcgtggggcagggcccctccctgggagggcagggcttctccagccagccctgcccgaggcactcgtgggaggtcctcagcacccatgggacctcgcccagcatgagacctgagcctggggtgtgcggggcgcagagaaaccccatccctcccctgaggatctcagcatggctgggattttaggcagctgccatccaggcggaggccacggctgcctggcacgggggcaggaggggccagagagcttggccagagcgtgcagggcagggggagccgttctgagggaggggaggcaggggtggtactgaggaagcaccaacagcaacttggggacccagaaactctgcgcaggtgtggccagcagggctggggacgcagggaggcgtggagttggggtggccacacagctcacgctctccctcccagtgcgggacacgcaggctgtcggcactacaagatctggcggcgtgccgggggccggctgcacctgaacgaggcggtgtcttcctcagcctgcccgagcttgtgaactaccacagggcccagagcctgtcccacggcctcggctggccgcgccctgccggaaggtagccgctccgccctgacttggtcacgcggggtcggctggggggtcacaggctggcatttcctactgggagaggttggccgggcagcatgggagggtcctgactcactgacctggggcccactggagggaagcccatggttctgcagagcacggtgtttgcctgagttgggggtggggccaggagaccatccccgggcctggccactctcgagaggccagcggcactctgcagggtcctggctccggtctgtctgggtgtttcatgctggctgggggcagcccccaggagagtccacccttgtgtcagacactcagaaacccccaacccggctgatcgtggccctaaatctgaggctaaatccaggctccctgtgctggcttcagactgcacttcctgaaggatgagcccctgccctgtgtccccgactcttcctccagcacgagccgagcccctgccccattgggatgactgggagaggccgagggaggagttcacgctctgcagaagctggggtccggctactttggggaggtcttcgaggggctctggaaagaccgggtccagtggccattaaggtgatttctcgaggtgagtgggccccgatcagggctctgtgtggcccgtgcctgccctgggccaccctcccaccccgccaacagggacctctggcctcgagccccagcagcacccacagcgtccatgcgagagtggttccctttcaattgcacctatgtttttactaaatacatttattataaaagaaaattttaggccgggcacggtggctcacatctgtaatcccacactttgggaagccaaggtgggcggatcacgaggtcaggagtttgagaccagcctgccaacatggggaaaccacgtctctactaaaaatacaaaaattagccgagtgtggaggctgtgcctgtagtcccagctactcgggaggctgaggcaggagaatcgcttcaacccaggagcggagattgcagtgagctgagatcgcgccattgcactccagcctgggcgacagagcaaaccccgtcttgggaaaaaaaaaaaagaaagaaagaaagaaaatttaaaatccttgacgtatggaaagccattaaaatagatcactggaaatgggtaaaacttccctggaacccgtctggccccagcagaggtctggcctctatgtcagaggtctgggccgggcacaggaagaaatcggtggccaccacagccccgtgggtacgccaggctggggccctgtggggccggctgcatctccatttcgtggcctcgggagccaggtgccctgtcgggggcaggaggtctgtgtgtcctgacagctgctgggtgtgatggctgctgtgtgtgggggcagggccttggcctcttccttgggcctggggggtcaggggctgcatccaccgaggccacccgtccccgcagacaacctcctgaccagcagatgctgcagtcggagatccaggccatgaagaagctgcggcacaaacacatctggcgctgtacgccgtggtgtccgtgggggaccccgtgtacatcatcacggagctcatgccaagggcagcctgctggagctgctccgcggtgagtggcatgggccggggctcttgctgaggcagcgggggcacgtgaggaaataaagtgcacacccccccccacgtctacacacacaacacgtagacacacagacacacagacacacacatgcacacacagacacagacacagacaacagagacacacacgcacagacacacatgcacacacacatgcacacagacatacacatgacacacagacacacacacaagacacatcacatgacacacacagacatacacatagacacgacacacacacagagacacacaaaacagatcacacggacacacacagacacacacacagtcacacggacacacacagacacacacacacacagacacacactgatccagacacacacaagacacacacagatcacattggctcaaagacttcatcctctctaagttccattatttccttctcaccaaaaccaaagacaatcgctgccagggaatggagatgcccgtgcgtgaaggccagtttggattccgatgttagaatgggagggaacgttgtggtataggaaaaatgccgtggtgtctgaggagagctacactgaggcaccacgcacgtttgcgctctgagcgaaaggctcgtacccctcgccctcacacaaagggcttgatcatctcagacagtccccacgcccttcaggtcctccgggagggaatgtggggtaaaacaggcaccaccaggccgcaagccgctgacagcattctcctgttcgagttcccactgcctacatcacgcagtcatgagcctcttcgctggtcttctgcgtccagctcctcccgcgtcatcacaaacttccagaagggaaatcgctgggctgaccactaggaactgctccttggttcttttttttttttttgagacggagtctcactctgcgcccaggctggagtgcaatggcgcagtctcggctcactgtaacctccacctcctgggtcaaatgattctcctgcctcagccacctgagtagctgagattacaggcacctgtcaccaccccagctaattatatatatatatatatatatattttttttttttttttttttttgagacgagtctggctctgtcgcccaggctggagtgcagtggcgtgatctcggctcactgcaagcccgcctcccgggttcacgccattctcctgcctcagcctcccgagtagctgggactacagcgcccgccaccacgcccggctaattttttgtatttttagtagagatggggtttcaccgtttagccaggatggtctcgatctcctgacctcgtgatccatccgcctcagcctctcaaaggctgggattacaggcgtgagccaccacgcccagcttgctccttggttcgtgataaacagtgccttccagaagggcggtagctggcctgcagttccaattttcaatcaggccagctgcctttgccccggcccctcctctgagcccgcagagcttggaggcagatgagacatggcccagctccccaacccttccccacctcagctggctcagctgaccccaggctctgctccactccctctgcagactctgatgagaaagtcctgcccgtttcggagctgctggacatcgcctggcagtggctgagggcatgtgttacctggagtcgcagaattacatccaccgggacctggccgcaggaacatcctcgtcggggaaaacaccctctgcaaagttggggacttcgggttagccagcttatcaaggtagggccctcagagggcgtggctggggtcgtggccggggcgtggccggaggctgggggcttcctgtgtgtggagctggggactcggctgggagcaggatgcggcccctccctcgggagcccaggctgggcagggaggtgggaagccaccgtgagtccggtggggccccattctgaatggcacgcacagcagggcccaccacgcagccgctgccttgttcacgtgcctgttcactggcccagccctgggcccctctgacggcctgggagcctcccagttccctgtccccgggccctccggtccccacacacctgcaatcccaggggaagttgggctcctgaaggtgtcaggccccagtgtggccttagctgcagcggccgtgcgtgggtcagacagtggggtcacaccgtcccactgctggggcaatgcggccgctgtgcccgtccatgcttcgggggcagggacaggcagcccccacggcccactcagctccaggctgattgcaggaggacgtctacctctccatgaccacaatatcccctacaagtggacggcccctgaagcgctctcccgaggccattctccaccaaatccgacgtctggtcctttgggattctcctgcatgagatgttcagcagggtcaggtgccctacccaggtactgtccccactgtccctgactgggcatgagaggcagagtggggaggtcctgggtagccggcagggacgctggggggtgcctcccccacgggcttcaggccctccgcgggccatcgcctgaactccacacctgcaccattctctgagcacccaggctgtgcctggagctgcctgttggagccctgtccagagggaggtgttagcagtggacagtgtgtgggtggcgccaaggcatggcagctgaggctgcggggaaggccccaggaaggggcagtgatggctggtgtggcttcttgggggagggtaggcaggtgggccccagctcttctcatcccgtcggccgcaggcatgtccaaccatgaggccttcctgagggtggacgccggctaccgcagccctgccctctggagtgcccgcccagcgtgcacaagctgatgctgacatgctggtgcaggaccccgagcagagaccctgcttcaaggccctgcgggagaggctctccagcttcaccactacgagaacccgacctgagctgctgtggagcgggcatggccgggccctgctgaggagggcctgggcagagggcctggacctgggatcaaggcccacgcgcttccctggggtttactgggtgatgggtgcaggaaaggttcacaaatgtggagtgtctgcgtccaatacacgcgtgtctcctctccttactccatcgtgtgtgccttgggtctcagctgctgacacgcagcctgcttggagcctgcagatgagatccgggagactgacacgaagccagcagaggtcagaggggacctgaccacagcccgctctctggctgtctgtctgcagtgcccggctgagggtgggaggcaacacgccttgttcctgctcttcccagttcagcttggtgggagaaagtcattcgcgtggccgggacgctcatgtaaatttggttttggtgctcaagggttctttcctcccaggggcagggtttctttcctgtttgtcttgtgtcttgagagcttggccttatgaccagtgagaactcttccctggtctctgccagcccaagcatcactgcccgaggcgccagctcagtttcaccgtcacgtccacaaggggcttttcccaccttcacctttgtcgctgggtcagtgctggaaagcgccctcactcctgcgctgacaagggcccttctctactgtctgtggggtggttccgggctggggggctgcctcctttgcacctgattttgaaggtgtctctttcatccatggttaagtcaaaaaagcttattggttttggttttgactcacctgaaagtttttttggtttaaaagaagataggcggggcacggtggctcatgcctgtaatcccagcactttgggaggctgaggcaggtgatcacgaggtcaggagatcgacaccatcctggctaacacggtgaaaccccgtctctacaaaaaatacaaaaaattagctgggtgtggtggtgggggtgggcgcctgtagtcccagctcgtgggaggctgaggcagcagactggtgtgaacccgggaggtggagcttgcagtgagccagatcgcgccactgcactccagcctgggcgacagagcgagactccatctcaaaaaaaaaaaaaaaaaaagaaagaaagaaaaataattttgggagtttctggaaaggtactaggattttcaaaaggatttgtcttctgccttgtgaaagacagatgtcagactaatcaggcttatccatgtgctacatgagatggaaagcgtgtgaaatagtaagtcacactaagtcttctggaggtctatttacgggtttggttttgatatgaatgttgcagaaactctataaaattcctagaatctgatacgttatcctatgatatatatcctatctcacatgctattcctagaaatctggtcaatgttatcagtcataattttggttattacattaaaatgctgcatgccacagaaataacaagtttccttgccaaccgtgtcacgaatataataaactctcatcagatcctgagccatgctatcttaagtcttcggtcattcacagttattatcttactttgattttttctgaaagcttgcaatcagctagtcccaaattgtttattcttcaaagagattcctgggaaggattctgcaggtgctctggagcacaggtttctggttcaggtcatagccttggattgggtgcaaattccagaactcgaaggagggacctggcaggtccatgaaagttctgtcccaggatcaaccagacaagaattaatgacatgggaatgaatgaactgacgaggatgtttactgtttaatgactttgtctgaagcattacggttctttaatattttgttttccagatgtaagaaaacgtttttgtttctgtttttgtttttgaagacagggtcttgctctgtcacccaggctggagcgcagtgcgtgaccacagctcattgcagccttgaattcccaggctcaagtgatcctcccgcctcacctcctgaatagttgggactacaggaatgcaccaccacacctggctaattttaaattttttttttttaggagattcagggtcttgctatgttgcccaggctggtctcgaactcctgggtctagcaatcctcctgcctcgggactacaggcctgagctgctgcgcccagcctgggcacaaagccgtctgtacgagagttgctggggaaatttctctgaagtctgtatcaagtggggcgcttcagcttacagggctttgggaaaagagcagttttaattttcagtgactccatgaggatggtggaagaaaaaattggaaagagtggtttggtgagctgtaggcaaatattggaggaactgaagttcaggacccggtccggaccacaggtgggcgacaaaacctccagacagcaaacgggctagagtctaatagtgggggcacgagttttattttgaaacataatttttctctctcagtcaacaaatttctttttctttttttttttttgagatagagtttcgctcttattgcaaggctggagtgcaatggcttgatctcggctcacggcaacctctgcctcccgggttcaaggattctcctgcctcagcctcccgagtagctgggattacaggcatgcgccaccacgcccactaatttttgtactttcagtagagatggggtttcttcacgttggtcaggttggtctcgactcccgacctcaggtgatccacccacctcggcctcccaaaatgctgggattacaggtgtagccaccgcacccagccaacaaatttccttcttcctttttttttttgagatggagtctcctctgtcgcccaggctggagtgcaatggcgcaatattggctcactgcaacctctgcctccgggttcaagtgattctcctgcctcagcctcccaagtctctgggattacaggtgcctgcaccacgcccgactaatttttgtatttttagtagagatagggttttgccatgttggccagctggtctcgaactcctgacctcaggtgatccgcccacctcggcttcccaaagtgctgggttacaggtgtgagccaccgtgaccggctgcaaattaacgcatttctatcaaagataataaagtaggattgttttcaaattaacacatttctatcaaagataataaaagattgatttgatgcagagtaagtttggcctcagtaaacctggtgtggttatttatgtaagtggaacaagatagtgattaaccacataggttcttcctcatttttgttttccaacagggcctcaccctgtaccgaggctggagtgcagtggtaccatcatggttcactgctgccttgacctcctgggctaagccaccttccagccccaccctccagagtagctgggacgacaggcatgtgacaccacactggctaatttatttgtattttagtagagagggagccccactatgttgcccaggccagtctgaactcctgggctcaagcaaacctcccatctcaggctcccaaagtgctgggattatagtacacctggacacgtgggctcttttaaaatttgctttactggaactttttttttttttttcctgagacggagtcttgctctgtcgcccaggctggagtgcagtggcgcgatctcggccactgcaagctccgtctcccgggttcatgccattcttctgcctcagcctcccgcatagcgggactacaggcacccgccaccatgcccggctaatttttttatttttagtagagacgggtttcaccgtgttagccaggatggtctcgatctcctgacctcgtgatctgcccaccgtggctcccaaagtgctgggattacaggtgtgagccactgtgcctggcctactggaacttttttaaggaatctgagattgggcttttaaaagcctcttgaggctaggaagccatcgcaaagattgccatcagactttgcctgcaataagtacagatttaggggaattcctctcttcttgagtccctaaggtatcttaagattctgggacctgccaggaattgacattctttactcatctgaagggaaccacgtatgtgaggtaccaggccagcttttttccaaggggctttattggacctgcagtcaaccctaactcctttagtcgtatctgaaaataggacattccagtcaaagcctggtaatataaccaatgttttcaattgtgccctattacaagaacagattctcattgaactatgcaaacccactaacagtttctgaattctgggattagggaggaagaaaaagataaatattcaccgttgaggccattctaacctccctgcctttcttccctgaagcaggccataaaaccaggaaggccactcccagaccctctccctgcagaccctcacgtggtgtcccgccccctaccagaggaaagggatgtcagagtcaagtcgggccttgatcacacccttccatcctccgccactcctgctccgctgtgaaatagaccatttctttggtctttgttttgaaggggcccactcacatggaactcgcattaaatgtttgtatgctttttcttttttttttttaagacagagcttgctctctgacgcccaggctggagtgcagtagcgcaatcttggctcaccgcagcctcgcctcccgggctcaggggatcctcccatctcagcctccccagtagctgggactccaggctgcaccgccacgtctggctaatttttttgtttttgatagaaacagggttttgccgtgttgttgccatgttgaccaagctggacttgaagtcccggcttctagtgatccacctgcctcacctcccaaagtgttgggaatataggcgtgagccactgcgcccagtttaatctgtcttttttcaagggtctgttggatacagtgagttctagatttctcttagaggactcagcatgtatttcagttctttgttctccatttaactcgtgcatagtttcagtaaacaaccttttccaccgttttaatcaatagttcacatctgttcccctggtcacctgctccgtcctgactcatcctgtacctgtttttttttttttttttttttgagatggagtctcgctctgttgcccaggctgagtgcagtggtgcgatgtccgctcactgcaagctccgccccccgggttcctgccattctctgcctcagcctcccgagtagctgggactacaggtgcccgccaccacgcctggctaatttttttgtatttttagtagagacggggtttcaccacgtttgccaagatggtctcgatctctgacctcatgatccacccgcctcggcctcccaaagtgctgggattacaggcgtgagccacgcacccggcccctggtcacctgctctgacctaagtcatctttagctacctgttcctgtcttcctgccaaactactcaccccaccactctgggtcacacccctgctctctttaaaatatcaatcagaattaccttagagtgtgcagtccaaccccacccaacaggggaatgacacagcgtagaggctacctgtgtcaggaataagaaccccttcccctcccttgtccaggtgcgcttcaccattgctccatccgcgagtcgcacccttctatagaagtaaaaattgccttgctgaaaaattaatgtttgagtgctatttctttgtggcaccgaggaagcattttgtttctaacagtctcagccatgaagcttgtgatgggtgaggaaaagatatgacttctccccctacagagatctgatgagggtgcagctcccaggaacaggccatggacacccccagggttgtgaggtctccagtcaaggggccccctgacccgaggcaggggacgatgccgcgggcagcctgtggctggctgctccctactcccagctgccccttccaacaagacaccagctcccgggcagtgccctcccccgctgactccaaaagccaggacagcttctttccaagcagggtggacccacccttgtcctgaccccaagccctccagctcagccaagggcggagcccccccaggccatgtgtggggggacctgagcgtggctgggctctcccttcaacaccaactcctgctaccctcacagcttgtgtacatggaggagggtctctgtgggcttcatctggacactgcaaaaggctgcaggggctcaactgccattaggagcagcctcccactcctgggtccatcggaggctcccccacccgcctcagcactgaccaccggcttggatggctgggtgaggctgcctccaccctgtggacagacaaaggctcagccatcagaggccacaagccagatgccttcccaccagcttcccaccactagtacagctatttatagtgcagtggaacagggtaccaggcagggagcacccactgatcccacccctccccagagtccctcccccaccactgaaccccaccctttcccaccccacggggcccctcctctcaccatgtccctggccacacatcaagtctccagctatctcactgactccacctgctcactaagctgcctctcaacagaactgagtcaatccctgtaggctcctggcgaggtgtggggacaccacccaccttggttatgaaggagtctactaagctcacagcccatcactcctgtgtgtggacccccatccctgccagcctgcagcactcccggactccaacactcatgcctataccaggccagaatgatgcagccaccctcactttaagctgggctgcctgtgcaggaagacccctccacggtgcctgcagcccctacccctcagcctgtcttggggcaacaccctatgggaggcccttgggagacacctaccagcaggaaccaggtccctccagagtgaggcttcccagctcacagccagaggctactccccgccccgcaggccctcgggtaaggggccgaatccctcagaggaccagccctccctgctccctttccccccgctaaaggtggcacggggcccacctcagtggctgccctgggtcctgcttgtccagctccaggactgcctgctgtccaggctctccagaagcagcagtgaaccccacccttatcagccccagcaacagcctcacaggtgaggaggcccagaaaggcctgggagcagggccagcccccacaaggcagtgaggtcggagggattcagccatttctcacactcaaatggaacctcgggccacacagctcaggcacacccatcggggctactggctgcttggagtttattttccgcttggtgccaggtgcacagttcaggtgtcaggaaagctagcgagtgctggggccgggcggtagagagcggggctctcactgtttttggtgtctgctgtgttgatgcgaaggtctgcttgctgcagccgcctagtttacaggtggggggtgggaggtggggaggggggcgagggatgcggagtggggagaggggcggggagggctctggtggactagcgcctccgcaggcctggggctggtggtaaccgctcaggtcagacgggggcccagcgctggctgtgctggactgaccgccgggctgcttcctcggggcgtccgagccaggccacaggcggtcatgctgctggaggcctggggaggttccgagtgctctgcgactccaacaccgtggccatgaacgggagggtggacttcccgaaaaagaagctggcccacaatgacccgggtcagccttggggagacctgagagaagcgaagtggggtcttgatgctgcagctcctggaggagcggggggagaaaggggcgatcctgcactcacctggggggtggggatggcttccccggggcactcggtactgctgcaggagctgttgctggaagtggaacccaggggcctggagaggagaggtcccgtcagcaacgcggggcgcggagccccccagcccaccggcttcaggccgagcgctggttccgcagcctgcacggggccggcactggcgccagcagagctccgcgtggatggggggcaggggctactcacgccggtagtagtcgtgggtggccacgaggagccgctggaggggatggccgccatgctttagcttgctggctggtgggatctgcgcatggggtggaggagcccctcgggtcagcggccttccgtcatgaagggcgctccccagcgggggagccgccgcgctgggttatttaccgaggcggggctccccagctcccggcaccgccttgccgcgcggggcgcgggcggctccaaccagcccaaaccggccgagcgggtggaacaaagcgctttgtgcgcggggccccggcccagacgtcgggaacctggtgggcgccgtcccaaccgcccgacccgagaggagcccgccggggaccccgagcccagcgctcgccaggcggagagggaggagcccccggcccagccccgcccctcgccccccgcccctcgggcctgctcgtcccaccgcgcgcggcgcccctcacctgggcggcgacccctcgcgggcctcggcgcacgatcacggtggcggggacgggggcgctaggccacggagcccatttgcagagaagaccgcgggaagcgcgccacgacagagaggcgcgcgcggggtgcgcacgcgcggacgcgcccacttatatggcgggggccgcggcgcgtcacggagggcggggcgcacaggctcctccccgggccccaccggccccgcccctttcctggccccggcgaggccgcgcccccagcttccacctcggtgcgatctcgccgtctggcttgggctgagcccagccctgcggcgttcgtcttggggcggcccggcggtcctgggtctgcaggggttaaaaggccccgcgcccgggtccgggagcccagccccccccctctcccgggcccaggcccccgtctcggacgcgtctcggagccccgcctggtccagccgcccgtcctcttcagcccttgtggaggcgacgggggcgccgggcgggccaaaaagtgtacgtgcgcggagccctccggcccggcctccagggacttcgcagccagaggaacctggactctcccgagtccccctcacagctctggcagctccggaacctgcaccccggttgcccagcccaggacgcgcctgctgcccgcagggggcggtgaaagggtgggcggatggcggggcaggggaggcggggcccagtcggagagcggggcggatttgggcgggtgaggtgagtctccagcgccggaggcagaggctgggccccactgctcggagaccccatgtttggggagcccagaggttcccggcagggccctggggcccgggggacggcccgccatgccaatcaggagggggcggttttcccttcccaggcagaaaggcgtcctccctctcctcctccccccagcgcagaatctccccacacctccctcggccccgcaggggaaatcggcctgcccctacggaaatcccgttctttatacacccggtcctggctgggcggtgtcttccccgtggaagagagggtccgggagtccgtggggcggaacagtccgagggcttcgggagtcagcccgggtggatttgtttcgtgctctcgttgctggctgggacggccgtgtgcccgtgttgttccggagatcgaggccaacgatgccgtactctgtcctcgccgggtgctcagtgaggacccacagctgggcagggaccctggaggcccctgagcaagacttggagggacgcccttgtgccccctgagcacgtggggaagcgctgtcctgggccctgcaccgctctgtgtgttcattgcacgagtgtggtaagcacctatatgtgcacatggccgagccaagcgcagggaacggtaaaccaagggagaacggccttccgtggggagcagtgcagaggctggcgggggcgggtggtggggagagctcaggtttcagctaggtctaaggacggagggcagggaaccgcctgagccccacctgggagggggagctcggtccggagagcagtgccaggacctgcgatgggagaggtgtgcagccccgaggggtcactgagaggcagacgggtcagttgggttgacactcagagggtcctcaggggcagacgctgagacgggtttggggtttggggtgcagagtgagtactggtgatcagcacctgggaaggggtgggagggtgcagggccgggcagggactgtaggggcggcctgcgttgggcttggctggcacagctttgtggcttgcttggacccatatgcagccgcccagggacgggagaccctggtgaggttctgtggtccaggcccaccctgaaggagccgtggggccgactgccgaccacgcctgacacacggccttccaggtcacccgcttccctctaggctggcctgacccagctcacctcattccaacctcaccagtcaacaccggtcaacatcagtcacagagcgtctgaaaggaggaatttcattttcctttaaagtgaaaaggtaaaaactgcatttactaaaccaggccggtgggggcctgtgagcccctctgcacaggaagcctcagagacgctgcatggtgttcccggggcatccggccaaggtgggagaacgcagcctccgtgaggacccgcgggatgccctcgggggccgcccctggttctcgtctcctctgaagtgcagacgacgctggcccacatccttgtcgggcagagggctgccgactggcccctggccatggctcttgctgggagccgtgtggcctgggcttggcccacatccacctcttgctggctgcctgctcttgccagtggctgagcctggcttctccctgacagtggccgcagacagaggggacccgtgccaccaggcaaggtgagctcagggaacgtagctctcctctcccttggctctgaggggttcggcggtgcccttggtgtgtctgggggctttgggaagtcccaggtctgggctctgggtcaggaagcaggagcgaggagagacactgccccgagcctccccggctgtaggaaatgggggcagaaaagctaagcggacggaagatgcatgtgcgcaagctatagcaggccggttcaggcccggttgctgctaggatgtgatcattggagggatgagattgacggggacggtcagctggagaggacagggcacagctggacgagggcgggacggccacaggcttcccacagggcgggagggaaaggcttccagtcccacttgtaaggctgcctgccaccctgtagccactgtctcctcccttgtggacgggacgatggtggcacctgttatggttgggttaacatacatatgttaagaatgcgttaaccccagcgtgtggggagactagatgggagaggcccctagtgcggaggctcacagccttgctcggcccctgggagcttcgccacctgcactgtgctcctcccacaggtgtctgggggcgaggtgagagttctgccaagccggagccagggttggacccccggagctcgttggtcggcccctggagggagagtggttgttcacaccacggccctggtggcccagctctgcccatcttcatcccaggtggcagctgtgcccagctctctggccagtgcctcttagatggtgtcaccacctgcagaagaaaacagagtgctgactaatatttgatgaaggcctgctatgccggcggcacctgatgtggcaggtgagtccggggggcagcagccaaggctgcctgttcctcagtgtccctgcgcgtgagacgggctagctaactcctgtggccaccttgagggtaagatgcttcctgcaggtgcttggaccagttctggcacggggcaggtgctcagcgaaagttccttattaatccctgtacctttcactgtggaagtaactcaggacattggcttggtggttacacaagcactgtgggagaaggtggtgttctgttcaccctgggtcccagtggctgaggcagagccagccatgcaggaggcaggcgtcagtatgtatattggatggaaggttgaattgcataataaaatatattaaagatttccagatggaggggtgaggaggtcaacaaaccctctctccaaaatgtacctgtaaatctaaacaaagtcagaaacaaccatgtcagtgctttggaatttaaccaaaggcaaacagcaaaccaagagtgtttattcatcaaagagccacgcgctgtggtcccagccactcaggaagctgaggcagagggtcactggagcccaggagctggaagctgcagtgaattacgatggcacctgctctcagcctgggtgacagagagagaccccatctctaaaaagaataaaaccctggacttaggataaatccaaaattacttggcataactgaaccaggaaaatctcaacttaaatggaaaacgagccgggcacggtggctcacgcctgtaatcccagcactttgagaggccgaggtgggcggacacgaggtcaggagatcgagaccatcctggctaacatggtgaaaacccatctccactaaaaattacaaaaaaattagccgggcgtggtggcgggcgcctgtagtcccagctacctgggggctgaggcaggagaatggtgtgaacccaggaggtggagcttgcggtgagccaagatcggccactgcactccagcctgggtgacagagcgagactccgcctcaaaaaaaaaaaaaaaaaaagaataaaaccctacactttaggataaaatccaaaattacttggcataagtgaaccagaaaatctcagttgctgggcatggtggctcatgcctgtaatcccagcactttgggaggcgaggcaggcagatcacctgaagtcaggagtttgagaccagcctgaccaatatggcaaaacccatctctactaaaaatacaaaaattagccgggcatggtgtcgggcacctgtaatcccgctacttgggaggctgaggcaggagaatctcttgaacctgggaggtggaggttgcagtggctgagatcacaccattccagcctgggcgacagagcaagactccatctccaaaaaaaatataataataatacaaaattagccaggcgtggtggtgcatgcctgtaatcccaactactcggaggctgaggcgggagaattgcttgaaacctggaggtggaggttgcagtgagctgagatgcgccattgcactccagcctgggcaacaagagtgaactccatctcaaaaaaaccccgaaaaacaaataaatggaaaaaaacagtcagcaaatgctaacactgagatggcacaggtgcgggatttgtaaaaatgcaccaacctgcagttgtaagccccttacatcaagcgatggacatgagcgagcattggacaacatttagtgtgcgttcacggtgaacatctcggcaaagcaggacagaaaacaacttcaatctaagaaagagctctgatgaagtatttacagccagtgctgtctgaggtgagagaatccttttcccaggactgagagcaggacgagcgcatccactcctaccctattatcaacatttaccggccgggcgcggtggctcacaactgtaatcccagcactttggaggccaaggcgggtggatcactggaagtcatgagttcaagacccgcctggccaaggtgtgaaaccccatctgtactaaaaaacaaacaaacaaacaaaaaacatgctaggtgtggtgtgcgtgccagtagtcccagctactcaggagacttaggcaggattgcttgaacccaggagtggaggttgcagtgagccgagatcatgccactgcactccagcctgggtgacacagtgaaccctgtctcaaaaaacaaaaacaataacaacaacaaaaaagccatctattggaagtctagtcagtaaaatacaagagaagcaaagtacaggcatacagattgaaaatgaagaaataacctctcccgattcccagacaacatgattgtctatgtagaaaatcccaaggaatctacaaaaagcaaactcagtgaataagtggggttagcaagatggcaatatacaaagtcaacatgcaaaatccattgtatttgacatgatttggctgtgagtccccaactgcatgttgaattgtgtccccagtgttggaggtggagcctggtgggaggtgattgggtcatgagggtggtttctatttctttctttcttttttttttttttttttgagacagagtctcgctttgtcccccaggcggagtgcagtggcccgatttcagctcactgcaacctccgcgtcctgggttcaagcaatttcctgcctcagcctcccgagtagctgggactataggcgcccgccaccatgcctggctaattttttttttttttgtatttttagtggagacggggtttcaccatattggccaggctggttcaaactcctgaccttgtgatccgcccgcctcggcctcccaaagtgctggggtgtcagggtgagccactgcgcccggcctcatgttggtggtttctaatggtttggcaccattcccgatgctgtctggttatagagttctcacgagacctggtggtttgaaagtgtgtagcaactccccttcactctcttcctgctgccacgtgaagatgtgcttgcttcccctttgcctttcacctgattgtaagttccctgaggcctcctgtacagcctgcagaactgtgagtcaattaaacccttttctttataaattacccagtcttaggtagttctttatagcagtgcaaggacaaactatacagtatttctacctgcaatgtacagttagaatcagaaatttaaaaaaatgaaatgtaatgaaagtatcaagacccaggcaaacggagagacatgctgtgttcctgggttttggaccaacagtagagatactgatttttgccatgttgatttatacattaaatgcaattccagtaaaatctcagccacattttctgaagatatagacaagcagttcccacaattaaaatggaaaatgaactagaacaactacaacaattttggaaaataatgatacagaggccgggtgcggagctcacgcctataatcccagcactttgggaggccgaggcaggcggatcacttgaggtcagagttcaagaccagcctggccaacatggtgaaaccccgtctctacaaaaaatacaaaaatagccaggcctggtggtgcacacctgtaatcccagctactcaggaggctgaggcagaagattgcttgaacctggaaggtggaggttgcggtgagccaagatcacaccactgcactccagctgggtgacagagcgagactctatctcaaagataatgatatagagaaattatgctacctaataatttttgttgaggtaaaattcccatatcataaaattaagcattttaaaatatgcattcagtagcatcatggaacactcgcaatgcagtgcacccatcacctctgactagttccaaacatttcatctccccaaaaggaaactacacccattaaacagtctcttcccctgtcccctccccagcccctggcaaccactaatatgctttctgtgtctctgaatttacctattctgacacatcatacaaatggaatcatacgagttgtgccttttgtttctggtttcttcacccactttctagattcattttttgtggctgaatagcattcctttgtatggatagaccacatttcctctccatccatttatggacgtcagttgtttccaccttttggatattataaatagtgctttgcaaacattccatgtacaagtttttgtttgaatacctgttttcaactcttttgggtcgtacttaggagtggaattgctggctcacacatcgctgtctatgtttaacttactgaggactgccagactgttttccgcagtggctggaacattttatgttgctaccaacaatggaagagcttcccatttttccacatttttgccaaccttgatatttttcatatttctgattatagcacctcagagagtgtgaagtggtgtcttactgtggttttgatttgcattttcctaatgacaatgatattgagtgtctttgtattgttgagttgtaagagtcctttgtatattcggaatgtggacccttatctgctgtgattcacaaatattttcccccattctatagattctcttttcttctcttgacagtgtcctttgatgctcaaaagtttttaattttggcaaagtccagttactaccttttcttactttgcttgtggttttagtgtcttatctaagaaggtcatgaacaattacctatttttctttttttttttcgagacacagtcttcctctgttgcccaggctggagagaatggcacattctcggctcactgcagccttgacctccaacgctcaagggatccttccattcagcctccctggtagctgggactacaggggcacacaaccactctcagctaatttcttattttttgtagagatgtggtctttctgtgttgcccaagctggtcttgaactcctgggctcagtgatcctcccatcttagcctcccaaacagctgggggattataggcatgagccactgttccagcctacacctatggtttcttcaaatagtagtatatttttattagatcacatattgtatataggtgagggaagagcccggcttcattatattgattgacaggtgagggaggagccgcttcatgatattgatagacaggtgagggaagagccggcttcatgatattgatagacagtgagggaagagccggcttcatgatattgatagacaggtgagggaagagccggcttcatgtattgatagacaggtgagggaagagccggcttcatcatattgatagacgggtgagggaaaggtggtttcattgtattgatagacgggtgagggaagaggtggtttcatgatattgataacagatgagggaagagccggcttcatgatattgattgacaggtgagggaagagcgggttcattatattgcaggtggatatgcagattttctaacgtcatttgttgaaaagactattcttccatatacgacctcattttattttattttactttttattttattttatatttttgagaggagtctcactctgttgcccaggctggagtgcggtggtgcaatcttggctcactgcatctcctgggttcaagcgattctcgtgcctcagcctcccgagtagttgggattacagggatgaccaccacgccccgctaatttttgtagttttagtagagacggggtttcaccatgttggcagcctggtctcgaactcctgggctcagggatctgcccgcctcaggctcccgaagtgctggattaatggcgtgagccactgcacccggccatgatcttattttagaaattgctacaaaacgcaatattgaacacagtgtgcgataacaagatgtcttagaaaaacaaaaataacagaaaaaacaaaacaagacagtgagggccgggagtggtggctcacacctgtaatcccagcacttgggaggccaaggcgggtggatcacgaggtcaggagattgagaccatcctgcccaacatgtgaaaccccgtctctactaaaaatacaaaaattagctgggcatggtggcgtgtgcctgaatcccagctacttgggaggctgaggcgggagaatcgcttgaacccaggaggcggaggtgcagtgagctgagatcgtgccactgcactccagcctggcgacatagtgagactctgtctaaaaaaaaaaaaaaaaaaaaaaaacaagacagtgaggtcttggtgaggagacagatacaacatcagtgtaacaggatggagtccagagacagcctcacacaaatgtgaccaaatgttccggagaaaggcactacagtgatttgacagagcaagtatcatcttttctgccgggcacagggctcacgcatgcaatcccagcgctttgggagactgaggcgggcggatcacttgagcccggggttagagaccagcaggggcaacatggtgagaacttgtctctacaaaaaatagctggcttcgtggcacgtgcctacagtcccggctactcaggaagctgtggtgggaggatcgcttagcccgagaggcagaggttgcagtgagctgagatcatgccactgcactccaccctgggcacagagtgagtccttgtttcaaaaaaaaagagtataatcttttcaacaaatggtgctggagaatttgacattcacatgcaaaaaaaaaaaaaaaaacaaaacaacaacaacaaaaaacaccaaccaaacaaaaaccttgacctaaatctcacatattatacaaagattaactatacaatggataatgtatctaaatataaaatgtaaactataaaacatctagaagaaagtacaaggataatctttgtgacctgagcagccaatattaaaagcatgatccacttaagaaaaatatgataaactgggcttcactgaaataaaaaacttgtattgtgaatgatcctgttaagagatagaaagacaagccacagacttggagaaaatatgtgcaagtcacagaactgacaaaggactgtatccacaatacatagaaaactctcaagactcaacaccaaaaaataaaaataaacaatcaattgaaaacttggccaaggggctgggcgccgtggctcacgcctgtaatcccagcacttgggaggcctaggcgggcggatcaggaggtcaggaattcgaaaccagcctgaccaacaggcgaaaccctgtctctacaaaaaaatacaaaatttagctgggcatgatggtgcgtgccgtagtcccatctactcggggggctgaggcaggagaatcacttgaacctgggaggcagagttgcagtgagccgagattgcaccactgcactccagcctggacaacagagtgagactccactcaaaaaaaaaaaaaaaaaagtcaaggatttgaatagacatttctgcaaaaaagacatcaaatggctaaaaggtacatgaaaagatccatagggttagtcattagggaaatgcaaatcaaaccccaatgagacaacacttcacacccagcagagctctgataaaaagacacacaatataaaagcagaggaatggaaaccctgctacacagctgctgggaatgtgaaatagtgtaacactttggaaaacattttggcatttcctcaaaaggttaaatatagtcacaggattttgccttcaatatctacccgggataaatgaaaacgtgtccacacacaaaaaacttgtaccacctagagcattattcatgttagctaaaaagtggaaacaggctgggcgcggtggctcatgccgtaatcccagcactttgggaggccgaggtgggcggatcacctgaggtcaggagttcgagccagcctggctaacatggcgaaaccctgtctctactaaaaatacaaaaattagtcgagttggtagcaggtgcctgtaatcccagctacttgggaggctgaggcaggagaatcacttgacccgggaggcagaggttgcagtgagccgagattgcaccactgcactctagcctggaccaagagcaagactctgtctcaaaaaaaagtggaaacaacccaaatgtccatcaactgatgatgatgaacaaaatgtggcccgtccctacagcagaggattgtttggcaataagaaagaagaagcactgacgcaggctgcgacgcagagaaaccaaacccagaagcagccagtcagcaaaaccacacactgcgcacggttccattcatacaaaatgcccagaacaggcaaatgcatggaccagaaggcagatgagtggttgcccagggcttggttagaggtggaggaggaatggggacgattactaaatggtacaaggtttcttttcggggtgatgaaatgttctaaaattagattaggtgatggttgctcggctttgtaaatatgctaagagccattgcatcatgcactttaaatggcgaatattatggcatgtaaatgatatctcaataaagctgttttaaaaaaaggataaaggatgggtgcagtggttcacgcctataatcccagcactttgggaggccgaggcaggcggtcacctgaggtcaggagttcgagaccagcctgggcaacatggagaaaccctgtctctataaaaaaaaaaaaaaaaaaattagccagggtggtggtgcatgcctgtaatcccagctactaggaggctgaggcaggagaatcgcttcaacctgggaggcagaggttacagtgagccgagtcgcaccactgcactccagcctgggcgacaagagcaaaactccatctcaaaaaaaaaaaaaaaaaaaaaaaaggataaaagacttaatgggagcttcaccaaagaccgtgtactaactgcccatgaaatgttcttcagcaacattagggaaatgcaaattaaaagcaccatgagaggcacctatgagagcagctgaaaaaaaaaaaaaaatttccaaacaccaaggacaccaagtgtgcagcggccgtgaggctccgggaactcccctgggggtgcagacggcgcgggtttccctccgaagccaggtcggcagcttctggtgaagggaaacctgcgcctgacgtatgacccagcattccgcttctgagcatttatccaagacaaattcaaacaggtttacgttaaaggacggtcacagatgtttatgggagctctattcatagctgcccaacctggaaacattgcaggtgttttctgcgggtgaacagagactgtggtgtgtcgtgtacgagatactgctgagtgatagaagaacgagccgtcgatccgtgaaaccccctgggtgggtgtccacagcgatgtgccaagtcgaaaagccagacctcaacgcaacccggtgcgtctacgtcctgggcctcatctgacattctagaacaaatggggtttccagggggaagaggatgggtgaccgcaaacggtatgtctgggagatttccgagtcgtgggatgtcctgcttcctgagtgcggcggtggcaatacgtgtgtggaatattcacagagtcgtacatcttccaaaaaagtcaacttactgtgtgacaattcaaaaaataatgacagataaaacaatgatttaagacgcacagccatcatagtaaacactgatcatgaatcatccacgaatgctaagtccagagatggattctgatgagggacaggacatttactaacccaaagtgagacaggactacgacagggtggccgcaggagaacagatgattccagtagcagtttcatggctatcaaaagagagctgttgaaaaagctgcagaggccagggggtgccagacactgaagaccaggacatgggccaagctggccgagacgactggacccactgggcgacctgggccgagacgactggacccactgggctgagctgggccaagacgactggacccatgggccgagctgggccaagaggactggacccactgggccacgctgagccgagacaactgacccactgggccacgctggccgagacgactggacccactgggccgagctgagccgagacactggacccactgggccgagctggacaagatgactggacccactgggccacgctggccggacgactggacccactgggccgagctgggccgagactactggacccactgggccgagctgacaagatgactggacccactgggccacgctggccgagacgactggacccacatggcagggacttgacctgggtttcaccggtgacctaattatatgctcatcaacacacaaatcacatcggcagtgccatgacagttccaggaacacacatatttggtgtaaaaaagggtggcacccagttcctagaaatcttcacctttttccagaaatctttatgaatattccactccttggtaaagaaacccattaaaggtaggggccccaaaccctgcctcacgactcactttcttgagacacccatactcccctttcttctttgacttttttttctatttgcttgtttatttttatgagcagggtctcactatgttgcccaggctgatctcgaactcctgcctcagcctcccaatgtttaggattacaggcgtgagccttcacacccagccacactctgctttctggagggtgtacttttgctttgcaataaatctctactttcattattttttaactcatccttgaattcgtttgtgatggtgttaagaggcaggacactggcctgggtcaaggtcccattcgcatttggggactcccctggccaccagtatcaaaagtacttccttgttaattttcagggttttttttgagcagattctcactcactctgtcacccaggctggagtgcagtggcatgatcttggctactgaacctctgcctcccgggatccagcgattctcgtgactcagcctcctgagtagctgggaaaccggcatgtgccaccatacctggctaatttttgaatttttagtagggatggggtttcacattttggccgggctggtcttgaactcctgggctcaagtgatccacccgccttggcctccaaagtgctgggattacaggtgtcagccaccgtgcccggcttacttatcagttacaaaggcaaagtggtaactttactgtgagaagcttgtggatgccagtttaaccagaggatcaaagtaccgttgccgctggtgggcagccagcgtcccgagtgctgggaaggatgcctggctctggtgccaatctgttcatgcagaaatgtcaggaacgctcaatgcggggacaatctacaaacaaccggtttgcattcttcaaaagtttcagtgtcataaaagatttttaaaaagacaggccaatgtatataccgtgaaaatagtaaaacaataaaatataaaagtaaaaagactgaagtaccttgtctttgtattgatgtggagtcaaccgctgcttccagttgcgggggagtagctgtgccaggtacgtctccctccagaaacgactctgagaccagacaaaattcgtgcgctgcttcttcaggcagtggggtgaggacagcacaagaccgagagggtgcttggaggcgcccacatcccggctctccttggccataaccccacaagcagggctccaggcagagcacggcagtcccctgggatgagaggcagagactggagtgaggggcttaggtgtgcatgttgctggtgggggtgcttgggacctctgcaagcctgtggctgagggtgaggaggtgccggaggctcaccaggagcagtgactataggccctgtgctgttatccgtcactgcataaccaatcaacaccgattagtagctttaaaaaacatgcatttattctcagttttggggggtcaggagcccacacacattccgctgggtggctcggggtttcaagagtgccaccaaggtgttggtatttctttctgagcttgaggtcctctttgaaggccacgtggttgttggcagaattcagttccttgtggcttaggactgaggtccctgctttcttgttggctggcagcctggggccactcactggttcccgatacgaggcccctcccatgccttccaacagccatatcttcacagacagcaggggtgtctgctgctccgtcccccaggacagagcctggaatgatgcagccaatcacagagtgacttacacctttctgtgttctatgggctggacacaaaccgtagtgtttctcggaggaaagtactaaggctgcgactcaccagggattacctgaggttgtatccacccaggttagagcagaacaagatagtagaggacaagctgtgtcgggcagtattttggcatttggcatttggacctggcagagtggagagacttgggcggcattggcatttggcatttggacctggctagagtggagaaccttactttttttttttttttttgaggagaaaggactacaatgtacaataatgcctacccacactcacctaacgaaagttcagaccaagccccacagagatctgcaggggagactgaattgagggttgagtcttaccaaggtagcaggacttgggaaacactttgggctttcgacacgacactgacaaagcatgagaacaagtccacagggcccagcagtgaaccaacctgcaaacaaacaccgacagcttcagaggaggaagcagagtagactctccacatgatgttcagtatcagtcaaaaatcactagacacacgaagaaacaggacaatgcaacccacgctcaaggggtaaagccaattatcaattgatttatttccagctgcaaattcaccctttattgccttcctcaaaaagtgaatctcagctgggtgcagtggttcgcgtctgtaatcccagggctttgggagcgaaggcgggtggatcacttgagcccatgagttggagaccagcctaggcaacatggcaaaccctatctctataaaaaatacaaaaattagctgggcgtggtggtgtgtacctgtagtccaaatacttgggaggctgaggtgggaggatcgcttgagcctgggaggccgaagctgtgggaaccatgattgtgccactactctacagcctgggggacagagtgagaccctgtctcagaaaaaagaaaagaaaaaaaatgaatctgcccagtgtaaaggagaaatgcttaaagtaatttgtccactgctgtggagcaggtattgaaggttaaatttcgagccaaaagacaataaactgtggttggcataatgcacctatcatgtggctgaaacatcctggggtgtgtactgagcagtacacccgcacaagagagacgcacacaagtgttcgtagcagctttatttgtagtcgttcgaactggaagtggaatgcagtacagtgatgaaaatgaacaaatgcctgctgcacgggacgcatggaggcatctcacagacacggtcgtgtgtgaaagaagccacacaaaaggatacacctgtgcattgtgttccctttatataaagtttaaaaacaggcaaacgtgatctgtgctgtagaagtcacctttaccgaggggcaggagggaatgttgtttcttggtctgggtgtgttttctggtgataactcatcaggcacatttgcagtgtgtcacttttctctatgtatgctcaaatcacgtctttaaaaaggcagacgtcccctctgtgttctccctgcccttcctcctgccctgcccagctgctcggttcctggccgtgtggggaggtccctccaggggtggggaggctctgatctctgtgggaggcgatggtgggcggcagcccctgggaggctcatccccagggtgcagcagggtcctgttattcccttcataagattcccagctgcctaattgagggaagggctattaaagaggtgaaaacagggcctccagagctgctaatgaacttcaggttccccagggcaattcccaccttgagagatcccccttgaacctggtgccggctacataggagaggagatgggacttgggtggggcccaggaagggagctctgctttagtgggcccttgagggggccctgacccagacactggaccccccattctctccagacctgaccacagacactggaccccccattcttccagacctgaccacagacactggaccccccattctctccagacctgaccacagacgttgaccccccattctctctggaccagctgcagaatgagacacaattgatggccccctcttctccagggcccagaggaggcagctgtagggtcaatggtctgcagaccctacccaggctctccctctgcctctgggcactggagggcacagcgcccctgtgctggcaccaggggctgccctcttgggtccaagaggtgaccccaccctggtcggtgaccccggcctcctgtttagcctccagcctgcaatgggctgtaatggccaggggccgggaggggctagcggggactgcagctgaagcccagaagcccagaaagtgctgcttgcggcaggagcacgtgctgtctgctccccacagggtgggtgctgggctcccgggcagcagggcctggagggagggcatcctgctgctgctcctctcaccatggcaacgctccctgctggggcctgcaggtgggggtggcaggccaggcccccttccccctggcggaggggctgcatccctcctgggcctccctggtagactcaggtctcctcaggcacacccagataccgggttggagggtgggctgtcggggccgtggctggccctgtctgtggcctgacctgcaggcatgtttgcccgctgccagcccagccccagcttctctgtctggggggacatgagctgctcctctaagggaggctccagaggcaggagctcctctgctccatggagactgtttaattcgctgcctcaagggcatgctcagtcccctgggagccagcccaaggcatggccgcgggggtgggccttgtcctggtggccgtccagggggcccaggtgggcagcagacgagatgctccgtgaccggaaaatgaatccacacctgctctggggccaggccgggctgaggtcatcctgtgacactgggggccagagagcggccttggccttgctccccacctgcctccaagcccctgtctgcctctgggctgccagcctccacctgcctgcgacggtggcccggggtgatggcctggctgtgccccatgcacaggtggttcgttaggcactcggcggcattattaacccagcagtgacgtcaccggcagccaatgggaggcaggtttatttccagggtgacagcttgatagcggttaattttagctgcatcttctttcccgaggctcgtgaaacccagccagccaaagaaggggttgcctgtgtctccccaaacagctcagggatgggtcctggggctctgggaggcggcaaggaggggcggggcctgggggctctgggaggggtcgaggagggcggggcctgcccccagggaagccctgattggctggtgccctcttgactcgccatttccctccccccaccccccccaggttgttggtgaggacggcactgtgaccagggactcagatgcagaagaggggcccaagtcctgacctgggggagggcagggaaagcacaggccacaggccccttacttgctgtgtgtccttggacaggaatcttggcctttctgtgcccagttgcctcacggttctcaaggtcctccagccagccttgtggggcctaccttgtagcctctgtccccgcacccccatccccgcacactgtgcacgtgcacggccccctgtcccccgtcccccacactgtaactcacacagctgggcgacttggctgtgactaattaggatgcttggtacttgaagtcattggtgctacccggccattgacaagtgttttgcctgcttgttgtgctatgacagaatactgagactgggtaattatacattacttaaatttaaacatttataaagtttgctttataaattataaattattataagtaaacagaagtttatttctcagtctggaggccaggaagtccagatcaaggtgctgccatctggtagggccttcttgctgtgtcctcacatgggagaaggcgaagagcaagagagaacccactgccatgagtcctgtttatagggcacaaatccattcggagggcaaaccctttatgacccagactccttcccgaaagcgccagcccccaacactgttgcttggggattaagttacaactcgtgcactttggggacgtggtcaggccactgccgttattagcagttagcattccgtagttagtagccattcagtcctgttcagtctccgcggtggctcgaaccatcagtgtgttagtgtttagccttgtgaccgcagccccgttagctgtgtgttccagtgtctgcggaactgagtcggtggctcccaggaccccgaggggccacaccgtggaccaacgtgtcctggcgcctgggagaccctttggagcagccaccgacacccttgcccagagtcgcacacaggtgctttggggaggttgccacattccactctcaggggccactcctgtgggtgcaaggccccacggcacatgtgagcccctggcactgctatgggtgagccgggagccgaggggaaggggtgtctggaaaaggtagcccagagtcctggtgatcccttgggggagtgggggggcatccccgggaccccggcctgggccactcgagcacctgcagcaagcccacttccaatccctgcctaaccttcaggctgcaggggaggcgttaaatatagagaccagctgggtgggtggggcgggccttgctttctcgccaggcggttatttttattcctggctcctgtttgacgcatcggcagcactcggaagtgccggggcacctagcaggccctccctgcctcctctcctgctgtggcccaggagcccaagtccctggactcctatggggcagacgcagccacagaccaggtcctcctgagaggccctctccacaggctggggagaactgtttggccccgaccctgggccccacctttccttcctcctcacacctgccagcaggccaggtaggggtccagtcgctgggatccccatggatttgcccagtcgcagctgctgggcccgacccggggcctccatgtcaaccccagtgggcactcagggctgagaggacaggtgccagggctctgcccccactcagcacaacctcccgagaccccgctggcaggaagatccgagtgcgtgggggtgggggggcagcgtggagggaagacctgaatacctgggtgagacgacaggatcttggggtctggagaaagccccaaccttggtcttcacacaacacatggctgccacatccccttcctcacaacccacgttggcattacccgcgtgtgccaggacctcagggactccccacttcctacagagcgtggcccggctttggcttggcatcctgaccccatatgagcatcagctacaaggcgctgaggtgcagcgggtggggcgctgggcgggggggcctgggtctgtctggatctgactcgcccttggctggcctgtttcccagcagcagccggaggtcggcgcacccggaggggagggtccctggaagatgcagtgggtctgggagcgggcttccggcgttccctgcaccgtgggagaccagcctctcaggggagggtggttctgcgctggatcctcggggcctgtcatggtgcgcccaggagggcaggacgtgaggacagggactggaaaccagcagattccggggttccaccctgaggcctgcaccccgggcctcattagggagagcccctcagagccgggcttcgttggttctggggcgtccccatgagcagggccggggaggggccggtagacccaggctcgtctcccaggctgcagcccactgctcccctcccccgcctgccggctccggtcctcggcgtctgccctgtccccggggacccttttcgcggctcaagcgtgttcctgccctgagccggctctcgccccgtctcccgggccgccgcgctctccccgcgccgtctccgtcccggtccctccctcccgccgcctccctgcccgccccccgccccgcccccgccgcggcgcgtttctcccccgcctcccgcgtccgtctttgagcccgcgcctcccgcatgcccctcgcgtccccgtggcgcccgcccgcgcgcgtccgcgcccgccccctcccgcgcggttccgcattggcgtgctgcagggcgcggtgcactgcgccgcaccgtcaataggtggaccccctcccggagataaaaccgccggcgccggcgccgccagtcctctggctgagacctcggctccgggtaaggacgctcggcccccgggcctccgcccccgccccgtcttccgaagagggacccccggggccggtcctggggggcagagggtggccgggcccgcacccgcccccgcgcgcgcccggagtccggcttccgggggtccccgcgtcggccggctgggcccggggtggggggcggcgcggggcgcggggccgggtcctgggcggcgatcgcccgtagccgtgaccttggggccgcggggactgcgggcgggggctgatgggggtcgggcttggggcgctgggccagaggacgctgagggaggtggtgagatctgggggccctggcctcccacccccacccgtgttcccaccccagggtggcttctgtcctctttccctcccccagccactgtccgcgaggagcagcgtgggtttctccactgacctctgtgatgggacagggctgtgaccagggtcctgagtcacagggagggggggagggagggtgccccctatacccccacgggcgagggcatctccacctggcacttgctgggctcggcaggggcggtcctccttcctcaggcggaacagggacccccacctcctggccgctgtctgtccctgtgagagtccggaggggggtcctagagctattctgggttcctaatctgggcagcgcatctccgtcgggctctggcccagctgccgggcagggatgaggggaagatggcgccgtccctgcctgaggaggggagtggggacagtggccatctctccccggtggcagcgggtgggggtggggcgccgtgtccctggccctccgccgggggaggggagtgcgcgtgcaggacagggccctggagcgctgggcaggtgactatcacccggctctgctggtcacggacgtacccagcctggcgctgcgtggtctctccaaaggtggctaaccccttcccaaggagcagcccgcgggctccaacgcccagttatttacagcgatggggctgtttgggctcaagtgtggggtgggggcagtgcacagcctctgcttgccctgccaggcccagctgtgggtgggggcccttccctccccaccaaacatgggggcttggttttgggcagggatgcctgtccagcctgtgccaggacagtctctgctggtgtctccccctgggctccccatcaccggtctccccaccaccactggccccacagaatcactgcagcccccctgccctgagccagagcaccccgggtcccgccagcccctcacactcccagcaaaatgggcaggagaagacccacatcaacatcgtggtcatcggccacgtggactccggaaagtccaccacacgggccacctcatctacaaatgcggaggtattgacaaaaggaccattgagaagttcggaaggaggcggctgaggtgagctccccaggctatggtcttggccccctgagaaggaaccccaactcccgtggtggccaggcttggcatctcccagccccagggcatggggctcaggtgcctcctccagggcaggagggacccccgctgtggggcactcaggcctcagagggtctggtgggcagcctctctcttagggggagcttggtgggggaggggtggccatcgagctgccggattgccctgtggtgagggaggtgacctgggagggtctgcagaaggctctggaactctgcctgttgagctggggctggagggcgctggagccttacccccttccccccagggccaaggctgggctggggatggtactgccctcacttgtcctagggccctgccagggcacacgctactataatagctgattgatgggcagccggcccgtctgctccattttcttgtgctgggctgtgggggctgctgtccagggcagccctggggtgggggtcctggatgaggtgacctcctagctgccttttgaagcgattcctctttggtggctgagacggtggtggggagcggtcatgagacgggtctgctctctgatccccatcccccacccaggactctggggagaagcccactcctggggggcctgtgggagctctcacctggatgatgagggcggaggccagggcccaaggtgggggactcgctgtcctgggctgagcctctgccctggcggggttgggggtgctctgagctgcaccctgagtttgggctgcatcaccctttacctggccttgtcaggaggaggcgggggtttcaagggccgctgtttcaggccccagctgggtcccatctgggtctgctccagactgggcagctcctggagggcagagtcctgtctgtgcgaggccctggcgaggagttctgcccagctgggagtgaccgccgctgctgccctgactgaagcccgtccccttctgtgggggtctcactggcgaggccccccagcttcccgtgtccggcagagcgaggaaggggaggagaagcctcagaggatggggaggctggagcagcgggaaggagctgcgtggccaggccctcctcctgacctcatcagttttcctttctccttaccttaaaaaaacacacacacacagagggttatttatctgaagccccaaacacggtggtattattggcctctggttgaggaagggatctgggggcgtccgagcttcagataaaggggagccctcgcccgggaggggtttatcccatctggcggcttcgccgtagagcgagcgactcccaggcccttgcgccacctgctggtggacctgcgtagccgcgccatttcggagcaggtgcggaggccggccctggggggcagggtctgggtgtggggtcccacggagggggccggcgtcccaggaccccgacggagagcaagggggtgctggagcccatccccgcctctcgcggccactctgctgtaacaagcagctcgcaccaccagggactcctgggcccgggtcccgccctcagccgtgaccctcacccgctccagatggggaagggatccttcagtatgcctgggtgctggacaagctgaaggcggagcgtgagcgcggcatcaccatcgacactccctctggaagttcgagaccaccaagtactacatcaccatcatcgatgcccccggccccgcgacttcatcaagaacatgatcacgggtacatcccaggtgagcagggcacagcaggggggctgggggagaggccgctgcacccttcaagggacactgggggcccctggggtcactggatggtggggtctcctgtgcttcctgtgagggcaggggacccctcacctgggccaccccacccagtctggctcagagcccccctaaggatgaatccagtgctctggcatctgaaccatgcctgtgaaggcatccagccagtgtcagagtccccagatagatgggggcagatggggagtggacacaccttcatacatggaggggttggaggccaggatggggagagtgagcagtggcagaggtgccacccgccaggtgtagactgtatgacatttcagggcactcacagagacgccggacaccccagacacagcaccctgcagacagcaggacacatgccaccacctccaaactctttgataactgtgacttctatccgtcctcaagtgaggaacaggagcagataggctgaggacttgtccagggacacacagcccactggtggtggagccagggctgaacctcggtccccgacccagggcctggcgatgagcccccatgctgcccttgaagtggggacccccatgcctcctccccaaggccccagtgggctgctcaggccccagcccgctgcctggagaggcctggaatgaggtggggccaggctcgctctgtcccctgccaggcaggcggggcagggctcactgtgcccctgccgggcaggcggactgcgcagtgctgatcgtggcggcgggcgtgggcgagttcaggcgggcatctccaagaatgggcagacgcgggagcatgccctgctggcctacacgctggtgtgaagcagctcatcgtgggcgtgaacaaaatggactccacagagccggcctacagcagaagcgctacgacgagatcgtcaaggaagtcagcgcctacatcaagaagatcggctacacccggccaccgtgccctttgtgcccatctccggctggcacggcgacaacatgctggagcctcccccaacgtgagtggcggctagggcggggcgggccacgggagctggctggacccctggcccagagcgaggcaccggcaggtggcacggggaggtcgagggcctgtccccgggaatgcaggttcccctcgaaacctgctgggtttccctaactggctcagggcccggcggggagcccatgcccctcagcaccgggctttgctcctacactcagcctcccacgcggctggccgggccagggcccatctacgatgtcaacacagcaggggcagcggcctccagcaccaggcccagtgcttggtctccagagccctgccatgggggcggtcggtttcatctctgccaggccatttcctggtcctggacaccgtgcaggggctttgggctgggccgtgggggcctccttggctgctcccctgggatcttggagcagggttgggctttgggaagtgtgcatgcttctgggcttgtgggatggccaagggttggctcttggccggtcacctgggagctcaacgtgcgaacagtcgtagcccagggactctgccttggctggaggtgacgcgtggagacacttgcagaacctgaactgttcccagggttctccaagccagaggagaccccagaatggccaccactaggctctgcagcactgtcgctgcccacagtgagggtgcaggtgtggagtctagagacagcagggagaagaccagcagcactgagcctggagctgaggtctggggacagaactgagagggactccccagctccgcctccatctcacgaggctcggtgttgtttacctgtgatggcgttttcctcatgggtatcatgtggcgaacgccactctcccctccccagggaggcctccagccatcagggacctgcactcccctctggcctgagctgctaggtggcccgtgcttacacaggccctgggggctggggcactgtgctgccggccccctcccctgctccctgtttgtggcaggtggcccagaggaggcttcatgggatgggagtgggggccacactaggagaagctccggacaaggctgggcaagctcggaggcagcacggtgtccagaagctagggtggggcgaggctcctccagctcttccctggcctggcccttggccagactcagcatcctcctagtcaagtcatctgccctgccggagctgatggtcaggggcccggggtttcggggacttggggctggactggggatttgttacagtgtcagcaactcctgagcagcctgggctgggaagggtgctttccctctttgtcctctccttttaagagggatctccttcccagagtccctgtgatgctggggctatgggctgggaggagcagggtggggaaattcctcatctcaaagggcacgaggcaagtttagcctgaacacagtactcctggaagcaccctggggaggcctgagggtggggaggccaccaatgtctcttacggattgattttctccctttggtccagatgccgtggttcaagggctggaaggtggagctaaggagggcaacgcaagcggcgtgtccctgctggaggccctggacaccatcctgcccccacgcgccccacggacaagcccctgcgcctgccgctgcaggacgtgtacaagattggcgtgagcaagggcgctgtgctggagctcctgcctggccagctctgcctgccctagaccagggcccctacaaggcatctcaagactgggctgtctccaatctctccccttaccacacacttctgtgggacagtccatcccacatccatccatccatccacccacctccccacccatccatctctgtccatccatccacccatccatctatccacctctccatccatctatctatccatcatccatccatcgatccatccatctccccacccatccatccttcactccatccatccatcatccattgtcccatccatccttctctctatcgaaccatccctccatctctccatctatcacctccccacccatccatccttctgtccatcaatccatccatccatccatccatccaccctccatccatccatccatctccccacccatccatccttctctctatccatccatccatcatccatccattgattgtcccacccatccatccttctctctatccctccatccatccatcatgcatccatccatccattgtcccacccatccatccttctctctatccatccatccatcttccatccatccatccacctccccacccatccatccttctgtccatccatccatccatcatctctccatccatccatccatccatccattgtctcaaccatccatccttctctctatcatccatccatccatccatccatctacccacccatccatccttctctctatccatccatcattgacccacccatccatccttctatctatccatccatccattcatccactcacccaccacccacccatccatccttctgtacatccatccatccatccatccacccacctacctatcatccatccttccatccatccatttatccatccatccatccatccatctatccacccaccacccacccatacatccatccatccacctccccatccatccacttccccatccatccatcatccatccatctccccatccacccatccacctctctatccatccatctccccacccagcatccttccctccatcatccatccatccatctcatccatccgttcatctcctcatccatcatccatccatccatccatccatccatccatccatccacctccccatccgtccgtccatcatccatccatccatctatccccccatccatccatccatccatccatccatccatccatcatccatccacctccccatccatccattcatccacccaccttcctacccatccatccttcgtccatccactcatctacctcctcatccatccatccatccatccatccaccaatccatcatccatctccctactcatccatctccccacccatccttctgtccatccacctccccatcatctaccaccccattcatacatccatccatccatccacccacctccccatccatccgtcatccatccatccatcccaccaagaagagaaaccataaacaaatctgagaccctagagaaggcactgataggagacccccagccagtgggctgcagccaaagatgttgcaggcatctcttgtgcactgtgggggcatcatgctcaccccagcacagagcacagccactggcctcagtgagttggctggaggctacaacaggcctccctcacagccctgggaggtgagggtggagaccagtagcctggggggggacaagacccccatgtggcagctgcacaattggtttaagtagatcatgagaaatgccagggacgctcatgtgccgctgtgcctgtgctgcatctggctgagagcccctttagtgatagagacctgcagcatccaagtggggcccagagagcctgcagggagcgggagcagggcctgcagggagcagggagcagggccaccaggccccaggcagaagcagtcgtcgccccgcccacactcacagggaggagtcctcagacaaaggaggggtcccatagtgctcctttgagggaaagtgctctccgggggcaaggatgggaccccaggttcagacagccccctctgcccatcctcccgcttctctgtccctgtggcttttccgtgggttcctgggagctcgctgctcagcctcttatttccccagctgggtgggagagcccccacttcccttggaatcttgtgtctgcccttgtccctggcctcccttcccctgcactccgcccatgtggccccaaccccaggcctgtcggggggatccagtcccaggctttgttggtttccaggctctgtccccgatatcctgccccagcatcccctcgggccccaccttcccctcacaccccctcccctctgcagcattggcacggtgcccgtgggccgggtggagaccggcatcctgcggccgggcatggtgtgacctttgcgccagtgaacatcaccactgaggtgaagtcagtggagatgcaccacgagctctgagcgaagctctgcccggcgacaacgtcggcttcaatgtgaagaacgtgtcggtgaggacatccggcggggcaacgtgtgtggggacagcaagtctgacccgccgcaggaggctctcagttcacctcccaggtggggggctgcgctgggtccagggggctggcgcctgctggaagcagcaggactgtcctgggtgaggctgctgtcggcaggtggcctggcgtggggagaaaccggaccctcaggctgggcgcagtggctcacgcctgtaatcccagcactttgagaggccaggcgggcagatcacgaggtcaagagatcaagtccatcctggtcaacatggtgaaacccgtctctactaaaaatacaaaaattagccaggcgtggtggcacgtgcctgtagtcccagcatcaggaagctgaggcaggagaatcgcttgaacctgggaggcggaggttgcagtgagccagattgcgccactgcactccagcctgcgtgacagagcgagacttcgtctcaaaagaaaaaaaaaaaagaaaagggacccgcataccaccgagggggccaccgagcactcaacgaggggtcaatcagttctgggaggggtgcaggccctgtggctcccagcctgtgtgcaatcccgggctgtcttccacgctgcactgctgggatgcccagcctttgaggtcctacattcgtcctagaaaacgcttttgttaacttactgtctgagacatctctgtcatacttttattctctacagcttcattgcccctctttgctggcctcttcatatgatttatttatttattttttgagacgagtctcgctctgttgcccaggctggagtgcagtggtgcgatctcggctcactgcaacctcgcctcccgggttcaagtgattctcctgcctcagcctcccaagtaggtaagattacaggatgtgccaccacgcctggctaatttttgtattattagtagatacggggtttcaccatgtagccaggctggtctcgaactcctgacctcaagtgatccacgtgcgtcagcctcccaaagactgggatgacaggtgtgagccaccgtgcctggcctcttcatatgatttttaaaagtggtttattgagatacaactgaaacacaggaattgaggtccagttttgtcacccccccgcctagttccagctggggttggccgtgtaagtgctgcccctgccccttcgaaacaatgaatctagttgtttatcttttgcttaatgaggatgttgaggttcaggtctgggggctgggtcctcgagcctgagccccctccagtcagcactccgggcccaggagcccgtgcaggggcgccggtactgggcctcccagccccgctctggcgccctcccggtgcccaccgccgatgtgcctgatgccgcctgtggctccgctcgcaggtcatcatcctgaaccacccggggcagattagcgccgctactccccggtcatcgactgccacacagcccacatcgcctgcaagtttgcggagctgaggagaagattgaccggcgctctggcaagaagctggaggacaaccccaagtccctgaagctggagacgcggccatcgtggagatggtgccgggaaagcccatgtgtgtggagagcttccccagtacccgcctctcggtgagccggggtggtccggggaggtgcagcccccaggctgtgctgatccaggctgagggcagaggactgcggggatggggcgctggggacagcagtgggcccctttcctgcggagcttggcccagagcatggcaggagagccacggcctccgtgtcactagtgcaggtgaccctgcccagacgagctggggtgggccctgtgtgcagacgaggccccgaagtgagggaggccccgcgagtgaggaaggcccgcggtcgcccagtggcagcgttagggtgcccccgccccgtggccgccccgcagaccgtggagcagccgcccaggcaggactcccggaggccggccgtcttcacaggggcgcgctctgcgctaagcgtgttccgaggacattcccacgcggttgcgcccccgcccggccagagccctggggttggggggggtcaagtcctccggcccgcccacacgccgccccccgccccccaggccgcttcgccgtgcgcgacatgaggcagcggtggccgtaggcgtcatcaagaacgtggagaagaagagcggcggcgccggcaaggtcccaagtcggcgcagaaggcgcagaaggcgggcaagtgaagcgcgggcgcccgcggcgcgccctccccggcggtgccgcgctccgaaccccgggcccgggcccccgccccgcccccgcccgcgcgccggtccggcgccccgcacccccgccaggcgcatgtctgcacctccgcttgccgaggccctcggtcagcgactggatgctcgccatcaaggtccagtggaagttcttcaagagaaaggcgcccccgccccaggcttccgcgcccagcgctcgccacgctcagtgcccgtttaccaataaactgagcgaccccagagccgtgtgcgcctgctgctggggggtgggccccgcccccccggaccccctccctgcccaagtggccggcccagcatccttcactccctgcccgggaccccagggtgggcggtgggcctgcaagagtggtcccctgcgctgcacagggtgagcgtgagcgctcgctgaggagggcctggtgtcccccaggccgtggcccagcagcaagacccctccgaaggccaggtggcctgggtggctgtgaggggcttctccatggctactcagggcaggaatggtgccttcagatccacagaaccaggctgcgggttttgggatctctgggggccgctgagagctgagggctcctccaccgcgagtgactgtcacacacacactcattcttcccctgccccgcacacctggtctcactctcctgctaagccggtcacctgtggctgcagcctgtactatccatcctgctcccaggtccaggccctctgtacgtggttgtaggaactccagccccgaacccgggaggctggtgacttcagtcagtgggctgggggctttgggtcttccctagtcctctgggctagaacctgccccgaccttggctgggaagagtggaggggtggggagaggggggacagctcctttccacccctccctgctctgggaaagcggccccggcccacagccagtctgctgcagcaggtgaaggtcggggtggagggtgagcaggttccctgaggatgcagaggaggtcagggtggagggtgggcagcttccttgaggatgcagaggagggtcagggtggaggggggcagcttccctgaggatgcggaggagggtggggtggagggtgggcaggttccctgagatgcagaggagggtggggtggaggatgggcaggttccctgaggatgcagaggagggtgggtggaggatgggcaggttccctgaggatgcagaggagggtggggtggaggttgggcagctccctgaggatgcagaggagggtctgggtggagggtgggcaggctccctgaggatgcggggagggtggggtggagggtgggcaggttccctgaggatgcagaggagggttgggtggagatgggcaggttccctgaggatgcagaggagggtggggtggaggatgggcaggttccctgggatgcagaggagggtggggtggaggttgggcagcttccctgaggatgcagaggagggttgggtggagggtgggcaggctccctgaggatgcggaggagggtggggtggagggtgggcggttccctgaggatgcggaggagggtggggtggagggtgggcaggttccctgaggatgcggtgaggtcagggtggaggatgggcaggttccctgaggatgcagggagggtggggtggaggtgggcaggttccctgaccctgtacacagcactgaggcaggcctctctgtcgcccagccccagctcccagcctgcagccgggtacctgactcggggggttccgcagagcaggcaggcgaccgcagggcctcatagcgcgttagtctcttagggatgctgcgaccaatgacggcaaaggcgaggcctcctggggtcaggccaaaaccagcctccctgccgaaatcaaggtgtcgatgggctctgctcctctggaggccccaggagagtcggttccctgcttcaccccttgccgtgctgccgacaccccttggcttgtggctgcgtcactccagtctctgcctctgtcgccacacgctctctcctcctctgtgtcaaatctccttctcatgaggatgcgagtgactgcacttaggcccacctgggataatctgggattgcccccatctcaacatcctcaaccaaatcttcaagtcctttcctgccacatggagtcagccacagattccagggttgaggtcctgatacccttgggcatgttggacccactgtgctaggtgaggacggaaacgaggcagcccaggtgacaggcgtggtgatgggggcactgtctaggggcgcccttggagggcctgctcatgtctccctccatcccaaagtggggtccctcaaacccacacaaaagggaggtagaatgggaggaagagtgggcaaccagggagtttgggcccccaggtggtgctggcagcccacggccccagatggggagatttgaacccacgaacatcagagccacgaggcctccaaggaggggatacaggacccagtacgtcgggactttggatatatatcaaataattgtttactgtaaaatatttggggcatattacacaaaaatggtactccttatttatctaaaattctgatctgactgggtgtcctgtgtttatctggtggccctacccaaggacacaggtgttcctgatggaccctggcccatcctggcctctgtggggccacatagatgggaggggcctagtgggacctgcagggcctgtctggaagaagttgtcctttcacacgtgacctggctagaactggggccaaatgggagaaatttgccgcctgagatgggacaaaagtgaaaaacagcccccagctggagttgcaggaatcccccttggtggtccctgaggtgctcaggggtcccctcacccccatgtcccagttgcagttgctaatctggatgactctggcagccttggtcaccaggcactgctggtggggggcaagcccagccgcctgccatggtctgtgctggggccacagggccccctccaggtgggtgtgtttctggggggggaggagcacagggagggcagagagatgggagcactccctgttcccactggggtcccagcagatgagagtcctggccgtggtagcctggagggtgggtctcctgggagggtctctgcctcggctccccttctggggtaatgaaggcaggcccaagtccttgggtctgatgcctggagggctccgggccttgctgcgcccctcgtgctcaggtggggggctgtggggtggggaccgcagtggctggaggaggccaggatctgggactgggctcctggtgtccatcgtgggtggggcagcacccacagggtgccaggattgccctgctggatgccggacaggggataccctgtgccagcccactgtcagctctggggagggcaggggcttggccaaagccgccctggggtcccagccctcggtctctggggagttctggtgccacccacaccgagggcagaggagcttctggaggtgagagacccaccgagggcaggaggagcttctggcgggtgagagacccagggaagcagctgtgctcgttaatcaggaaggggggctggggggacaccaggcagagctctgcgttgctccaggacagtaatgctcagagctttcgtgttaggacccttgcacagtgttaaatgtcgggaggttgcatctgccactgtttagtatgctagaaactaaacgtgtggatatttaagaacgagaaagcaggggagtgtcacacctcttatggcctctgagaactccactgtccaagcaggacgggagagagaagccttggcattattgtgaaaacagattttgaccttggggcttttcgaaggttctcgggagccccggggggcctggaccgtgctttgtgaaccgaggctttagcggcggagcagtggggaaggcgaggggtggggtcccagctctggcacctgaggccaggcatggggccagagacgccgcggtgccccttctccatcggtgaaagggggttgtgtggcactgccctgagggtcgggccaggatgaaaggaaaccacggcctcacgcggcctctgcggctcctctccagctccctgaacaggggctgcagtggaggtgtgagctctagctgctccctgggcccagaggagggtgggtttttccccatagcaggtgggggtaggggggtggggaggggcgagctcactggggttggggtcaggacagaacgctccgtgggtgtcggcttggggagcctaggacagctggagggcggtggccggggtgagggcaggggaccacaggcagacagtgcccggagccctgcaagggtgggaccgtgcagcctcagggccccagcggggtgttgatggatgttgcagctggctggacacctgggctgctgtctggctgaagggggcgccaaggcccagaggtggctctgactggcggccactgggactcagggtcagtcctggggccgctgaggccccaagcaggtcctgaagtcagggagggcatgggtggcggaaggagctccaccctacttgggtggtgaataatttttttttttttttttgagtctcgctctgtcgcccaggctggagtgcggggcgcgatctccgctcaccgcaagctccgcctcccgggttcacgccattctcctgcctcgcctcccgagtagctgggactacaggcgcccgccaccacgcccggctaagttttgtatcttggtagagacgaagtttcactgtgttagccaggatggtctcgatctcctgacctcgggtccgcccgcctcggcctcccaggtgctgggatgacaggcgtgggcccccgcgcccggccggttggtgaataatttaaaacagagtccgccaagacgccctgttggcggctttggtctgactttgcacgtcaccgaaaaattcctgaggcctcgagaggctgtggggccctgctgagtgccgaatgccatctgtcccttgcccttgtctctcccgggctcccggtgccctcctgtaaccaggcgggaaggaccttcccaccccgtgcaggttcccagcgtggctggaagggcctggtgcccctggcagtcctgggtttgagcagcggcttctgggctccctgccaaggggctgggtttgcggcagccggtcaggcctccacaatgggaccccggggatttcccatgtgctgtgatgtgggaatgactgtccttgtgggtgacttagtgtgtcccggagtggggctgcaggcacgggttacatccataccctggtgcgtgtgtgtgacctgggtgagctgtgcatacctgtggtggctgtgtggggtgcaggggagaacttggcggggtgtcctggagcccctggaaacggtaggatgtatgtgctcgtgcgtctgttcatttgtgcctgcatgtctgtgtgtcgggcatcggctgtacctgtgctgccggctggccgcctggagtcagggctgagtctctgggggtgccaccaggtggctggactcaggaagcactgggcaacggtccctatccagaagccagggaggagaaggcagcccgggggacaggctggactggcaggtgcatgggccttgaggcagctcctgctctgctgaggggagagaagccccgtccccatgagagggtcaaccaggagcgtcagggtctttggaggagctgtggggtctggcttatttcctggcttcatgccgctctggcatcttctttgggggtcggctgggggaggtggggaagaccctgaggaggatgtgtgaggctgagacagctccaggatggagagcagatgcaggtggggtcagcggccccaaatcagggccctggttggtctgtgggggctccgaggcaggggcaggaggcaccaacacccagaggaggggagaagggtctgggccctggatggtgtggggtgggagcaggaaggaagccgttgcccctggacccctgcccagacgtggggcctggttgcaggcctcctgctgcaggacagcagttcctaaggcctgcgggcctcctgcagggacaggactggagccgtgggtgtggcaggaggcagagctccaggcaggaccagcctggaggggttggaggggcagaaacccacgccccctgccctgccactccctgaacatctaggggga

SEQ ID NO: 5042 - DNA, 27936 bp, Homo sapiens
tcaacctggagacaccgtctattcatagacattgttgttaacctggagacattgttgtcacctggagacaccatcaattcatagacattgttgtctacctggagacaccgtcttttcaagacattgttgttaacctggagacattgttgtctacctggagacactgttgtcaacctgagacaccatcaattcatagacattgttgtcaacctggagacaccatcaattcatagacatgttgtctacctggagacattgttgttaacctggagacattgttgttaacctggagacatgttgttaacctggagacaccgcaattcatagacgttgttgtctacctggagacaccattagctggagacgccatctgtccttagacatcctcatctacctggagatgtccacacaagctgctgcccactccccatgccaatctcaagccccgggtgcttcagaccaattggctataattgaggttcctaacccccatatttgggtcagattaatttcctagagcagctcacagaatcagggaaacatgtttacccatttattataaaggacgttacaaaggacgcagatgaagaatgcgtaaggggaggggcgcagagctttcaccccacaagggcaccccgtccaggaacctcacggctctctgagccctgtccttttgcgacttcatggaggcttcattacccaggcatgttgattacgtcactggccactggtgaggaccgccttcagccgcctctcccctcccctgctggaggttggggcaaggctgcaagtaccaccctctactcctgctgaggcctttctgaggccagccccatcctgaggctgcctccaggctgccagccttcggtcaatatcagcacaaaaggcacttgccactttggctactccagggattttaggggtttttgccaggaaacgggacggaccaaatatgttaatgtatatttcacaatgtcacacgcacatggctgtgtgtgcagagccaggcagggagagaggacagagcagctgggaggccccggggggcgtagacccatcctggactaaacccccatcagatccttctggcacccctgcaaggagaaggtgtggtccccctgctttctccccaggggctcatctcgaaggaggcctcccggctgcacggctcccacaaggcaagaggaggagatctgaaatcggctccactccctcccactgcagaccctatcacctcctcactaggggtgtgagcttttggctggtgggagggcgcccgggagggtctctggaaagatggaaccgggtgttaaagacctgcttaagcgagttatacccagaggccgtcagttcctgccgagagcacatggcccacagtcacaggtaaactgaggcctggccctaagccctggggactccacctgcttcgtgacgctggggacagtgtgtacgttttcctgcagggttcaggtgatgcagacggcagagggcagcagacggcaggctggcactggggggccatggaacccactggagggacgctgggtgaggaggacctagggaccgggatgagacaagctgagggtgttgggcgacatttcttactttgtattttgatatagtaatttaaacaaacgtacacaaatgttgcaaaatagaacaaaggactccctgtgctctacgcggactcaccagtcgctttgttctggccatttgccggttctgtagaagcctgtagttccaggcaattgagactaagacacgatacccttcacctttcagatacgataccccttcacccttcacccttcacccttcaccctttacccatcacttcaaggtgtgtttcctcagaacgtggaagctgtctgttacaaagtcaggaagcgacgtggatacaataatattactaatactcagcccgtgtgagcgtgttgttggccgtgtctgtgtgtacgtggaactctctcccgtggtctcacactcagcccgtgtgagcgtgttgtggccgtgtgctgtgtgtacgtggaactctgtcccgtggtctcacactcagcccgtgtgacgtgttgttggccgtgtgctgtgtgtacgtggaactctgtcccgtggtgtcacactcagccgtgtgagcgtgttggccgtgtgctgtgtgtacgtggaactctctcccgtggtctcacctcagcccgtgttaggggtcactgtggcctgagcacagctggacgggagccagagagcttccacggcaacctgcaggttttcaatgctctgtggactcgaggtggcactttttgttttgttttgagttaagaagacgtgcacagatgtgaaaggtgggcggaaacaggacgtctccccctgtcctggccgcacagtcctgatctgtctcccaggctggagtgcactggcaccatcaagcttactgaggtcttgaactcctgggctcaagtgatcctcccgcctcagcctaccaaatgctgggatcacaggtgtgagccaccgtgcctggccaacctcatttttaatggccttaggtcttccatggcacagggtggagactgcccattacatagaccctgagcgaggggccctggcattcccggtccattgggtgtagaaggagctgccgggagctgttggtgggcacagatgccctctgtgcaggagcctctgcggagccacgtggaaggcgcgtgtcctgtgctcccgggctggctggtttccagagcggtgctgccagtttagactctggccgagtgcctgcaatgtcgaggggtggacgggttgtctggggctggtttgcgtttcccttacgccgaggttgaacactcactccatttacagcaatttcactttccacgttttgtgaagtattgatttgcatccttgcctatttttcttttaaattatacatctttttcttaatttataagatctttaaaatattgagagatcagggccaggcgcggtggctcacgcctgtaatctcagcactttgggaggccgggtgggtggatcacgaggtcaggagatcgagaccatcctagctaacacggtgaaacccctctctactaaaaatgcaaaaaattagccaggcgtggtggtgggcgcctgtagtcccagcacttgggagactgaggcaggagaatggcgtgaacccgggaggtggagcttgccgagatttgccactgcactccagcctgggtgacaagagtgagactccgtctcaagaaaaaaaaataatatcagagcgatcagacttttcactgtgacataagctgcaattttgttttctgttcattttggtttttgactcctttgatggtggtgtttttttccatgtgaaattgttttgtgtcatgaatttatcactgttgtgctggtagatgtttaattcgttctctaagaagaaaaaaacatgcttcaggagacaggttttgtggatttctggggtgtatgcttgcccctcacggcatgttgaagccaccagccctgtccttgagcctggctgggggcgagtggcgcagggctggatttacctagaaaggcctttcacatcccaagagtcctgagaatcagacactttcagccctggttctcctagtgcctctgtggttggcttttccttccgtgagagtgtttgattatttcatatgtgtaagatgctacgtagagaccgtccctcccatttttgtttccagatgctgctaatcattgttctaataatttgtggaatgcatcaatgaattgtttttccctgaggtgtgagagccagctttcttttcttttcttttctttcttttttttttttttttgagacagagtctcgttcgtctcccaggctggagtgcaatggtgtgatctcagcttactgcaacctccgcctcgcccccccgaccccaggttcaagggattctcctgcctcagcctcctgagtagctgggactacagcacctgccaccacgcccagctatttttttttttttttttgtatttttagaagagatgggtttcactatgttggccaggctggtctcgaactcctgacctcaggtgatctgcccacctggcctcccaaagtgctgggattacaggcgtgagccagtgcgcctggccgagagccaatcttcatcccaccccagactcctgagtgtgactctatttctggactctctgttctgccttgaactgtgtgtccacaccgggttcagtggctttgcagtgtgttatgtgtttagtaagtcagccagcacccgctgggaatcctttttagtcatcatcctgggctgggtgttgggattcaacctgtaatctaatcccggcactcaaggaggccgaggtggggggtttgcttgagcccagggttcaagagcagcctgggcaacattgagaaaccccatctctgaaaaacatagaaaaaacccaaaatagttaactgtggtggtgtgcacctgtactgtggtggtgtgtgcctgtagtccagcgactcaggaggctgaggggggaagactgtctgagccagaggtcgaggctgcagtgactgtgattgcatcactgcactcccgccggggcaatggaaggagactcagtctcaaaaaaaaaaaagccctgtccagcctttcttggtgatgtgatgcttttccaaatggacttgaaagcagtgtgtccaccatgcgactgcaggttagtttaggaggaactcacgtctttgtgtggtttgagcctctccatccaggaacacagcgttccacacaaattctcccagcgttccacgcaatggaccctgctcagcgcccggcccctggggctgctattgtcgagggcctgccctctccaggagctccaacgtgattggtctgcggagaggctccctggtggttgacggcccacccagcgacctcccgaggtcgctgtgagcccccagcctggccctccccacgaggtgctggccttggtggcagccttgcttccttgtttcaggggcagcatcactgtccgttatctactgctgcgaacagatcgccccaaagctcaggggcttaaaacaacacagatgtttattttatttattatttgttttgagatggagtcttgctctgttgcccaggctggagtgcagtggcgcaatctggcgcactgcaacctccacttccttggttcaagcaatgcttctgcctcagcctcccgagaactgggactacaggcgcccgcccccacccctggctaatgggacgtttattttaaacatgacatctaacagctgggcgtggtctaggtgggagggttaggcctggggtctccctgagaggcagtaaggctggggctgggactcgagctgcaagtgggctggaggcctcagctcctcttggggcctccccacagggctgctgagggcccagagccagtccagagagccaagagccagcgtgctgactctgggacccggcggccacttagccattcctgccatatcctggttggtgaagaagggacttggggtcccagcagcaccagggccacgggcaggtcctgcctgtcaggggcccaggcttccaggtcagctgtgcctggatttctccaggggctgatggtggagtcaccaaccatcctgccgtccagggccgggcagggtctcaccccttccgcctggcacatcatcgggcgtctctggtgtgtgaagggctggacggggcgtggggccctggaggggtgcgggaaagacccccacccccagccgcctccgccttcgacggcgctggcccttcagggaggggcgtccctgctcgctggcgcttcccgaggttccctcgcagcgggggccgagctgtcgctggaggcgggcagggcggggcggggcggggggcggtgaggtaatttccgcgatcagcgtcagtgccgggccagaatcgaaactgagagctcctgggcaggctcggcagggcaggcagctccaggaggtgagcgcgggggtcccagggtggaggggcgggggcgcgggggtccaggggcggctccggagggtgagcgcgggggtcccagggtggcggggccgggggcggaggggggggtccggggggtgagtgcagccgggggcgcggagtcccgggagccacagacccagcccggggcagtgagcccgtccaggaccagcaccctccgcagcaagacccagcgctgtggtctctgcacccatggagcgcaggattttggggtctcggctcccgtcctttctggatggcagactcggatgtttctcagaggggtccgcggggagtgccgggttctcatactgaagtctgcctccagtctgtgcttttaaacttactcttcttgtagcatcccagctgcggtggggacccggggacccattcttcctggcaccctgagctctggtgggcactgtaccctcctctccgtgaggcccctcccaggtgcagatgtggagtcctcttttcctgggggccagtggtcattcaatagaaaaggagtgctgtgtccttagaagagtcaggagcctgaggccctggggtgcacaggacccctggcggggcagaggggtgcggcctcctgggggcggcactgtgccgagggctctgccccctccaggctccacaagcagtcaccttggctccttctaggtggggcctgagacccttcaggaggggggtctggctgtgtccgggtcagtgagccctgtactccctgacaggacacagctactgcaaggcctccacttgggcgtcagggtggggagagtcccaactccttgcttggtggagaggctctgcttgggcatcaggataggcagatccccagctccttgcctggtggagaggccgtgttctgagctgggcctggaccagatgtcctctggcctcagtctcacctgctccttctgtccaggcttcgaaccgtggccaacagttccagtggactgcgtggacccgtgagctcaggagctcagacgcctccctggagagccaagctggtgttcgaggtggcgcctccagggtccacctgctgcccaacagccccgcggccaccagagggccgtccctggcccggctgtgtgccctgtggacctgtgtctgggctgctcccgctgcacccagcggctcaatgaaagcacctacgtctccgtagggtggagcatgactgctcccgcgagatcctgctggcccgctttaagcaggccccaagagcaaggtctggcgcgtggtgggctgccggcccaccttcccaaggcccctgtgcaccaagtctgccactactacagccctgggctcggctgccggcgccaccgaaaccggtgccctttgcccgcagtcgcgaggaggccctggtctggaccttcgagcgtcagcacaacctcagcgcctatggctgaaggcggaggtgcagggcagcggggcccagggaggggcaggccggcggccgacgccatccttacggagtttggcggccgcttcgagctgctttgctccctctgctcaggcgctgtcccccatgcatctgtcgcgtggacccccaggggcagtgccctgagcacgagcctgcccctccctcctggcccacgtgagcgccgagggccgccgcaagcaacagttttggtggtgaggccgcggccccgggccggccagcctcctgcctactgcaggtttgtgggggtgggcagccgtgctggcgtggggagtcccgctgccagtttgcacacagcgccgtggagtggctgtgtgggaggccgagcagctgggtggcctccagcggggggacctgctcacacccctgcccctgatggcgacgggcgcacggccccccttggccagccccctggggcccagctgactgcccggcctgcttggtcacctgccactctcaggaggccttcgagaaccactgcgcacctcggagcacgcacagatggtggccttcgaccaggccctgccctgggagcaccgttcccacccccgggactctccaagttcgagctctgcccaaagtaaggatactcgaggcaggagttggagtagggcaggagcccaccataggcagaaccagaggttcccaggagcttggagtgggcaggagcccaccacaggcagagccagaggctcccaggagcttggagtagggcaggagccaccgtaggcagagccagaggctcccaggagcttggagtagcgcaggagcccaccacagcagagccagaggctcccaggagcttggagcagggcaggagcccaccgtaggcagagccgaggttcccaggagcttggagtggggcaggagcccaccgtaggcagagccagaggctccaggagcttggagcggggcaggagcccaccacaggcagagccagaggctcccaggagcttgagcggggcaggagcccaccgtaggcagagccagaggttcccaggagcttggagcggggaggagcccactgtaggcagagccagagactcccaggagcttggagcggggcaggagcccccacaggcagagccagaggctcccaggagcttggagcagggcaggagcccaccgtaggcgagccagaggttcccaggagcttggagcggggcaggagcccaccacaggcagagccagagttcccaggagcttggagtagggcaggagcccaccgtaggcagagccagaggttcccagagcttggagtggggcaggagcccaccacaggcagagccagaggttcccaggagcttggacagggcaggagcccaccacaggcagagccagaggttcccaggagcttggagcagggcagagcccaccacaggcagagccagaggctcccaggagcttggagcggggcaggagcccacctaggcagagccagaggttcccaggagcttggagcggggcaggagcccactgtaggcagaccagaggctcccaggagcttggagcggggcaggagcccaccacaggcagagccagaggccccaggagcttggagcagggcaggagcccaccgtaggcagagccagaggttcccaggagttggagcagggcaggagcccaccacaggcagagccagaggctcccaggagcttggagcaggcaggagcccaccgtaggcagagccagaggttcccaggagcttggagcggggcaggagccaccgtaggcagagccagaggctcccaggagcttggagcggggcaggagcccaccacagcagagccagaggttcccaggagcttggagcggggcaggagcccaccgcaggcagagccgaggctcccaggttcagtggacgggggcctccctgccacctgctgagggctaaagccattggcctctgaggacccggataagggaggttcatgtttgggaactgcttgagccaggcctgtcccgggagcacaggagtgggtgggacgaataaagcccctgctccctacagaggccagattgggctgaggggtcccggcctttgaactcagcacggcggctgtgcctctgtgtagcctgccgacctccctgtcccccaggcctgacctctgtgagtatggggacgcctgcaccaagcacactcagcacaggagctgcaggagtgggtccggcgcacgcaggctgtggagctgcggggcaggcggcctggcaggacgggctggtgccctaccaggagcggctgctggccgagtacagcgcagcagcagtgaggtccttgtggtaagtgggccctgggagtgggtggggtggggtgggtccaggcctcttgctgaaggctagacttccacgcagctggcagagacccttgatgggtgcgtgtcacctgcaaccagcccctgatgtaccaggcccaggagaggaagacccagtaagctggacgtttgccgtccactctgaggtgagcggagaacagctccgactgggcggaggagccctggggaagtggtgacttcagcccgggcagacgtcaacagcctgggtcatggagcaataccgaggcactgccgctcagcacctgcgtgacctgcagcaggtcccttagcctctcgcctcagtctcctcacctagagacagggggccaggacagtcccaccttggcagggttatctatggagtatatgggttaaaacaaggatttggccaggtgcggtggttcacgcctgtaacccagcactttgggagaccgaggcaggtggatcacctgaggtcgggagttcgagatcagctggccaatagggtgaaactccgtctctactgaaaaaaaaaaaaaaaaaaaaaaattagcaggcatggtggtgggtgcctgtgatcccatcttctcgggaggctgaggcaggaaaatccttgaacccaggaggcggaggttgtagtgagttgagatcgcgccattgcactccagcctgcgacaagagtgaaactccgtctcaaaaaccaaaacaaaaacaaggattcaccagggtcggcacctggagagtgggtggtgaggcctcaagctgcccacactgccccacgggacatcccaggggccccaggagggttcagccacccccatgtagcacaggaagaaactgaggatggcgaggccgggtggcctgcttgcgttctatccaggaagtggcagggccaggacctgaacccgcacttgggctacgctggccaggctgcctctcgggagggttggggggagccctgggccccctcaccgtctggcctcctctccaggagcccctgctacacgtggccctgctgaagcagggccaggagccgacttctctctggtggctcccggcctcccgccaggccggctctacgcacgggtgagcgcttccgtgtgcccagctccactgccgacttccaggtgggagtgcgtgtgcggccgcctcgttcggcacctttgagcaatgggtggtcttcgactttggccgccggccgggctgctacaaaagctggggctgcagctgggccaggggcgtcgcccaggaccctgcaggatctggcgctcggccaccctgaggagatggagcgctggcacactggcaaccgccacgtgggcctggcgtggagcggacggccgagcagacggccctgatggccaagtacaagggccctgcctggccctggagttcaaccgcagcagcgtggcctcgggccccatctcgccaaccaacttcggcagaggatgcaccagtttctctatgaggaggaggcggctcagcagcagctggtggcaagtgagctgggggcaacaggagcagctggggtagcaggagcagctggggcaatgggacggctggggcaacgggagcggatgggggcgtggacttggcagcggggctggcagctgtgccccatgagctgacccaggccatcctgccaggctgaccctgcggggccaggtgttcctgagacggcattgcagacgccagcgctgaacatgctcttcgcgcctccgggagcactgtaccagaggtccccgtcccctcctccctgatgccagacacagaccagggcttcctgctgggcgggcggtcagcacagccctggtggcccctgtacctgcacccgacaatacggtgttcgagtgcggctggagaggcgggccagctcagagcaggcgctgtggctgctgcttccggcccgcgctgcttggccctggggctgcagcctgaggcccgcctggtcctggaggtgcagttccagttgacccgatgaccttccgcctctggcaccaggcagtggacacactgcctgaggagcagtggtggtgcccgacttgcccacctgcgccctgcccagaccttggtctgtcccacccttgggcgtggcaaccgcaagcaggagctggccgtggcgctcatcgcgggctggggccctgggatgggaggcgtgtccccccgctactcatctatggcccctttggcaccggcaagacctaccgctggccatggcctccctggaggtcatccggaggcctgaaaccaaggtgctcatctgccacacaccaacaggtaagcccgagcctggcctgcccccacctcacctgacgcccggcccagtctacaccgggcaggcggtcaccccctggatgtgctccagtcctctgattctgcactcctgtagccgaccagctttgggctttggctttatcaggcccagctcagggcaccgagggggccgggtctgctgtcaggtgaggagctgggtgcctctgccggggccctggcccaaggaagtgtcacggggaaggctgcagcatggcccacccagcacttctggggatgagtcttgttttcgtttttatagaaacacagatctttgtcctaaccacaaggttcccctttggtttatgggtttcctctggttcctgccaccaccacctccccaggccggggccttcccatccctgccagtggggagtgggaggaagagcctgggacagtggccatacgtcccgggctgatttctggttgggggttctggggaccagggaggtgcaggtgtctgcagtgtcagaggagccgctgggtcgcccaggtgttgcctgaagccctccgtggcctcttgccccttggactcctgacagcaggacaccagtgtttgctgctcacctctgacagccagacaagggctgtgctcaggggcagtcggctgggcacacagtaggtgctttagcggacagcactgaggcccccagcaagaagccatgagctcctccccctcccgcagtgccgccgacatctacatccgggagtatttccacagcacgtcagcggcggccaccccgaggccactcctctccgtgtgatgtacacggaccggccctgagccagacggacccagtcacgctgcagtactgttgcctgaccgacgaccgccaggcttccgcccgcccacacgggcagagctggcgcggcaccgcgtggtggtcaccaccacctccaggcccgtgagctcagggtgccggtcggcttcttctcccacattctcatcgatgaggcgcccagatgctggagtgcgaggccctcaccccgctggcctacgcctcgcacggcacccgctcgtgctggcgggcgaccacatgcaggtcacaccccggctgttcagtgtggccagggccgggcggccgagcacacgctgctgcaccgcctcttcctgtgctaccagcaggagactcagaggtggcgcggcagagccgcctggtcttccacgagaactaccgctgcacggacgccatgtcagcttcatctcgcggcacttctacgtggccaagggcaaccccatccacgccaggggaaggttccgccccacccccggcactacccgctcatgttctgccacgtggcgggcaacccgaccgggacatgtccatggcgtcctggctgaatctggctgagattgcgcaggtcgtcgaaaggtgcaggaggcctacaacacctggcccagctgctggggcggccgcgagcagaggtgatctgtgtcgtttcccacggtgcccaggtgagcccggccagcccgggacagcccccgacgcacccctgctgggggagggggagctctccggctgatggacgagcccccgcctcagtttcccatctgtaagagggggctgcagtatttgcctcccagggctgaggtggggctcggccctgaggtgtctggagcttggtgggggtgccgtctccttgtcgggggtggcccagtcctcatgcgtcctgcgctcatccccgagcttggtgggggtgccgtctccttgtcgggggtggccagtcctcactgcgtcctgcgctcatccccgagcttggtgggggtgccctctccttgtcggggtggccgagtcctcactgcgtccagcactcatccccggccctgctgcgtcttcaggtagtgcactgaggcaggagctgaggaggcgggacctaggccaggtgtctgtcggcagtttgagatcctgccaggtgggtgaccagcggggccaggtgctgccagctgccccaggatacccgggtggctcggcccactcctcagcctggcatcggcaggggtggggctggtcccaccgtttgcgcacccagcctgacctgactgcgtgccccctgcagggcggcagttccgggtcgtgtgctcagcactgtgcacacctgccagagcctgctcagccctggggcactggcccctgagtcttcaccgacgcccgcgtgctcaacaccgtcctgacccgcgcccagtcccagctggtgtagtgggggacgccgtggccctctgctccttcggggcctgcggcaagctctgggagagctcatccgtgagtgcgtggagcggcacagtgtctgccccgagggcctgtccatggagcagtcgagcagggtgtggcgcagagacggcgctggcctccccgaggcacacaggctggggcacggggaactgggaggctgccccagagccagtaggggacctggccgaggagcaggcggcttggtgacggccatggtgaaggcagagccgggagatgaggctctgagcccagcatcccgtacatcacggcaaccacagcgcagacggaggctgcggcagcaccagcaggagacgcagtgaggaagacgtggtgcccggggcctgtgcggcaggagcggctgctgcagcgggcgtggagccacggaggctgaggatgcagaggctgacttctggccgtgggacggggagctcaacgctacgacgccatcctacgggagcttctggacgagagccagaaggtgatggtgaccgtcgggaggacgggctgctggacaccgtcgccaggcccgagtccctgcagcaggcccggctgtacagaacctgcccccggctgcgctacggaagctgctgcgcgcggagcccgagcggtaccgcactgctctttcgtgccagagaccttcgagcgggcgtcagccatcccgctggacgatgcccctcgggccccatccaggtcaggggccgcctggactgtgggatggccttcgccggggataggtgctggtgcagctcctttcgggagacaaggcgcccgaggggcggcttcggggccgctgctgggcgtgctgaagaggaagaggcacgagctggcgtttgtgtgccgcatggacacggggacccgcgcatcatggtccccatcaatggctccgtgaccaagatcttcgtggccgagtgaaggacccatcgcaggtccccatctacagcctccggaagggccggctgcagcgtgtgggcttgagaggctcaccgccgaggcccggcacagccggctcttctgggtccaaattgtctgtggcggcaaggcttctactacccgctgggcatcgtccgggaggtgctgcctgaggccgcacctgggagcagggcctccgcatcctcggcctggagtacagcttgagggtgcccccgcggaccaggccaccatcaccaaggtgctgcagaaataccacacggagcttggccgggttccggccgccgagaggactgccgcgccttcttgaccttcactgtggacccccagggcgccgcaacctcgatgatgccctcagtgtccgagacctgggtcccaggtgcgaggtggctgtgacatcactgatgtggccagcttcgtgcccagggacggggtgctggacgtggaggcgcgaggcagggcgctgcgttctatgcccccggcagggagccagtgcccatgctgccggccagctctgccaggacgtcctcagcctcctgcctggccgggaccgcctggccatctccctgttctcaccatggagaaggccagtggccagctgaagagcctgcgctttgcaccctccgtggtcagtctgaccgccagctgtcctacgaggaggcggaggaggtgatcaggcagcacccgggtccggccgtgagctgccggcccgcctggactccgtggacgcctgcgtcgtggccgcgtgcacttctctcggctgctgcgccggcaccgcctgcggtccgactgcttctatgagcagccgacgaggacggcaccctgggcttccgcgcggcccacatcatggtgaaggagtacatgattagtttaataggctcgtggctgagttcctggtgggcagcgagtgcacgcggacggtcacgctctgcggtggcagccagcaccccgcagccagcagctcaaggccctgtgtgagaagcatgggaccgggtgcccctgtcactgcacctcggccaccacctgcacggcggcgggggcagtcccccgacacgcggctgcacctcctggcctccctctggaagcaggtccagtttgctgccgcacccaggactacgaacagatggtggacttggtcaccacggacgacatgcacccattctggctcctgcaggccgcgacctccgcaaggccctggagcgctcggcgttcggccgctgccccggggccaccagcagcagggcggccactactcgctgcaggtggactggtacacgtggccacctcgcccatccgcaggtacctggacgtggtgttgcagcggcagatcctgctggcgtgggccatgggggctctgcctactctgccagggacatcgatgggctctgccaggccttcgcctccagcacgcacttgcccagagctatcagcggcgggcgcgcagcctgcacctggcctgcagctcaaggcccagcctctggacaagctgggcttcgtggtggacgtggaggcgggccccgctgcttccggctgctcttccccagcaaccgggagacgctgcctgacccctgcccctcccctacggctccctgcagctggccgagcacccccacgccctggcaggccggccgggctgcggctcctgtggcggcgccgtgtctactcagcgcagggatccagcccgcccctgccatgcctggcactgtgccggacccacacaccctggccgtggagacggccctgtggaagcagtgctggagctggtggagctgcagcgctggccggaggcggctgctctcatccaggagaaggcgaggcgtcccagcggcgggagctggtgcaggtgcagcggagccactgtggccatttctggaggtggcccgggagctgggcagtggggacaccctgcaggtgcagctcggcaccagctgcagcacggcttcctggtaccgagccctcagctctggacggtggcaccgggcttcagctctgcctggagcacgtggagcggcccggagactgcttctcaggccgtgtgtaccgggcccgagggaccggtaccgcgacgtggatgagtacgcctgcgtgtgggaaccattctgcgcctggagtcggccaccggcgcggttgccgagaatgactccgtcacacttcagcacctgagttctcctgggaggcgtcacggacgccgcaggggcagctgcagggcgccttccgcctggagccgccttcctcgaggagaactgtgccgacatcaacttcagctgctgctacctctgcatcggctcgaggggctgccggctcccacggccagcccacgccctgggcccagcagcctcggcctggcctgaatgttgaccccggcacgtatacctgggtggcccacgggcagacgcaggacgggaccaggagcgccgggcagaccggcaggaggctcccagacgggtgcacctcttcgtcaccacatgggcatggagaaggttccggaagaggtgctgaggccgggcaccctgttcaccttgagctgctgcccaagcagcttcctgatctgtgagtggcttccaccagcagaggctggctgggggaccgccccgggcccctcacttgcaggaggggggagctcgtggggcagcagccctttcctgggagtcctgttggttttccagtgtctgccttcacccccagccgcaaggaggagccgtgcgtggactagaggaggcgtccccgctggtcaccagcatcgcactgggccggctgtcccgcagcccctctgcagaggtaggtctgccccacccctccagcttcccctctggccccagccccaccctgcatgagtgctcagggaggctgccccctctcagtgatccccagcagttcctggagcggcagacctacaacatccccggaggccgccacaagctgaaccccagccgaacgtggcggtcagggaggctctggagaagcctttcacggtcattcagggcccaccagtagggcccacgccgggggagccgcaggctgccttgggccacagggacccacagggtgggtacaatctcctattctctggctgcaggtacagggaagacgatcgtgggcctccacatcgattctggtttcataaatcaaaccaggagcaggtgcagcccggaggccccccccgtgggggaagcggctggggggtccctgcatcttgtactgcggcccctccaacaagtcggtggatgcctggcaggtgcgccggggtcggcggtgggggcctttggggagctggcacgcggggcagactcacgtcccccaactaccctcaggactgctcctgagaaggatggagctgaagcccctcgtgtgtacagtgagcaggctgaggccagcgagttcccagtgccgcgtgtgggcagcagaagctgctcaggaagagcccccgggaggggaggccgaaccagagcctcaggtgtgcctgtgtctttggggcttgggcggagtggggccgagctgtccagacagtcctgtgtaggtgggctcactgagctctgcccccgtgatggccctgcgtggacagggctcactgtgtcctgtccccaggagcatcaccctgcaccaccggatccggcaggcccccaacccttactcgtcggaatcaaggcctttgacacccggctgcagagaggggagctcttctccagggaggacctggtcggtaagtggcaggggccagggggtggagctgcctgcagcatgggggccctggggtgacagcagtgtccccggcaggtacaagaaggtcttgtgggaggctcggaagttcgagctggacggcatgaggtcatcctctgcacctgctcctgtgcagcctctgccagcctcaaaatcctgacgtgaggcagatccttgttgacgaggcaggcatggccacggaacctgaaaccctcatcccctggtgcagttcccacaggccgagaaggttggtcggcggggggtgtgggcagcatgacaggcgtccctggcacagtctcccacctggggtgccctgtgtgtgcagacgcgggtgtctgtggggctggggtccctctgggtctaggggtgtcagggccaggcctgcctattcctccggtggttcttctcggagaccacaagcagctgcggcctgtggtcaagaatgagcggctgcaaacctgggtctggaccggtctctgttcgagcggtaccacgaggacgcacatatgctggcactcagtaccgcatggtgagcccgccccactcagcccccagcccacctgcagcccctgggggccacaaccccgcgtggcagcctctgaccagcgcacatccttgcctgcagcatgaggcatctgtgccttcccctctgtggcgttctacaagagcaagctgaagacgtggcagggctgaggaggccgcccagtgtcctgggccacgctggcaaggagagctgccctgtcatctttgccacgtgcagggccacgagcggagcctgctggtgtccacggacgaagggaatgagaacccaaggccaacctggaggaggtggctgaggtggtgagtgtctggtgcctgtgagtcaggagggctttctggaggaggtggctgaggtggtgagtgtctggtgcttgtgagtcagggaggcttcctggaggagggcaggagagacaccagggtccgctccacctgccccctcggctcccaggtccgtatcaccaagcagctgaccctggggaggaccgtagagccccaggacatcgcgtcctcacgccctacaacgcgcaggcctctgagatcagcaaggcccttcggcgagagggatcgccggggtggccgtgtcctccatcaccaagagccagggtgaggctgggggctcgtggtggggccgggagggtgggcgcagcggcagcagggcctcacctcccatcccgcagggaggagtggcgctatgtgctggtgagcaccgtccgcacctgtgccaagagcgacctggaccacggcccaccaagagctggctcaagaagtttctgggcttcgttgtggaccccaaccaagtaatgtggctgtcacgcgggcccaggaggggctctgcctgatcggtgagggcggggctggctcttccagggtgggaacacaggtgaggccagggctgggctagggagctgccgactcctcctgaccctgactccgacctgaccctgactcctcccacctgaccctgactcctcccaccgactctgactgactcccatctgaccctgactcctcccacctgaccctgactcctcccactgaccctgactgactcccacctgaccctgactcctcccacctgaccctgactccgacctaccctgactcctcccacctgaccctgactcctcccacctgactctgactgactcccatcgaccctgactcctcccacctgaccctgactcctcccacctgaccctgactcctcccaccgaccctgactcctcccacctgactctgactgactcccatctgaccctgactcctcccactgaccctgactcctcccacctgaccctgactgactcccacctgaccctgactcctcccactgaccctgactcctcccacctgaccctgactgactcccatctgactcccaccctcacagagaccacctccttctgcgctgctgccccctctggcgtagcctcctggacttctgcgagctcagcagaccctcgtgcctgccggccaggtgcgcgtctgcaggaggccaactatgcctcctgaagagccctctccacctgcaaggtgccaggactgggagggaaagtccagggccccccaccctccccaccaccctccgccatcagcctgcctgggccagcctgcctcctggcctcggatctccctggggcaggaagtgggtggacttggaggaggaacggcaagggccggtcccacactcttgctcctcctgggcatctggggacaggaacacctctcagggtggccaagagggcttccttgggaccagtgtaaggaagttctgctgtccctgggaagtctcagaaccaggaggaaaccctgtggaggctgccctttgacctttggacgccacctgtaatcactctggatgtgtctgtggagttcaggtttattttctatttaaatgaactaaaagccagcatcctgccggcgtggtggctcacgcccataatccagcactttgggaagccgaggcgggcagatcacctaggtcaggagttcgagaccatcctggccaacatggtgaaaccccgtctccactaaaaatcaaaattagctgggcgtggtggcgggcgcctgtaatcccagctacttgggaggctgaggaggagaatcgcttgactccaggaggcgcaggctgcagtgagctctgatggtaccactgcctccagcctgggtgacagagcgagaccctgtcttaaaaaaaaaaacaaaacaaaaccagatctgttactggaacagagacctcagcccaagctcaggacaaggaggcctccctgggaggggggcctttctcccaccatcaccgcctgtgtccttcaggggctgctggagggcagcccaagccaggggcccaccccgccccaccccaccccaccccaccctctgaaatgtgaaaagctgcactcttcctgtgggctgcgcagtgggctcgggggttggggggtgccggggcgatgctccaccctggactgagtgttcggggcagcctgctcggctgtatgtttctcgcacgctcaccgcttcagtgcggctctgtccctgctgccgcctccagtcctgagggaggggcttgcccaccttctacattccaatttttatatctttgaattatgtgattagatattaatttaatgaaaaaccactctgaaagctcttctcacttctgggtgtttgaggtctggctggggggcaaagtggatggtcactgtgcttggtacgcagttgtggaggctgtcgagggcctactgcagaggctgggcgcaggggcgtggggagggcggttttgggacgcggccgtggaggccgtcgaggcccactgcagagcgctgggcgcaggggcgtggggagggcggttttgggacgcggccgtgaggccgtcgagggcccactgcagagcgctgggcgcaggagcgtggggagggcagcgacccccctgcagggccggtgtctccggctgcctgtgtggggaggggagggccgtgcctggtgggtggggacaagccacagctccagagctgctccggtgtcaccaggctggccaagtccaagtccctgaggccaccagccttgactgtcctgctggtcccacttttaaagctgctccccagaccccctggccgctgtggactggggtccctccgcacctggcccatttgtggctgcgtcacaggggctcctgtggcctcccagagccagctcgggggtcagatggtcgcgggggctatgtcactgtgggaaaagaggttctgggcatctgtggagggaggggtggagcatggagtctcaggactgtggccccgttggtgtgctggacgggccctgccttgaagaccatgtctattctggaccgtcatgaaataagagtagttctgcaatagcttgagaagtgcctgcagagaggagagaaggcgcctctaggaagggggacttggggacctcaccagcctgcagccagggaaggttctgggaggaaggggcagctgcggccctgaaggtgagcggtggggggacgcaggggctgacgcctagcaaaagcagctgatcctggaggagagagggagctcagggccgggaaggccttgaggaacaaaaggtggggcggggcatggaggggcacggctgagctgctcacagccaggatccccggtggtgctgctgcctcctcgggcgggcgtgctgatgagcactcgaggctggcaggggatggtgggaggcatcacggcctaggagtgtcattccctgagggagccccacaaccagggaggtgggtaaggaaggccggagcccggtcacggtgatgggggtggtgaggagggcgggggctaggaccgcagaggccccgtggagcagcttttgtcgtcgtcgttggacccgaggtgtcaggggctggtacttcttgctccaggctcagctgtcttgggaggtccggcctgggctccccctgggaaagagcaggagcagaaggcctggggcttggcatgttttgagccagaaaaacactggtggctgctgcctttaaaacataaataggtttgcttctttaattccatagtgcatttacactcttctttattagtggataaatattagaaaatcatctctcagacagatggctgagggcgggcccctccaggggctccggcttggtgtgcagggtgaggctgtccctcagggctcgtacaccagcgtggaggtctcggccctcttgatggtgaacttataggatcgttgggcagcaggtttcggacgtcgaaggtgcaggcagccacggggatgacgccacactggcgcactcctgctgtgtccgcgggtccagcagcctgaagcgcaactcatactgctccgagtggctggctggatggtgacgaaccagcgcagccgggcccagtcctggtgagccgccgagcctttcggtcaaacacgacaggcatcttggtgctcagcatgagccagatgtgcgggatttggtggcactgacatcagacaccaggcggtgcttgacgtgtagccgccccggcaccatatggtcaggaagctgtccatgacggccgacacgtccgccagccgccgctccaccagcgccagtcggccaggaagggccgtgggtctggcgaccggagcagggcatccagctcagcacgccatggtcgagctgttccaacaggtccccgagcagcaggagctggatcttggtctgagcgtgcccaccttcttcatgcgctggaacttccaggggtcgatgagctggaacaaggcgctggcagcaccagcgggttctggtcgcccagggccaggtgcttgggcaggacctcgatgtataggagcacttacgcagcagctgcatgcgggcgtggtggcgcttgagcaggtgcggactaggtccgaggtcaggaactcacgcagggcattgcggcgctcggtgtaggtcttccacgctctggttccagcagctgctggtcatctgcctcctcctggtccaggaaggactggggattcccagcttcatcttgtccaggcccaggcctgccacatgggtgctcattatccgggagctgggggagggctgggtgtcagctgccaggcaggctggcctcccctgggctgtggcatgttgggggatggattcagcccactgaccccatgctggacctctgtccttcttcgggggcacactcgatgggaagaggctgcctggagggctggatgggcagcctacagatctggacacagttatactgaggggcaaaaacctctactgacaaccagtggcctgtgggacaggacagggaaaactaggactgcggacttctggccagaaccgcctgacctgtggccttgcaagggccccattcctaaccctgctgctgaaaggggttgctggcacccctcggggccgtggagaggggacgcgtggtcctaagcagcacaggatccccctcggggacattcgcgggccatcctcccgctcggttctccctggggacgctccacgcctcaccgcagttgtagggcacagagacaggcctaccaaagacgaggccagctggctggtcagcatgggaggagggcgcccaggcctgggcccgaggagcagccctcctcccacgctgtgggccctcgctgtggacccgggatcctgtccctgtgagctcatggactccacaagtgacactccatttcccagatggagcctgaggctaagagcttggttcttgttctcatccagggcttgagcccagtgctgagccgagtctgaccctcttccgtgggtgcaccggctgagtgcagctgtggccccaggctctgccgcagctccctggaagcaagccgcacccctggttgctgccccggctcccagcaaccctggagatctcaggttgcacagccacttgggccttggacgacccacaaatgagagctaagcagttgctgagttcccagggccacacaggtacgtggtgaagtcatatctgcccgggaagggttgcccttttgggctgaggcagatatgacttcacgagcgcactcctcgggaatccctcgagaacaggcccctggggcagcagggagtgtgtctggggtgaggtgccagctgagagcaggaccccaggaccccggcctaagccctgctcttgctggaggctggggcggatttcaccgctggagggaaaccgtcctctgtgacgtgtgagggatgttttctagtctccagcagctgcccaggtggaacacccgagaggctggtcgtgaacccggaaaggtggttctgagcccctcgctgcttcctacacgcccggtcccaggcccgcttccctgagaccaccaggtgcccgcactctaccccctccaccaactccccttggctcccctggcccgggcccacctccccggccgctctgcctgccccttacttctcgagacccccagccctcctctcccggcccccgccgccgccccaggaccgcgcccattgccctgcctctgaagcggagccgcgcgcggacttcccagagcccagcctccctccgcctccgcgggttgccctggggaccagcggcctttgtgacgctgcggcccgggggcggggcggggtggggacccgggaccccgagccgagtaatcttccatccgcttcgcttcctggagaccccagacttctgggggcccgcgtccccgactgaggggccacggcgggtggctggtccagagccaggctccaaggggggttcccgtcccggagcccttccgcgggcgcaccactcccccgcacccccggcttcgggcggggcgcaggagcctcgggtgactgggagggagttcctgccaaccccccagtccgagcgcactcctcgggaatccctcggaggaatttgggagagaggcgtggccggtgaccaggcggatggaccacccagcgcctggacagaggagaggggcggcttccccgccgcgggctctgcccagcaaggccccgcccattacagatgccacccattacaggtcctcccaccgcaggctccccccaccgcaggctcctcaaccacaggctcctcccaccatggctcccccctcccccgcaacggcccctcccatcataggctcctcccaccgcgggctcccccaccacggcccctcccaccacaggctcctcccagagcaggctcctcccaccgcgggccccctactacggcccctcccaccacagggtcttcccaccacaggctcctcccagcgcagctcctcccaccgcgggctccccccaccacggcccctcccatcataggctcctcccactaaggctcctcccactacaggctcctcccaccatgggctccttccacctggggctgcccaactcaggcaccgacctgactctggataaatggggtctccatagctccagggagccccgcagggagctctgaggccatctggtcccgtctgtatctgttcagttgggctcagggcctctggatccccccgttcccccacagcacaccccagctagctgggggtctcctggggtcacaatttagacaccccaaggtgcccctccttcaccttcaggaagatgctggaggaagacacccttccatcctcctcatctccacccccacggaggtcagtgctggggcctcttccaggatggggtctttgagcccctaccaggctgttctgtaacttgagcctcccccctcctcccggtgacccaccctggaagagctttcccttggtgcatggaggccccaggggttaggcctggcaggagtgggtggatgtgggtggttttttttttgagatagcgtcttgctctgtcacccatgcggagtcttcacccccggggctcaagtgatcctcccacctgggtctttctgatccttccggatacaggtgtgagccttgcacccagtcctgttgggtgctgtttctgccctgccctccctgctgggctggaactcaataaatgccagctattgttattgttatttagggctccaggggacaagccggggttgtttggagaagggggtgctgtctgacgcggagggttgggaagcagtagagttagaccccttacccccggccctgcagcccactgacggagaagcggggtgggggcaggcagcctccccttctcttttggggccaggcaggtcctggatgtctcccctctcctgggcccaccctaccccctttctttcaatttctgatttctaatctaattttttaaagttaaactttggccaggctcggtggcgcaggcccataacctcagcactttgagaggccaaggtgagagatcccttgaggccagaagtttgagaccagcctcggcaacacagggagacccctgtctcacaaataatttgaaaaattagctgggtgtggtggtgtgcacctgtggtctcagctacttgaaagctgaggccggaggatcacctgagcctgggaggatgaggctgcagtgagccaagaggtgccactgcactccagcctgggtgaca

SEQ ID NO: 5043 - DNA, 100000 bp, Homo sapiens
  misc_feature (30282)..(30557): n is a, c, g, or t
cgccatcccatctaggaagtgaggagcgtctctgcccggccgcccatcgtctgagatgtgggagcgcctttgccctgccgccccgtctgggatgtgaggagtgcctctgcccggccgcaccctgtctgggaggtgaggagcatctctgcccagccaccccatctgagaagggaggagccctccgcccggcaaccgccccgtctgagaagtgaggagcccctccgcccggcagccgcccgtctgagaagtgaggagcccctccgcccggcagccaccccgtctgggaagtgaggagctctccgcccggcagccgacccgtccgggagggaggtggggggtcagcccccgccaggcagccgccccgtccgggagggaggtgggggggtcagccccccgcccggccagccaccccgccgggagggaggtggggggtcagccccccgcccggccagccgtcctgtctgggagatgagggcgcctctgcccggccactcctactgggaagtgaggggcctctctgcccggccagccccccgtccaggagggaggttggggggtcagcctcccgcccggccagccgccccgtctggagggaggtggaggggtcagcccccccgcccggccagccgcctcgtccaggaggtgagggcgcctctgcccggccgcccctactgggaagtgaggagcccctctgcccggccagccgcccgtcgggaggtgtgcccaacagctcattgagaatgggccatgatgacaatggtggtttttggaatagaaagcggggaaaggtggggaaaagattgagaaatcggatggttgccgtgtcgtgtggaaagaagtagacatgggagacttttcattttgttctgtactaagaaaaattctctgccttgggatcctgttgatctgtgaccttaccccgcaaccctgtgctctctgaaacagtgctgtgtccactcagggttaaatggattaagggcagtgcaagatgtgctttgttaaaagatgcttgaaggcagcatgctcgttaagagtcatcaccactccctaatctcaagtaccagggacacaaacactgaggaaggcctcagggtcctctgcctaggaaaaccagagaccttgttcacttgtttatctgctgaccttccctccactattgtcctatgaccctgccaaatcccctctgtgagaaacacccaagaatgatcaataaaaaaaaaaaaaaaaaaaaaaaaattgtattttccatatcattgtgaagaaggtcgattttcaacaattctccaatagaaacaaagacaactgatagagactaaggtcctgtgataggttactgagcacaagaattgaacttataagtatcaaaacccaataaatcactttgcacacttacaagttatttgtataatacttgatctccctgaaagatctgcagagcaaagcttacacatactttttacttctaacaataaaattgtgtagccaaaaattagccggcatggcggcgaacacctgtaaacccagctacatggcagctgaggcaggagaatcgcttaaatccgggaggcggaggttgtagtgagcggaggtcgcccactgcactccagcctgggcgacagagcgagacttcgtctcaaaaaaaaaaaaaaaaaaaaaatttctgtgtagccaaattttatctttttcaataaacaatacattgaccactttttggttttcacagtggccatttacactgttctgattgaaaagtgtatgtagattcctaaaggaatgtatcttaaatccctagccttctcaggctagagggggattttacgttttctatggctgttgataatcgatacatgcatgacagcatagctgacacaatggacacacaaagataacacagctctctgttctaaattgttctttaaagtagtgcttttctttctcaatttgaaatgctttttagctctacagcaactactaagtgataaaaggataaagaaaacctttaatcctattaattcgataaaaaagtcactatcatgtgagatattccacttaaaaggcaaaacactaaaatacggcctttcctcccatataaaatttaaacacaaagaaatgttttaacactgatgtaatttaaaccaggcaattcagtttggaggcttgatactctctatgtagtttctactatgtgaggaattttaaaaagatgatttatgttaattctttatcagaacagaggggggacgtacattttctatgagctgttgataactgatgcatgtagtaaaataccatatgtgttctaactctccatctttttgtttagtccaatcaaggactatatagttacttaaatggtttggttgtatgagtataagaaatactttaaattaaaagtagtcagtgatcaaagttcataacttaataaataacagctggccataccttgtaaccctcccattccaaagaggtttagacctgatctttcacaggcaagtctcctgcagtctcatcagttggaccagacatggcctagctgtgaaaaaagaaaattcaaataaactctttccaaattattacattaactatgcaatggaataaccaaataaaacgaaaaagggactagaactttaatgggcatcttattgtccacatgtgtgcttggagaagatgaaagcttctattctaatagtactactacattcagtcatggagacgtgttcctttcaacagtgtatttcctatagtttgcttaggaaatgaagtaagattatcattaagaaatacctcctctccatccctttcctctccccagcctccaaaagaaagcagatacttggaaaaaactcaggtcaggaacttgattcaaatggttgctctatcattaacaaactgtcaagccacctaaactctctgagtttcagtctctcagttttaaaaatggagaaaataaacctatctcagagagttattctaagggtaaatgggatgagtaaattaaaagcactgatccatgtgcctgggatgtcaatattactcaaatattgtctgcttgatgtacaaatgagtggcagttctgtgcattttgtgagttttgtgaaagaggtttcgttgcataaatttaccaactggtttgtgtttttttgtgtgtgtgtcttgcctttgttgccatgaggcctaggtctcaccagggttcaactacttcaacatataggctctctagctaattctagtatttttgtagtttcattctttacagaaatacaccatagtaactctattttgagtatggatgtgagtggtccaccaatatctagtatgcaaaaataaaggattttatattttcatttcaatctacctagtaagtacatgcaaactgtgaatgaagatactctaaagggcagagttcttaagctctaggatatggttctagaatgtaaagaccaagacagtagcaagcttcattgtcttgttcagctctgtatcttggaggctagcatagagcgtggtgcattctgagagcaggcattcattaaatagttgtgagtgagtgaatggagtccatggggtttcagggtctgtgaacccagagatggtttaccaattttgtatgtatatgtatatatgcaatatcttttaaagagggttcataacttttattcaactcgcaaatggtggagaaccattgcattttgcttttacagaaacagctaacagacaatccttgggagatcatctacttcttttggaagtactcctatagaaaaggtcaatttttagatcctgttgacacataggcccgtgtatgaaaatgattagttttccatgacagagttaagtcactttaaaaataataatgatgatgatgatgatgatggtgttaacattcattgaacgttactatgtgccaggtactgttctaagtgttctgttataggaatgaagtgtctcaccattccttgtgaggctgttactcaaatgattcctgctttacaaatgaggaagctgagacacaattagttaactcacttaaggtggtagttgaaagtattaatagttgtgtctggtgatattttggttgtcacaacaaggaagcgggatgctactggcatctagtgagtagaggccatggagatgctaaatatcttacagtgcttaggagacataataatgaattatccagcccaaaatgtaataatagtgtagaagctgaaaaaccctgcacaatgctgcaatgcctctccaacaccacttatgttatccttctttgctcactatgcttcacttacattattctttactttcctcgaccccccatacccttgtcttgctcaaggcctttgtattagctggttccttaatctttggactcagttcacttcctcagacaggttttccctgaccatcctatgttagagtagtcttcctacatttcttcactgtttatttcttttcttttcttttttttttttttgagacagggtcttctatgttgcccgggctggccttgaattcatgggttcaagtgatcctcccacctcagcctccgagtagctggaactacatgtgcgtgccaccaagcatggcttgtatctcttatagcaatgcctctatctgaagttatcagataaaattattgtttgtctccactaaaaaaggataaaatcttgagacgggtattagtcttgttcacaactgttcaggaacagtgcctggtacaggggggaaccaacattaatatttattgaatgattggctgtgcgtggtggctcacacctgtaacccagcactttgcgaggccgagacgggcggctgacttcaggccaggagttcgagaccagctggccaacatgatgaaaccctgtctctactaaaaatacaaaaattagctgggtgtggtgcacacgcctgtaatcccagctactcgggaggctgaggcagaagaatcgcttgaacctggaggaggagtttgcagtaagctgaggtcttaccactgcactccagcctgggcaacggagaagaacctgtcacacacacaaaaaaaagaataaagaaaaaatatttattgaatgaataatgaatatcaggtactgagattaaaatggcaagcaaaacccccgcctttatgaagctagcagttatggaggtaatcacatgataaacaaataatatataattaagcaaacaatagaccatcaggaggtttagggtctaccaaccaactcctaatccagggcaaatgagcaaactgtgtagggacctacaacttgcaggatctggatagagatggcaattagcagcatcaactctcacttcatggctgggatataacatttcaaattggtcctggacgtggggataaagggcggccttgattcaggcctgaggatgtggaggtgtcttgggctgggctgctttcacgccagcagaatccagggccaactccagggccttctccaggcggcagagcggaccctaggaccccggccccgctgcagtggggagggtcagcaacctccacccaccctcatcctcccccatcctcccggtactcaccgtgccactggccctgcagctagctaccgttgctatagcgccgacagcgtgggggcggctggccgagaggagcacgggagaaacatggcaggctcccgtagcctcctgggaatgtagttctccttggactctagcctgtttgctcgcggggtagcggactacgctcttccgctgtcggacctgggaaattctcctgtgctaaatcccgtggcgctcgcgggtgtcgccgggtgcatcctgggagttgtagttttttctactcagagggagaatagctccagacgggagaggacgctgagagaactacatgcaggaggcggggtccagggcgagggatctacgcagctgcggtggcgaaggcggctttagtggcagcatgaagcgcaccccgactgccgaggaacgaagcgcgaagctaaggtatgtcgggctcccggggcctggagatcttcgtgcgctgtgagcaggatcagggaaccggaagggcttggtttgatggcgagcggatgcgcggtgttaaactagggatgacagggccttgtcagcaagggacctggagatattagaggggatgttacaaattgtgctcttcaggatgcaggccgagtcttgttggatcggctcaaaaatgagaagcaagatcccatttccttgtccttcttctgcatctattccttggttaaatttgtcgccatccctgtcctcagtttaccggattctcagatgactgtgatcataccagctgtgctttctcataatgtctctgaggactgagatcggcttagatgaaatatctgtgcagtcagctgtgtttctttgaacaattgtctccgtgaccggctgataacagtttgtgtcttttagcgctgtggatatgatctttaactacattgctcctctctacctttgatgttcagcttctggtagttgccattcctgggatgaccataataatggcaacagagattttaaaaagcatttattgtgggtcaggcatgtattaagtgcataatatttaaattatttcatatcattgtcacagcagattgcaagatgatattatacagatggagtataaataacagcccagcttcacagatgaagaactgaggctagaagcattgagtgttttcctttctctcattcccaaactcagatcctgttgatttgtctcgtatattgggaatatgcccactttttttttttttcatctccactaccttggaccaagcaccattatctttttaatagactgttggaatagcctattgattggcctacactcactctaaccctaacttaactcttcttccaccttctctcccttccctcaactaccattctcttctgacaccatagagtaagatcttcgtgaaatgcaaatataattatgtccctttcctttctcctactctgccaaccacctgtttaaaaatattccatggctttctgttgctcttaggataaagcaaaacttcacattgcctacaagatcctgcatgatctggaccctacctgctttcacaacccattggatatgacactctgctctctgcctaccagtcactttggccttcttaaaagtcctcttcactatactttatcgggcttcagggcctttgcacatgtcatttgctgcctactcatgttaggcaaatattggcagtgaataacagtgttaaataacgtagacacagttcttgcttcatagaatttcatcttacacgtgagtctgtttagggcaatacacctaaggatttaaatataaaatctgctctatattgacctgagttattgcagtatttcgtaagggaccagaagtttcatgcttgagtctgcatatgatgtggataatatattaaagataagcacaaagagggcacccttctgctttagtctacacagtgcaaagaaacaaatgtcacctcatggtgttgtgctgatgtctttctcatctttcaggtttatttttaaagtatttcatttattctgtgaagattgttgagcacctattatttgccataagttgggattataattttggctgaaatagaatcatgcaccaaagaagctcttactctattgaaaccataaccattgcctgtgagggagttactgtgtcatccatattttagagatttagaaactgagacttgtaggtaaatcgtgacttgccaaggccacttggttgctaggtgaaactagtgctctgagccaggtcttctgactccaaatcaaggcttttcccattttctgcttgtgaaacatgttgaattagtagagcaaattgtcttcttttttctttaaaaaattggctgttcatttaaaatttgtttgcttaatattatttgttgaacaaagtataagtagttgttttaaatcttaaatgtaaagtgtccaatggctcatgaatatcttctctttttctaatcaattttattgaggtataatttacatacagtcatttgcaacatttttgtgtacaatttgatgccttttgacaaatgtatatacctgcaaaaccaccacattggcatagcgaacatttctctcctaagttccctctcgttaatttgtggttagtctgtcctccaccttggcccccaaacaaccactgatatgttttttgtctctgtagatgcatctgtttttctagatttcatataaatggaagcatacagtgtatacttttgggtctttttttcatcagcgtaatgatttttttttcaaaatagagatggtgtcttgctgtgttgcccaagttggctggaactcctgggctgaagccgtcctcctgcctctgctacccaaagtactgggattatggcgtgagccactgtgcctggccagcataatggtttttgagattaatccatgttgttgttgtatccataatttgttcctttttatcgcaaattagtggcccactgtatggagataccaatgttgtttattcattcacttgttgctggacattaggattgtttctggttttggactctatgaaaaaagctgtttttaccattcatgtatgagtctttccattttcatttctgtcaaaaaagctgctatgaccattcacctaagagtctttacatttttatttctgtcgggtaatgccaggagtagaattgcttagttataggggagttctttgtttaaccttatgaagaaattacagttttccgaagtgatttgaccatttgttttagtttcttatggctgctgcaacaagttacacaaacttggtggcttaaaacaacagaaatttattatcttacagttctggagatgaggattgaaatcaaggcatcaatagggccatactccctttgaaggactctaggggaaactcctccttgcctcttccagcttctagtgtccctggtgttccttggcttgtggtagcatcactcataacttctctgcttccatcttcacatggccttctctctgtttctgtgtctcaaatcttctctcctttctgttaaaaggatgccagtcattggattaggacccgtcctaaatccaggtgatcctgagatccttaagagcctcaacttaattacatttgcaaggacactttttccaataaggttacattcacacgtgccgggtttttggattcggacatatctttttggggaacaaattcaaatgcactgcacccttttacattcctaccaactgttagtaggaatgtaaaatgaagttctacttgtttcatatcttttcatcgcttgtcagtcttttacattttaaccattctgtaggtgtgcagtgatatttgattttaatttgcatttcagtgatgactaatgaggttgctatctctctttttgtaaatctttattgagtgaggtataatttacataccataaaattcactgttttcagtgtaggactcaatggttggtagcatatttgcagagtcgtgtaactgtcacaccgtcttattttagaacagttccattccagaagaaactttgtattcatttgcagttattctcaattctacttcctccctagggaaccacgaatctactctgttctttagatttgcctttctggacatttttatatagatggactcatacaatatgtggtcttctttcacccaggagtttttgaggttcatccatgttgtagcatatattggtactttgttcctttttattacacgtggatagaattccagtgtcaggccgagcatggtggctcatgcctgtaatcccagcacttgggaggccaaggcaggtggatcacctgaggtcaggataacttagatcaagaccagcctgccaacatggtgaaaccctgtctctactaaaaatactaaaattagccaggagtggtggccatgcctgtaattctagctactcgggaggctgaggcatgagaatcacctaacctggaagcagaggttgcagagagcccagattgtgccactgcattccagcctgggtgacagagtgagctgtgtctcaaaaaaaaaaaaagaattccagtgtcaggatataccatattttgtttatcgttcaccagttgatggacatttgatttgtttctacattttgactattatggaaaatgctctgtgaacatttgcaccctagtttttgtgtggacgtgttttcattcctctttggtagatcttaggagtggaattacaggacttatggtaaatctatgtttaacattttaagaaactgaaaactgtttacttgtgtggctacaccattttacatttcccatcagccattttgagggttcaattttgtcacatccttgtcaacacttgttgttgtctgtcttttctattgtagccgtttagtgggtgtgaagtagtatctcattgtggtttgatttgcatttctctgatgggtaatatgttatgcatcttctcatgtgcttattggacatgtgtatatcttcttttgtgaagtgtcgttcaaaatctttgcccatttttttgttggattgtttgtgttcctattattaagttttagagttctttatattttctagatataaatcctttgtttactatgtgtgttgcaaacattacttccattcatctaggttacttaatagtttttaagaaaggtccactttatcaatgtttattttatgattcatgctttttgtgtcatatctatgcagtctttatcccaaagtcacaaagtttcttttttgctttttaaattaaactttgtcatccccataatgggcacttagtttttattttcttttctctttgaaataacttagatcatattttctctcttgtgattgcttatgcttggacttttatgctgtttccaagtctggagggtgaataagaaggttggaccacatagcttctacgattaacatttatttaatttgtgttaagcacatgagaatactatacggtattcagcatttttaaaatgaacttttcttctaaggcatataatagaacagtccagataagtattgatggtttgagttagaaccatggcgtctactatttccttactgtagggataggggattctaccccgtgcctcagtttctccagtcattaatgaggttaagaatagctgcttctgtgggtggtgtgaggacccagtgtgatgaggtctagctactattccaggggtagagtagcatgccttgattgagtttggtggcctgaggggtcctctgctggggtggggctggccctatgcatttttcccagatgttataatttattattttgaaatgatttaaaacttattgaagagcaaggtagaacctagagctctcatagacctgtttgtccatattcacaggttaacatcttgctggttcactttattgctctctttctcgccatatatatccacatgaacaatttttttaatgaccattgcagagtaagtcggagacatcagtcctctttacccctaaatagttcagcatatattcctaagaacatggacattctcttgcatacaaatataaacacaatcaattgttaatttagaaaaagttaacattgatataatgctattatttcatccaaagtccatattcaaattttctaattgtcctaataatgaattttatagcatttttttcctggtccaggttccatctggatgcatattacctttcattgtcaggtccctttggtctcttctcctttaatctggtgtccttcatgtcctttaaattggttcctcatcctttttctttcaagacattgacatttgtgatggtgcaagctatcttttatttatttatttatttatttatttaatttttttgtagaatggcctgtattcttatttgtcttatgtttccttatgattagattcagattttgccttttttttttttttttgagaccaagtctcgctctgttgcccaggctggagtgcagtggcgcgatctcgctcactgcaacctccacctcccgagttcaagcgattcttctgcctcagcctcctgagtgctcagactacagacacgtgccaccacacccagctaatttttgtatttttagtagagatggtttcaccatgttggccagcctgatctcgaactcctgacctcgtgattcacctgcctcgcctcccaaagcgttgggattacaggcgtgagccaccgtgcgcagcccagattttgcattttgcatgtatatttttgaggaaagatggggcctctagaggtcacatatttataatccaatatgcctcctggctgtaggtaagttttatttggcccaaacaaactaaaagttgtttcaaattattttctaatatttaaaagttgagggatttcacataaagatctgggtgtctgacttcttgaaaaacttaagtatctggtaacagtgggcatgcattttcctaactagaattgaaagtggcttcccttttaggtgggaaatgtgctttccattttgctgtcatccagttttgcccttaagttacaatatagtggtgtagtgtggagctttagatgcagactcctgagattgaatctgctccctcatttacttgcgcaagcaatttaacttctctgagcctccatttcctcattatcaaataggagtgatatggttctggtagggattgagatattatatagcacataaaacttgctggcatacagtaaaaataaacattgttatcatcatcattatcaccatcatcaccacaccttcactactgcctatctgaccccagtagatatatattctgtatgtatatatatattatgtattctgatcccaggacgtttattctgtaaacttatgttgagtgtctagtcaagtgattttctcaaatggggttccattaacttatttcccatgcagccagaatggtactagtttgtaccacctttcagaaaattgagaatatagtcactcaaaccattttctgtgttctgtgttcagataaggaacctgattaagtgtcgagtagtgtactcagcaccagggtaaagatggagacacagtcccatggaactggctggctgtccatggaagataagtaagtaccaacagcaagtggtgagttttatcacgggaggacacggtagcaaagaggatctaacatggcctagtatcatggaattccttccttagaagatctgtttaaaggtgtatccttatgagaggcctgggttccttacggggtttttcagaaacattaaaactgtttcattagtcatggaataaaaagcatggatgttgaaatccaagttagcttcaaagactcttatgctggcttaggttagataatttttaaactattaaaaatagaactagtttattatggaaatggttatatacctaagaacattaataattttgtttgagtaatgtacatttttatcaatgaaggaaaatatccagaatattaacctaccgttttaagtaacatgatttaaaaactcttctgcttttggtgatagttgtctatcaactttaaatgataaggtttattgagttataaaaataataacttggccaaatgcatggcttatacctgtaatcccaatgctttgtgaggccaaggtggaggaggctcacttgagccaggagttggaggttacagtgagctgtgattatgccactgcactccaggctgggcaacgagtgagaccctgtctctaaataataataacaataactcaacaaaagaaagtttgttattatgtttttactgactgggtatttttaccttattttatatttcaaatttggcattttatgaggtcctgagaaggttcttttggagtctacttttattatgggccattctagattatgtaccagtttatctaaagtggacactaaatataggacagttttggtgttaggccaaagaccggggacttgaaaaatgaaaacctcacctgacagattctactctgttttttttccttcttccgaaatccattattattttttgcttaatctctccttcaatatatgggtaagcctttaacactgtttcggaggtttagttgacttctgtaaatagaagaagagttagtgtatttgatctagtttccaaaccacttttaatactgtaccttacttgaaaattaaccagctaaactatcagtaacagtgagttcttgttgctttctgttatttccaggctgtttcctaaccctcctagactggttttgaaaactaaattagccattcaaaaaaactcttagacactttgagcaaacatagcttccttgaagatagcatttgtgtctaattcatcttttcatctctccattgtacctgcaggatgtcttccacaaaggagacattaataagtatctggtgaagaaagattaaatggtgagagagtccagcatctgttatgtgatatatgtgacccttcataattatgattctggaccttggctgctaatgagatttactgtggctgagtttagtgatacagattttggcatgtaatgatagtctccaaaaaagtagagatcatgtttttttttttttttccgttttgtcattcccattttatccctagcccttaagattttgccagacacatggtagatattccatacttgtaaacaatgaatgaatgaattcccaagagcatcacttgttattggtcagtagactttctatagtgagagatggaaccggaatttgaaagaagtaatggaaaatggttaagtaccttatgattttaaattaatataccataggtgtgggcattaattttgagaaacaagactcttctgtcaacacatactttagcaactgtcaacacttgttttcaagtgttctcttccaattttaaatgccagtttacctttcagatttagagtattttgttgttgttagtttattatggcagtttcttgctaaagttatatttaaagtgtgactttctaacttctagaggagaggaacttttgtaaggtggtacttttggaaccttaatgaaaaacacaccttagagaaggtgaatttagagtctgctaagcacattcatttactcttctattataaactggttttgtaatattttataaaatgtctcactggttgatttcacaatgtaaactgggaggattcttaggattccttgggttgattagaacaggttcaagagatgaagatttgtgttggtaggggcttgtttccaaacgttttccttggcatgctctttgttaagccatcacatgtttgaaagttaaaccttgaattggtgcatggtttgcatttaaaaaaatgtattttattatggtaagaacacaacataagatctacctcttaccacatttttaagtgtacaataaagtattgtaaactgtaggtacaatgttgtaagcagatctctggcactgattcatcttgtataattgaaactttatgccgcttgattagcctttcccatcctcccagccctggtcatcatctttctactctctgattctatgagtttgatattagacgtacatttttgtttttgctataagcatctgtcctgttgctatgctgatcattatttactctgtagttttggaaatgacctgcttacaagataaccatgcctccccttatgtaaaaaactgccatatggataaagggcagttaagacctttacaactggtagaaaccaagagaaaattcagtttgaaggaccaaattatgttgcagctgctctgaggaggagatttgttccagagcatgagtgttttcataattgtttgtgatcagaaaattcagagctctgatttctcattagccctaagtctgccctttggcaccttcatttagtgattggatcattcaaggctggcctcaagggccagcatttctccagtaataatataaaatgggctgatgttgcaaccttactcactctgctgaattgggcatgattaaagtctcaaggctgcattaatatggattttcttttctatgtacagccgtccattatctcactattttccagtttgccattttttgaaaacaagatggaaaattctgctgatgaaattttttttttgtctgtcagcacaacagcattttttggcttaagaatatgagaatagcaccgggcaaatgaatgcaaacattacagtttatgtggctctagcctgttgtcatgtcaatcttgttatttaggtaaatagtgtgcaatttttcaccaatcagcagccaatatgctgcgagccatttttgttttagttacattattggctggtaacctattaatgagacaataattgggaaatagtagtcattgttctcataaaacacgatcctttgttggaaccacagccaggcagaggagttgcatatgcagactgcaagggaggaaaggatagtagccagtgttcccagcttttaaaatcatcagacccctgctgcttaaattgccccagtgttaatgctggaaccattacagtaatggactcagcaaatgaaggagaacgaagacacgacactttattaccagaggggcaattttctcttcatatgtaatagcagcggtgcctcatatgatcagaccatcaagatactaatcctctgtaaaattactttttataactgaaaatgtgtaatccaaatcagtctgtgtcctgactgtctacttactattgaatacggactattagatctttatttttcatgatttaaaggctttgccctgaaaatggttggcttttcccttgcaacctgagtgcttaatcttagctatagcccagggttgtctttttgttttaaacagaacatcaccacttaattaaggagtgagtgtctgtcttgctgagttatgctggtgttttatgttccttggatttattaagcatcttgttttacattcagtctgcggtttgtgctgtaaataaaaatggcccatcttgcacatattagaaatttgcaggtagcaaatgtcaataagtaccagggattaaggttctttgatttatacttcaggcaccaggttgtggtttgtcgattgaacccatagcaggatgcatcttggtgtcttctgtggagcagatgtgtttttgcatcgttgtctgagaagtttatgtttatttctgcatccttggttcagtagattgcttttcagacaatgaggcataccgctccgcctcttatgtcttgtgagaaatgactacagctaaacattattatgagaagaccattaaaaactgatttctatcttcctgaatatttggaattttgggaactttgtaaaatcccatttttttcattataatctctttccacataccttatatgtttatttgtatatagaccaggtgccctcttggcagtatatttattctaatatgttgttatagctgaaagcatttgttgacattctctgtagagttcattcagaaatacttaattagtgtaccctttgtgtaccagacttggattacaggctggagacttgaggaagtgtaagatataatctttgctattgaggactcagtttaggaggaagacaggcatgtaaacaaataattataataatgcagtatagtaatactagtctactgtgaatgtgtacttcttgggagcatgggcgcaatagtaaaatcagcccattggttttttttgctgtgttatcaaaagcagaattctgacatccactttgagacttgttctgaatgactcgtagctgtttgaaagaaatctcttccttcctcactggagacatgttaccaccctagggggatagtcaaaggaaagttttccaaaaatgttttgatcaatgatcactctttggatatgtatagagtttcccaaggaggctacttgaaaggagatagtgcttatgtgtttatgttctggcatttatgtataaatcagtcttattgctttagagtatagtttatgagagaaactgtagcctgtggtggttaagaacgtggaatcctttagctctatttactggctagtgatcttgggcaagtcacctattctccttgagcctcaatcttcatctgtaaaatgggatcataatagttgtgaagattaaatgatttaatatatgtaaagcatttagaatattgttgggtaagtgctatataaggttattattattatgcgtgtgactattaatgaaattattttcatatgtagcttatgaaagtcagcttcgtaaatatagaaccacactgtatatataagtaatggtatgtgagatagagaagcatttcttaaatttcttaatgaaattttttttctgattcataataattttttattttagaaaaactaacaaatatggaaaaatatgaggcagaaaaagtctcatactcttcagagataaatactgttactttatattagtgtattgcttagaatatgttattatgcttatatataatatatacagtatgactaattttaaatatatttatgatcttatttatataagatatattttaaacaaaaattagaaagataacttgcatattttttacttgcttttttttaccatccagtatattatatttttttcatataattccaattgtatagtatttatggatttttttccatcctatcataggttatcctttagtgaacattcttgtacataatctctgcaaatctttggaatgtttcatagggtaaattaaaaggagaattgtatgggctacttttgttaagatttttggttctcattgtcaagttgccacctggggaggtaatgccagttccaatttaaagaagcaatatgtcagaatgcttattggtacatccactctaacactggaattatcagaaaacaaaaatgtttgctgatttggaggagaagtaggaacttgtagaactatttgtattttcctaattattatatttggttgaatttcctcccaccatttatattggccaatatagttcttttgtgatttgtttattcatataggctttgttcattttgctaacgtgtcgtcttttcttactgatttggaaaaatattttgtagattagggatgttatttactaatctgtgatagaaatatttttccagtttgtttattgcctgacttttatatttttgttattcaaagttttcctttgtttttaattagaaaaacattttccctgtcagtattagattaacagtatgcattcttctggttattaatattttatgtttttttcatgtaattgttaaaatgtgtcagaatttagttggtgttatggtatggagtagatgtggaaatttttcttccccaaggccatcagatatcgctgcctgcatttattgacttatcttttacgtactgatttgaatgcttaataatcagatctgctttttatcctgtttgtttttactttgacacatcattttaattgccacgatttataatatctttctaaatttggcagcatgaggcccctataattagtctttacttcaaaaattctgtggctcatctcttgctttgagaagacaacctaaattttttcccaggtaatttaaaaatcaccttttcaaggtcccccatgtgccccaccagtcttttggtattttaatgttattgcattaaatttatacattaatttggaaataactgaaatatttgtggtaaatctttttctcattcaataattatctgtctctacatttatttaagttttatgatcttcagaagctttgtaattttgttcaattgggcaccatttattactttatgtaaaatacgtgggtatttatatttttgattactattttttggttactattgaaaatgggatatttaaaaattgtgtttttaaatgatacttaagaaagttttttatgtgtttgctatttttgtatttggccacatacagaatgcattcttatcattctaatagttttggatgattttcttgggttttctggattttacgaggttgataatctacttatctgcaaatataatttgttttttcctctttcagtattatactctcctctcctttttttttcttctattattaccttgtctagaacctccagttgtagtggttatagcagatagtcatgtcttcaacagttatacttcgggattctagtattaataaagtggtagttgttggcagttatctttgattcttactttgtttttttcagggactgagttgaattttattgaattttaggaacattttttggacatctctttagatggtagtatcttacttctactgataaaatgtaatttattagactttctaataatggttccttgggataaacctacttggttatattatataggtcttttaatatattgctgaattcaacattttagtattttcaattaggaaagtaagatgggtcagtatcagggattcttatggaaaccgcagagtgtactccaggggttgagggtatatcagaatctttgaatggggcatatataacatacatgtgaacataattcaagctacagtttgtaaagcctaataaagcatttttggctgatggggatagatcacagtagaagaaggtaaagtgaataaaaatattgagaaactcctttttgtgcttcttttgtcaaatttggtatcgtattatgctagtatcataaaatgacttgcagagttttctcctccctgtcttcttgggaaccatttacaaagcattaggattatttgcctgttggaagttgaactttacttcttcttcttctttttcttcttcttcttttttttgagcagagtcttgtgtgtcacccaggctcactgcagcctctgcctcccgggctcaaacagttctcctgcttcgccccccgagtagctgggattacaggcgtgcaccaccatgcctggctattgtctatttattttcttcttgagtaaattttggtcattatatcttagaatgggagagttttacatttatgacatggcattgagcataacattctctggtttactagggtagaattgtgtatagttttaaatttaaaaaattccatattcactttttccatcttcttttaaattataactttgtacatcttgtcttctctttaaaaattgactatatttgctggtagtctgtttttttttttttttttaaacaagctcttgaatttgtttatgctctaattcattaatttctacctttgtttttatgttttctttgtcctgcattgcctaagcttcttttggcaacatcttgagatgaatgcttattattcatttttattcttttttgtttaatatggaaagtatttcaaaatcttaaaatagtttatctttttggtttctgtagcaatttgtgcatgtttttgtagcacttattcagtattcaatgatttttttcattttctttctcataccttagttatatagactatactttatttttcttgtaccccaatgtccgcagagtcttgaacacaataggtactgaactaatgtttcctaatgaataccctgaattcccccattcccctttcactccacacaaatagtaagtagcctgcttagttagtggaagtttagctctccaactaccagtgcacatcactggtggttggagggctaacttgtagtctcacattccaactaccagtgcacatcactagtagttggaaggctaaactggagtttcacatatgccacttactacgtattaccttgtatgagtcctccaatctctgtatgtttcatctgtaaaatggggataataactcccttccctgcttcatctgagatgtcataataagataataaatgtaaaagaactttgaatactaacaatgttatgtagatataaatagatttaaaataggtttttagcattcttatctcatccaccacttctccccctccccaccagtagaaattatcaagttcttaggaacagaaacttattttgaaatagacaatattgtacaattcatggagtacatagtgatgttttgatacatatcgtgtatagtgataagatcaggatattagcattttaatcatctcaaacatttattatttctttgtattaggaacacagaaactaaaaagatatatatatatcttttatatatataaaatatatatatatcttttatatatattaaaagatatatatatatctgtgtcttccgaagtatctagcacagaactttgttgacagtatacagtaaatatttgttgactggatgttttctgagatgtacttttctttttcttttttttttttctttgagacagagtcctgggtcctgctctgtcacccaggctggagtacagtgcacagtcataacttactgcagcctcgacctcctaggctcaagcagtcctcccaccccagctcctcagtagctgagactacaggtttgtgccaccaagcctggctaatttttgtacatttgtagagactgggtctcactatgttgctcaggctggtttcaaacccttgggctcaagcttctgcctgccttggtctcccaaagtcctaggattacaggtatgagccactgcacctggctgagacctacttttcaaacatgaagtactaagtgatcctcaattggaccaagacttagggccctgccccaatcacgttgcttctcccagtttactcggggtgacctagacagctacataacacacagtctggtgaaatgcacatgcgtaacttgaggatgtcaaccttttggcacagctcatttcctctgcagaagagcggctagagacattatactctgttcccgaagtatatagctaataaaatagtggagttgatttagattgataacaaattataaaattgataaaaaatatttctatttttataccatttagaacagctattaatatttttaaaatttttttctcaattgatgaaaaataaatgtatgattattccttccctttcaattgcagttacattacattttcttgtttctcttgcactgagatttattttttatttttagtttattttgttcattgctatgaagggtgataattgtatcaagtaagtctcttttacttacctgagagttcccatgttcttggggaaataaatgtcatcatataagtcagtcttaggttaacaggttgttttaaaattgcaaccactatccaaatgcagagtgatagtattttctgggtaggtatttcatactctctttcgaatattggtcaccgaaggatttcacaaaccactgacatttcagcattatgacagtgcatgtgctcctgtcaccctctgaccccatattttttttaaaccattcatttcaatcggaaaagtataattttttgaaaaaacagagatacttaccctttgcgctgcttttaaagattacgggagacttcatatctcagataattgatggtaaattctgcttggttgtttataagctcaactttggagatctacaaaaagagtttcatctgagaaataaaaactattttaatgattgttgatccaccagactgtgaggtcttttcttcagtccctcctctttcatgaagcgtttgagattattccattcatctctttccttaccgactttatttcctgtgtcaaaaagtatgatacaacggtaagtttgtgtatggtacatttactggtgtatggtaccgtatgtggttgacgttggtcatattaaattttacattttgagattgcttatacatagtagtgttttatacacagtattctcttttccctatggggattataagatccctctggctgacaacactgctataaattgttttttgtgtctagtaagatgctacaaatgtggttgactctcagcatttcttgtcaaaggaaacatgtatagattggaagttaagctttttgttttttgtttttttttactttactgacagttatttaaccttaactcttaatctgctctccatcaccagtagaaaatattttgttagaaaatgttttgtgtaggctaggtgtggtgactcacgcctgtagtcccagcactttggaggacgaggcaggtggatcacaagatcatgagtttgagaccagcctggccaacatggtgaaccccgtctctactaaagatacaaaaaattagccgggtgtggtggtgtgtgcttataaaccagctactcgggaagctgaggcgggagaatcgcttgaacccgggaggcggaggttgtgtgagctgaggttgcaccactgcactccagcctggatgacagggtgagacgccacctcaaaaaaaaaaaaaatgttttgtgtaaaaccatatgacagaatagatctgaggaaactgcattgtagccataggagaaatcatagattttggtggctctttacctatcactgtgttttttaaagagttatgtctgaaccacctatgtgtcccgattcattttgccatttcatctactgccttcctcctgtttttatttaagactatgaagttactttagtgtaactgctgctgtcaccttgcccttagctaatcaaatagtttaccttgagggaagcatttatctcccactttcattttattatttttgtagctgtaaagatatatattttatgtctgcagaaggctgtaacagtgaacgaggtattgatctgctgtatttagcaatttctttccaccttgccatcaatagcatgcagcatctgtctgtaccgtggttgacctcacaaatagctctttatgctcccattggattaaatgatatagtatgctgaaaactaaatcaatgaatgattataaagtttttagtattattcatgacctggaggcaactggtactccttgcactgacagttcagtgtacaatgaatatgtaaaatgagtgtgtctggcctttgttctactgaaaggaggaaaacgggtcacctggttggtcagctcatacttctaatgatctcaaagcacttaggcacttcagttaaacatctcacttacagaatcaggcagagagaagagcaagactcctatttaactttattccccatgcctcacacaagtatgtagcaaatgtttctaaaattatttgagctataatcatataggcttttgcttcatttataaaagaaagacaaaaacccaaaactagatgctttgtcactgtcaccaaggcctaacgaaaaggcacatggtggaaggagggagagtggtaacctaggtttaggtctaagggactcttgcttgctgtcagcacctggtacaaataccaagatagggtttttggggccacttttccatttgagggagttcctactcacctccactgatctgtggaacactgaaatagcagagtcactaatttgcctgcttttggatgttgctgaattcagcatcgtcttgaaaagttctgccgaatcatacattcagatgaaagatgttttagatattaaacttgacatttgggataatggaaagatagaaccaggtgatggtgggtgaacagggaaagtagaacccagcagttgtatcctgatcttttgaggatatgaatcaaatctatttatttctaagaaatgccatcctgagtactcctttgtccatcagcccagtaggaagtttgacaaggagtattggggagttcacaactaattcattccccagacatttgttggatgaataatgtctgaaaaatagggtatcttgctgtattccttacagatgacgggttatctcctttccccagggtcacttaaggaagagtgatgatagtgatcagagcttaaaggtgttggtctacaccagtgctgccacgaagtcaggatttgagaccagtctatagtgctggtgtagaccaacacctgtatataatgtttattttcagttcatttgtaccactaaatactgtctctgatgggggccactagggctctatttgtgatagaaatcctattgttgagaattattactgtgtcctgggttagagagaatagatatgaggctagctcctcctcttgaatgttcatgggaaactgtcatgcttggctttagcaaatccagatgtgtctacctgccttttttggccaattgccattattccccccagtaagatatttgaaaggggaaataatgggtggattttatgaccatttcatgtctggtcagtttcttttcctactgaaaggatgaagtggggactcttcatgtaaagccacagagtcggaagccccgaggaagaattcagcttggtcctctgaatctgggattgagaacaacaaactgaggcaccatacccttatttcctgtagtataggaaattgctgataattaataattttagcattgaacttattcagtccagtaaaattttcttaggatctgctcagggatctgcctctcctaaattcttgggttcttttgttattcattatggatatgtgactgattaatcagctaagctgtttttgaagtcatttaacttttgttctgtattatcctttaggaatatgagtaccattagtactttgtgatgctacaggagtacttccttttcatttgtcctgtggtgtctgaaggagaactttcttttattttcctgtattagttcacgttatactgtgaggtttgcaactcaggtctaaatacaggattgggaaagatgttcctgtctctcaattcagtctttgtgattttatgtacatatatgcctaatattagataaggaattttcccactcagattatgctgctggaaagagaagtcacttcaattcaaatctttctcaagtcttttgtattgtagaatgatcttcattgtgaacggcattattggtcagctatccaaatagtatgtgagtgtgtacttatggcttggaatatttttctggtcaaaactatatgtagtaatctggatttatgcaccataatttctattttttgcctaagatggaaggttgctacatgctcatatagtacttaaaataatttatgttttgctgtctgcagtatatattagaaactagctatattcttgttggtagagaatagggcaattagttgaccttgttcatataagctttgatagtgggatgtcttggctttgttccttgtagatgatgggttattcctctccccaggctcacttaaggatgggtgggtggtagtgatcaggaattaaagagtactagtgttgcctctggtgtagacccacacttttatataaaatcattttcaagttcaaactctaaaggctgtgtctgatgagggccacttaaggctctgtttcttagaaatcctattgtgatgaaaaggctgtaagaagacctgtccaacttaattcttgatcctagctagtcacttatgacaatcatgtggcctgtaaatgagataagacatttctttttactcaattaagataagaagaaacctctttacaggttatatgttaatgcacacacatcttaatacaatcatgtattctactacatagaaaagcaataagagcccgaacttagaattgtataaggaggtatttgttcatatactggactctgaatcatttgtggactacgattttataaacactctaaaaaaattaaaacgtgtcgatgaactactgtgtacctaaagttacattatttttcattaaataaaatctatatacacacactaatattcacagttctcataatagtatggttatattatgttgaactcgtccttcttaaagattattttgttttgtagacatgtaggaactttcctagaaaatcgtatccagtttttttctgtgccattttgaattagaaactccctaaagaagaataaattactttgcattttctttcatttttttaggatctgagaatgtgtatgtgtctgaggctaccttgtgtctaaaagcagagcatgcttaaaaccatggctgaggagttatgcttaacggtatatttgcatgcatttgtgatttgaaataggaaaaaaagtcaaatttgagacagcttgaatgcatgctgtcagtttggagcttcatgaattggcaatggtctcatttaggaccttcagatggtctctgcctggacagaatgagaacattttgcatgttcagaaggagacagccactccttctgcttcacaataggcagtggtgcatgacagttgcccttcattgctggcttcttggagctaacctctgaccctccacttagtcactgtgcagcagttggagcaggttggagatgttgggaatgacaggcattggcctgcaacatgcttgtcattatttgactgtcaaaaggagcctgcattggtttccatcaaggtttgaaacctctgtgcagcagtccatattacttaacttccaggctgtcaacaggatgatcaaatgtgcataaaaaaatcagagtgctgaatatatcttcatcaggagaaagaagtttcccctcttcttttctttctttctttctctctttctctttttattttcttttggctaaatatattcagatgactttcacagggccaagaggttgaatctgttctccagtgagaaaagtgaactgttgtctcaagtggtctaagtttcaaatagcacaatttaatctgagcagctctgctggctaaattctctgacttgtctggcatattctatcagctttagctgttagtttaagggactagatgctagtccagtggtgcctggtgttagctcacaggaaaaacgtttactttggtctctatgtagtgttgcaaagggatgcagacgtctgtgtatgtactgcgaatgaaagggatgattttggatgtatgattactatctcatttaagactctttttccacatggtagggttcaaactggaattttaagtgatctgatcaagtcttagaaacttacaggtcagtcttatgcaatttattttttagacatagaaaaatatgacagcaaaagccatttttttcttgtaaatttgaaactttggtttgaaaagcatcttgaagtggaagaggatgacctaacagtattctggaagtgtatggaaagtgttggtttgcttctaacattgtgcagtgatggtgtgggagtcacgagacctgagttttagttttgcttctgccattttccagcagtgcactgtgtgtaagtcactgaaccccttagtctcagttcttcatatggaaaaatagagatctaatatggtgaggatggaaggaggtactgtttgtaaagtacttgcttttgttaagtacgtagtcactcagtaggcattccctgatctcctttttatccttttcttttacatccagtgtagcaggaaagacatcaaacagtagtaaggggccaggtacagtggttcatgcctgtaatccagtgctttggggggctgaggtgggaggatttgaggctggaagttctacaccagcctggtaacatagtgagaccctgtctctacatgaaattaaaaaattagtcaggtgtggtggtggcacctgtagtcctagctacttgggaggctgaggcagggggatcccttgagcccaggagttgaggttacagtgagctatgatcacgccattgcactccagcctgggcaacagtgctagccctgtctcttaaaaaaaaaagtcagaagacaatacttgagctgaataaacattccagacctgacacagtcaatcgttgtgttccaactcttttcttctcccatagttctgattcttgttatgacatcacgttttagtcaagcactcaaactaccaatctgagtaggctgcctgcctccttttttctccttcccttccttccattcattcattcactcaacagatatttatagagccctactatgtgccaggccctggtctaagttctaggatacagccatgaactagataggtacatttggctatcattaggtatctggagagagagacaaaaaataaacaaacaaataatgatttttgatagttctaaatactattaaaaaattagtgtaagaggataaagagttattttgttggtcacagaagagctttcactgtagagttctttccagcagagaactgtttgaaggaagagagggccctgggaagatggggacagtcttccagacaaaaggggaccatacttctttttttttttttttgtcagggagtctcgctctgtcacccagactgaagtgcagtggtgtgatttggcttatagcaacatctgcctcctgggttcaagtgattctcctgcctcagcctccaatagctgggactacagatgcccaccatcatgactggtttttttttttgtatttttagtaggacagggtctcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaaaaattagctgggcttggtggtgcgtgcctgtattccagctactcgggaggcagaggcggcttgaacctgggaggtggagatctcgccactgcactccagcctgcgtgacagactgaactccgtatcggggggaaaaaaaaagtaaaatgaccgtgtcactccactgttcacaattcgtggagatttgccactggctgcatgttaaaattcagactcctgggcttgctgtataggtcctgttttttcagccttatttattgtcagctggtaaccacgcccccaacccccagcttcacccccataatttataccttatactcctactgttggaaagtggtgacccctgaacatagcctctgtccttttctctttctagactcttctcctcccttctcattggcacctagagaagatgtatctttcaacaatgtccacaaatgccacctcttctgagacttctgtgattctgcatcctcaatgttgtgtacacttccttagctttcccctcactatagctgtttgtccattatttctcagtccctgagctctttgaaggcaagaactgcgcttttattcctctcttgtaatgcaatatctggctgagtgtctggcatacaacaagcactttataaactgtcacctgtgatgcctaatctttagaaatatttagggatagatttatcatggacttcaaatgtagatataacagattggacagtatacattttgaagagctcttcagtcaaaatattccatgattgataggagacttctttccttaggcctaatttaaataaatatcatattgaaaggagagtgatgcagaaaacattagaaactaatagaaatattatatatactaacttcccaagaacaccaggattagtgtcactgagcaagttagcttcagataaacttttatgttgctttttttttctataaccaacatgtgatgtatcttttttcaaagaagatagtattaaattttgtatttcaattcataagtaaatttcatattttttctatccatccatttatctctacatttttccaattatacgtatagcattgtcatgattttttttgtagttttcattattttagaaggcttttttttttagacagggtctcactctccttgcctaggctgaagtgcagtggcacgatcatggctcactcagcctcaacttcccaggctcaggtgatcctcccaacacagcctcgtgagtagctgggatacaggtgtgcaccaccatgcccggctaattttttgtatttttagtagagacttggtttgctattattgcccaggttggtcttgaactcctgggctcaagcgatctgcctgccttggctcccaaagtgcttggattacaggcatgagccaccgagcccagcctattagaagcaatttatgccaaaccacagtagatttgtcatatgaatagaataatttatttaaatagtttcctcattgttgaccaattagcttgtttcatttattttatcagcataaataatgctgtgttgagcagtgggtttaaacatttgtatgtgcatttttaaatgaataaattcctagaaacagaacacggagttaaagatagggattttttaaggctcttgatgcatattgccaagttgccttatgaaaaggtgtccagatgtttgtagagataggttgtaaaaaggatcctgcattagaatgttttcttagattacttgtatgtgaatttgggatctaactgggaattttatatttgagaggcattggagagttcagtaatgggcataaagagaagaaagagatagaaggaaaggaagaacaaatctagttttgaacttctcaaatggtgtgtaggctgtggtttagtgattttcagacttgtcctggctacctatagggatctgcttctccaggtgggggcctgagaacagcttagctctgttgatgtatttgtttatacttttggataaaagttccttcatattaatacttccaaattgaaaagtttgaaagccacttggtaggtctctatgtttactactatcattttcagacaatgattcaaaagggaattatcttgttcatgcctctgttgtttgagatgtcagcctcctattcattgttaccttctttttttaaaatttaatttaatttaatttaaattttttgacatgagtctcactctgtagcccaggctggagtgcggtggcatatcggctcactgcaacctccgctgccgggttcaagtgattctcatgcctcagcctcccgagtagctgggactacaggactcaggcctgcgccaccacgcccaactaatgtttgtactttttttttttttttttgagacgagtctccctcttttgcccaggctggactgcagtggcactatctcggctcactgcaagctctcctcctgggttcacgccattctcctgcctcagcctcccgagtagctgggactacaggtgtttgtactttttgtagagacagggtttcaccatgttggcccggctggtctcaaactctaaccttagataaaccgcccacctcggcctcccaaagtgctgggattacaggcgtgagcaccgcgccccagccctcattgtggccttatttttttttttttttttttttttttgagacgagtctcgctctgtcgcccaggctggagtgcagtggtgcgatcccggctcactgcaagcctgcctccgggcttcatgccattctcctgcctcagcctcctgagtagctgggactacagcgcccgccaccacgcccggctaatttctttttgtatttttagtagagacagggtttcacatgttagccagcatggtctcgatctcctgacctcgtgatccacctgtgttggcctcccaagtgctgggattacaagcatgagccaccatgcctggcccattgtggtcttcttaaaggaccatgttgctaacccgaatgagagaggagtaacctcctgaattaggagttgttactgcatttacaaatatcctgttacctccttcacctctgtatggttaaggaaatgtggtatcaagcactttccagttcctacttcagtgtgggaactgtgaagtatcttttaggcaaagtagagttaaggcaccttaagggcaggaacttcttatcttgcttttattagcagtcgtgtcaacagcactaaaatgtgatgacccactttcccttctgataaaaggagaatgacctgcttggcaggatggagagaggtgcctgaggcagattacattgttaccgctcataataacagtaggcaaaaggaggggggtggtggaaaggccagcagatttctgtttacccatggaaatgtttgactttttggcttctgatgaaatgtgctaagaagagggggaaaaaggagcattgtagcagggaaggaatgaatgagtaaggaaaagaaggaatctggcatcagggaaggaatgaatgagtaggaaaaaagggaatctggtgtcatgtgagacatgtgaagccacgaagggccttaaatccagccctgtagccatctattggcagagccttaagacctcaaaccatagagggagcccccctttctgtctttttaaatttaacctatatttgtttagagccaagatctctgacatggcttgctgacttttctaaagatgaactgaggccaggcacagtggctcacgcctgttatcccagactttgggaggccgaggcgggaggatcacctgaggtcaggagttcgagactagcctgccaacatggcgaaacccctgtctctactaaagatacgaaaaattagccaggtgtggtggtggtgcctgtaatctcagctactcgggaggttgaggcatgagaatcacttgaacctgagagcggaggttgcagtgagccgagatcgcacaactgcattccagcctgggtaacaagagcaaactccgtctccaaaaaaagaaaaaataaaaaagaagaagaagatgagctgaatacaggggacctgtacagttgataggctctgaggagatatcaacacggaaaattagggacgtaattcccactcctcaatgaaggaggattcttctcagttaagtttatttacttacttggctttggaccagagtctgataactctgggaaaaagttgtagttattttgagatggtcgatataattaaggcttttttaagagagtaattgtgtggtttaacctgtcatcttgaaatatgaattaacagagataacattaaaaaaggttatatgtgacatttctaggtgtctcagaaaaagattgagtttgtctcatgtctaccatggcaacactcttgagttattataaagaacattatataggatttcctctagaatttttaaatcttaaaatgtaacttactttagccagaataaaaagggtttaaattaatggaaaactgactggaaggaagatataaaacaagaaacaataacacacaaaacttcactaaagtacacaattctacaaattatgcacacaagcacacacattttacaattgagggtatttgtagaaattcaactctcatttgaatcaactcatgacaaaacgtattacaaagtaagtagaatggaaaagtaccaaaaaagcatttcttgggttaatggtattaccaggtcaaatccattaaggaaattctctgccagaccttttcttttttcttaagacatgagttttgcacttgttagtataatttgggagtggtcaagaagctaggtgatagaacaacttagattctggatttctggtctattatttggttttttttatgaataagagattcactctttctttaaaggaagtaatttagattcctagcactgtcatttctgttctgaatgttataaacctctgtacaaaatttgaaaggaacagacatgctctgatgatgtacagaatcttaatgttcaaaaacgatagttctcttcccctagaatagaaaagtatagcgttcacctgattgcagacccaaatgtctacatctgtggttgggtggccaatatcacatgaaagagttttgtgccttttgctcaatatataagtttgaaaaatgttggctgcaagtaacagaatttccatgtaacatggattaaacagtaatgacatgacttttcccacatcataagctgtctggaaggaggaagtctcatggaacagtggcttaatgatacagtcaaatgcaggtactttccagttttctgcttgccattcttcagcacgttggctttttcgtcttttgacttgtaacctagtgatcactggttataacagtgccaggtatcatgtcctcatgtaactgtgttcagggtaggaagaagaggtgggaagataaaagagagtttttatattaggagggaaatccttcctgtaagtcccctagacactccttattatgtcctattggccagatctggatttgttggtcattcctagttgcaaggagactgggaaaagaagtgtctggcaaaagggaatgcgattcctacgcttggcttagaagctcatgatccattccttggaactgggctcatggctgcccctgttagcagggaagcagatgaatagctgttgagtaggcagccaatggcttctgccatactcaattaatgtgtgactgaaatgagatttttatcttttgttccacactggccaagggatatggcctctgttaccattaatataaccctttgagacaaatacatttaagaccagaattggaactttgaattatccaccaatacatttaattagcactgacagtgttctaggttattgctagacacaggagatactcagtgaataagatggacagtctctgaactcatagggttgatagtctagtaggactgagaattaggaagtagtttcagtagatatggggaaggcacagtttgctgtgcggtgaatgcaatcagctaacatggactcggagagtcagggagggcctcttggaggaggctacatcctcgcgactccagagacacaggattcagctaatctcagaaaatgatgagttgatcaccctcctttttaggtattcttggaaatccaagcaaaaacaaatctgctcttaatgtggaaactgtggaacttgagaattttatgtgcttcacggagtgagtaattccagcagcagctcaggaagcacatagcagagtgtaaatggcattgtctttgaagcctagttggataagctttctgcctcatctatctgtgtaaggaacagggtttctctgaaggtatctttgaaatactctaccatcagtcatatttctactttcacctaagtcaatattgaatcctctttggaaatcttggggtcatcttcctttctgtcaccttctatcttcagtcaccaagtctttctgtctgttagcagctctaaatctgacccttccttctccttcttactgcctctgctttagtttcttactctataaaaggagataatatatcactgtgtagatgccataatacaaatagcaagctcttatggcactataattttttaatacatgttaaccatatgaataggtcttattattattatgtccattttaggatggagaggttaagtaatgtgttcaaactgctccagctagcagctggtagagttgaggtttgaatataggctgaacatctggctcctgaatctgtcctctgcattgtactgagaacctgtatcgtaccgaggtacgtcatctgtgttcttctgtactctcctattttgggctaaacaggtcaaactcctatcttagtgtctttgaaatgctcaaacctgcacgttgtgcacatgaccctaggacttaaagtataattaaaaaaaaaaaaaaagctccaccatcaatctgtagttctgccctcacccaagtcaatatcgagttctctctggaaatctcggggtcatccttccttctgtcacctatcttctgtcactcaccaagtctttcaatctgtcagcagatctgaaatcgacccctccttctcatttccactgcctctgcttaagtttagggtgtctcaaaatacctcttccagcacagttgcaatagtctcagaactaatgttcttgcctctatttttcccttctcccaacatcctctctttttgccaatttctgtttcacattgctgacaagtggtttttcttatatttaactctggtttgactttgattcaatgtaggtcttaaatgtatcccttttggctgaggataaaaggccaagtgccacaggtttccagagcactatctgacgtaaccagcgtctctcccagttctgacactttccatctccccgctaccagctccatctatttgctgtgtagttgtcagggatgctgtcttccatactcattcccctcccccagatttatgtgggggaactccttttaagatttagctctaaagtttctgcctctgcaaatccttcccttccattgtgcccattatcacttcagcttctggtcactttgtacttggccattgcgttggtatacttggtgtcctttgatggtgagtccttggaaggcaggaaccctgtgtgcgcctgtttctgcagagcacgtgcagtttctgctaacagagggcctatcataatacttatggaagggttgattgatgtctgagagtatgtttttaattttgcatggtggacacattttatatatttatctgtgggaagagattcatgaataagtgtgtatatatctctatatacatacacacatatacaatcatgcatgcttaatgacaaggatacattctgagaaatgcattgttaggcagtttcatcatgtgaagtcatagagtgcacttacacaaacctagatatggtatagcctattctctactgcatcagacagttgctgtttcgtacagtaacttgctatacaagtaacttgctatacattactgtacgaatactgtaggcaattgtagcacaatggtaagtatttgtgtatctaaacatataaaagtgcagtcaaaatacattattgtaatcttatggaagtactgttgtatatgcggtccgttgtgtctgaaataccattctgcaatgcaagactgtgcatatgtggatgtaagaaggatgctcttgtcacccagcagtaatatgagccatcacttattttgcctgtatagtgccctcttggaaacatgtttattggctcccttagattaactttatgacgagagagtatgtacccttcacctactcctccccccagcctacccaattaaagatgactagtcttttaaaaatagcgttatgagatataacttacatcatataaatggaatcataccgtgtgtggtctttgtgactggctcttccacttagcatgatgttttcaaggttcatctatgttgtagaatgtataagttcttttttcttttttttcttttttgagacaaggtttcgctctgtcacccaggttagaatgcagtgcacaatcgtagctttttttttttttttttgagatggagttttgctcttgttgcccaggtggagtgcaatggcgtgatctcagctcacagcaacctccgcctcctgggttcaagcgatctgcctcagccttccgggtagctgggattacaagcatgcgccaccacgcccagctaatttgtatttttagtagagacggggtttctccatgttggtcaggctggtctcgaactccccactcaggtgatctgcccacctcagcttcccaaagtgttgggattacagacatgaatttctttaactttttatagagatgaggtctggctatgttgcctaggctgttcttgaactcctgggtcaggcagtcctccctcctcggcctcccaaagtgcacggattacaggcaatactttattatttttatggctgaataatattccattatatggacacatcccacgttatctcattcatagttgatggacattgggttgtttccactttttggctattatgaaaaacgcttctataaaatttgtaaggaggtttttgtgtggccatatgttttcatttctcttgagcatatacctggagtggaattgctgggtcatatggtaagtctatgtttggcagtttttgaggaactgccaactgttttccagagtgacattcccactagaaatgtattagagttccattttctctacaccttgccaacacttgttattgtctatataacaccatgtcacattcccactggcagtgtattgagttccagtttctctacatctttgccaatacttgttattgcctatttaaaaaaaatttttttttgagatagggtctcactctgtcacccaggctggagtgcagtggcaagatcatgatcactggagcctcaacctccggggctcaagcagtctttccacctcagcctcctgagtagtgtaaccacaggtgtgcttttaaaaaattttttgtagagatagggtctccccatatgttcccaaactggtctcaaactcctgggctcaagtgatcctccagcctcggctgcccaaactctgggattacaagtgtgagccatcgcaatctggcccttgtctgtctttttaatctttctatttgattcttataattctattagccaaagaaaaatattcttactattactatttattttttatttatttgagacggagtctcgctctgtcgcccaggctggagtgcaatggcacgattcggctcactgcaagctctgcctcctgggttcacaccattctcctgcttcagcctccccgtagctgggactataggcgcccgccaccacacctggctgttttttttttttttttctattttagtagagatggggttttaccgtgttagccaggatggtcttgatctcctgaccttgtatccgcccgccttggcctcccaaagtgctgggattacaggtgtgagccactgtgcctggctactattactttttagatgaaaaccccaaggcaacagacagattaaatgagatgcctctatatgtgtgaatggaaagaaagaagtggtgtggataattcaaaaccacagattatccaaagtaatttaaaagtttttgaatcaaacactaaagtatgtttgatgttggagatcatattcccactcccacgttaaaagacaattagtatgattgtatcttttttgtctgtgttttttttaatcattgaggtataattctcctaatataaaatgaaccattttaaagtgtttgaaatattactctgaggatgcctattttttagtgattgtaatagttatattgtcttcaaaaatattgcatgtacttaaaaacacttaaaaaatagaagcagtataaagtttgatctcccaagggccatcatagatctatagagggaacaagaatagaagtaccacgaggcaaactggaagtccttgttttaaagtaattaagataaccatgttgacttttatccatactttatgtatagcctttcaaaattagaaggctgtgtcttccttgttattctgacatgaatatttagcagtgcctctgtaaccctaggatcatatggtaaatgttaacaagaagcaccagaacttgtgttttcctgtcctattgtttttctacaagaatgctgacagctagagtggctttgtgacattgtgccacaaagctgaatattacatgtgtagttacctgggtaggtgtagagtgtattttttttaagagcaggacatagtgactggatgtcatcagttacatctgttttatcgtactaaaaatttacgtatattttgaaaacagttgcaaattagaattttctaacttgtatcttcatgttacttcctgctaagtgaagaaaatattttctgaaaatatgaaacttgtaatgtgcatacaggttgaaaatgtgctgatagaatattttctggtttttcttgcctttctgctcagtgtgtcaaatcttattttttgagggaaaacatgcacattttacagtaggttctccccatctgtttcattcttcatcttgtaatgcttcctttcaaatagctacatgattaccttccagtttagggcactgaaaatgttatctctggctcagttgacagtttttattgatgatctggtgggaaccggtctgtggctttttcagcacatttcaatgtcccaataccacacaagaagcttttctcttcccctgcacaccccagatgaatacaactttactgtatattctaataataaaatacataccataaattaagacaaggctgaaaggtttaaagaagaaagtaaaagtcaaccttaatttactttccaaacaacataatcactccggacattttggcctgtaacaggggtcagcaaactttgtctgtgggccacatctggcctgccacttgttttttaatcgaccttgagctgagaatgtatttacatttttgaatagttgaaaaacattaaagtaacagtaacattttgtcacatggaaaattgatatgaaatttaaaattgtttccccaaataaagttttattgaaacatagcctgctcattcatttacatattatctagactgctttcatgctaaaatggcaggtttagtagtagttataggccttcaaagcctgacgtgttcattattactatctggacctttatagaaaaaaatctgctgacccttggtctatacccttcaagactttttctgtgcatttgcgtgtgttgtttacattttgaaacaatgaggttattctatgtgcttttgtaatttaccctttttgcgaatagtgtttacaagtaacttctattgcattgtttgtttattccattggattataatcgtgaaccactctgttgctcttttatttgtattgtacaaacccattagatgttacctaggacagtaataataatagtagtagtagtagtacttactatatgaattaaaattgattttaatgtttaatgaaataaaactttatttttttcacataatctgaatcatgacctaggtagtgtcaagctgcccaagaaggtcattgaggaaccaggatctttccagtgtcctcttctgccatctcagcatgcaatttcatagagagagggtgactaaactctgttattgttgtgtatcaattaccacaagtcttagcaatctgaaacgacaaatattaattaccttacaatttctatggtcatgagtccagatacagcttagctagttgtctctggctcagggtctcacaaagctgttgctgggaaatcgcttatttcaagacttgactggggtggaggggatctgattccaagctcctcatgtaggttttgggaagtgacagacccatactggctgttggctggagaatcaattcttgccacgtttctgtctccatagggcagctcacaacatgtttgttagtttctcccagagatctggggagagtggggggtaggttacagactttttgtaacctactctgggaagtaatatccataacttctgcggtattctgtttgttagaagtgaatttctaggtccagcctatactaaggggaggaattccaggagggtgggaatatcaggaggcagggattattgagggtcttctggaggctgctttactatgtggtttcatttaaatgtggtgggtagaccttcaggcattgcctggcaggaagggtcaataccagcccttccagtttttcaattagaactatgccatatgccacccctagctgcaagaaagtctgggaaggcaagttttttttggtgacacattgttgccaggtcaaaatcaggattttgttgataagaaaaatttcgataatagacactgggtggacacagaaggtatctactatccctgccttctaaggtggttataaaggttcagtgaggcaatcagcactggtctggcttataatattcactcagttaaacaggagctatgattattgctgtacttaaaatcacataatatagctttgtaaattagcttgtgacaaaacaggatccctatggttgatactaaaagaagtagcataaaaggaagaaaaaaatacattgattgggtgcatagatgtaccaggcattttatttacatgcagtatctgagttaatcttcatcataaacctaacgggtattgtttgccacactttatagataaagaaaagaaagcccaataagattaactaggtgttgaaggagcgctttccactagtgtgccttgagtgggttatagtttgtggagatattgttcctttagttcttggaatgggcagatggggacaggggtaactggagcccctggtctctcatctctaactctgggcagcctcttctgattactccagtgtgccttaaaaaatataatttctgcacactccatgatgtggaaaaggttagagtgtataactctatccatgagtaagtaatccaggtatgtataattccagctgcctgtctcctttccactgtcaggctctcaacaactatagaagccttgaattttcgttagcctaaaatttgaaatgccccttcatttgctacaaaatattatatttctacattttcttggattataaagtgatttaagttaacatgatttgagcttcactgtggtcggaatgaaagcttgcttggccactaggtggctccttttggttcttctcccagtcgatggttgtggctttgtcctgtgccacctcttagaaggaacctaaattggcataaggaagcctagacaacaaggagatctgaaatgaatgggacatgcactctgatgatgcagttaccttttcatcctttactttccactcctgttcctcctgtgctcatacgctgattttaggtaacagatctagtccctggagcctcagatgagtctttgatatctctttctcactataaaagtgggaaagtggggtaaagaacttttgtcctcatctagtatgttaggtaataaataattgtaacatgtttgcagataattttaggcacaatttttaatacagcttattatctgggaatacttgtgttactacgcagataatgattgcactattaatattaatttccctatctttaatttaataatacaagctttaacttacatgtattatctcctataatcctcataggaccctgcctagttaccatttttttccccctgattttagagatgaggcaattgaagcttaagagataggttaatttgctccaagtttaatagagtttggttgctttcagattttttccttccgtttggaagttgttaattcattatagttgtgggcagagttttgacttaagtcaataatttaaaattcctatgaaataattcagtagaaagtacttctggaaccatagtttggttgaagtacagacatcattttctccagtcgtcttgtagaagtgagcagtagctggaagtgggtcccttcaggaaggctacaggctctttgcagaattacaaattgtatacactcagggatccttcctttctcttgcctacaaatgcagcacccattatcatagaaactgcagggcatttgcagcttaggttcagactcggagctcatagaatggaacattcttcttcttcaattagagaacactaaaaagatgggaaggcacctaggcctagggttttctttgagactgctgactgattgttctcttttacccaaatttagattctgcattaatttccaaatttctctggttgccttaaaaaataaatcggctcatgctaggttttctttagtcacgaataatttaactgtgcttatatctctagttgactccccagttgtggtggtgatttctgcagaccataggaaaatgtatacaaatgtgagatgagagagccttgtcaggcagggggcacttactctgggaagtcagagtggcagtgggagcagtccccagcactaacaggtacacccacaagatctgcctcctacacgtcacttctacctctttgttccccttcctgactcacttcctgccagtgatttgtgacattttcgtagctgatcaaatgagcccctgacacctgattgccgagtgcttcttgtttacagtgctttccaaggacacctagacaagatggaaagcttaacgtgaagtaattaaatttgcactgctctgtgacaggactctaaggacttttcttccccccccctcatatatgaatctcatgtagagctcctaccgtctttgaccatacaacatctaaaaaagggaggatgtggacaggtaacaaacattggttcagtctactgcctgtcattatcatgataaatattaaataagatcatgatatccctttcttatttggctttctactctttacctacttgttttgccagattggtactgattttcaacataagaactgtagcttggaggtgatttaaaaagatatttttaaaggaaacaaatattgccaaacaatctggtttggtttaacaccctttggattgtacatttctcaaaatgcttatgaataattcagcaaagccaaatgcaatctgctggtggtatctagtgttatcacacttgctaatgaataattccctttggcttttatagggcggctctaaggaatgactctgagactcagatgagttattattgggctatttgtcagtgtccttggggcattgcgagcaaagcccaacttggctacccactccacataccttctgcaattcttctgggaaacatgcactctctctgtcccagctttttagccccagaacgttgctatgaaagagactctaacagaaaggaaataaaaatgacagaattcagctccactgtgattgcattggttcagttccttcatgtttcattcatataaagaaatgtttattgagcaccttaaaagcattgtatgtccacaaaataagatagatttttatgtgcaatgtcctcaaataaactagaaagtgtagggtgtatagagaggcataggatcccagaggaggatggtcagggtcttttgtcaaagtgatcagttaccttttctcatcatgttctcaggtatgcacttaaatgcatatttgccatttgtggtgttggtgagggttccgttgctttggataaacctaagatttgactaatcttgaaactgcttaaagataagccctataatgtgatcccagatatgactaagtggccgttgttcatttctgttgcttgaagtcaggaatgtggtatgacctggctttaccagcctgggcaatctaaggatggtgacgtggatttatttatgcttgggtggtctatatacttataccttagcaatcatactgcatatgtataaccctgaggtcagtgagtgcattcagccttggtgaggttgtttctggcagccgtatccatttcagttttctctatgcaactcctaagttttcctctagaggagtgtaatctcctctgagcacactggaagattacagttcccagcttccttgcagttaggtaggatcatggattagttctagccaatgatgtggaagtgatgggtattatttcctggtcaagacattagagctagtgtgccacttgcattctttccctttccctgccacagtgactttgggggccttggtttcagatggtggggtctccattgggctgatccaggaaggactgagtggagtagagtcattcccttcccccatcaacatattagacaggtaacttgagcaagacaaagacctttgttcattaagtccctgagatttgggggtttatttattaccacagtgtagcctggaccattgtactaatatagagggattagtacaggaatagctgtgtgcttgttattcaacatgatttagcagctttagagaatgtagtttcttttttttaaatcattttttattgtaaattgccaaatatagttgtaaatattatgggatgcaaagtgatgttataatttatgaaaacaatgtggaaaattaacatatatatcaggtcaaatacttaccattcctttgtggttagaacattttaaagaactcttggtgattttgaaatatataatatgttattatttactatattcatcacactgagtatatctaaagtagaaaaaacctcccaaacttactcctcctgtctaattgaggcttttaccttttggccatcatctccccaatcttctaacactcctagccttgggtacccaccatctattctttgcttctttgagttcagttgtttttgattccacatgtaagtgagaatatgcgtatttgtccttctgtacctggcttatttcacttagcataatgttctctcattccatccatgttgctgcaaatgacaaaatttctttctttttaaaggctgagtggtatttacgggcttgtatatatgtcacattttctttgtccattcatctgttgatgaacactttggttgattcataagttgaatagtgcatagtgctgcagtgaacatgggagtgcagacatctctttgacaaccaatttcaagtatcctgggtaaatatccagaagtgaaattgctggatcatatggtaatctattgttagtttttttgagaactccataattgctgtactgattcacattcccaccaaagattgcaggggttcccttttctcaacatcctcactaaaacttatttttatctctttgaagtagtccttctggctggtgtgaggggatatctcattgtggttttaatttgcatttcttaatgattagtaatgttgagcatttttttcatgtatctggtggccatttgtcttcttttggaaatgtctattcaggtaccttccccattttttaactgggttattaaatttttaatgtaaagtatttgagtttagatattaatcagatgtatagcttataaatgttttctcccaatcttaggttgtctcttcacttttttaattgtttcctttcttgtgcagaagctttttattttgtgtaatcccatttgtctattttgcttttgttgcctttgtttttaggggtcagatataaaataattgctcagacgaatgtcctgtagtttatctactatgttgtcttctagtagttttgagtttcaggtcttatgtttaagtctgtagtccatttgagttgattttagtatatggtgtagataagggttcaattttattcttttgcatatggatatccagttttctcaacaccgtttttgaagtgactgtcctttccccaaagtatatacttggcacgtttgtcaaacccacatactgcatgggttcatttctgggctctattctgttcattggttgatgagcccatttttcactgtaccatgctgttttaattactattgctttgtaatatggttggaaataaggtagtgtgagcctccagctttgttctttttgtgcatgattatcttggatattcagggttttttcttgttgtgtggttccatatgaattttaggattatattttctatttgtatgaaaaatgacattgaatgttgatagggattgaattgaatgtgtagattgctttgggtagtatggacattttaaaatattaattcttctagtctatgacatgggatatcatttacttagttgtatcatcttcatatctttcattaatgttttattgttttcagtgtataggtcttttacctccttggtattaatttattcctaagtattattttttcacaactcactcttcatagaactattttttatagcattttatttatttatttatttagagacagagtctttctctgtcacccaggcaggagtgcgtgatgtgatcttggctcactgcagcttccacctcctaggttcaagcaattctcgtgcccagcctcctgagtagctgggcctacaggtgtgcaccaccatgcctggctaattttttgttatttagtacagacagggtatcgccatgttggccaggctggtcttgaactcctgacgtcggtgatccacccaccttggctgggattacaggtgtgagccactgtgcctggcctgtagcattttattttattattttattttatttttttgaaacggattcttgctctgttgcccaggtggagtgcagtggtgcgatttcagcttactgcaacctccgtctcctgagttccagcaatctccagcctcagcctccccagtagctgggactacaggtacatgccaccgtgcccggccacttttttgtatttttagtagagacgaggtttcaccatgtgggccaggctggtctcaaaccctgacctcaggtgatccacccgcctcggcttcccaaagtgctgggattacaggcatgaccaccgtgcccagccttgtagctattttaaatgggattgttttcttgatttcttttttaatagttcactgttagcatatagaaagactactgatttttgtgtgttgattttgtatcctcagcttaattgtattcatttattagttctaacagtattttggtggaatttgtagggttttaatatgtagtgtaagagcatatcatcagcaaacagcaatagttttacttcttcctttctatttggatgctttttttctctttttcttgcctgattgctctggcaatactctaatacttattccacttctgtactgaatagaagtggcaagagtgggtatctttgtcttattctgaacttggaggaaaagattttaattctttttttcttttttttttttttgagacgaagtcttcctctgtggcccacgcgggagtgcagtggcgcaatctcgggtcactgcaagctccgcctccgggttcatgccattctcctgcctcagcctcccgagtagctgggactacaggcgcccgcatcacgcccggccaatttttttgtatttttagtagagacggggtttcaccgtgttagccggatggtctcgatctcctgacctcgtgatccgcccgcctcggcctcccaaagtgctgggtcacaagcgtgagccactgcgcccggccaagattttaattctttaccattgagtataatgtagctgtgggcttatgtatggcctttattgtgttgaggcacattccttttatacctaagtattgagtgtttttatcatgagaggatattgaattctctcaaatgctttttctgcatcaatgagatgaccatctggtttttgtccttcatgtagaatgtaatttcaattgggaatcaatggcagatctaatttaggggcagaaagagagtttgtttcatcagttatcaaagaatcttgcaagaaataacattggtgaaaacagagtcatggaagtaaaagaataagtagtaagaaagacagagttgaattgaggctatcataactgatattaatgaattttaaattgcatttggatgtttaattggtaagattatgaacctgtaatttttctctttgcttataacttatatcaagtctggcccttgagctaagaatggcttttttctttttctttttcttttcttttctttttttttgaggcagagtctcactctgtttcccaggctggagtgcagtggtgcgatcttggccactgcaacctctgcctcccaggttcaagcaattctcctgcctcagcctcctgagtaacgggattacaggtgcacgccaccacacctggcgaattttttgtatttttagtagagatgggttttgccatgttggtcaggctgttctcaaactcctgacctcaggtcatctgccctcctggcctcccaaagtgctgggattacaggcatgagccactgtgctcggccaataatggctttaaatttttaaaagattataaagaaaaacaaagaagaagaagaatatttaataggggcctatgtggcctgcaaagcctgaaatgttactagttagtcctttacagaagaagtttgctgccttggtaagtttgcttaccatctctacaaactattatcaaaaaggatcacacttaaccaaatgtgagttcctggagaattgggaactcattgcttttattaatctctgtgtctttcatctagcatggtacatggcaacacagtagaagatcacagcaattttacttgattgaattgacacagaacatgggcaatatggaagacagtttagaggatgaaaaccaaaaacaaattacaaggttgtaggtctaaagaaatagaactgttcttcctctgtgcttgtgggtggtgacatcctggtttgtttaaacctaagtatggacgtttatttaattttcatattcatcttcaaataaaggaaggttttaaaacagatgtgtccaatcttttggcttccctgggccacaatggaaaattgtcctgggccacacataaaatacactaacactggtcaggagtggtggctcacaccgtaatcccagcactttgggaggccaaggcgagagatcacttgagctcaggagttcgagacagcccaggcaacatagtgagaccctctctctattaaaaaaaaatttaccatcctggctacacggtgaaaccccgtctctactaaaaatacaaaaaattagccgggcgtggtggccgggcctgtagtcccagctatttgggaggctgaggcaggagaatggcatgaacccgggaggcaagcttgcagtgagctgagatcatgccactgcactccagcctgggctacagagcgagacccatctcaaaaaaaaaaatttaaaaagaatgaagtattggcacatgctacaccatggacaatgttgaaaacattattctaagtgaaagccagatatggaagactaatattatatggttcatttatataaaatgtctataacaggcaaatctatgaagatgggaagtaggtgagtgatgcccaggggtggggtgagaatcaggagtgagggctgatcggtgcaggggtttctttttgagtgataacaaagttctaaacttagaatatggtgattgttgaacaactctgtggatatataaaaaccattgaatcatatactataagttggtgaattttatgttacgtgaattacatccaaagatactaacaaaaataatgatgcagtggattgcctatttcctagtgatgttgctgttatttttctctctgattcaagctgcagtcaggatttgaatcgcttacattttaccttctgaagtaagatcttctaaaaacaaaattgacttatagtcaaatcctctttgacccagcttgttctacttacatgaatttgctccattttttgtactggcacatgggcacaaagacatagtataagaatattcattgtggcattatttgtagtggcagaacacgagcaatctaagtatcatcagtagggaacagtttaaatacattaagggagatgaagctagtgaagatgaaactgcttcaagacaattaaaagaacaaggtgtagaatactgttactatttgtgtaaaatgcttcatatagacagaatatgttgtaaagattcaacagtggctacctctttgggaggcaaagatgggctgatctagtaataggagagggacagcctattgcagggttgcactttaaaaaaaattatactttcttttcatggaagcattattcataattaaaaagtggaaccaatgcaaatgccaccagctgatgaatggataaaccaaatatggtatagccatccagtcacgtaagtaggtcaaaggggatttgaatataaatcaatttcattttgaggaaatcttaattcaaaagggtgtgctcaaatattatctttaaaattaaaaaagttgactcctagactatatctcagcaataatcttgcatatctttttgcatacttcttttcaatccatatggaataatttgtcttaagctcatcccttcaattcaccctccaaccactaatgatgcagcaattatgtggttccactgaattttaacactgtcttctaacccagctgtgtggcagcagtgtatctgcagggcaagaagtggcttgcaagggtcaatatcacactgcccacaattattttaatgtctcctctgaaatataaatgaactttatagttataataaaaagtaaacccattccccctaaggtataaaggggtacaatttacatagtcagatatgactgcctttttttttttttttaaagaatccttcgtgagggctttaaaaaaaaacagggttagggataggaataggtggctcatgcctgtagttcagcactttgggaggctgaggcaagtggatcacttgagcccaggagtttgagaccagcctggcaacatggtgaaaccttgtctctacaaaatatttgctgtgcatgatggcgtgcacattagtcccagctactcaggaggctgaggtgggaggatcacctgagcctagggagttgaggtgcagtgagccgtgatcgcatcactgcattccagcatgggcaacagagagagaccctgttcaaaaaaaaaaaaaaaacaaaacaaaacaaaatgcaaaaccagaaaaaccagggatggttttcagtgtgggcatttatttgatccagcccaataaacatgattaaaatatgaaaatgtataggatttatagctgctcctctaggaacttacactttttttttttttgctgttgttgcataattggaagaaattcttccaagttttgcatctgcattgcttgtcttataacactaattcatgtaacttacaaaatatttgctggaagttttcctggccctaggaggacccataattataactcctgctttttattatttggtgccacttgtggctcgtgtccttcctaattattcaaatcctctagcctgcccccacattcactcagtaagactgccaccttgagacatgagcgttggtgtttgcagtatttaacatagcatctactaccatcatttagctatctctgacaagagctcattgggccctcttgcaccatttcctcagctgggaagtgtgggattgtagaagcgcttcccttctccccacatctgaagctttgtcctatcacatgaagctaggatttccacgtttctttctagctgcaggagaactggctgctcaggggtgctgcgttttctaccttctgaccacagccagaggcagctcccactgcactttttcatttgcattagatggcactttgcttatacaattgacgtctccatttaatttttatatcttgcctgtatcgttagagaacggggttggaggtgttcatgacttatagaagccccacagttagcccttttatgatccctcttttactaggccctatttacaaattttgtaaatttagatggcttcttattaaatgatgtaaaccatccatttgtactgttaaagctgtcatgaatggtatggcatttttgagtcaggccgtccatagcacagctgaagcacactgaggcccagagagtttattggcttcttcaagattacaagctacttaattacagagctgaatttggaatttagaattccaggtccagaactttttccaaaactgaactgaagtaaaagctccaggctgggcgcggtggctcacgcctgtaatcccagactttgggaggctaaggtgggtggattacttgagcttaggagttcaagatcagtctggcaacctggcgaaaccccatctctactaaaaatgcaaaaattggccgggcacggtggcggagcctataatcccagctattcgggaggctgagtcaggagaatcacttgaacccggaaggtgcagttgcagtgagctgagatcgcaccactgcactccagcctggatgacagagcgagactcgtctcaaaaaaaaaagctccatgataccttgaatttaagggaaaattaatggtgagtaggaaaggcatgatacacaatgcaccaaacaacactccatgaaaatacctcaacaacgagtactttggaaagagatgacgctgaggtatttaaaattttatttactttcatgattatcaagaagtaacaaatctttttttagattatttctgatagtctttacatgttcttccaggtcttctgtagcaacttaacagatcgtatgacaatatgctgatagtgattcttccttttgaaacggtattagagaagacagacagtgctaggacaactgtacaaacaccatttctcatcgtataggcaagccagaagccacatgtttcctagggaaaagggctgacctgttaccattgcagttgtgtgtaaaacatgtgttagaagaagtaattatgtttagctgactgactatgaccagattaatagctcttgaaagggctgtaatgaaaggctgccccaactggcttccacattatctttatttatcccgctctcatccctgtcacctttgggcaccagccaaatgtcatttattgagatttgccccttggatgtgaaaggcctctctttcttaatgatgggaggcgattgggtgcagggctggagagcttggacggttgacatgacccagaggagatgctccaggtctgtggagtcagaggcctaggactctccctcctgagggagaaagaacatgaggatattcagctgctgatcccgtccattgaggtgtacttgagggattacagggagtacttcaaacactctgtgtcaagtccatatatttcggtggctcttcagtttggagcacttggaagtttcttattttaagaccatttgtttgaatgaaatcatcaatcatttctagtttcgtaaaacttggaagtcccttgtggtagagactgcacagatcccttcttgcttctttgagtcatggacttttcaggtggactgctgcccaaaatgcagattgcatttccccagcctcccctgcaacggggtgtggcatgtgactgagagaaggtgtactatgggagtctctgaggtgtttctttaagagaaagcggtgtatgccctttgccctttgcttcttaggcccttgcttctgtcccgctgcctggaattacatgctggacttggatcttgaaggtgaagcccaagccttatgggctaaaaggggccggcctctgagaacttcaggagaaccactgtcccagcctggttaagccactgttattttggttttttgtcacttgtaggcaaatctaaacttagataatacactgtttctacacttgcagagatgaaaacgccaaacccttggattgccttttcccttcctaagtattaatatcaaaactaaacaggttcctttccccttctttcaactcctctaaattaaaacaacctacaaaaagacatgcagtaatttatttaaaaactaaagacatgagagagatctcagtaagagagatatagagagggagattaacaagaaggctagaaaggaaaataacacatttaggaaaatgataacaggactggtcttcatggccttctgtaataggtcagggagctctcactcccttccagtgtggtggcagcaacagcttcttttcttagattattagaggccctagggattcgatttcaccgctttgttaaggccataggaagctttttaaaatttcagatttcaaatgtcaagtctctatcagtgcttttgggccccttgcatcagagtgtttatattttgcctgactctttggtttcggccataaagtttgcatgttgtcatcttttctctaacattatgtgtattagataacatgactacaatagctatagtgggttacaaaagattcttaacacaacccttttaaaagagttgagagatgcgtaattatttttcatgattttcaaaacttttgaaagagaaaagcagctgttggttcactgttctcattagcatttatatagtaaactaagagagaggttttctgtgcagttttttccttgctgtttcttgccttttaatttgaagaatagcaggatcttgtcttttgttacatgagtagaagtccattcagctggaaaaagaacagtgcactctttgtgtactcagagatttgaatgcttttggtcacacactagttgctgtttaactacaataaaattgtgaccaaggagataaacatttaaaggataaatgacaggcctgttaatctgaaagcaagttttgtaggttgttgtttttagctaataggtgtatagccaggagtcacggtgatgacttttaaatctaaactgagtgaagtctgtgttttcaaccagtttaaaaaatgttgccactggacctttttaaaaaatatttttaaaaatacgacaaaaattttatgtatttatggtatatactatgatatttgacatgtatacattgtagaatggctagatcaacctaattaacatatgcattatctccatacttttttgtggtgagaacacttaaaatctactttcttagcaattttcaagtatatatacattgttattaactgtagtcaccatgttgtacaagagatctcttgaacatcactgacatatttatggctgatcattttgtgttttaacaatcatttgaacatgtctaaactgtcttagaaactggtagggatttccttgctgtgtttgctaagcttggccatgtcatccacataatatctgaatatattcatatatgaatacatactgtatataatatgtgtgtatatatgaaacataatacctatatttatatataatatgtgtgtatatatgaatacataatacctatattatatatataatatgtgcatatataaaatgcccaagtatattatctaagaaaagagccatggggcttttataagtctatgatttcagaactatgtccatctttacacctctaaagcgtatgatttacctgatttggtggaggaaaggtatttttggtaattttctgtccctatgggattcaaaggataaatttcaatctctttttctttctttctctctctgtccatcttatgcagtgaaaactggcatatgactctttgagaagagctcaaacagttgtggtaagggtgcttagtgttgagtgctatctgttttctggggtgtgaaacatacagggttttaccagtctgttgtgcagagtgctgggtgtattttgctttagctgactgttccgttggagtattcagcctttcttaggataacaaaaaataaaattaatcaaaggcataatcaaggacgttttccttttgtaagtcacatctcattatacaacattagtcttaagctttgcccacctgccagataggtgtagatgattaatgaaagctgaaactctcagtctagaggagacagcagggactggtggtgctgtggtgaagtaagaagtacatatgctgcctaaagggactctggttcagtgtgtgaatgtagcccagtgttgcaaatattctgacttttcaaaagaagcaggacatctagatttttattgaaatctctttattttaataagccatcgactaattgaaatttaaaacctgtgtagtccaatagaccatatctacaggctggaaggaatagagggcctgccttttgtgacctctgttgttggggaggttatgtaaccattgtaaccagggaaggatacatgaggattcctcttcagggagctgaccagcccaataaaaaatatataggttgacatttggagatatcttaaaagacggcaggtttccatcatatcgctctgtagtgaggcccaccagttgacaaactaagcttctgccattcagcttctgatctgtttcatattccctcactggaaattatgaactgatgggcaaaatcattgaacatccaggaatgcctcaaataggaatgacaaaatacagagcacagaaacaaagaaaaggaacccagaggaacaggaaaatgtggagagcagaaaacaatttcaaaacaattataattaatattcccagagagatgagagaaaatacacgaaacaggaacaagatgctataaaaaggaaccttcacactgttaattttgttagttgtgataatgtattgttatacattttaaaaatcttatacatttaaaaaaaagttgtccttagttattagagatttatgctaaaaattacaatttgaatattgtgatgtctgggatgtgatttgaaataattcagaaaaaaggtagagtcgtgtgggagatagataaaatgagattggcaaaatgttggtaattgttgaagctgctgcgtaatgggcgcataggggttcattatattattatttgtacttttgtgtgtttgaattttccattatacaaccttaaagaaaggatcatttagaaagcaagaaagagcttgcaattgaaaatatgatagcagaaattaaattttcaacagaagtattagaaaatacagttgagacatttgtccagaaattagcccaaaacaaagcaatggaaagtaagaaaggaaaaatataaattagaggatcagtccaggtggtccagtatttaactctgggagttacagaatgagaacaaaatatcagaaggaaagagattatcaaagaaataatacaggctgggcacagtggctctgcctgtaatcccagcactttgggaggcccaggcaggaggatcagctgaggtcaagagtcgagaccagcctggccaacatggcaaaaccccatctctattaaaagtacaaaaattagcgggcatggtggtgggcacctgtaatcccagctgcttgggaggctgaggcaggagaatcattgaacccaggaggtggaggctgcagtgagccgagatcgtgccactgcactccagcctggtgaccgaaaaagactcctctcaaaaaaaaaaaaaaaaaaaaaaagaaaaaagaaataaacagggtcatttccttgacctaaaagacatgagtttccagatcaaaagagcccagtgacgcccagcacaacagatgaaaaatgatcccactatggcattttatcatgaaatttcctaacccagaggaaaagagaagattctaagagctctcatttgcatcctgagctggtctaggatcagggtttccttgggccaatgcttcagatagttaaactcatcttttgcttggtcagggagtggtggttgcctggctgttgggattgagagaaagaatctagggtctaacctctgctctgacttccaactagtcttcctgttttcagcttcatggttgaaatgcaccttccttcagaattcctggttattgtattcctgagcctttctgtagatggtggcatgggagctcacttcttttggtcttccccttttctccctcaatcctgtctaccagttagtcttcagctttggtgtggtgtgtgtgtgtgtgtgtgtgtgtgtgtgtgtgtgtgtgtgtgtgtgtgttttttggagcagggtctcactttgtcacccaggctggtgcagtggtgcgatcttgggtcactgcagcctgacctctgaggttcaaaatcctcctgcctcagcctcccaaatagctgggactacaggttgtaccaccatgcccagctgatttttgtattttttgtagggatggggttttgccatgttcccaggttggtctcaaactcctggactcaagccgtctgcccgcactggcctcccaaagtctgggattacaggcgtgagccaccacacctggctttaggattcaggttttgctgttacatacttgccattcctttttcatcttttaacatctctcatctgcttgctttctttttttttttttttttttcctgagactgagtctggctctgttgcccagactggagtgtagtggcatgtctcagctcactgcaacctccgcctcccaggttcaagcgattctcctgcctcagcctccaaatagctaggattacaggtatgcaccgctatgcccagctagtttttgtatttttagtaagacagggtttcaccatgttggccaggctggtctgaaactcctgacctcaagtgatccactgccttggcctcccaaagtgctgggattacaggcgtgagccactgcgcctcatctgctttatctttcacattgactttgacgatttatttttattgttgttattgttgtctccttttttttttcttttcttttctttcctttctttccctttccctttccttctcccttcctccctcctcccttcctttcttccttcctcggttccttttcttccttttctttcttttcttttttctggagacagggtcttgctctgttgcccagtctggtgtgcagtggcacaatcatagctcctgcagcataaaactcctgggctgaagggatcctcctgcctcagcttcccaagtaactggacatcaggcgcacaccaccacacccagctcattttttttttttcagttttgtagagatgcaccttattatgtttcccaggcttgtttccaactcctgggctcaagagattctcccacttggcctcccaaagtgctgggattgcaggtgtgaaccactgcacccagtatattgttttatttctttacaggcgttccagtgaggttttgggaaggagccaagtgcatgttttgaatcaccatgttagaatggaagttaatttgttgtgttaatcattaatttgtatgtcagagtttttttcctgaggtttatttgaaaatcaacgtaagaaaacaaaatttaatatggagaaaatatttcctccttcttaaagtctcctttgactatcctcacggaaattggtttgtttctacttctctgaaatactgtggccctgggagactcctgctcagtttagcaaagaattctctactttttgggtcttaatctaagcactggatgtgtgcttttcacccaactagattatggagtcctgtgaacctagggagatatcttagtctgctcattgattaccttacggctccttatggaatgaattgaataaatactttgctgatcaaagtatactactcaaatttgtattactttattttatatgtgttatatgtgattcttttaatgccttctcagcctgttgctcagagattaggggaaggaataaatgtaacaagtagactttgggggtaatactgataagttaaaaatgtcttggtttatagcttcaagggtattttactgaaattgcaaatgttctattatatttagaagagaaggaatggaaacctgactagtcattatactgaggttgggaaatctggaacttgagtctgaatcagttttctgtagatagcctgtttcacagtggatttgcttaatgttttaccgtaaacaggcactcctgtttattttcagctcttgcctttcagcacaggatagctacaattttcagagtatgcctctcttgtataaataacaatactgtcattttctctaaagtcatccttttattaaagaaaccctttaatagtcccacatattctgtagttatgcatttctgtgagtcttactgaccccagcacagtgtttaataaattattgaactttgaagaacctttgagaagaagggctttatgtgactgagcagcagacatgaaaaaacgttatcctccagagtatctaaagacagaaatagaggcttgatcagacaatataagcaccgagtgaatgatggtaataccagaaatatttacacccatagagcatgcgagggtggggaggagagtgtgggtttttatcctttgggttgaacctgatgccatacaactcaccactctatgatcttaaaagcaaaacagaagagaatgagagaaagaaaggaagaaaggaaaaggaaaataaagaaatgatgaatattgattggtgatattttgttgtttgcattatcttatcacaaaagcaaggctccttttgtagacggaaccttactaagagtcaagttttaatcagtccttaacagaaactgaagatatctgaatgatttcttgccactacaagtttaaagttttaatttaatcaatatctcatgatttaccagcctcaaaagctgtcattttattatctgtaataaatagagatttgaagagtaaagaactaatatagcctgatacgatcttacttttaaacagaagatgcaatttatttattttttcatggatgctattttaaagtgacttgtgatttctttaataatgatccacagagaaaattaactaaaggaagaagtgtctaattatttaggaaaggtttggaagatgtttatcccggctaattagatagagagtgtctaatatcttacagcatagaaaggggctaaaacaaatgtgccaacaatttgttttgcccctgtgcccagtattttatatatccatttttttaaataaggatgaacttttaagatttcatggtgtcatctaacattattaaaagtaattattgttgatgataaaaaaggttgacaatgatgtgctttattgaatttaattttactcgtggtttattttaaaaaccgcagattgtgtttgggagatattttaatgtagtatgtctgttttttgctttctagtttggaagaaagaatcaaattatgtattaataaggaggctcagattgaccatagacattggctttcaaggggatcatctggttttagaggctttagtctcctttgagtaccctggatgttgctatgtattatgctaaactaacgcatgattacattgaccctatgattatagtgacctaattggcaagtttctgtcacttataaagtcaaggtagtaatgttggaagggaaactgtaggagactctcctttgcaactgtaatgttttgtctgtagattgcaaatgagggaattttataaggctttattatttgtaatgtaggaacccattgcatacaaagaaatttttagtctaagacccagtattagtgaaatgtgacatagatctatttgtgaaagggtgtacccagttgaaaagcaggggcaagattttatttgtatgtttattatttttgttaccaaagcgatgccctggaagaatcgggatttttgagtgagtgatgtgatgtggatttaaatcctgtctttgccactagttctttcacttccagcaagtcctgaacctaagactcaattttttctctcaaaatgggctcatgatgatttacttcgcagatttgttaaagcttgtaagcattcagcacggcacccaagtgtgggaggcactcaatgaatattagctcctttctccttccttttcagctaaaccaaaaggctttatctaggaggtgagacttgtagaaactcttgattgatggaaggaatgagtcgtgaactagaagaagggtattcgaggcctgtggataaccatgtgagaaggtgagaagtggtgtgtagtgatgggagagtgtggctggacagatggacagataaagaaaagagggtgtgctgggcgcggtggctcatgcctgtaatcccagcactttgggaggccgaggcgggcggatactaggtcaggagatcaaaaccatcctggctaacatggtgaaaccccatctctactaaaatacaaaaaaaaaaaaaaaagaaaagaggggctgaattaactgacttgtagaggcaaattgatattggtgttgggacacatcatctgaacttccactgtcattatctgcttctcaaaatggagttgagagcatgtgcgaacttgagaatttattcttcttgtctacttgaacatctccttttaaaaaatgcaaaatgttagaaatgtttgatccaatatagggcaaataaaaattgtctgttctttttttttaaatttttttttgagacacagtttcactgtagcccaggctggatacagtggcatgatcttggttcactgcaacctctgcctccagggttcaagcaattcttggcctcagcctcccgaatagctgggattacaggcgcatgtcaccatgcctggctaattttgtatttttagtagagacagggtttcaccatgttggccaggctggtctcgatttcctgactcaaatgatctgcccgcttcggcctcccaaagtgctgggattacaggcatgagccaccagcccaacctgtctgttgttaaattctacctctgatcgtaatacttcgatggagaatacatgctattacttttagcatgatgggtaccaatatgagatttccagttgcttcccgcatgtcattttgcagattttaactgaggcttatatatgctcagggctgtactgtactctggggatcagtagtaacagacgagagtccctcttctcatggagattaatattctattagaggaagatgctagtaaataagtaaacagtggctgggcatggtggctcatgcctgtaatcctagcatttggaaggccaaggcaggtggatcacctgaggtcaggagttcgagaccagcctgggcatatggtgaaacccggtctactaaaaatacaaaaattagctgggggtggtggcaggtgccgtaatcccagctactcgggaggctgaagcaggagaatcgcttgatcctgggaggcagagttgcagtgagccgagagatcacgccattgcactccagcctgggcaacaagagcgaaactcgtctcaaaaaaaaaaaaaaagaaagtaaacatatttaaggtcgtaaataaggccatgttaatagtgataaacagtatgttgtgttaatgactgaggggaggggactgctttagatacgtggtctgaggtcacctttgatgtgaactccaaaggatgacaagggcatacatttcagctcagagacaaagctctgaggtgctaaagagcttagcatgtagaaggaacagaggtggtcgtggccagaacttaaagagaaggaaacgaaagggcaaaggaatgaggccagatcatgaggtagggactttagactgcggtagatttcgattttattccaagtcccattggaaatcactgagtgttttaaggtagggagcgtgtgtgtggagtgacttactctgatttgatttctataagatcactgtggctctgcgtgaggaatattggaaggccagagtagaattagggagaaatttgggaaaggaatgttctgatggcttggcccagttggtgactgtgcagatagactgaagggaaggatttaagatacattttgtaggcaaagctgccaggatttacttttagacagcatagaagtttgaaagaaaagaacaatcaaggaaaatttccaggcttttagcttgagtaactgattggttttgtttgcttgttgtttctttttggagatggggtctcactctgttgcccagccggagtgcagtggcgcgatcgtggctcactgcagccttgacctcccaggcttcagcgacctctcaccttagtctcctgagtagctgtgactacaggcgtacatcactactcctggctattttttcgttatccgtgaagatgcctcactgcattgcccaggctggtctccaactcctggctcaagtgatttacccatttcagtgctccaaagtgctgggattacaggtgtgagccttgccctggcctgagcaactagattgtgaccatttactgagataagaaaactgaggacgagcaggtctggggtgaatcaggtgctatccctttggacagtcacatgactggtgtctgttagcacccaagggaccatcaaagaggctgttgtggagagggaatccgaaggtcagggccaagatagaaatctggggagtcatccactatataggtgatgggttaaagccttagaactctcttttcatgaatcattgttgttctttaggttgtaatgaagttttaggcctcagcttcccgaactggagtgtttttccttcaccttttccggtctctgggttgcatcgccagactgtcttaagcccaacaaacgcgttccttccaggcaaaagcaggagatgacacacaccatgagccgattttccatggcagacttgtaaggaacaagataatctcattgttcctcctgctacttaaataaaggtaatattgattttatagtagcagttcaggtcctaaggcatgatattgattagtgtctgatgagaatttgtagggtagtctcccagacctgcagctacagggcatctccccctgggccaggcctctgtgctgacctccactgttataagtggtgtttttcttaggaatcctagccctgtttagtctacgcactgtccagaagcatttatttaacctgatggatggctcatccaacccatcaccttaatctgaccttaaagatgggaacctaatgtttttgttcttagtaatgtgaagactaattttgacactgtttagaattattttcttattagtagcagtagattcatgaattttctgctgtgaaatttcctattaaaatactataatctaatgttaaatgacggttaatgggtgcagcacaccagcatggcacatgtatacatatgtaactaacctgcacgtgtgcacatgtaccctaaaacttaaagtataataaaaaaaataaaaaataaataaaatacataatctgacttttttatttttacttttttactttggagcctggctttatgaatttttttttaaacaggggaaggtacctcttttcaaggtgtcattattaagcccatgggactcttcattttaatgttatatcaaagagagtaaatttcttgtgattattgtgatatgatgcattcacttgcaggtcaggttttatatcatttatagatcagattctgaagatatcttcagtcaatttaataacaatcaaggaatatattattcaccggcctgaagtatagaaagagttcccagaatcatctaaaaataactgtttcatataaaacattttgactttctattgtaataagattatatatttttctcccatgtctaattctggctggattgttcatggggttgatgtgaggatcagtgagttaatataggctaaggtgcataatataatgcctgacacatagtagatgctcatttatgttaactactgttagctgctttagcctgttgttaactgcaaactccttttacatacctagcacaggcctgggcacaagtatgatatttaagtagatgcttagtgactgattgagtctccaaacatttgggatttccttccacatttgccatagcacagcttgttttatgtctttctaaaatggtctaggtacctgacatcctttgatccttcatatggttacactcaaaagagccatatgaattttgaccatttgcacatctgcctgtctttttggttagctgccagataagctcaggttttaaatcctttgcagttaaaagagataataaatgttaacattcctagtaagtgcctggcacagaatgtgtaaatatcatttgattcggaaacatgactgctggtcaatcggcctccagggagacaaaactaaggggtggggttgtggctttttttgaggtaggggatgaatagatatttcttacccgagtagaagatgatgccgggggatctaatgcttcttttaatttcccttttgatgcacaaaggggcaactccgtgtagcaggaccttggtgggatggatagcagctttgtaagtggagaaatggcctctgtttagcttatgagcacagagtcattttggggtggtttatgagtcatctgaaatatgcatttaatctagatttgtggcctgcttggtgagctgctgcttttttatgatctcaagtgtcttgtccatgtcaaaacttgccttgttttttgtttactttgaatcagaaaaatgttcacaaccacccttggaattcctcctcaagtgtgctttggtcacatcacccctggctaccaccagtacatgactgtttattttggatgtcctttctgatgttcagctaatttaacccacaatgaagttaatccttgcttctttggaaaagtacgatttacttattagctgccttccagagacatttgcattttcatgaaagcgagtatataatacattgacttttggactcatctacccacatatgtggtgggcgccttttgaaagtcaggttcagagtaaatcagaactgtcttgagttagctgaagttctctttaaggttaacaataatgtatctatgacaaacatggggatgtggtattgcatattcgattatgtccatttatcttccttcttctgggtgagaggggagatgaaaatggagctaccttggagttcatgttttcacttgattctccgcatttatagcatactgattgaaagcatggctgccagaaccatattactgggcttgagtactagctctgtcacttactcattgtttaactttgggcggggtacttaattctctgtacctcagtttcataatctgtcaagtggggataattatggtaaccaccactgacattgttatgaagatcaaataagttaattcatgtaaaatatttagagcagaacttagtaatagcaactgcgatacaagtgttagatatcatttttattagggtttagtaattgcataataaaagagatgaaagtctaaattattaatcagggccatttatctatgagacactacaggattgtgtctagccctgtgggtttacattagttagggtaggttattgctgcaacgtacccaacttgatatgatttttgctgcaaaaatcatatcaaaatagtctataatggcttaaacaaataaaatgcatttcttgtttatgtaacagtaatgagtaggtaaacagggtggtaggacttttcctctctgtattcatttagggatctaagctgaaggaggctctgccatcttccacaaaggtttctaaggtcaccttaggttatctctattccagccagcaagaaggggaaaagagtgcagaaatgtgtttaggggttttttatgggccagacctggaagtggcactcatcactttgttcacattccattggccagaactcagcaggaagaggaggaaaacagctgccactcattcagccacagagtttttcaggggtctctaaaaatgtatgagacttgaaaaaaatgtattactccaaactccagacataaaattgcagaattgaaatgaataaatgtttaactaaatgctataaaatggagccttatatcagcttccaaagttgttacagtttgtatggaaaaaaatgaatttcttcctaacgaacctccttgcttctttccctgccttctctactatatttgaaaaattttgtaagttggaatttggaatttccaagaattcccaagtactatccagtgattgctagaaattataattagtcataaatgagtttctcaaggccaaataaattcaaacgaaaaatttctcaaattattttgcattgcagagaaaccttttaatgtgaaatatgaatacaatttatatgtttattttgatgttgagtgaggccttcaaaagtagcaggatcatggcctacagagtcttaacattcctattgtatgcagacacatttcaattgctttgaaaaggtgtatgttgaggtaactaaacacattttgcatttcaagctcagaaaatttcccctttagattcccttttttttctccttttattttctaataaaatatttactgctgtgatatccaagaacatgaatgtactgcattgaataacccaggtgcttggtctggtggatgccagtgccagagaagaaaaggccctattttttcagttatcatgtttgaaggcgaggctttggtctgccttctgagtcatcttggcttcttggatgatagatttcttaaattcttctattctcctaactcaaggcactttgaatgggtgtttgcgagacgttgtttgaaaaaccacttatcgtgatggatttttgttctctattttttgctctcttacacactttgctgttgtcctgccaattggaatttgatttgtaattacaaaagcaaactatccaggatggctctaaagggacttcgctataggttggggcttgatagagactttcgcgaaagggattggcaattaagaaatatagcaactgcttctgatgttaaacatttcaagcaactctgaaggtagaatgtggggaatctccagagaaggaaggaatagagagggaactaatatttatagttactcctatagtcatctccatctcagtacaggactcttcatccttccagttgttcagaccaaaaaccctggaaacatccttgacttcgtctttccattccacatttcacccatcagcaaattctgttgcatctgtcttcagaatatattcagatccaaccacttcttacaacgtctccttctgccatccttctccaagccactagcatcacctcctggatcatcgcaatttcttcctatctagtctccttgcttctttccttgcctttcctacatagcaatcaaagtttagtcttcaaaacacaacaaaacaaatctcttttctgttcaactcttttatgtttcctcaaaatgttatacgtagagttaccatataacccggcaattccctcctagttacccaagagaaatgacaatgtatgtccacacaaaacctgtacatgaatgtcacagcagcgttattcatgatagccaaaagtggaaaaaacccaaacgcccatcaatgataatgtacaattaaaatgtggcataaccatacaatggaatattatttgtcaataaaaagatgaagtactggtaccatgctataaaatggttgaactttgaaaccatatgctccgtaaaaaagccagtgacaaaaggccacatattacatgattccatgtacagaatagacaaatccatgagactggaaatagattagtgattgccaggagctggggagagaggaatggggagtgactctaatggatgcagggtttctttttcttttgtggtagtgaaaatgttctgaaattaagtatggtgacgattgcataactctatgaatatactttctggcttgtatacttttttgaagggaaaattgtgtggtatgttaacgatatctcaataaagctgctattacaacaaaaacaactctttggctttctttctgatctttttccctgaatcgtttctgacctcttcccctactcttttctctttctttttaacccacccagactggcccctattttgttcctctaacagggcaaggcttcctgccatgggcctttgtattttctcttctctctttttgtagaactttcttccccaggtatctgcgtggctggttcacttgcttcctttagctctctatttaaacatcctattccaggagactttctctgattacccgaaaatagtactccctacttcatggcctgctggcgtctctgtttctttcatcctgttttatttttctctgtatcatcaacatgtgatacactgtttcttgtttgttttttatctgtcttccaacattaaaatgtaaactccatgaggcagtaacaggctttgtttgtgactgtatctgcagtaatacataccacacctcttttcactagaccatagcttgaggaagacatggatttccttggcactggtgttgaattgggactaactgtattgcaggaggaatattcagtgtgtctattagatgctacattagaaatcatcagcttggaagagtctccatgggaaaagtaattttgattcaaagggtagaatggaactactcaggttacaggtcttttattgtcatataaatctttgtacagagttcctactttttaaaccattagcatatgctaatatacaaagtttgctacttttcatatttgtcttacagattcaaagcctttagtcttttcagtcttaatttaccacctgtctgctctctccttttctcccttggaatgttctaagatttaattttgaaggaactttctgtcagatgattattggtaaagtaaaatgtattttgggaagcagctgattacttgggcctttgatttatttatttatttttttttttgaggagtcatattgcgatatacctatttggtggttatttagaaaggccaaggtagggagaaaaagaaagaataaaatatatgtatgctttaaaaaaaagcaagcatttagtttggggagccctcaaatgtgatttcttctactcctgttttcctgcttccaagcataggtggaagatattgtcgtttctctgaactcctaagttgaaatgtgcaagtcactaggtggcactgaagtatcatttccacacagccacgccatagaacacttttgttatcttgctccagctgactggatttctagtgtcagggaaattgttttattggtacagggcatagtgtaatatattcctctccaccctggcagctacttaacgccctgaaacatgcacctcttgtggtcatggcctgttaactatgctatttggtgtaataattagcagaatttctcactaacaggggtacttaccaacacctcactcttcactgtgtttttgtacgtgatggattgtacattctgtggagaaagttgggaaggtaaagcttaacctctgcctaacaggactagttttcgcacatttgttcagaataggtttatttaactggcttttgagcttcttcagaccagaattgtgtgtaacgtaaacatatttgagctttatgtaaggacctagtgaaggtttgtaaacacaacactgttaattttccaactcataaatgacagaaaaataaatgaatagctgctggaataattggacgacacttgttactcagactgtgagtgttggaagcgtgtcataggaacagtgggcctgccacaagcaccacattttagttaaaatcggagaagaaaattacacatggaattttaattttttccatggtcgtaagttggccccatttaattctttgtggtttttacaagccctcttaggctcctaatatttctatacaacaatttcaacgtttattttagaatgtggtcagaattaaccgacagaagaccaaacagataaaataggtttaaagcaggaaatactttagctggaccactaacttaccctctatgacttaggcaaactgtttgccgtctctgtgctttgattctctcatttcttaaaatggagatataatacgcacccttgtgtgtctcctccaccaggtaaaagtgaaacaataacttctcaaatacctttgcttatattcaaagctccaggtaaatataagatgttgctataattacctaaaaagctaggaagatttttctttgttgattccaaggtgagttgtagaaattccagaagatgattaatgtagtctgagggctcagacttctgcatctgtgtagatagtacctattttcattactgtggcctggctctgtttctggcctggctctgtttccaaggtttaagttccattctttaactgtgtatcaactattttcacttggttgttctacttttacttaaaccctttatattgtctggatttagttgtaggaaacagaaactatgtgagatagggaaataggttgatataagtcatcaggaggaccagagaaatgggctgaaggtggagcctccagagatgggcttctgaacaatattacagattggcttgccagggtagccgctcatctgtcacactcgggaagggcaagaatcaggagtcattcctagaactgttgatttgtaagaacacacaaccatagttgtattgggatcaggaaggtaccaccattacaactggcatttgagaactacaaagtgaatggcagattctggaatgttattgcctcatgactatgttgcctgcagaaaaagttgaaacagcaggtgatggcctccattttatttttgacttctgattctcacatgccgccattaaattggtaagcttatttctcatccagaactcctagctgcaaaagggtctgagaaataatagtgtttccttttcatcctctgcaccataggaaggcacaataagaggagattggaagggtgctgaggccaccatatctacctcttcccccagcatgtttaaaataaaatatctttacctccaactatattgcattttctgtccagcacagcaactagcttagtgggccctcagtagatgtgttatgacattgacttccttatttcttatatggccccacctttcctagtcacgtgtcttggtatatgtgagatttcagatccacctgcctacctgtaactcttgattccttttcatttccatgctgtctccttgttcaggtccagctcctgtctgcctgggcttttgcagtagtctccttactggcttttggtttctttcaccgtaaccatattataagtagattggtgtttaaaaatcaaacaacaaataacaaacatccttccactgtgctcctgtccttctcaaaagctttctgagctcctcattacatgcaggatagaatccagactccttagcttgactttcaggaccttccaaatcagggtgcaatctatcattccaggcttatctttcattttccccctgctggaactgattttagccaaaaggtctaatcactgatgtcagagtgtcttgtcctttactaacttttcactctgctatccttttgcctgcttttaatagtctgttttctttctcatttgtttattccttgatcacttaggcacagagtttttttctcctttcttcatacttatagcatggtttactaggcattttaattttattacctatatcgttagttttctttttatgactatatactctccgtcctttttatgtcgacaatgtaaatatttgttgtggattgatttgttgatttttcatggttagacatctacttgcttgggaaaaaggggatggtggagggtcaatctgggggctgaagggtactctagctgtgtgattttgtctttttgattactactgaaattaactatttgctttagcaaactaatgctgagttttgtggatttagtgtttgaaaagggccctgagagggaaaacctggagttgagctccttatccccgtttgccaggctggatgagctccatgtccataccatgcattgcagtttgctgaagtgtgtgttgtgaaatagcaatggaatttgtctgtggtttttgccagcgaggaggaggaagaaggattctgagtaaatcagacatgtaaattagtaaggccatgggccttaagcgaattacacaataaagcccaaagaaattcactttggcttctttcgctttttgtgtgtgtgagaaggcagctattatgtgtttgctttaggccagaggttcacaattttttggcttcagaacccttttatactcctaaaaattgttgaggactcaaaaagctttgtttatatgggttaaacctatcaatatttactgtactgggaactaaaacaggaactttaaaagcctttattgatttaaaaatagcaaaaccccttcattacaagttaatgtaacatttttatgaaaaataactcttttccaatgtaaaaaattagcaagaagtgtgccattgttttcttttctgcacatctctttactgtctagcttgatgcttgattcttatacttttttgtttgttgttgaaatatgttgttttggttgaagtatatgaacaaaatctggcctcagacattatggaaaaagggagtattttaattgcttcttcagctattaaatgtagatattcttctttgtattattccaaaacttgtcaagtgatagcttctattttaaaacatttttgtttttaattacaataattatctatatttatggggcatgctgtgatgttccatgtacacattgtggcatattaaatcaagctaattaacatatctgtcaccacacatacttattatttctttgtggtggaatacttaaaatctactattttagcaaatttgaaatatacattactgtttactagtcacatgctgtgcaacagatcactagaacttaggtctcctgtcaaactgaattttttacccttgactaacatctcccctttctctgctctatcccaccaaactctggcaattactgttctgtctctacttctatgagtttgacttttttagattccatattttagggagatctgtacctgcttatttcacttagcataatgccctctagattcaagattcatccatgttgtcacagatgcagaatttccttttgtaaggctgaatattattccattttctttagacaagtgataatatttaaagcttacttgcagtgtggaatccgaagctatctcaattaacttttcttactttgtatattaaaatctgttgatctcttttgcactttgaatgcatcttttacattcaaatgatttgtaacattacgttttgatcatttggaaaattatcatgtcactgagttatacagatcttcaaatgttgatgcatttcattatacagtgtaaaaaaaggtcacactcatcagtatcaccctgatcttatacaagtttttaagtattgaaaagccccaagctcaaggtagcaaatacaattttctaaatttctgatttttcttgacaacctgaagtttatcattggcagcaaatatggcagttgtttttcttgaagtggcaagctcacttgattaattgttgagaaaaagtctgccaatactcaagtccgattaaccagaaaaatgtcagtcagctattttttcaagtaaaaatgggttccatggggcaaattcagcccagaactcaaatcacacatgtacttttgtttgagacaccattttactttagtatttatcagaagtactttatgtatgtttactattttgtcacacatatagtaaaaagatagctacttaaagctcaagatttaatagaattaataatttttcctgttcaccaaggacatgcttaagtgaaactaacttcctttttctttctcttttaaatggaagcatggtaaagaacatagcaactagtaagtttttgaggtctattaaaacagcctgctcatatagttaataataatgtatatttcaaaattgctaaaatggtagattttaaatgctttcccacaaagtatgtgaggtgatggataagttaattagcttgatttaatcattccacaatgatacaaatgtcaaaacatcacattgtactccataaatatgtattacttgtcaattaaaatagatgttaaaaaaactgaatactagtttagtttggtaccgctggcttgattagtgacaggcacctgcagttttacccagcattctttaaaccgtcagtggaaatgtccacacggtgaaaaagcaagtaatagtattattctgaaaatagtattgatcttgtggaacctttgccaattactgcactatgccaattaggaagatttgagtagctaaaaattccaagagtggaataatgttttattagttatatcttgaaggccaatttccttttttaccctggaacttaggctaaggaggcaacctggaggagaaaatttctctcctgtcctgagattgctgttagcccagggtcgaattcctggggcctgattttttgagtttaagaagcacagggaggatttttttttaaccgcctttggtgataataaatgtttaacctaaatcaatgtgattgtggatttttttttttttttgaattgttgtttctgttagaaaaataatgaatgacaagtgccgcagagatcagttgttgtgagatgactgagaaggtaataggacctcctatttgggacattaaggaaagccttcctaaaaaaagaacccattttgagcaacatgcgaaaattctttgagtcagttggcctcattgtaagcctttgattgctttatttgtttgtttgcttgcttgtttatttatttatatttgaaggcaatctttctgcttcctgactggctgtcagatctcccaaataacatcatccctttctggtgtgaatatagcctagacttgaggcagcaattaactgatcatgtaatagaagaatccaatcttccagtttctttttttaacttcttgggtggttggggcacatcattgcaacaatattacatttactcaagagtttgtcttttctattaaaaaaaaaattccatctaagtgcctacggtgaagaggaggagattgtgtaactggagtctccccttaactggtctttattgttaagaagagtgatccctttgtgtttcagcttggcacacagaaactgttttaatttaacagccagctcctttaatagatcaattctctattgtggtttgaatttggtgcactcccaatttctctaaacttctacgggcttccttggagaaactggggcagagatgccgaagactcatttgggtacaatttagagtttgtttatttatataaatgtaaggggtaccagtgcagttttgtacatggatatattgtgtagtggtaaagtctgggtcagcttttagtgtaactcatctgaaaatgcacattatatccattaatttatagttttatctcaaacctcttattaattaatgctgccatggaagctagctagcgcttgtaaatgcctgctgtgtgttagatgctctagtaggtttttagacaccctcatctaatcttcatggtgattttctgatatatcctgaacctgtacattttctccacttctgtcactactactacaggccaagccaccatcatttcttgcacagactctgcaccctcaatgtggcctccctacttcaagttttaacagtcttctccctctcataaccactttccagacataagttggatttattttaaaaatatatatcaagtgatgtcacctcctgcctataagactcttcagtgacttaatgacaaacagaatgagatccttctcctgctcggctgacaagaccagaacaacctgggttctatagctctgagagctcaccagccactctgccttgctcgttcactgtgctccagactcactggcttgctttctgtccctggaagccaccgactggttcttccttagggcctttgtaccagctgttcttcctgcttgggacactctctcccagatctttagtctgggcctggcttcttgtgatttgtgtcttgcctaaaatgacacccctcaatgtgccttccctgaccagctgagctacagcggtttccctctaccgcatcactagttttactttctttctttttgtttgagatggagttttgctcttgttgcccaggctggagtcagtggcatgatctgggctcactgtaaccacctcctgggttcaagcgattttcccaccttagagacggggttttgccatattggtcaggctggtcttgaactcctgacctcaggtgatcacccacctcggcctcccaaagtgctaggattacaggcaggagccactgagccaccacatcagcctagattttattttcattaaatcgcttgatgcagtgcagagtgagtttctgctatagactgtctggatttcaatcatggcctcgtcatttactggctgtgtgattttggagaattacttaacttttcaggactttcatcttcttctttataaaatggaaatattattatatcctccattgtaagaattgaataaggtagtacttagcatcttttatggtttctgacacatttacataatcaaaaaatgttaaatattgctattttaatgtaatgttattaaaatcattgctattttatagcttatttatttggctatttttctgtctcttctaccaggaatataagcttatgagggaaagaatcttatgtgtcacattcccaactgtgcccctagagcttagaacagtcttagcacatagtaggcattcactaaatctttgctgattattaaaatctgagatataatatccctatttttccaattgagtaatcagggttcagagaggtaaagtaacttacccaaggtacgcagctactaaatgctagtagttcctggtatttgtactgaatgctgattacaaagacatgttctttctgttatgccacaatacataagtggatctttatttcagattctgtcattatagcagatgattttcaggttgcctttttatgtaaatgtaacatgactcatgaaatgtaacagccatttgtgtgaacatgaaaggtcagagccaagagttaggccacaggcaagttagaaagtgagatatagcacacccaccacattcagtggtggaagaaaagttacctgattcctccttggagatgtgtagggtagtgaccttggggttgggctgcctgaggaggttcctatgcttgatttctgaatggacaggatccctaaagtcatcgaccctagtttgggctcttgtactcttctatcatcttattctagttggtggaggcagaggttgaaaaatcaaaatgttggctcttcagcctctaaaaagtaataggcttgaatttgcttttgtcactaacatgattatggtgttggtctgtgggggcttcactgatgcattctttttaacagccctgtttgtttgtttgttgtttgtttataagtgagcatagcacagaggaaaaaatataggttttggagactggcacacagggttcagatttctgctgtgctacttcttggctgtgttttggcacgtgaacttctctcacctcagtttctttgtttatgtaatggggattcatatgacaattaaagagagagcttgctaaagtgtcttatgtagtagtatccccagtttgacccttttgagaatctgatgacagtatggaaccctctccccagacaagtgcccgtatacccagaactttgtatttaatttcatgggttcatgaagcctctgaaactcagcttaagagtccataccaaccaaggtccttataggagagcttgtgtttttgttttgttttggctttctgcagtctcttaataatgtttattgaagagagaatttaactaatttccggtttccataatcactttaaactcggtatttgatttcctttccctgggacctgtgacagtgccagcttcatagcctagtctaggcatgccagttgccactgtggcaatcaatatctgagcctgtggtttttgccttaggtaaactgtagagatggatcatggaatgcttggaaaatttttcagtttatgataatgtgtaaatgtcgagagccaatattgaggaatggcacctcaaagtatttgggtactctagatcagacatgaccatcttggttgtgaaattttgctaatgcatctttcctaatagaatatacaatctcagggctagaaagtttagagatcatttaatttaattcctccagattgattaagtggtttgtccaaggtcattcactggtatagtggcagagctcaggctgtacaaatcaggtgagtattcttcagctcctcaaagccagtaacttccactcacttgtgtgtgtctgaaattcattaaaccttcgacacaaatgcagccattttaatgctgaatgatattcatcactgtctgaaatgggcttatttatgtagaatgtttattcctatctcttcctccattctcccaaaatgtaaaccccataagaacaggatcttgtctgtcttagtcacactcagtatccttagagccttgtgtgtagtaggtgtgtatgaattttggttgaatgagtggcagttctaataatgtcagaagaattggaatttctttaagaaatctttatcagtaatttaacaaacatcgattgaacctattatgtatcaggcactaaccaggcacaggtacgaatgagatatggtgctcagcttcaaggagttacagtctaaatacaaaataacagaatcaagagcagcagactaaattgggcccactgtattttttaaaaattaatttgactgctgggtgcggtggctcactcctgtaatcccagcacttcgggagcctgagtgggtgaatcatgaggtcaggagtccgagaccaacccggccaagttggtgaaacactgttctactaaaaaaaaatacaggccaggtgtggtggctcacgcctataatcccagcgctttggaggccgaggcgggcgggtcacgaggagatcgaggccatcctggctaacacggtgaaacccgtctctactaaaaatacaaaaaattagccagggcgtggtggcgggcgcctgtagtccagctactcgagaggctgaggcaagagaatggcgtgaacccgggaggcggagcttgcaggaaacgaggttgcgccacggcactccagcctgggtgacagagcaagactccataaaaaaaaaaaaaaaaaaaaaagtaaaagaaaattagccgggcgtggtggcacgtgcctataatccagctactcgggaggctgaggcaggagaatcacttgaacccgaaaggtggaggttgcaggagctgagatcgcgccactgcactccggcctgggtgacagagtgagactttgtctcggaaaaaaaaaaattaatttgaatgcatgctccattatatcctatgtcttttaccttcctgcttgctcatttaactgcctgatttctgatgacatttaagttcaggtcttaggttctgtagtcagtggtttctaaacctggttgatcatcacctcacctcactggccttagaaacaatacgaccctacttctggagattctaaaccagggctgagatgggcccttggaaactgtattgaaaacagtaactctatagtcacttacaatgagcagccaaatctagctagatgcccctgcttatgggtgagtgttgagcatgagggtttcgtcttaaaacctggacttgatattctatatcatagcatctttcatatccttaaagattctatgtacttttcagcacattgttctgtttcaggggctctgcaaagtatacttgctgtctgtacatttccactgtgaaaactccttgaaacatgtagacaaatgaaagctaaacatcaaataaataacctaaactggtaatactcccattggctctccttgtgtcttttcatgtgggttagctcttcaaccagattcagcatataaatgagtatgtatggttatatggtgactttcaaaagtaaatactttttctgtggaacaaaaggatggatttgtggttttccaggattccttttccctgacttggtagaaagatagccaggctagctcagcagacctgaaaataggtgagctgtcaaggtgttggcagggagaggctcctcgggtgggacttggggcatcctaccagcgaaaaagagactaagtttaagtgatttcacattgggctttacttactataattgctgaagtgctaaattgagtgtgacaaatctaacaggtattgccaagtaggtttcattaccagtcattgcatagataaatgatgttccttatgttaaaaataaaaccaaactaaagaaaaaaaattggactatatttggaggtagaattcagatatgcagatatgttcatatacatcaaagctgtttcaatgtgtcaacgaactcagttcatttactctgccaaggtggtatagtgtatgtgggagtgcagagtgggggaaagtgaggaggggtgtgatttatgagaaactgtaaaagaggttagaattgggaaacaagtttttttcttagagagtggcaaatagtaagtagcatttggacctcactcagctctaatagttaaagctaagcttttgacattatcattatatattaataatatatatgtgtgaccagcctcaatagattttatcattagtaacttggttgatttaatgaaaatagttttaaaaggcatactgaagcacagtaaacctaaggctcacatcactgtctggggagtcagtgaggaacagggcagagtgccagtcatatgaagagggatttttttgccttcttggttcactgcatattcccagtaattggaacatgcctgacatgaagtagacataaaataattactgaatgaaagtggaaaggaaagtatattagtctctgctttcatggagcttatatgctagtgggagagagacaaaaattaagtacaataaataaacagaatatatgatagcaactagggtgagagtgctgtttttgataggatggagggattgggccatttggggaatgaattgatgagaaagagaaagttgtgcaaagctggggaggaaacatcatttgaaggacagaaagaaggcctacatgatttgagaatggtggagaggagatttgagggacagacttgctatgattaagaaagatagctgggcgcggtggctcatgctgtaatcccagcactttgggaggatgaggcgggtggatcatgaggtcaagagatcaagccatcctgaccaacatggtgaaacccggtctctactaaaaatacaaaaattagctgggctggtgacatgcgcctgtagtcccagctactcgggaggctgaggcaggagaattgcttgacccgggaggcggaggttgcagttagccgagattccgccgctgcactccagcctggtgacgagcgagactccatctcaaaaagaaaaaaaaaaaaaaaagaaagtcatgataaagagtgggattttattttacgcaaagtgggagctcattaagaaggtaaaagtttttaagcaagggatgacatgatttgacctactttttaaaggaggttgctctgacggctgtagaggatagacataggcaggggacaatagagagaccaggaggaggctgttggagtgtgttaggcgagataggtgagtggtttcagaggcttgtgtgagaaagttgatacactgcccctaccccatgcaacacacactttcttttcttatgatgacctttctttaaaagcatttgttggaatatgagatataggccataagtgagaaaacaactctttttgagctgtgaggaatactaggagaggagaagtgagctgtgtgtgctgcccatggtggtacgctgctatggttctacagttccagtcattttgacagcatggattcaatgcaaaatggcaacacacactctgtatcttttggcagatcgaacataatgaaaataaaataaaaaaattcaaaactggctcttgaatgaaataggattcgaagagatgatctcaaatctactttatgagataatgtcctttttaaaaataaacactaaatcagttatgcatttagaatgtctgaattattattctaggttccttgcgactgctgtgattttgtgatgcacttggatagtctctgttactctaaagttttaataggtaacagtcagaatggagtgggagagcataaaagcaaactgaaatgcaaatagctggtaccctgaagccataactttaagctggttattcctgacctactgtttggacataagatggtagagaggctgaggtgacttgaacatttgttccttagaaacaccatccttgggctgggcgcagtggctcacgctgtgtttccaggactttgggaggctgaggcgggcagatcatgaggtcaatagatcgaactatcctggctaacacggtgaaatcccatctctactaaaaatacaaaaaattagccagggtggtggcgggtgcctgtagtcccagctactcgggaggctgaggcaggagaattgcttgacccaggaggcagaggttgcagtgagccaaggtcgcaccactgcactctagcctgggcacagagtgagactccttctcaaaaaaaaaaaaaaaaaaaaaaaaaaaaaaaggaaaaagaacaccatccttgtaaagagagcgcatacaccttcaatttctagggcagcagcgtttgcttacaacttctatgtcttggtgggagtagcactatctatcaccttatgggccaaagggaaaagtccagtgaaaatggctctgatgttgttggaagtgggaaagcaggttaataggttctcttaatggaaaatgcagccaatattggccaacttactttgatttcggtagtcataacacaccctggaaggcaccctagatagaggtcacttgctaccactcattttacagatcaggatctaaggattttcctgattttaagcattaagtatggatatccctgttggttgaagttaaatggtcaactagaatttaaaagcaaaaattaaaaaaaaattattttgtattaggtttcaaggaattgttgtcagtaggagaagcctgattgttccttttacgctgactcatacagtttcgcagattacatttgaggcctaatgttgaaatctcatctgtaagtctggtatatctaactatcatataaacatctttcatcttagactgtgtagcatgtccctagtagaccaggtgggcaaatgacattatagttaaatcaagccaataaatatatgagaaagaaggcaaatgagcgtgactccatagtgaatgatggaggttccgacgagtcaaagacactgaactattcattgctttggtttatggaagagcaaacccagatatgtgttatgctgattctgtgtgattggctactccaggattgaccctgttctcctgtcctgctcaagtctccttccttcacttaaccatatttgtgggtactcagaaatgccatgcttttgtttagagtagcaggattggtgttgaagataacaagaaaaagcaaaatgggcttgtctgtcccatcaagtgatgtgctgtcaacatatgagaatatgtgccctgaattaggagaaaaaagtagagattcctgagtttaggaaattatatctgatgcatcttcttcagactcaagccttacctaaagtttgtaaattctttctctttctctttattctttctctactcttaacatttttttcccccacctctttggctatatgctgtctgcttttgatacagaattgaccttatttggccagatggggtggctcatgcctgtaatccagcactttgggacgctgaggtgggcggctcacttgaggccaggagtacgagaccagccggccaacatggtgaaactccgtctctactaaaaatacaaaaattagccggacatggtgggggcgcctgtaatcccatctactaaggaggctgaggcaggagaattgcttgaacccgggggtggaaattgcagtgagctgagatcaggccactgcactccagcctgggcgacagagctgactctgtctcaaaaaaaaaaaaaaaaaaaaaattgacctttttcatgcccaacctctactccattatctcctagctttttggaaaatatttagtactggcatttcttcttcactgattttcattctacctgtctttagtatcataggggtagttacctcagcgggggtagggagacttgggtgtctcttacttgtacatactctgtcctctataagtaagtgtgtaaatacactgattttcccattcagacatattgtgtaagtaataggaaccaggtgtttgaataaattaacaagtgccaaatttcattttggaaatgaaatattttagtttaagactctaggacatttataagctgaaatacattgcaaagtgatgaaagctttcttaaattctgttatagtcatgcacttaaaattattcattgttacttatagttattatctgtctgtatatgctcatctacatattaaaacatgaagatattctctcaagtgaggacttcatgtgccagatttttcagcctggatgaattttatggatgagagagataccctggaaatggaaccattggcataaccttgtgtcaatataataacagagctctaatgaactgcaacatgagctcagatctgcaaaatattcagggatataggcaaagagcagttttttcctccttatgagctaggttgttctccaaaagcaaaagtactacttgtcttttcagagcgctgtcatggagctgtaagtctctttgtggtttagcttaatgtgagtaagattcctctgcattctcagcctagaaaaacttgaccgttctcttgaatttggtgaaagtttcctaactttgaagctagagaatactctcatttcagattaggcattattaacatttttttctgttctaatttcatgatgccaaaaaatcatgtatggttgatcatttggagaacaatatgtagcctcagacacttaagatcatatgtagtttagaaataatgcaattgcatatgaatgttttgatgtttttcccccagcctttctgaattttttgatttctcaaattgtacctggttttttatttttgtttctgtttttgtttttgactttcacataaacgtttatagtgtctggaacatacatatatatatatatacacacacacacacatatatgtagtatgtatacatgtgtacatgtatataaacatgtatatgtatgtatattccagacaaatatataaatgtatgtatatatatacaaattatatatacatatacgtatatatatacaaatatatatatacatatacgtatatacacaaaaattataacacaaattatatatacatatatttgtacatatacaaatatataatatgtttgtgtatgtatagttatatatacacataaatttttgtattttgtatatatgtatacatatacattttgtaatatatacgtatatattacttatgtatttttaattgtaaaatacacataggataaaatttataattttagtccttagccttttttttaaccatttaacaagtggtattaagttcatcctcattattgtggaacccatcccactatccatcttcaaaacttttccagcagcccatactgaaactgtaccaattaaacataactccttgtttctagcttcccccagcccctggcaaccaccattctattttctgtctcacaaattcaactatttcaggtaacacatataagtagaatcatacagtatttgtcctttttggctggctagtgacgacattaagattaaaatcaggagaaacagggtgggcatgttggccacacctgtaatcccagcactttgggagcctgaggcaggaggattgcttgagcctaggatttgagaccagcctgggcaacagagtaagacccccatctctataaagaaaacaaaaccaaataaagcaaaaaaaaaaaaaaaaaaaaaggagaaacagatttaagacagtcaggaaagaaaatattgactttgattttggtcttattgaatcttaggtgctggcaggtgaggactttatgttgtaatatcctgaagacagtttcaaatataggtttggaatggagatgaggacttcgagttatcggtaatgaactcattttaagaagatgagattgcctaaaggaagaatgtttttagagttagaagagtgggatttacctgatgatcttaggaattctggacatttatcttaattgctctttaggaagtttagtagaaaaagaaaggatgcagatagtgtctgctattaaagcagaggaagaaagacctgaaacagagacagagaagaagggagcttaggttataggaataaagggagaggatgtcatagaaacgaagggaaatgaggattttgagaaagagatgcaagtactgtgcccagtgtttccctaatgaccaagaggatagttctgggttttagcaagtatgattggccattggccttgggaagaatagtttcagcagaatggtagtggttgaagccagatctcataggggttagggccaaaagaaacagtaggaattctaggcatttatctgaaattgcttttaggaagtttggtggggaaagaaaggatgcagatagggaatctcaggcacatagaggtaagtaacttgctcaaggtcacacagtaaccttaagtaggcaggataagctctggttctgagctggtgctcttcatcattattttaggctgtactctcccacctttttttctttgtggtgtaggtggttgtaggctacttaaagagatacctatacacctgcagttaaaatccaagtactcagtggagagcctggtccttcgttattatgtctcagattgaagttttatattttacgcatgatgaaattacatatatgatggttaggttaggttgcaagtcttggaatatatgcaaggaataactttattacaatgactatttactttttataagacaatccagcaatggtaattttcattagtgatataattgcaagaggaaacttgagaacagaaaatggacatattgaaaaagattaaatacatgctgatgaagttacagagttttatgcaacgtttcaatcaagaaagatgataataaagcgtgtataggccgggcgcggtggctcacgcttgtaatcccagcacttgggaggccgaggcgggcggatcacgaggtcaggagatcgagaccatcctggctaacacgtgaaaaccccgtctctactaaaaatacaaaaaaaattatccgggcgtgatggcgggcgctgtagtcccagctactcgggaggctgaggcaggagaatggcgtgaaccctggaggcggacttgcagtgagccgagattgcgccactgcactcccgcctgggccacagagcgagacttctctcaaaaaaaaaaaaaaaaaataaaaataaaaaaaataaagcgtgtatattgactttcagaatcttgagaatggataaatggaaacaaagagaaatacctattttgtattataaaccctaaaatagttactaaataagttattcttttaggtatttttctttcacttttcatcgctttaggcaaaactgatagtcgatgtagctgtgtcagtagctaagggatttttgttgttgtgttaaactaacatgtcatatcttgtataattcagctgtgactatacaggggaaagtattaatgtctgatgattatacagcctgtgctttggaaacagccgaaagccagacagcgacagagagggcaaaggattattaaatggatagtcactgaggtcacttatagtgactttactgcacaccgtgtgcatctcctttcccatggcaggttgtttgatcatggcttaatggctaaagtttgtaaaattataaaaaaagccagaaatcctgctgatctcaagtgttatttacagttgatgcttggcaggaaagtgctaagtctgatcatactaatgctaagtcaggcagaacacgtgtgaaatctcatggagctctatcctctgaaccttgagaagactaccaaagtataagattcagggtggaaagtatgctgcaatatgattgagagaatttggctttttcatctgaacagggtggccaagtggaggagtttctcctcttggaaatgtcaaggggtgtatcattaggtcctggagctagaatgtaggtagaatggcaaggaaggaattttaattagttctgttatctttctttatggtttggaatggtattttctttggtcatctattcacttacaaaattatggacagatttgattgtgaggaagaatcttgggtaagtgttatctttgttttcagtagaattacttgagctggctcaaggaaattatattagtagtttgcaagtgagttacagctaatggagtcaaagaagtttgaaaagggtcaaaagaagttagaattgttccatctgagtctttggcccttgtaaaggatccagcattttgttttgtttttgcttatgtctttgatattaatatatttttagaatattataaaccacccttccccaaagttttatttccgcaatcactccctaatcttttttcttttttgcttcgcatcatatacatttttctcttcaggacaccttcttttccctttgaaacttggactatgttcttaaaattgacgattataggtaagaagaccaagtttgtgagcaaatagaatttgatattcaaattatctgaagaactgaagtacattattttgtacttgttttatttattaaaaaaaatttcccttggaaaagaaattggtgagattaaggaatgctatgctaactttgtaggatatttggaaaactatgagttatagtgaaaggtgctgtcttaggggtacattttaaaagtgctagaaaatataatattacagcttgaatcaagagaagtgaacttgctagggactaagtactttgttagaaaggtgctcataatagaatggcgtgaacgcggggacggagctttcagtgagccgagagcgagactccgtctcaaaacaaacaaacaaacaaaaaacaaaaataaaatagaaaggtgctcataataaaatgagaaataaaaaaaattctaacgatcaaatgggacaaaacccagattcacggtctttatatgcaaataaagtatagattctagattcagaacagtaaaagaaaaatacctagaaaacaataaacaaaaggcatgaacaggatttcacaaaagagctactgcaaagtcacaaacatattaaaagttactcatcctaactacaatcaaataaatgtaaattagagcaagcaaacttgtttttccatttatgaacttgccaagatttaaaagtttgataataatgaatgtttgagtatatgaagaactgggtattatttgtgatggacatgtaccatagcatttttctggagcgtaatttcacaatgtgaatcagaagtttaatagtgcatacgttttgacctagtgaatctcctgctaagactttttatcctaaagagtcatctgtgccttcttgtcaagatggtactgtaagctcacagtttgtacataccttctctctaaattcataggaatggcagatataatgcattaaaagaattaaagaaaaaagtcgtgctgggcttacagacaagatagtgttgtagacccgaaagctaactaaacataaagggctgtaagctggattgaagggatggtgctgcagaggctctggatggagaaacagaaagctagtttagctcccatagagtgctaggactgaaagtttaccacttgaaatgggaccataactagctcactgcttaaagccaggggcagggatgaagttgtcaatcctataaaaggaaactaataaaggctccacatggaggctccagtttatatggagctgtgggtcttgaggggcaggagagatagattcaatttcaagaatagcaactgaatcaggctgactgtgaggagacaataatagaaaatgtggtgttccatgttacaattatgaggtttggtcctggacagtagcacagggtcctggtggaggcagctgcagaaacactatggagggaaaggtgagcacaggtggagagaaggggagtaagagaagcaaagaagaaaagcctttcacttagaattagccttcaaaatgcataccaaaatactggaagaaaataaataccaagaaagatagctaacaaaatcaacaatggaacaaaaatttatcccagatgagatgaatttttacagaaaagtcagtcaaaaattaaagaatcatgttcagaatactcaaggggataaataaaggcattacattgatgaaaaatgattttaaaaatactcccaagatatgcagaaatggaagaggaacaacgacatgaaaaagaacagttacaaattttggaaatgaaaaatatggtcatagaaataataaacttaatagaggggtggactttagacctcacacaattaaaaagagaattgatgaattagaagagaatactaagaattcattcagaatgtatcataaagagacaaaagattttttaaaaggcatttaggagattgaaggatagatggagttccaacatatgtctaataagagaacacagccttgaacttttgcctcaagtgatcttcctgcctcagcctcctgagtagctgggactacaggcacatgacacagaccctgctaatacatttgtgtgtgtgtgtgtgtgcgtgcgtgtgtgtgtgtgtagagccagattctcgcgatgttgcccaggctggtctcaaactcctaggctcaagccatccaccgaggtctcagcctcccacaagtgttgggattacaggcatgagcctctatacctggccaaaagcaaaatgtaaagagccaagaattgagaattttcctatttaaagaatgatgagtttaatatattgagtagtatcatcatgttgacgttgtagaatttaagggatatagaggaaaaacatttttgagatacaaaacaaaaaaatgccaattacctacgaaagaaagattagcaacatagatgctagaagacaggagaataatatactaatatattcaaaatgctaaggggaagtttagttaattttgatttttaaacccagttagtctttgattcaaaagtgaaggaaaaatacgatactttcagatataaagaaagaccaagagagttaccatccatggaatctcaccagggaactgttaaatgctgctctttagcaagaagaaaagtgaaaccagaagtaaggttttgtttttttctttctttctttcttttttttttttttttggagacggagtctcactctgttgtgaggctggagtgcaatggcgcaatgctgactgcaacctccgcctcccaggttcaagtgatctcctgcctcagcctcccgagtagctgggattacagacatgtgccaccatgcccagctattttgaatttttagtagagatggggttttgcaatgtcggccaggctaatctggaactccgacctcaggtgatcggcccgcattggcctcccaaagtgccgggactgtaggagcgagccctgctcctggcctagtttttaattaaaacaagtgaacaaacaaaggtgggcatagagatgataaagtgtattggaaaattcactaagttattggtttaaatactactttttgttctaaatgaatataaagctaaaactctggagaatgatgagaatgtaagaagggagaagtaaatttgtgtgatccaatattagggacacaaaaagggacatactacatgaattactaatatctagaaaatatgatacatttgagaacttagatgaagttgatacatacctagaaagataggcatacttaaattgcttcaagaagtagaaaatctgaataaaacaatgaacgaaattgaatgaaatgaaaagtccatctgtcaaatgacagcaggcccagttttataggcacgttaaaccaatttaagtaatccttacttactcttcttccctttttaaagagttttattggggtataattatatagaataaactgcacatatttaaagttttgacatacgtatatactggttaaaccacaaaatcaagattaggagacatgttcattatcactcctaatttgtgtccctcagaaatcctttctccttctctcccctagtggttctgggcagctactaatctgctttctgtcactattactagttggcattttctcgaattttgcataaatggaatcaatcaaacagtatgtgctttgcactcgctctctctttctctctcccttttaaaaaatagattctggttttttagagtagtttaggttctggcaaaattgtgagacaggcacagagatttcccatatactccctacctcacacatgctctgttacacacactccactattatcaatatctgccattagagtggtacattgctacacatcattatcacctaatgtccataagtttaataaaccattagggtttactttggtggtatatattgttgcttgggacaaatgtatagtgacatgtacttaccactgtgttaagtatcacacaaagcagtttcactgccctaaagattctctgcactgtgtgctcttttttgaggtttagggggaggcctgtcttccgtcactcagcattgtgattttgagatccatcatttgttgtatgcttcactaattcattcctttttattgctgattggtgagttattatatggtataccataatttctttttctttttttcaatatactgcgatttctttatctgtgcacttttgatggacatttgggttgtttccagttttgggtaattacaaatgaagctgctgtgaacttcatgtgcagatttttatgtagacatgtgcaatcatgttgtaggtgtttaatatatattttttatgaaagttccagattgtcttccaaagtagttgaccattttgttttcatgagagagtgtataagagttctagttttgagagcagattttcttaaatttcatgaagtttatccttttttcttttatggattttacttctgggttcatttctctgaaatctctgccttgtgtaattaaatactaaaagagtttcgtatgttttctaatactagttttatagttttaaggtttttattaggttttatattgatgtatttattaattttgagatatttttgtgtatgcacaagggtggattggagttctttaaaagatatagatatctaattcttcaagtactatttgttaggctcttctttctccatttgaatctttgtcaaaaatcaatgaaacataaatatctgggtctttgtggacctctattttgttccatttatctgtttgtttagtattatatcaatacagcacgtcttgatttctgtagttttatactaagtcttgaagttaggtagtgaagtccttcaacttattttactttttcaaagatgttttgtcactttaagtctttgcgtttctaagtgaatttagaaatagaatgtcaatttttacaaaaaaaacctgcagggatcttagtttgagattgcacaatttggggacagtgaaatattttatcgagtcttccagtccactaacatggcatatcttttgtttaatttcggtagtgttttttaaattttctttgtataagtgtggaaaacctttttccagtttatctctgagtactttataatttttgttaaggtacatggtatttaaaaaaactcaatttcagattgttggttgctagcatataaaaataatttttgtatattgatattgcatgtagctaaacttatttattagctctaatagctgttttgcaaattctgtagaattttctcatagatgcttatgtcgtatttaaataatgacatttttaccttttaaaaatttattctcatccggatacttttcacttctttttcttgccttgttgcacgggctagaaccttcagtacatctggcatagagggggtgatgggaaacatccttggcttttttcctcattttagggtaaatcattcactcttttaccactaggtagggtttcattgattcctttattaagatgaagaattccgtagtttaccgagtgtgtttatcagggtcattgttgggtattgtctaatgctcttcatctattcaggtgaccctctagtttttctttcttagcctgataatatgatggatttattagatttttgaatgttaaaccaacctggcgttctgggggtaacacttggttattatatatgtcctttttatgtgttgttggattcagtctgctaacattttgttaatactttttacattatatgcatgagggatattggtctgtagttttcttgtaatatttctgcttgcctttgggttgaaagccattaattttctggattaatttatgtagaattattattatttctttcttaatgctttgtagactttatcagtgaaggctttggatttggagttttgtttgtgggaagttttgaaatacaaattcaatttcattaatagatataggactatctatgtctactaaaaagggctatccttttctttttcttttttttctttgagagcaaggcctatgtcttgatcaccatttgttccaagcatatccctggcatatagtgggtcaggagtaaatgtttggtgaatggatgatgaatgaggcaaactcagggagaggaagtggggactgtgtctgttcttggccccagtgggggttgtttgtggatgacatctcattctcatcctgtagtagagggataacacaaaagttggagtctcagggctccagagtcctcatcctctgagctacatctcctacttagccgaggcttttcactctctgggcaagtctcctcactttgctgaaatggcagcgttcctggtacatcccggtttagcctaggctaacctcttcttgagtgaacctaggtaatttgtgtctttcaagaatttgtctattttatctaagttctagaatttattagcataaagtttataacatcccctattatccttttaattggtatgttgaaacttctgtgtgtatttttaaatcattctggctgggattttaaattttcttttctcaaagaactagcttttggcttcattttttttt

SEQ ID NO: 5044 - DNA, 100000 bp, Homo sapiens
gggctttcccctcttcattctgcacttctatttcctgctgccatgtgaagaatgtttgcttcccttctgccatgattataagtttcctgaggcctccccagccatgaggaactgtgatctattaaacctctttcctttataaattacccagtctcaggtatttcttcatagcagtgtataacatacaccctttctcctgagtccccaaagtccattacatcattcttatgcctttaatcctcatagcttagctcccacttatgagtgagaacatacaatgttgggttttccattctgagttacttcagttaaaataatggtctctaattccatccaggttgctgtgaatgccaaatctcattcctctttatggctaaatagtattccatggtgtacacatacaatacaggcaccacacatacacacacacacaccccacaatttctttatccactccttaattgatcggcatcgggctggttccatattttcacaattgtgaattgtgctgctatcttgtgaattgtgtgttacaagtatctttttcctataatgggttctttttctctgggtggatacccagtagtgcactggtggatcaaatggtagttctatttttagttctttaaggattctccatactgttttcatagtggttgtattagtttacattcccatctgcagtttaaaagtggtcctttttccacccatccatagcaacagctattattttttgatcatggccatttttgtaggagtagggtggcctgcattgtggttttgatttgcatttccctgattattagtgatgttgagattttttcatggtttgttggccatttgtacattttcttttgagaattgtctattcatgtcgttagcccatttttgatgggattgtgtttttcttgctgatttgagttccttgtagattctggatattatcctttgttagatgtatagattgcgaagattttctcccactctaggggttgtctgtttatctgctgactgttcctttcgccatgcaaaagctctttagtttaagtctcacctatttattttgttttgttgtgtttgcttttgggttcttggtcatgaagtctttgcttaagccaacactagaagggtttttcccaatgttatattctagaatctttattgtttcaggtcttaaagttttgatccatcttgagttaattatttgtataaggtgagagatgacgatccagtttaattttctacatgtgttttgccaattatcccagcaccatttgttgaatagtgtcctttccccatttgtttttgtttgcattgtcgaagatcagttggctgtaagtatttggcttcatttctggttctctattctgttccactggtctatgtgcctatttttatacaagtaccatgctgtttggtgactatggccttatagtatagtttgaagtcacgtaatatgatgcttccagatttgtctttttgcttagtcttgctttggctatgtgggctcttttttggttccgtatgaattttagattgttttttctacttctgtgaagaatgatggtgatgttttgatgggaattgcattcatttgtagattgcttttagcagtatggtcattttcacaacattgattctgcccatccttggcatgggatgtgtttccattactttgtgttgtctatgatttctttcaccagtgttttgtgttttccttgtagaggtctttcacttccttggttaggtgtactcctaagtattttatattttttgtagctcttgtaaaaggggttgagttcttgatttgattctcagcttggtcactgtggtgtatggcagacctactgatttgtgtacattaattttgtatcctaaaacttgctgattcatttatcaattccaggaactttttggagaaacctttagggttttctaggcctatgacatatcatcaacaaatagtaacagtttgacttcctcttgaccaatttggagccctttattctttctcttgtctgattgctctgcctagggccattttcttaataaatggccttttattatattgataccacttgatattgtcttgttgcactggggcccatagtttcaggtggttcctctttcatttcactaccatgtctccaagagatagattcaccttctaaaagcccccttttcttccagaagtgcctttccaaagctgccacctctggtcctaatctatctttcaatcccctccttttacttcccctgtagctaatgctctggtccaccagccctcagatcagttctcagatttccccactcagagtggcccttctccttctgtgggcaccttagttgatattatttgtttctgccataactagaatgctgccacactctccccttatgctcaatccttaccttgcctcccatctggtgtgggcttctgagctgatgtgtatttcccccacttacacataacgcttaagaattttgtctcctagttatgttgtaggagagggctatttcttgtcctattaggacccgaatagtaataatacatccataaatatatataatttttatcaactaagaatataaaacaaaatatttttaacttttaggcatgattgttttagctatcctcttttgctattgatttctattttgttgcattttgcttagagaaatatatattgtaagatttcaattctttggaaattagacttcctctgtggctgaatacatagttgattttttctttccatgttccatgtgcatccatattcattttagtaatcatgttaagcaaatctagactttttcttacatttttgatctccactgacagtgaaaagctattactaaaatggatgtagccgtagtatttttccatagtttgtcagttgttgcttcatgtattttgaggctatactgtttggtgtatataagtttacatcatatatctttaacttgttcttccctctaacagcataaaatatccttctttgtcacttttttgaccttgagttttgtctgacattaaaatggttaccctgtcttaatctttacatagtaatatgcctttgctttaaagctgtctttcctctctgttagtaaagtcttcccaacctctggttgtatgtacagtctcttacattttcttctaaaatttctcttttttttccaccaaccgatgaacaaaattaaaaaataagtaaaaaatttctcttattttcattgtcgttaatgatatatgtgtaactatgacaaaacatttgcatcaaatctagctggattttaatgacatataccttgaatttttaaaaaacttccttatgcttcagttccttaccagtgattcctgagagcttctgagttccagcctctgttacttcactataaaaacgtataagaagcaaagatacaaaattagcttgctgtttcctcagtttcataatggctaagagtgcccctgtcatgttaaattagacaaatcttaacacaaaggaacgttttgggaaggccactggtcacagatgtcggtattcaagaagtggctgtctcaccaagaaaagaaacagtaaagagaaaggaaaaaaacagcaagaggaaggaaaaaaaatgtgctttgactagataaaaataagcaggagaatagacagatggaggagatgttcagttgaatatagatgtgaacaaattagatagtaggaatataaaaataagatgttaaattttatttaaaaagaaaacaaatggtgcacagtgaagacagaggtaatctgttctagggatgaaaaaggtgactctcaatagagtgagaagaggcaaaaagcagaaagtcaaacagcatctacctcagaaaacaggtcatgatcgaagtctaagagtaccagattgacttccaaaagcctgaaggaaaaacatagcttgatatattagtgaatgtcatatggaaatgaaagggcaagaacaaaaggtataagaataccagtaatatgggtccaattttccaggcgtcaggctggagggtgcagtccactggtggcactttgaaatggaagtgaaaattctacctgtaagataaaagagattaggatgaggagatgttttctaattctatatttttagttttaaaacacttgtttctcttgctttgatattttctagctttctggttgacctagaggttgttttgttctgaacaaaggggatgtaaatctgtttgttcccattcatggatttaattaggcagttgcccaatctctaataaatcacgggtttagtttttctttgttaaggtagtcagaggcttcaggcatgagtgacttattaaaatgtactctgatagttggggatgaattatcatcctatattgtcaatcacttgataatttttatcccaaaatctctctcctggttgttttgtcctcacaaagatgacattttattctcatatttgttcacagacatgattcacatttttctatcagtgcataaggaaatcattctacattcagcaatagtgccagtttgactaaaaaaaaaatttccatatccacaaaaatgttaatcagattcttgttagaacatgtgtaagaactggtttcattttcacagctcttgatgtcagattactaaaataatttatgttttgttgtgggaacagagtgcacgcaaaacctctccaatcacatgaccacttctcagcccacatgtcttcataaacatagaaattatttgtgttttgtggtaacgaatgaatggcaggaacagcagaatttcatgtggcctttctttatttgattaaacatattctttatgtatttttaaaaaaactaatttagttaaatggcagtaaaccatgataatttagaaaacatggtgaaactgagagtgaagagaatgttctttacgtaaaccacactgtaaaccataaaacttatttttgtcaactgcttttatgacagtggctgggaatttgacatttctactacagtaggcaaaaatacatgtaaaataactctcccacataccacatcacatctctatttgtatttccaaactaaaagcattacagccaaaaaagtgctgcgtgcactggtctagttacaccaagaagtgtatgttcacaccagcacaccttaagctggtatctgtgtggcaaggccactgctggtggcccctgacgccaagccccttcaatggatccagtttggctcaccaagagaaatccactgctctttaacccaaaaggtgtaagcttttcaatggcctccagttaccacaagataaaacaaacaaaattctcaaacagttatgaaacccaactgaagtatccacatgacagcgttcaatactacctcgccacttcaaatgtgtcagcagcaattagctatgaaaatgagtgttgtgaaaattcgcaatagtttgaactgaatattttaaaactagatatctttaatatgacagtaaacaatgtgacagaaacatgctgtttctctcatcttgtctgagatatacattccatacaggtgactgggtcccataagtttctaagaaaaacttttcctttccacttaatgatcctaagaagtcagtgcaatctggttttctccctgcagaagggttatttagtttgggatgtaacattttacaacaataatacaaactcctgggagaataccacaataaatgtctcaaaaaccactcagttaatcccagggtatatctggctgttttaaattactgcagggaatattatgggccttaatgacactgtaactgcaaaagccaaagaaagctagaaaaaggggccaaaaaaatgagctcagagccagccgaagtgcaacaaacatgtggttgtttactaggactggagaggtttagtctgcagatgtttgtggttccagaaggttccagaggaacgagttgttatgaagatttgcagagttggatgagagcaaattcttctcggagatggcaggccccaggacagggaggcccagtggtatagacagaattttagatttctgtggtcagatcatactctactggtcccacaatgtacatcaacaaattaatttgtacggatgtcatttcaaagccttctaaagacgagagtcattattgaagccattagacacagatggttcaaactatatgcagatattcatacttgcatttttgcattatagctgcttttttttctattgaactgtaatgaattgtctcataatctattccatcttcttgccattacaggctttgaatgttcacaaataggagcaaagaactcattttccagagctttaatcacaaaagagggaatgcctaattctctaaatgaaatggtctgtgatcactgaagcagagatttatatatcacggcaaattaggtagattttaataaattacttatctccctgaatactttactatgcttaagaaggaacatagcctgtttgcaaacagtgaaaacccacagcctataaaaacctttgaagaaaatgacaaataaaaaagtaaattaaaaaatgaaatgcattatatcctaacctctagagacaattcctttgcagcattgattcacagctccattaaaaatatcaattaatccttcagtgagattgggtaaaagctagaaaattaactttcagagctgcttttcgaggtctggttacccagatacaccctggcactgtactggcttgatgtaaatttaaaaaatgataaaagatactcctttcacgtctaactaagcatatcagaatttgagttatacttttcatatttctttctgtgtcatatactaagttttcaacgtgtaaatttcacatctatctatataatatctcctttttatatatacatccctgggtcaccattacaaatgtatgaaaataatacaatagaatgaacttttaagaaagaaagacaaaaaacttgcagtcattgaataagttggtgtaagtttcattctttatatttaattgatagaaactgcatgcatcaaagaaaatgcatacgagctttaatgtgcataaaatggatattagcattttaaagaggaagattaacacattaaccaagtaattttcatatattgcttctaataaaatcttcacagtataaaactcttaatgagctaatcataggcattccatttagtgggacgattagggataacataaaagtatttcttttcataggttttctaagatttatgcttttgcttattaaaaataaaaatgggaattgcattcggttcttcctaagaaaatgttgaaaatgcaaatagactttctcacgctatcacgtaggataaattattgagaaggtactgcccattatggagaacttaagtcctgaggggtggcagtatgagaaggagggaatagagaaataaacaaatgaaaaagtatacaaaacttcaacacttaaacccaggtctccccgctcccagcttcccatgaattatagattatatacaccagagtattacaaaaatctcatgtaggaactttcatgtgagcatttactgaggagtaggagatgccctggagcatttgctttcaagcctccaagtcatctctgtattgcttgtagacagactggaggcatggagagcttcgactgttaccctgagcttgccaataccttcaccatctgctcgtgatcaaaaactagggagaaaagagcaggaaagtgttaatatcattcaacagatttttcttggaaaggctcgcagacagaaacagtagttgaaaagatgaaaatagttctacagaagtccaagttcactggcatcttgggtatctaaagaataaaccttgtcacgtgtgcatggagatggcatttgagacgtaccgcatggacctgtacatattgtttgtggagctaaaactaataagtaatcctgaagtttacctagtgaaagcgtctaggataatgaccctcacacacaatcagatttttaagctactggacgggcatggtggctcatgcctgtaatctcagcactttgggaggcgaggtgaggtgatcacctgaggttgagagtttgaaactagcctgaccaacatggagaaccctgtctctactaaaaatacaaaattagccgagcatggtggtgcatgcctgtagtcccgctactcagaggctgaggcaggagaatcgcctgaactcgggaggtggaggttgcggtgaccgagatcatgccactgcacgccagcctgagagacaagagcgagactcctcaaagaaaaaaaaaaaaagaatttttaagctagtaaggagtaagtctaaagggaatttatgataatcttacagtgtttcagaatggcaaaccactgtacagatgttacatgatcatagcttgaattattatttaactttctgaggaaaacatttcatttaaaatagattttatgtgaaattagaaagattaaaatggcagacccaagaatcttaagatctgtgggtttgagtatatgtaggatttcttggaagagggaccactactttcagtggtgtcccaaaggtagatcttgggctcaagtgttcccccactgtggcctccccaagtgttaggattagaggcctgagccactgcacccagcccgaaggtagactatttggctggagccatgggcattctctgagctcagtggtggaagccaatgggatgccgattcaatacctgagactccatccctctgtggacaatgataatggctatgactcaaggccagaaacctggatttttgtaagtctgatagcacttatcacttatgagtttcatatagtttctgtttttttcttttagacagtatctggctctgtcacccaggctggatgcagtggtgcaatctgggctcgctgaaacctctgcctccaagggtcaagccaaccaccatcttagcctcctgagtagctgggactacagttgggcaccatcatgcccagctaacttaatattttcttgtagagatggggtttcaccatgttgcccaggttggtcttaaaactcctggctcaagcagtccacctgccttggtctcccaaagtgctgggattacaggtgtaagccacacacctggcttagtttccaatttataattccttatggttttccttgaactttaatgtgttgtgtgtgtgtgtgtgtgtgtgtgtgtgtgtttaattccaagaaaatttgttagaaagcttaaaacttgatacacaaagagttaggtgcagaaactgagcattgggtaagtgaaaatgcatgagtggtccccagctcattccctggagctgtcatctctgctttgggacttctcactctatggttgctgcagaacaaagcattaaaatcccaacctcacttatacctaatcttttgctctttcccaaaacatggccacaatagctgattatgtcagatcagtgggtcatatgcggctctcagaagaagatgggttgctaaacagccatttggaaaaaatacgaagaatataaagaaagataattttggtatttttgtcagactttcttggtcctggtagtctttaaaagggttaggttaatatttcaatcctctcatctttttctctgtgccaaagttgtgaccaactgccagtggttagaaatgtatagtttataaagatttcccagaagaagtttttaatttggttattggtctaatttggttaattatctggcttgagcctgacttttcagcacttgacacatacctggacaagcagcttgacaatgaaccagggctgaactacagcgtaagcagaatgcctggcaataagaggtgctcccttcagtgtttgttgaatgcacaagtgaatatgtaaacaagtcatcacatttttccaaagatggctctgctaacttaacaaatgggactaggaatcagccttattctctatttactacataaagcctaggccatccctgattatgatttttaaaagtctgattataaaacaatttagcacgttctaaatacagaagaatagagagtagaaattaagcattgtgggaatcacaactagtaagttaaaaatccaggacagcacatttgtcaggaacagatcaatgtcattactcctcacaaaatcctggtgggaaataaaggatcaaagctacttccttgcttgactgtatcactacattgcaacactgaattaaagagaagccttgagaaagacattatcggatcactcagaataacatgcttaaggttaagtaccttaacagaaataaggcttccataacattaacagaataacatcctgaaggttaagtcttagctgaaatgtggcttccataaacaccctagaaaaacatgtggccaggcgtggtggctcacgcctgtagtccgggcattttggaggcctaggtgggcagatcacttgagcccaggagttcgagaccagcctgggcaacatgagaaaccctgtctctataaaaaataccaaaaaaattagccgggcgtggtgatgcacgccttagtcccagatacctgggaggctgaggtgggagaattgcttgagcctaggaagtcgaggtgcagtgagccaagactgcactccaacttgggtgacagagcaaaactctgtctcagaaaaaaaaaaatccaatggccaactttttttcacgccttcactcaatactaacaaatgaatattccttgtgaagctaaattaattattttacaattgctgttgattcaaaggaaagcagggggaggacaggaaaaggatataggaagacgcttcagcttcaccaaagcgtcaacttgagtgtaaaggattcaagtaacgtgtgactcagcacccttggagccagcaaaaagaaggttttataaagagtttggagttcagcaattgttggttgcacaaactgagcaacactttcacccaaccatcgatattttgctcaatgaggtccctcccttcctgaaacatgtcggcaaggtcgagtgagccacgccaatgtcctcacactccaggtcctgctcgtcctctggagggtcactgacacggtgaagcgaaggctggtaaggcagagatcagagaaagtcaccaccaagtgagaagaatcaccacgagacaaaactcccaaatggggtgttatcactaggtataaaatgttaaagttccaattatcccaataaaaagaaaggtacactaggctagataagttattatatgaactttagaattgttataaaacacccaaccttcaaatgaacactaatccactttctaagcactattaacatttatctctataatctgagaaaattactaggcaaagagaaggaccagatgttactcaattacatactatctgattatattttgacacctctacttttaaggctaaaaggataagtgaataaagaccatggaggttaaatggtcagcattttccatagaaacgtaacatttctatagaaacacacaactctggagttgctactaaggaatttaacaaaactgtatgtgtttacaaaatgcagagatcatgctcccagggtaacattttgaatcatgttagataaatgtttaactctgcccaacagctatatcaaatgtttgtattacttgagcaatctttaacttacatcatagcatccaagttttattttactttaagacatataattgtagggttctgatggaacgatttgaattagtggcttgtgcggaggccaaatgcacttggattgaccaaatgacaggatttacagttaagtactcttttgatatgtcttggcagcatagcttaaaccatagatgctttaaactttaccattttaaacttttcaaaatgtatccatcccaaatcagaaacaaaacaaaaacataaaaatctacatctctgagaaatcatgccttgaaaaacacaaataaaatccttccaaatgcttataggtaaacatgacaatacatttaaccaacttgctgaaagtaagtatttatattgaattcctttactaagtctctgtttttagctagcaataagaatttttttgtttttgtgttttttttgagatggagtctcgctctgtcacccaggctggagtgaagtggcgcatcttggctcactgcaacctctgcctcctgggttcaagcaattctcctgcctcagcctccgagtagctgggattacaggtgcccgccaccacatctggctaatttttgtatttttagtaagatgaggtttcactacgttggccaggctggtctccaactcctgatttcaggtgatctgccacctcggcctcccaaagtaatgggattacaggcgtgagtcactgcgcccagcctgcataaatttttattagaaaatagaaatcctttaggtcaaaatcaaagttaacgcctactcaaaaataattataaagagtacagatcttggccttcaaggtggtacgaaggaatttttatacatgtataagatggagggattaagatggagtggttaagggcattcattctgggctcaaatcctgctttcctactgcttagctgtgtgaccttagacaagttactttaacctctctcattcagtttccttaccagtggaatggggataattatacttatcttacagggctcttgtgagatcaaatgagatgatacaagtgaacagttgcctggaacacagtaagcactgagtaaatgttgctcttctttttagtagtatttttaatatagatagagttgcttatgcttctacattttaaggggagagaaaaacttggcatcggaaaagcttgtttcaattgaaaatttagttagatcccaaattatacattgactatatcattcaattaagtaagaggaatgattatgaaagaattttcctaaaatgaattaggaaaagaggaagaattaaaactgcttggaagaggaggaataaaagtaacatataatgcacatattataacacaagacttacagaaaagactgaggctatcagactgtaataataatgttaagtgttatcttcatacagtgtctcatatctaaggatcagtctgtatcactttacaaatgcagacaattacctccactgaatatatgagaattctgtgcaaaagaaagccttctaaatgccagagaaagaactcgaaatttaaaaatgcaatatttcggctttaaattctatatagagaaaaatgagatgtcaaaaacaaaattaagaaaccagaagttaagctgaaaagggaggaaaagtacactaaaatcatttaagaattaaaagtaattttaaaaaataacgaaaagacacacacacaaatcttttatcttactttcaacactgccaaaaaaaaaggccaactttgtcccatgtctggaagaacgcttacagtctagtctgaggacctgatggacacagggggcagatgtcaagcactcaggtggaaggaagaacaggaagtgctaccgagctactcctgcctcctcttcccacctctttctcctgccactctctacttctcagtgaaccagccttgctaaccacctctgcctggtcctggaacacatctctctatactccttcatcctggagttccctttgcccgaaatgatcttctctgagctttttgtgacttgactgagtctcttatccttcatgaaccagcttacgtgtcacctcctcagattcactactgaggattcatgaatttgattcagctttcactgttactttctattttggcatttaactttttgattttccttagtctttgtagatgtaattcatttatctgtctattatcatcatctgtcttcctcagggtggatctgttcaacagaacactgttaacaagaaaaaactgaatccaaaaaaggacctaagtcagtgttaaactatgacttcaaataaatactgtttgaaggcacatttcaatatgtacctcccttttaaagtgacacgtgtatatttgcaaatatagcatggggtggcatgcaaagtactatatataatttattatacaatgtctataactttagacatgtcggggaagatacacaaacttctctaactgtcgctttgtaggttatcaccaatattcaacagggttgctgtctagaaaatggattctcataaactaggagctactttaaataatgtgacctctgagtatttaaaaaggtgagaacatttgctggaataacaattggcttttggctgtggaaaaacatacattaaacgcctctttcccttaggacaatgatactgttgagggagaacagtcaatggggccaccactcccatggttgttcgaggagtgcatggccagcactgaaacactcatccatggttgaagccctgagccagtcacttggcacctgcaatacctctctatctttctcaaaaatgacagaacatttgtttctttggggggtgtttgcagaaacaaccatgggagagtgggagtcatttagttactgtggacttttctctttttttgagacagggtcttgctctctcacccaggttgagtacagtggcacaaccattgctcactgcaagctcgaactcctgggctcaagcggtcctcctcctcaaccttcatagtagctgggactactggtgcatgccaccatgcctggctaatttttcttttttaatttttagtagagatggggagtctcactatgttgctcaggccagtctcaacttctgggcaccagggatccttttgccttggcctcccaaagtgctgggattacaggttgagccaccacacctggcctttttaaatttcttaatctattctggtacaaataagtgggcctctgaggaaaggcaggtctaacacaaaagcagaacttgattttaaattttttaaataacacttttggggtaaaaaaatgttgtctcccaatatgatctcacatttcagaaacaaaggaacacagaggcagacaaataagactgaataggctactgaatcgcagcccaggacttgtcatgggaactgagctccatcctagacagccatggcgcagcttgctgactggagggaagcgatgccatggccagtgctgtttattccctcgtcactcatgacctgggataaccctggggactggtggctttgaagggggccctgaaagaagctgaagcaagtcaaacctgagtgattacatcctgggaaaagtagagcctcagaaagctagtgaaagaatagtgataaagctatatttcagatcctgagagctaagcattccagtctctcttcttcaaacagaagataaaatgctatttggaagctcttttgaaaaatatgtctttaacattcactttatggccctctggaaaggaagaacttgagtctcctaaggcggcagagtcagcactgtttttgaggcagtgagaggcttgtcatcagtaggtcataaggcaaggagaagtgggcaatggagacagaaaaggggtactaagccgagggaggacggccagcaaggggcactggagaaaccagtttgcggttaataagcgcacagaggtaactcctcaaactctgcggcagaagctcacacagaagcactaactttttagatcagtttttttttctttcttctgaaaattatatacatgtattttctctactgaaccgaattgcaaggtatcctatttaaattagaaaaaaaatgccttcaaaaaataataatgaatgatggcttattaaacagtgatagtaagatacaaattagtctgaaaggctgatgagccatacaaacaataatattaatgtcactacttacaatgattgcaattaacactcactgtgtgtatgtgtcaggtactatactatctgtgttacatatattatctcatttaatcctcacaccaccctctatggtgttatcatctccattttaaagttgaaggaagagaggtgcaagaaggtaggtaacttgtctgaggtcagtcagctagtaagcaataagacaagaatttatacccaagcatgtgactccagagtgtacccacctttcaacctgttacagtctttacaactacaggagggcaataggatactttatacatgttgtccagtctttggtgttccaagtcctataggatcttacaattactttgtatagtaggaaggaccattaaatttctaggaggaaggcgatctacgagatcccgtactcattcgagggtacagagtgagtcagagaaccccgatgttcggcttctcatcttgtgccttttattttaaccatgtcctgctacagagatctactttatgtaaaccttagattatttggactgccaaaacataccttctattaggcatctcttgtttttgtagtaagcttttaagatgtctctctttgctttgttgttttctttatccacgtagatcactatacaaaagaaaaaaaaatgccaaaaaggaagtcactcaggaataggctacattagtaccatttgtatttttaaaaatacctgtttttaaagacacaagtcatgccacctcacttgcatgccgggaaaagaaaacagctccagaaaccagaatcaaatctgagtagtcatgtgatctaatgcatgtcactggcaggtttatgtgcacactgtcagaaaagatacaagcaacatctaagaggccacatcaccgtcactgcctgttaatggcactggcagtcatgacagtaaaagtcaacgtctttattgctttgtatttgagggatttactgcattttctttcacccaagaagcaagtgtaatgataatgtatggcagactgcttgtccttcctgacagcctcagtaatttaatcctttcttctgccacaacatgcaataaaagaggcatctagtgtattgggttgaggaaatccgcggctgacgcctgctggggaggggtatgggagagaaacgtgcagggagagaaaggcttttagggtgtgaggtttttggttttaaaggcacatgctggcatcgaggaatgtggccagactcactgggctgaagcatgagattagataactgacctcaagtctcaacagaaagaagacgggaacacttgacattgtaagtaagcatctgcactttgggaaaatggcatttcaatgtgcgacagtacaattttcatcctgattatttgttctcagttcggcagactttcagccatgcatagcttctgaagacatttctttttcataggccattttggatgtaaaggctcccctgtgacagatctcaacttagagattattcctggccaaaagcatgcaatgggtgaaagatatcacgtagttctaaagccagttctccttaggctctgccaggaacaaacatcttttatgttgaaatgtttccctgaacaattttagttcaattccaaattatgatgctatcaactcatttgtttgctcagttgagcaaatattaactgagggccaaaggcactgagtaggcacaaggcgggaggacataaaggtggcgggagagacataaaggtaccggtataggggtgggttagtggtttcgagaagaatcatccaagacataataaccaagttaataatcaactctggatagccaaagtaaacaccagctcctagcttactgctctttgcatgaaaccatattagtaaatgtggctagtatataggttactgaagtttatagaaatcaatacagattcaaaggttcagagtatttttttaatttatcaatgccaaaaagtcatgctaacagatcactggaagatagacttcgtttttagaggctgccagtacacaacgctaaaggggaactttttttccaaatgggatttttttttttttttttgctgttaattaccaattcaagatgtggcacaccatattgtttttgacttcgagttgtaaagcttttatgtcgtactggcttccatagtttgaagacaagggtaatctcatggttaaaaaaaaaagactgaatttcaaatgccagcatccaaataaagggtcttccaataaacctagaccagatttgataaatttcaatagcttaaatcatttttttattgtggtaaatacacataacataaaatttaccatcctaaattaacaattaatatttaagtattcagtttgtggcattaaatatctacatattgtggtacaatgatcaccactatccatttccagaactcttcatcttcccaaactgaaactccatactcattaatcaataactttccattcttccctttctcagcccctggtaaccaccattccattttttgtctgtatgaatctgactccccgaatatgtcatataagtggaatcatacagtatttgtccttttgtgtccagtttatttcatttgcattggtgttctcaagattcatacatcttgtagcatatgtcaaatttcattccttcttaggctgtataatatttcatcatatgtatataccacattttgtttatccacttatcctgtatagacatttggattgtttccacctttgactattatggataatgctgctctaaacatggcatacaaatatctgagttcttgatttcaattctttttggtatatacccagaagtgaaatgctagaccatacgggtcattctaaatttaccttttttttttttcttagagatggggggcttgctctgttacccaggctggagtgcagtggtgtgatcatagctcactgcagcctcgaatcctgggctcaactgatcctcccaccttagcccttagcctccccctggtagctgggactcaggtgagcaccactatgtccacctaatttttagtttttgtagagatggagtctcactagttgcccaggctgatcttgaactcctggcctcaagtgatcctactgtcttggcttcccaagtgctggaattacaggagtaagccaccatgactggcccaatcttttctttttctttttaaacatccttaccattgaaattggttttaaaaagtggtgtcgttggggattccctgtgctctgctttatcgagttggccaacatgctatatttcctattctcttaataaagacaaaaagattgccactatttactgggtactatttatgtgctaggtactacactaaatacttttacgtcatcatgcaggttaagtacctgacccacattttacagatgattaaatagatccagagaggttaggagtttgcccaagaccacctacttagaatgtggcagagccagaatttgaatcagcaatgttagcctcaagagtctgctctcttaacctccatgttacataacctctcctcctccatatgaagccaaagttttcctgtttaagctgtagttattttgttaacacaagaccaaaggtaagagaatgttccataacaatatcaagggaagtcacctcattttcttttgtttctaaaggaataattgcttagatatacctagtctaggtgtgtcaaatcatatttcttggcaaaaactttcaaaatactctttttgaaaatactccagctacttaccaataagcttagttcccaaaagtgtaccaagttggaactatggctctcctgcttccacaaacaaggcctagattggcatctttatctagcccagtggttctcagtctttattgtgtatcacaaccccttaaaagcttgttaaaatgcagattattgagttgtattcccagagtttctggttcagtagctctggttagggcctgagaatttgtaattctaacatgtttccagttgatattgctgctggtggtggggttctacacattgagaaacattgtttggcccaacattcatttgccaaatttttaaagggatcaggagctagtgaacacttttgggttgaataccgtgggaaacaggaacactttgctgcctctgattatgtcatgatatcctatgactaaccatggttcatttagtattctaaaccctagatggttaaaaaaactcacaatttcaaaacttgaaatacatcctataaaaagtgctctagtgattattaaaagtatcagaactctccaaaagttaaggtatttacctttcatttcctcagaaatcacatttgtttaggacttgtatgattttgacataaacttactgaaagctatgtctcaaaaaggatacaaactggtagtccaaatactttagttgatcttcagtcatcaccattaaaaacatatcctttacttctgcaagctggataaatccttatattctgttatcatgtcatatggcagaagaaatgcagatggcttaattataaggagtcgataaccctgaattcagataatgtttgtattaaagagtaatcatctgtatcatccttatctttgccaaattttcctcctattagtcacaaaatctgatgtttcacatcatcttcatcttttgaattaaactcaattgttccaaaagacagactgttccatccctagaggctaagggtccagacatgtatagtctcataaaaactttggatgatttcattaatctttttccttccactgtcaattccacttaggctttattcagcccagacaacattcttcagacctaccattaatcttattttttcccaactattttcttgctttctcagcattctctgagcaaaattttcaggcccaataaaatacaatgttttgttcctgctaccactgtctggcaagtaaattcaattttagtttttcagtgtggtatttctaagaatatatatatatatatatatatattttttttttttttttttgagatgagtctcgctctgtcacccagtctggagtgcagtggcgcgatcttggctcgctgcaaccccgcctcctgggttcaagcgattctcctgcctcagcctcctgagtagctgggattacagcgcctgccaccatgcccatctaatttttgtatttttagtagagatggggtttcaccatgtggtcaggctggtctcaaactcatgatctgcccacctccgcctcccaaagtgctgggattcaggtgtgagccactatgccaggacgacttttgtatttttagtagaggtggggtttcacatgttggccaggctggtctcaaactcccaacctcaggatctgtccacctcagcctcccaagtgctgggattacaggtgtgagccaccacgcccagccaggagatatatatttttgtgatgtaggttatactggttttaacacctcttaataaagactgaattcaattatgaataattagggaatcactagtctgcatctctcattttatgtacctaatttgggcctgaacatacagtctcttttgtacagattcaagtcacaatgcagggtaaaatcattgctaggttcagctacctctctactgcatgctgttcaaacaggagacagcatgtactaattgtcctctaaattaccatttgaattaaaaagtcagtttggaaataaaattacttccattaatatttaatgagattggaagatgtaagtctacattatattgaccttctgtatcaggtaacgagtgaatggtaatcattacaataatatacaagagatagttacttattaaccaaagactcaaggagatcccctgcaatggagatgcaaatataataattttaaaataaacattttcattatgtcatacttaatgaaaaatgaagcattcaaccaggttaatattaattatttctcaaatttgctgatgactaggagctcattttttcagatataacagatataaaacaacattagtttgcttctaagccggagtacattcctttcccctcctcccagaaaaatatccttaaaattattttcaattaacttgaaaattctacacagtcaaatttcattagataggaagagaagctaaaaaaagtatataaacagttttactgaattcatttctaatagattactggttttcttgctgctatcaaatattgattcattaaaaacataactgttaacataccaattagacaataaaataccctgcagaaagggaaaaaacaaaccaaaatgcacaaccaggctgggcatggtggctcgcacctgtataccagcactttgggaggctgaggcaggtggatcacttgaggtcaggagtttgagaccacctcggcaacatggtgaaatctcgtctctaccaaaaatacaaaaattagctgggtgtggtgcgtgtccctgtaatcccagctacttggggggctgaggtgaaaggatcgcttaaacccggaagtggaggttgcagtaagccaagattgtgccactgcactccagcctgggcaatagcccagaccttgcatcacaaaaaaaaaaaaaaaaaaaaaaaaaagcacaactaacaaaacacccaaacagacctagaggtaaccatgtgagaatgcacaaaatttgggccacttgagcattatcacagtttgagctaaagaaagatttgtattgctcttcaagcaaatggaaacatctatccttgacatggccaagtttctcaatagacaattaatctctaaaaaacaatgttgttgcagtccaaccaaatattctactcctgacctttacaaagaataatacaaaagccaaagagttgtcatttttcttggggtatctttcttaaaattagttgaatgcaactattaataatatttgatatggttttcttttctggtactctgcaactgatgatttccaagaagcctgagaaaaacttttggaaatgttttctttataccaagtgcatgaaatgaaggaggaatcagattctttcctgtccacactacttatttcacatgtgatttcttaacacacctgttattgtagaattaagctgaagtagatcttagaaagcaccttacttttcaaataagaaaacaaggaatcatgaatttaaacatcttgccttagttcacataacagtaaaaattggggataaagggaggactgaccactaggccagatctctggatacttaagattactgtcttgaggaatgaacgtattttaaaaatgccagatgggggaaaaaaaaggtaactgtgagcatttgtaatcctgctgataaacagcatggttatacatgttgattaaaatgcaatttctaagattagtgaggaaaaaaaagtagtgatgaactagcatgagatggcccattttgctaaaaataacacaacactccattttatggtttgttttaatgtagagctctaggagaacatactaagctgttttagcttagggcatggtagcctgatattattttttattcctctccaattatatactaacaatcacacaataagttgattgatctcagaatttatagggtgtctattgggtctgtgctggtccagtaaactacatgtcaactggctgctagatcaagccctaagacagaaaacctgcctgctgctatgatggatgtgtgtgctatatgatgaaaggtgtagtaagaacttatgcttcactcaattaaatcttgaacatctagacactgagagagatatatacacgtattgtaaaaacatccatgtgagacattgatcagaaaggtagacaataaatagaacattgaaagcttcgaatcatatgattaaaaatgacttctttgaaagatatttctttgaaatatcatatatttaaattaaattcctattatagacctagctgacatttttctgttgaactatgacatagcaggaccatcttagaatattttttcacattgttttgttttctcttaactgtggtattacttcaactttctcttctttttgagacagggtctcactttgccactcaagcaagagtgcggtggcaagatcagagctactgcaggctcaccctcccaggctcaagcaatcctcctgcctcagcctcctgagtagctggactacaggagcgcaacaccatgcccggctaatttttgtatttttttttgtagagacgggttttgccgtgtagcccaggctggtctggaactccagagctcaagcgatccacccgtccggtctcccaaagtgctaggattacaggtgtgagccactgtgcctggcccaactttatttcttaatctttatgctactggtttgacttttattaatcaattctgacaagacttccatgatttatgtgaatattagagaaataaactttctctctgttctttccacttctttcataaaaaaaaagacaaacataaaagtctatattacaaatgaatcatacataccattgctatagtatagtagacccactgcccactcttgggttttggaagtgacacgggtgtctcttcagcagaagactgtagaatcgacactcaacaaacagccgttggatagtgtcatccatggttacttagaatcattaaggcttagagctatgatctcaatccgaattttttctgatggctgtttaagagcaaaaacaaaaaacaacaaagaaataaaataattgaacaaaaagatccactattacttccactatcaattttaaataaaacacgaaggccaatgggcttcttttcttgaatgcaagtacactactgtatgttacacatgatagattattcatgacagagacacagaatgagatgtaatgccccagggtttgaagttaacagtgtcatggcaatagtctcctgatttacatttgggctataaataccccactagtagtctatcaggagtgaagattatgagatcttcatctccattgctttcagaatgacaagttggccttgtttcaaactatgtaatgaagtacatgtttacactgcctttacttaatctacagtacctgagaaagtttcagttattcggagatcaaagctgttgaacactttataggtattatgctaatatatgtagctatatgaatcaatattaactgagcagaaactacagttcattctcttatattctgtcataatatactttgttgaataaatatacattttcaagcaaaagaaacaattttatgtctaatttgaacattttctcataattttctttaattttatttttacaaaattaacaactaaaatggtgtttgtttaattttcacctaatccttgcttaatagattttggtgtcatagacattatcacaggaattacaaatgtttcttgagtaatgatttcaaataattaatagactaggattagaaattatatcacaccaaggtactcctcagttaaatctgttttttacaatttaaagtttgtcctttagtatcaaaatcctttttactaaattcagagacatgctataaattatataacttcaaataataattagaaaaactgaaaataagacctgtttatatgaccagcttttaggaattcattgttaaatttaaatcgtgtgtaaattcaccatagtggttacttagatatttcaaagcatataatataattaatcaattgaaaagcataagtatcctattgtaaaaatattcccataaagaacaatttccattgtgtcaaaccctctcaatatttgatgaagtaattttacccccttctttcaaaagacatttcttttattatgtattctaagacactttaactaaaaacccaaatctgaatatttcaataagttattttattattcagtagattcatggaaattttactaggatgacagagaaaattccaaccattctgtctccactaatacaggtacaaggctgcagctggcaatattactaggattacatagtatgatgaaatatttaaaggaaaattttttctaaaacctaataaatcaaatgacgccaaatgtcattaaagtgatggtctttgacttgaatatgcttttcatattcaaatttgaaagaaagagatgaaagcctggaaaggttactcggtttcaactaataacctcaagcccttccgttcacgtgcataaaaaatgaagttggctctattgtctaatctcacttcagaaaacccttctctgctcgctgaagactacatggtaaagaaaatattttaaatgatattttttttcttaaaatgtatcgtggtagtgaaaatactgtaatacatatattttataattctgctccactgtagcataatgtatagttaagtcttctacataagttggaatttgacaaacttagaatatagcaataacatcttatacaacatttatgtttctgcacaaaagaattaaaggaaaatgctataaaaagaaaaaagtgctatacatacttatttctactctgtgaaaagaggaatttaaattgtttatcacagaacctaatgaagaagtaaatgaacttgtaaatagcaggggaataaatttatctaagtggttattttattaataatatattagctctacaatccccatatgaaacttgcattattgtaagaaccaatttagactgtcaaatatgactacatgcaactctttaagtttaaaatacaatcctagataaaactattcacttggatcctagccaaaacacagaaaaaaataacaaaaccccaaacaccaaaacaacaaaaaagaaaactcactgtattatcaaaaaataaaataactttaaaattctttttatgatgtctatcttatttctggtcaatttttttttttttttttggatctctacactactgccattacttcgatcaaatgtcctttttaatttctgaccaatacacctggcagaaatgatcagttattgtttcttcattcatttaatgctaatgaatcaacttgaaataaatcctaaaaggggtacattttaagcagcttttatctaagaagtaagctctaaataaagaattttccaaacataaattttgacaaatgatgctagacaattatttttcaatgctggaacaattctggttgtgttcaagcccctctgattaaaaagttcactaggccgggcgcagtggctcacgcctgtaatcccagcactttgggaggctgaggtgggggatcacgaggtcaggagatcgagaccatcctggctaaatatggtgaaaccccgtctctctaaaaatacaaaaaatcaatcgggtgtggtggcgggcacctgtagtcccagctactcggaggctgaggcaggggaatggcgtgaacccggggggcggagcttgcagtgagccgagatgcgttactgcactccagcctggcagacagagcaagactccgtctcaaaaaaaaaaaaaaaaaaaaaaaaagttcaactagattttgtataaagatctgaagattggcccggcgcagtgctcatgcctgtaatcccagcactttgggaggcagaggtgggcggatcatgaggtcgggatttgagaccagcatggccaacatagtgaaaccccgtctctgctaaaattacaaaaaattcctgggtgtggtggcaggcacctgtaatcccatctacttgggaggctgaggcaggaaaacgctggaacccgggaggcggaagttgcagtgagctgagatcgcgctactgcaccccagccgggagacaatgcgagactctgtctcaaaaaaaaaaaaaaaatcttaagattaagaagccattaaatgcataatagacaacttcatctcagcatgtcagaaatgaactcattccctctctctcccccaatcctattcatactgtgttatttcctatctcagccgatgacatcaccatcacctagtcccctacaaccagaagacatagcagcatccttgcctttccatttttttcaccccactatatcctaaaggtcacccattcctgctcattttacttcctaaatatcgccacattggccaggtgcagtggctcatgcttgtaaattccagcactttgggaggctgaggagggcagattgcttaagcccaggagcccaagagcccaggagttggagaccagcctgagcaacaggtgaaaacacgtctctccaaaaaataaaacaaaacaaaaaccacacacacacacacaccacacacacacacacacacacacaaatagccaggccttggagtggcatgtgcctgtggtccagctacctgggaggctgaggttggaggattgcttgagcctgagaggttggggctgtaggagccatgatcttgccactgcactctatgcactgtagcctgggtgacagggtgagacctgtctcaaaacaaagaaacaaacaaaaaaaccactcaatgattcactgaattgttgaaacatatatttcagacattgttttaactgttggggagataaagaaaaataagatgttgtttttttccattttttatctctagagaaaatactaagttctcatgggggtaactaatacaatgcttcctagttatcagaaggtagcaatttgacagaacaaggagggagaaaatagaaggactgacgtaagagatttgagagcgaactggtagccgattgatgagcgttatgagactgtagctcagtgacagtagggactattagattgctcattgcgttatgtagtacacaataaatggtggatctactctcatgacagagagaggtgaggcactcatctctaatctcttgtctgcatcccaaccattctccttattgtagcagaattctcttcctaaaaaccaatcaaatatcattttccgcctgaaaatattcctattgccttacactctagccactcctttaaactcatggttgctgttttatattgctcagtttttgcatctgttatttattgtgtgaaatcttttccatagaattccactcctgtgaggccctgaaccacacatcctctcctttatgacagcaatactatctctaagagcaagttggttgtttcctcctctgggcctttactgcacttctccatcacttgtactacatggaactgttcacatatttgcctctgtctatagactctgggcttcaggaggcaggaccaatatcttactcattttttgctacttcacatcctccccaacatagactgtaataaatatttaatgaaatagtggagactgtgtatcttttatatattcagaatatcttttttatttttcttcaggttcttgctttgttgtccaggctgaagtgcagtggcaagatgacactcactgcagcctcaatctcccaggctcgagtgatcctcccatctcagccccctgagtgctgggactagaggagcatgccaacatacccagatattttttaaattttttgtagagacgggtttcactatgttgcccggactggtctcaaactcctggcctcaagcaatcctcccactcgacctctcaaagtgccaggatcacaggtgtgaaccacagtgcccagcctagaatatctttatttattgccagaactatgtgaagctgcaggtattattgccttctcatttaaaaaaatttattatggctgggcgcactggctcatgcctgtaatcccagcactttgggaggcagagcaggcagatcatgaggtcaggagatcgagaccatcctggctaacacggtgaaaccctgttctattaaaaatacaaaaaaattagccgggcgtggtggcacgcgcctggtactcgggagctgaggcagaagaatcacttgaacccggcaggtggaggttgcagtgagctgagattgcccactgcactccagtctaggtgacagagcgagactccacctaaaaaaaaaaaaggaaatatgtgctactaagttttggggagtggttattattaactgccgagaaatatatagaactctgctgttatagattttaatgaaataagactatctcaagacaggtgaatattgttgaatcaggtggtagggtactattatttctacttttctgcatgtttgaaatttttcatcataagaaatgggagtccctccccctccccctccccctccccctcgtctcagtctcctgctttccaggtctccctctgttgcccaggctggactgtactgccgcgatctcggctcgctgcaacctcctgcctgattctcctgcctcagcctgccgagtgcctgggattgcaggcgtgcgccacccgcctgactggtttttgtatttttggtggagacagggtttggccgtgttggccaggctgtatccagctcctgacctcgagtgatctgcccaccttggcctccccaggtgccgggattgagacggagtctcgctcactcagtgctcaatgttgcccaggctggagtgcagtggcgtgacttggctcgctacaacctccacctcccagccgcctgccttggcctcccaaagtgccgagctgcagcctctgcccggccgccaccccgtctaggaagtgaggagcgtctctgcctggcccccattgtctgggaagtgaggagcccctctgcccggcagcccagtctgggaagtgaggacgtctctgccagccgcccatcgtctgggatgtggggagcgcctccgcggctgccccatcgggtggtggggagcgcctccgcccggccgccaccccgtctgggaactggggggggcgcccagcctggcggccgccccgtctggggggtggggtggggggtgcctccacccggcagccgcccatctgggggctggggggggcgcgcctccgcccagcggccgccccgtctagggggtgggggggggcgcctccgcccggcagccaccccgtcttgggggtgggggggcccctctgccagccgccatgtctgggaagtgaggagcccctctgcccagccgccaccccgtctgggacggtacccaacggctcattgagaacgggccatgatgaggatggcggttttgtcgaatagaaagggggaaatgtggggaaaagaaagagagatcagattgttactgtgtctgtgcagaaagagaagacataggagactccattttgttctgtactaagaaaaattcttctgccttgggatctgttaatctataacctcacccccaaccccgtgctctctgaaacatgtgctgtgtcaaccagggttaaatggattaagggcggtgcaagatgtgctttgttaaacagatgcttgaaggagcatgctcgttaagagtcatcaccactccctaatctcaagtacccagggacacaaacatgcggaaggctgcagggtcctctgcctaggaaaaccagagacctttgttcacgggtttactgctgaccttctctccactattgtcctatgaccctgtcaaatccccctctccgagaaaaaccaagaatgatcaataaatactaaaaaaaaaaaaaaaaaaaaaaagaaaatgggaaaagtctcaatcaggtgaattggaagatgtcctaaataatatactgattcaaatgacagtattgaagcaaaggcttttaaagagatgaataataattgttcagaattactagagcaacataccggtcattcctctgcaggctaccagcatcctttgatacaggaaattggccagacagccaggctttagacttttcctgttttgtttcccctctacgtgtatgaatttttgttaccagtaagatgcttcttctcagttctttttttcttgttcaccaattaccctattagcatcctcgtatcaccatgtaaaaagaacatttataaattttgattgtgggctggccgtggggactccgcctgtaatcccagcactttgggaggccgaggcaagtggatcacttgagaccatgactcaagaccagcctggccaacatggtgaaaccccttctctactaaagatacaaaaattagcaggtgtggtggtgtgtgactgtaatcccggctactcgggaggctgaggcaggagaatcgttgaacatgggaggcagaggtttcagtgaggtgagactgcactactacactccaccctggtgacagagtgagaccctgtctctcaaaaaaaaaaaaaaaaaaaattttttttgtggtgacagaagtcattcaaatcagaactccatgcaacttatttttagttgtctgtatagatggcactatgtgttatgtgattaaatgatctagaaatgtgatgacagcttgtattgctctaaaaaataaattatagctctcgtgattttggctcaattccactattgcttcctgactgatgtaattcatactttggatcatatttttctatgtgatctaaagtgtttacttaggcttattttggcatgcttaaaattttcacatcctacttcacaggattgtgctgaattcttcctctgtttcagccactacacgcagccatactggagttgaattgttgggcttctgaaaactaattaacctgacaacccttaaaaatagtactgcataattgagaatggcctatgataaaggtctgcaacttgtttcagtcagttacatttaaatctaattatggtgagattacaggtgagcttattttattccaagtttctaaaatgaataggcatttctttaattttttattataaaacattcaaacatgataaagtacagaaaataatttggcatattcaattcaactagtcagccatccaaacagatgttaccatttttctataaccaacttaagtctttttattgttgtttttgaaaaataaaatatttcagatacaggtaaaactaccagctgccaaatcctttcccctcccttctcattcccccatggttaccactatcttgaagttggttgtatcattcccaaacatgccttatattttctactgcatgtgtgtatatctataaacaacatacagtattattttctgtttttggttttatatttgtggtatcatattcttattaatcattctgcaatttctgttttttttactcaatactatatttttgagatttatcacatttatttttcaaatccaatttattcatttaactgttgtacagaatcctatttatattgcatatataatctatagtacatttatttactgctgatgaacaattatgttgtttaccattttttgctattacaatgctgcattaaataccttttatgttacattgtttacaattttttgctattgcaaacaatgttgcattaaatatcttttatgttttcttgtatacatgcatgattcccttaggagcagaactgctgggtaatagtaagagaatttcaaccataaagtattatcaaattaatctccagataattataaattggattatttataaaaatactgtgtgtgtgtgtgtgtgtgtgtgtgtacatagatacaaataagcctacctgtaggagccacagtatgtagaacttgttactttgtaacaaaacaacagagcaaaatggaaatagaaggccaagatctatgtcaatgcttttgaagagtacaaattttaatggggtgagctctaagacaagctcaaaacagttggttaaaacaatcagactcaaccactgtattgacagagccatatgtaagtagggtaggaatgcatattaattaatggtgattcttcaagttcccttcttcaggctgggcatgggcagagacatcctctcaaagactcaaaaaaaccccttcagtccttcacatcaggctccaaagcttcctcttacattgtgcatcaaatccatcctcatacaagttctgattaaagcattttgattgtttaataactgtttaactgtttatttaacaactgttgattatttaaaataataataataagtacatacaaaggtgatgtctccgaatctcaagctgtcaaggtaataaggtttttaacaaacaaaagaaaaccacccagtttcgtccgtggcagtaatctatcttttctaacatgttctgttaaaatgtactatattaaacaataaggtaaacgttgcaaacttcagtgatggggatcaaaacagtgctagctttaacagacttatttttagaacattgtcacggtgtccttatatgccctataaattactatgtccttcagtgatttggattatttttttcctgccctaatatcaaattaatctccaaataattatgcaaataattataaattggtattatttcatcaccatagaaatggtgtgtgtgtgtgtataatgtgtataaatagatacaaacctgagggatatgacacattgcagcaatgtgaagcaagagaattttaaaaatcaccctcaatttcaggtgattttgatatgctactctcctttcacctcactgagaacagatgttgcagtgcagtggttcttgattttggctgcacattagaatcacaggggagctataaacaaaattctgacttaatttatctaggtggagcctgggccctggctttaacaatgctccccagacgattctcatgtgcagccaagggtgaaaagtaccactttttctaaagctatggttcttgcattttagcataccccagaatcacttgataaaacacggatggtggactccatagaacttctaattcattaggtctctggtggggccaaggatttgcatccttacaaattctcaggtgatgcagatgctgatgctgaactctggggatcacactttgagaatattgctctaaaccaaaaaagattcatcttccatccatggagacttctaacatcttttagaaaagctttcacaatattcatgttaaacagttcttttgctattattcaacattttatacagaattagctaactacttccttttttgagtcaatcgatgctcaccattaaaaataaccaacaatataaattaccaaatgtcaaatatgaaagttccttgtttcattctaccacctactcatgagttggcaatttttttttctgtaaaaggatgaatacaaatgtttttggcattcagctatatggtattcaactgtgcccttgtggagtgaaagcagcaatagataatatgtaacgaacgggtggctgggttccaataacagtagagggctggatttggcacaggggccatttttgctgactcctgccctagagatattcactgctaacgctgtcagatgtacattttcccaacattttctttgcttacataaacctaaatgtcatgtctgtatgtgcaaataaaaatattatatagacctttttgtatttcttttgtgtgtgtgtgtgttgcagcgacaggttctccttgtcacacaggctggagtgcagtggtatgatcccagctctgcagccctgaactcctgggtcaagcgatcctccaacctcagccttcagagtagctaggactacaagcatgtgtcaccagcttggccaatgtaaaaaaattgtttttgtagagatgggggtcttgttacattgcccagctggtcctgaactgctatcctcaaacaatcctcttgccttggacttcctcaagtgttagattacagctgtcagccaccacatctggccccatttgtttctttttaaatgaaatcatcataaggcaaaatttattcattagtttggcaaagagtgtaataggagaaaacatgaattttaaacattgttatatataataatgttcatcttaagcagatatatttgtattagcaaaaaacatagaaacacttaagggtccatcaaaaggggcttatttaaataaatatagtatagccaataatggaatattataggtatgttgaaagaaatagagtatactgttatggaaaaatgttatggtatattagtaagagttagttaaattgcaaagcataaaaaatagttttaaaagcaattctactaggagagtatgtcaacatttccagtttgacataaaatatattttatttttattatttatttttgtgacagagtcttgctctgttgcccaggctggagtgcagtggtgcaattcgactcactgcaacctctgcctcccaggctcaaggactgtcttgcctcccctcccgagagctggaattacaggtgcccgccaacacgcccggctaatttttgtatttttagtagagaagggtttcaccatgttggttgggctggtctagaactcctgacctcaggtaatctgcccactcagcctcccaaagtgctgggattacaggtgtgagccaccgcacccggccaagtaaaaatattttaaaacctactctctatctagcttaagcttccacatgtaaaacattgagagtgcttattttatccactgataagatatcatatttgattcctaagtgatttaataatttttctatgcgaattctaaagcgagtgaattgatttctgcattgtgcctttcaaagttttaaactactttgctgaacatcgttattgtaatcacctgggaatgccagctcattgttcagagaactagtttccaggtggaactgcaatttagtccaattgaatatggcagttttcacacaactctaggagtaggaacagagaaagagaatgatgtaaatatgcactgcacagaagagtccatgctctttcagcctgtaatttcccattctcacctgtgggcacattttaagacagctgtgattcatggcaatacattttgttgtgaaaaatgaaagctgcactattgaatgataaaattaaaataatgcaaaagatggattgttaattttttttaatgccatggcagatgcaaatgttcgttttgatgtctgttttgaggacctgaaacaaggcttttaatcaatgtattatacatcaatttatactgttaacttctgattattcaaattaatattcatagagaaatgtccaaagtttacatctctcagaattctgtccccccacactcgccattaattatcatgcctagaagcttttagtaaaagcagcagttgtcaggctgacggaatctgacaggccagcaaggcccaattaacttgcgctatgtggcactttgatgtccgggaaacgaagaaagataggggcaaattgggggcacattatgttaatgacttgatttaatccagccactaaactttatgtagcctgttaaaaagatgctaacactaattacgccactttggaaaggaaaggaggggacaagcatttcatctgacaaagtgaagctcataaatgttgtaaatgaaatgaaacaaaatgaagtaatctatattaattatacatcacagacatgaagaaaagagaaagaaccaagtaatacgtagaagtatgggaaatctgttagattccttttaaggatcaacatttctaagaaataactaggaactgcagattctgtaacatgaagaaaagaaactgatcttaaattgcttacacagtatatcagaaattcaaattcacagtgtaactggcataaatgatacttatctaggacactacttctagtctaattttgtgacattataaaatagaggcaattttttaaaaagtagggataactatagatagggttatctaattcctttctaactagtttgtgcctctaatctgttttttacattattacagcatgatctttcaaaatgtgatcaagcatgcaaactccttaagatcaggagcttaatttttgtattcgtggatctattcccagtccctagaacaaggctaggaacacagcaaatgccactacatatatatctgtttaatgaatgggtgatcttctatccccattccttaaaaattcagaggcctcaacgctctggattatgcctcccttttcagcctattctcctgggctcccaagcataccataataggcttggcccatcctgaaaccattctgaattccagaacaagccagcactacgttctctcagattctcatgcttttcattcctttggcctatgattttctcaccttttcatgaactcctaatcatcttcaacactggctccagctttactgactctaggaagtatccttgatgaagggaagacccctcatgctgacttagggaccccttctgaatgctcccaagcaccccatgcattccattctcctggtgcagaccactatgcattttaattgtgtttccctacagactatgaattctttgagggaaagaactgcttcttttatgcctgcctgacacacatggatgctaataaataaagaattgttgtgaggaaatattaacataggatgtacttagccataacaggcattcagtaatacattccttcctatgaaagctatgtttcactgttctgagtttttaccagaagcagttcttagagaagacaaaagaaaaaactaatgaaccacaagtattttaagcttacaaaaggatttatgaaacaacacttcaaccaaagttaacaccatcaatattaggcaaaatgacattttctacctcctgatatgatgcaatgaagagcacacagtatcgttctgtattcctaccaaaatgcataactggaatctgatcttgaggaaacaccagacaaaccaatgaagaatatgttacaatgtaaatggcctgtattaaagagtatcactgttataaacactacaagaaagcctgaagaagcattacagattaatgcaggctaaagaggcatgaaaagaaatgcaatgtgtgatctggattggatcttggaccatatgaataagatgctataaatgtattactaggacaactggcaaaattctaatgaaaaccgtagattagataacaatattattaattgttctgaagtgtttagaattaaaggggcatgatttctgcaacactcaaatggttataacaattatgtatgaaagaatgtatgtttataagtaaatacctaagtatgtgcactaatgcatatataggagagagactagaaatgataaaacaaatagagtaaagacttaaaatcatgaatccaggtaaggaatatacagaagttctttgtaccacttttgcaatctttaaagaaaaggttctattattcatattaaatgatttgctaaagtagtacacacaaaaactggtaaatcaatagaaaatcctgtatttcactgtcttagtccatttgtgctgctacaacaaagtacacagactgggtaatttatgaataatagaaatttatttctcagagttctggagactgggagtccaagatcaaggtgtcagcaggtttggtgtttagtgagggctgctctctgtttccagatggtgccttgttgctgcatcctcttcagaggaggaatgctgtgttcttacatggcagagagcaagataacttctcttcaatatcaagccctttcaaaagggtgctaatcccattcagagagctctgtcctcatgacttaatcaactcctgaaggccatatttcttaataatgttgattggggattaagtttcaacataaattttggaggggacaccttcattcaaattacatcatagccattatgatttcttgagttttgttcccaggctttcagatgataccattttactaatttggtatataatttaccaagattaaatttcacctgttaacaatatgctatggtatgaaatggtttgttcgtctccaccaaggtcatgttaaaatttaatccgcagtgtggcagtgtgggaggtggagtctattgggaggtgtttgggtcatgggagcaaatcccacacgaatagataatgccctcactctgttagttcccttgagagctgattgttataaagaacctggcaactccacctctctctctcctccttcctctcttgccatgtgatctacacatgctctagctcccctatccttatgccatgagtggaagcagcttgaggccctcaccaaatgcagatgccagtgcatgcttcttgtacagcctgcagaactgtgagccaaataaaccacttttctttgtaaattcccagcctcaggtatacctttatagtaacacaaaacaaactaaggaaacataggatgctgtcagtgactgctgctgaaaatagaattttttaaagcccatgggagctgaagcatgaagactgcttgctttaaatgatgttcacatttgagatagcatctgaaaccattataggaaataaattttggaatggtagtgaagaccgtatcaggctgtagcaaagtaagacaaattatttcccttaggtaatgagaaaaaaatccagtttattagaaagaaaaaatatatatgtacattgaattattggaatatttagagaaacagttatttattttgctaaacttctttgttaaattaagtttattctaccttagttaagagcaatgtacaacttcactgagatgctagccacgttccaacatacacatggttctattgcaggtctaagtaggagttttcatagattggatgctgtattgtaattaataaatatataataataatgataaaactttggacagataaaatgttcttttgtatttatcaagaacagaaacgatgggtatctctatttcatggaggaatctgtgacacaactgaaatgttctgttctattgttttgctttatttctttattttttgagagacagatctcactctgtcacccagactgcagtgcagtggtgcagtcatagctcactgcagccttgactcctgtgctcacatgatcctcctgccttggcttcccagagtgttgggatttcaggtggaagcactgtgcctggtctgtggttttgttttaaagagagattaaactaagaatgtgtgaggaagagttaaaagaaatattccaattcttatcaataaactaaaaattctacaaaagtcaattaatcacttaagaaaaattaacatagatgaatagaaaaagctagagctttttacttacttacatttactttataaaaactttttccctcttacaataaaaaatgctctggtaaaagtatacttcccatatatattttaaaaaatataattttcttctcaaaatttcaatttactactacttttcagccatgtgctctaagaaaagcaaagtataccggcacaagattaattgtttctaagaaggcttcacttgttttggcagaaatgaaataactgtaacatattatcagtgatatatctaggtaagagtagtctatgaattcacataggcaaactattatagtttcaaaagcatctcacattttgaattctttaaagttcaaatcttcttcaacacatcttggtatgcagtcttgaaaaggagtcaagaagtcagctagtttcagcaagtagctattggaggtacagtttaaggtactctttgtgaaaataatacttacatgttatagtccattacataatgaaacatacataaaaatttcttgtagtagatgactacttggttaagattatgataaacattaaatttttccagaaatagttttccttaagatttttatatatgaagactacatatgtactgtgatgaaaggcagccttatttcagaacatttctagttggcatcaagttactgacctgtttgtattcttggagataggacctggaataatacagtcatcactgtcagaagctgacatgtcccttcaactgtttaaaaaataaaagggtaacatttacacaagttaaaccaattctacttaaccctgtaaaataaagagaaacaagcacacaccataagataaccttaagaaacatggtattatacctagatcttttttagtagcaaatttgtttacagacacattacattttagggaaaaaaagactaaaaatttcaaggttaattttggtagaagcaaaggaaatgccaataaaaaacagcttattgtgaaatttaagaaaaaaattttaaaaagagaaccatagggtaatagatttttttaacagtctgaccagtaatgttatgtaagtcaatgctattcttattattttaaattttaaaatttttattgctttgttgaaataaaactgacagacaataaactacacacaataaactgcaatatttgacacacacacacacacacacacacacacacacacacacacacacctctttaattacttttagagacagggtcttgctatgttacccaggctggggtacagtggtattcacaggcaccatcatagcacactgcagcctcgaagtcctgggctcaagtaatcttccttctcagcctcccaagtagctgggaccacagatgtgcaacactatgcctggctaaaatagatgttttgacgtaagtgtaactgtgaaaccaacaccacagttaagacagtgaacattccatcacctcaaaaaatctcctcaggtccctctgtaatctcttcccttctgcccctcccattcctattcttacagattgtttgcttttaccagattttaaaaaatacagtaagtggtatttttggctggatttcaatttttaaaaagtcaagacctctacgctaatgcaaataatatactgaactcaaagagaacacaaaactgtttaaaacataaattgggaacatggtcagcataacacttgtattctattgtggagctccaagttgaaataagaagagatacaacaattcccctaactacaactaagaagatggaactatattctatcatttctgtcaagaaacaggtatgtgaagtagacgctaccattaaatgaagatgttctatgatgcatactctaacagataaacaaagcacagggttaactaaacaatgttagtttaaataagaaagtcaccttctggttccagtcctctgttatttctgtttcatcttcagaagatgccaagctttgttctgcaagctgacttcagatagtaaagacacatcatcttttccttgctgcattttctcagtattctcttttcctcatctacactgccttcttgtgaaacctgaagaaatcaaagcacactggtatatttaaattgcttagatcacattttatagcattattgctggaacagttgaataataaagcatgtaatttgagacttaaatatacagatatgtaatatgtatgagactcagaaaacaaccacttaatttgtacaaatgataatatatagataaatggaaatctgaatatgtactaagaataaaaatgtattaatctcaaaatgaattttacattaagactttaattcaaatattcatatattcctgtcaatagcagtataattatggctgttacccttgtcatatttttgactttctattcaaggaagtcatatataaaaataggggaaatgctatgacttcctgagtcatgtcaaaactataagacaaagtatttaagaaccaaattaaaccttccaaaataattttaacacaaatgctaccttgggaacatgtggaacagtcagcatattaatttctatttctggtatatgctctactctggtgaaatttccttcctatcttcaggaggaggagaagtctccttatattaatgtgaaacacgcatgtatgtcattttttatttattactaaatcccaaatcattctatcatataatattgaactactaaaaattggcagcaaatgtaacagttactcatatgacactgaatttcttagtatatttcaataaaatggtatttatattctttaaaatataaatatatatgtaattaagaactgcaagtttagttcattgaagcactgtttacaatagcaaaaaaaaactgagacaatgcaaatgttcaacagggcattagttaaataaaatatgctatatccaaatacctgattctgtgtaactgtgaaaaaaaaatgatgtagacctgtgtttattaacattacagagaaacataacatagtgttgagtaaaaaagctacttatagaactatatatatagttgtattattttgattaaaatacaaacaagcaagcaaacacacatatgtgtgtatttccatgggaaaagtatgaaaggaaattcatccaaacagtatctctgagttttagatttgggaacattaactttattttcactgttttttttttcttctttgtattttctaatatttctatgatgattataactactcatgtgattttaaaaatgtcatatgctagcataggtatgtattccttaaaatcatgtcatctttttatttcatcaaatatgaatttatagttagctattattcctgggttaaaaacgaatgtttagttttaaaatacagcttatgacttttactatttttaaaagtaaacaggccaatataggaaatgtaaaagataaatataaaataaatcaatataaatctagtactcatggtaatacctattaaacttcttagatttctatttctttaaaactaatttttgatggaataaaaattttggttacacaataataactgcattataaatacaatatatcctgttgcattaaaaaatttaatatcataacataaatattttctcctgatatgaaacttagaaaaacatattttaaatgacaatagaatattatattcatgggtgtgccatggcttaatgaaccatttactattgttggacatttaactagttcacagtttttaggtatcatgactaacattgcaacaacacctctatgtttatgtctttttaatgttagtggtcatttacttaggaatcaggctatgtgttcaaatcccagttctaatacttgggccatgaacaagttacttaacctctctaaaatcactttccctatctttaaacgggaataattctagtatcaactacatagggttgttgtaggattaaatgagtccaatgtatataaagcacataacaagcactccataaatactagtgtaaaacatctactgaattataattattgaattcattatttatcacatacatattaaatgtctgtatgtgccaggtattattttaagctctggagagacagaatattttgatgtgggtgtagttacacaggtgtatacatatttaaaaatccattgagctctatgcttaagattgatgcctttactatgtaagttatatgtgaattacaaagaagatatattttctaaaaagtccacacagagaatggtaaaaatctgaatacagtatatatttttaaagtacagctgacacctttgtggatgacctgggtgtaggggtgagaaaaaagaggagtcaagaggatgcctccaaaattcatgcctgtgcaatcaagtgaatgattatgtcatttacagagaatgggaaacagtgaagaggcaaaaattttggaagagggttggtataatcaggagtttggtttctgacatgttaatttaaattcccattaaacattcattgcacattaaataggtagtaagaaaatgaatatgaattcagcagtgaggtctagactaaagattataaatatgaaagtgtcagcgtatagatgctttttaaagccatgtgactgtataaggtctcttaatgtagatatggattgagaagacgttgaggattgactgcagaggcacgacgatatttaaacatatgatcaaggagcatgagaagataacagtaaagttggaggcaagctaggaaggcatggtgtcccagaggccaagagaagaaggcccatatttcactgtcaaatgctcctgggagatgaagacaggcactgagaattgacactgtatatggcagagagaaagtcgctgtgaccttagtaagagtagttttatgaggataaagcttgaatgaagtgagtccaagaaacaatgtgaagtgaaggagacagaatttagacattttttgaagacttaaaaaaaaaataggagcagaggattggggcagaagctagagagagtaagggcccaaaaaagggtttagataaaaaatttgaacagttaacacttatatatagtgcgaaacacaaagcaatcactttaatgggaaaagacatactttattcacctgtttccattaaatcaggtagggaataatatgcctatataatttatttcaaatatttgttatgaaaaaacagtattttcagtgtctactacttacatcactctgatgtggcatgatatccacgaaagaaccttcttatctacaggtgttaaacgttgtcttggtttaggtcttggtgcctaagacaaccaaccaatgtgtcagactgagtatgatgaccattagatttcagataagactttagctatattattatttttttttggtgggggtggcagcttagttcttaagctttatattcaaaatttatacttgtaaaaaaattaaaagtcactgatactcactaaaactagtgtgctaacagagatgctggaggaagtctttgaacaacttctggctcttcgctgcgaatgaaatttcctaatcttcagttgttattgatccacttggtggaaggtaagcaaatttccatttcaatataactggatggtgccagcaggatgcttttgatggtctgttaactcaaatattcctgtcaaattcaataattttaattaatgctagagtgaagttttattactgtaagaattaaagaacaaagactactccctactttaagagactcatgctctaccatgtgaactagccaggtggttgtacccctactttaaaaataattttggctttcactcagaattcagatggcttagagagtaaaaaaagacaaaatgatctatgacaggctcatctctcaagtagatctccttcagaagttaagcctcaaagataatactgattcaaagatgagacaattaatttataaataacttaattcacgaaattaaattcagacattattcagaattcttagccttccttcgtgaaggctcaagtatctccattttgacttgaaagtttttgtaagtcttttggcttgtctctaaagaaaaatatataatactttaaaatttcaaataatttacacatttaaaggaaactgtatgttaccatatattctattataattttaaatatattttgttgggatttgttaaatcactccaaattaatagagcacagaaaaagcccataaaataaatggaccatctacaacaaatagcagtaacaaaagaacttgaatctgttatattgagtctcaaattttaacagttgcactggatttttgggtataaaaaatctctgacttaaacaaaatctatatatctttttatttttttttttaaatagacggttctcactacgttgcccaggctggagtgcagtgattattcacagatgcgatcatagccactggccaccttgaactcctggcctcaagccatccgcctactcagcctccggagtagcgggactacaggcaccggctcaaacctaaatttcaagcattagcttttgcttaagagtatctttactttgctctcaagtgttgatactccttttaatggctggctggaaaaaaaaaaaactcccaaactctagactttgggtaggataaaaggacataagtagaacatgaggtgataacttttataggcatagcaagacttccagaatggctaagtaaaaagctcagcaaatcttcttaaaaaaatgataaaactggacaaaatggtcagaaacaaccatttaaggagtctggaaatgatcaaagatactggataaattgagaagcatttactcaagaaaatcaactgcacctcataagaacagtaggaatctgtgggactgctctcatcttaccctttctcccccactcccatttggagaatttctgccagtctaggataggctaagaggactggcagcctctgttgtaggggctgactatatgtggagcaaaatatagataatttcatgcccagaggcatcgttaaaaacacagcaacctcaatggcaaacaatcagagaaggtcaacatcacagacagcctgaggtctaatactggttggggcaagccaaaacaccagaaggccagccaacaatttaaaagggaaatcaaggaataagatatcagaagtgggcgttggctgggtgcggtggcttacccctgcaatccagcactttgggagctgaggcaggtggatcacttgaggtcaggagtttgagaccagcctgccaactggccaacatggtggtgaaaccttgtctctactaaaaatacaaaaattagccagtgtggtggcgggtgcctgtaatcccagctacttgggaggctgaggcaggagaattgctgaacgtgggaagaggaggttgctgtgagcccaggtggcaccactgcattccagcctggggacagagcaagactccatctaaaaaaaaaaaaaaaaaagaagtgggccttgacaagagctatttatagctcatgatgtggaaggctatgggcacacacacaaaactgtgtaaatgctcggagaaatcaaagaggaccctggtaagctatctgtccctgggtgaatgagaggtctagtaattcggaaagtaaaagctgaggcaggcttgtagactgaactttgatttgaatgcatccccatgccacacactgacccataggcaaaaggtggaaacctactggctcaaggtgtttaacacacctttgaacaatcactgactgaccactaagctatgctgacctatggttaaaagtgaacaaaaagaaaaaaagaaacaaaacttagctgaaacatcagtggctatacacagcagagaaatagattctacagaaatagtccaggcaagtcaccaagcaaaaatagcaacaataacacctaggaaatgacgttacaatatattatccaaaaatgtccagttttctacaaaatactatgagacatgcaaagaaataggaaaatgtactgcatacacagcaaaaaaacccatcaatgacagtttttaaggatgaccacatgttagacttggcaaagatctcaaagcagctattatcatatgttcaaagaactaaaagaaagtgtgtttaaataattaaaaggaaagtataatgaaatgttttatcaaatagggaatatagtaagagattataatgtttgggtgcggtagcatggcctgtagttttagctgctcaggaggctgaggcaggaggatcacttgagcctaggagttaagtccagcctgggcaacatagcgagacccctaattctggagttgaaaagtataattacgcaatgaaaaaattcaatagagggttcagtaggaaatctgaactggtagaagaaagaataatggacttgcaggttgattagaacagattattcaatctgaagaatgggaggaaaaatgacaaaaatgaatagagcctcagagacctgtggggaaaccatcaaacataccagcatatgtacatgtactggaagttcaagaaggagaagaaaaaaagaggagaaaaaaataactgaaaaataatggcagtaaactccccaaatgtggtgcataacattacactacacacaggaagctaataaattctaagtaggataaatgcaaaaggatccacatttagacacatcagtagaactttgaaagccaaaacaaatagaaaaacctggaaaacaacatcaagtatgagagaaccacataaaattaacaactgatttcttatctgaaacaatggatgccagaagtaagtggtctgattactcaaagtgcagaaagttaaaaactaaactgttgaccaaaaatattatatacagcaaaccatccttcaaaaaacaaaatcaaaataaaaacattcccagataacagaatcctcccaactgagagaattcactaccagtagacctaacttacaagacatgtcataggaagttcttcggctgaaggaaagagacaggaaatggtaactcaaatccacacaaaggaatagagaccaaaaaggtaattacataggtaattacaaaacacagtataaatatacattttatcttttctctcttaactgatttaaaagataactgcatacaacaataattgttgggctcataacataggagaccaaatatatggtgacagcacaaaggaggggaaggaaatggagctatattggaatagaaactgatatcagacagtaactcaagtctacaggaagaaataaagaatatcaaaaatgaaatatgtacgtaaatatcaaagtcttctataattatatattttctctcttctcttactctcttaacctctttaaagaatataagattttataaagcaatgattataacattgtactgtggtatataatacatagagatgcatactatatacatatatacaataataattgcaaaaagagatgagagaatgaaattatattagattttctatattttaattgaattaaatatttaataaataccttaagtatttaattccattaagttagtattaattttaacttaatactgggaaagatgcacatagagcgactagtaagaaaataatttttaaaatatagtaatataggcctaagtttaaagactgagaagaggttagggtgattagttataaacgaatcatatccataacctaaggtataattttgttttgtttttacaattttatagattcaaaaacataggcttaccgagatacacctgtcatgtgccaacgaaatcagaggcacattgacttttcctatgtaaatttctcctgggtatcactatcatcaaaaacataaaaactcagagactctgacttaaggtacgatccaagtccatattcattggcactgggaaatacatatgatcatcaaactgtggatcttgctactgggaatgatagctgtatcatggtctgcaaaatcaaaaaacttgtacacaactatgggtgtggctgcaggtggcttgctcgggactgcaggtggttgcaacatcttattgtatgtgaagttcatttaagttgccatctgtggaatctgtagaactgagttgagcagttttggtgcttgctgacttaactggaaaaacatacatatttatattaaggaaataacacagttaaagatgaacagcagctgccaagccccaaataagataattttgtcaatgacaaaagctgatattttcacttcataatttctcagtaaaataaacttttattctaatggaaaatcaatatccctagaacatgtatgaatagatgatcctgttattagcaataaaccttggagactgagatacatgtagcgattggtgctaaaatcaaataaaaccaagaaaaatgttaatctgatgtcttcaattctgttagataactaaagactatagtgagcaatgggtagatagacgaatgtctaactaaaatacattcacccgcccacccagagtaatgattctgttatatttgggttggcctcatcctgaaactgttgggatttgaggaagcagatacctgaggccaaattagccagtaaacaaagtctaactgttacgagaaaatgagaacagagtcagagacaaaccttgaagggaaaagagccaggaccgggaggatacttcaggagagagatgaacaaaaggagttattaggtgagttggaaactactctacggttcctttggaactattatggagatggacggcacacagaattttagaaaagtattgtgctgactgttaaatcttccatggctgatgtaatctggaacaagaaaatgctagtgtttctgtgctttgtttggtttagtgctggagtctctacattccacaaggcatccctctgcatttctgaatctggattgagcatctgggaccctgactccatgagagtttattggaggaggaaaaaataaagctgttgtcataatctccttagtggacaaatctgtgtgtggagaggagaaatctaagacgtgaatcacaatattgctttcccagggctagttgccctcagcaatagaaggctgagaggaatgactgaaaaagtacctccacttctccccttaatctacacaccagagctgaaattccaccaggaaacaacttattcaagtcagaatctggagtctaaaaagctttaaactacaaaaccaaacaatgtggtctccttatctctaactccctccccataacagcatttcccaaagtatgttgtaaggaatactggccagaaagatggtcttggaagcaggtgcactctttcttaagtttgggaatcagtgtgatattagtcacgcttcttaactgaaagtcatagaaactaattctatttagcaaaaacaacaaaaaagggactttaagttacaggcatatttcacggaatacatagtagaaatatggctggaccttcggaaggcagggcctagaaaccagcagaatgtcctctccatctgatctccatttttttctgtatgtttgtcattactctctttcttcagactcattgtgttaccttcgctgtttaacatggtagatgaggctgcctacagcccccaattttacgtgtccagatatgtcttgctttctcctgatctcaagggcagaatctgattggctcaactggggtcaagtgggtattcccaaatcattagttatatagggtggggagtgaaagaaaatgggatctgctaacgcaaacctggccactgggagccagctccatggattggaggtgaaggagttccaaataaaaaaagaggtaagataattatgattgaacagacataccaaatgtttctactatatcttatccctctgttactcaatgtgagtcatactttacattgcctactaaaattcatgttatatagactggctgcggtggctcatgctgtaatcccagtactttgggaggctgaggcgggtggatcacgaggtcaggagatcaagacatcctgcctaacacagtgaaaccccgtctctactaaaaatacaaaaatttagccggcttagtggcaggtgcctgtagcctcagctacttgggaggctgaggcaggagaatgcatgaaccgggaggcggagcttgcagtgagcagagatcacgccactgcactccagcctgggtgacgagcaagactccgtctcaaaaaaaaaaaaaaaaaaaaaaaagattcatgttatatatgaaactcctaaagtaaagaatcctatttaaccttgctcaattcaaggccttctgcatttatggatcatggaactaatatgaaaatatggtcattaagactccatgaaacattgggaaatgcaccctgaggaattgcatttaaattccaagttcccagaaagagaatattaattttgtatctactttgcagttcagaaacttaacatgaggaaataatttggaagcacaataactgatatccaataacggctgtttatttccttaacagtagaaatttttaacaaaagtcttttgatggtgacagcagtattgtgatgattaatttttcaaaagtgtcctgaatagcacggggcagttctttgtgttgatggaacagctctgtattttggttgtggtggtagttatatgaatctatcatgtgataaaactgcaaagaataattgcacatatacgtacgcgcgtgcgcgcgcgcgcccacacacacacacacacacacacacacacacacaaaagtgcatgtaaaaactgacgaatctgagtaaggtatgtagcctaattaatagtattgtcccgattttgaaattattctatattatgcaagacgttacaattaggagaaattgggttaaggttacaggggatctctttgtatatttttaccacttcctgtgagtatatgattacttcaaaataaaagttaaaaaaagacattgatggctgtgaaaatgattttagtttaaagcacgacacataaataaatattataaaattctatgtcataaaagggtcttaaagccaaatgagcttaccgactgcatatgctctggcccttaaaatttgatgttatataccccaaagcctttgccctttctcgataaagtcgaattcttgatccatgggaactcttaatcggaaccagtattccactgtgccaaaatttgggatgctccttttgttcctacaaatcagtacataacccaaggttaaaatagtttcatacattaaatagatagcagtaaaaatacatcaatggcattatgcattaaaactatacattttatgctagtaaaataatatgacttgcacaaatgatgtgagattggcaaataacagatgaagaaaaagttacttctgaagtatgagtttcattgtatattaaatattattaaagaactacatcaactatgtttgagatattccaatttgtactatttcattccttctgaaatatattttaaaaactaaacattggatcaaatactccacagattctttttgatgctatagtataatacttttttaaacaagttgcactcaatgttgtctgacatttacaatatgaaacctcaaaagtataaaatgacattccacattctaattcaagtttcaagacatctttggcaccttcccatttctagctatctcacaagcataagggaaaatgtcatagctatgccaaatacatgtcccatgcagtcacccttgcacgatgtttgccctgcacaccctcagtactcctctcaactcaggcagctctcatctctcttccatggggaagactttctgtgtggctcccaggagagtagagccctgtgctccttcatggacatcgtatgtccttgttagggcactgacttctttggcccgtctgtttccagcctatttctctaatacgccataagtttcttgagagcaagggccataatttccaccatatactcctactacagggactagtatataaaggctacttaatatttgtcaaatagagatattctatacataaactttcctgaacacaccagattattacaaatattacccctactcttcctactttatcaattttttccctgctaatggatcattctcatcagcatacaaatgtgattactatctgcctgctatagtttgaatgtttgtaccctccaagaatcatgctgaaatttattatcattgttaagagtattacgagtaggacctttaagaggtgatgaggccacgagggtccaccctcatgagtaggattggtgccattataacaggccgagattgaccccttcttgccgctcccaccctctaaccttctgccatgttgcagcaagaaggcccttaccagatgtgaaaccttgatattggacttaggtattctgttacagcagcacaagacacactatgacagaagcatcatttaaaaataagtcctaaaagaataatattaatgtaatatatatttgcttgtattgcataaaagatctttcaagctgggtgtagtggctcatgcctgtaatcccagcactttggagactgaagtgtgggcactgcttgagtccaggagctcgagaccagcctgggcaacagatgagaccctggcttaatgaaaaaacaccccaaacaaacaaacaaaaatctttgaaagaactgcagcctttggtgaggggacccagggtggctaaggaaaaggggagggaggtagacatgaagtctttttgatttttgagtcatgtgaatatattacctcaatcaatcactcaattaaaaaataaaatccgtcctgagaccctaagtcaccctccttccttcttcaaatactttcttacttggtctctggggtaccacagactcgttttcctcctacatcactggccactcctcagttcttttgctggcttttcctcctcttcctgaagccttaattttggagtttcccaaggctggtccttggctaccttctttcctttatttacattcactctctatgtgattttatctatgtcatggcttaaaatatattctatatgctaacaactcccacttttatatctctatcccttctttcagattggtgtgtccagccaccagcctgacatcaccacttggatgtctaataggcggtcagtcttaacttgtccaaacagaattcttgattttctttatcagatgtgctcctttccagttttccctatctcagtaaatggcatcactattcttctagctgctcatgccagaaatcttacttcatccatttccctcattatcacacattcaagtgataagcaagtcttgaagggaagttaataaaatatgtactgaatatgactactttttatcgccactttcattaccatctaatccaagccaccatcgtctttccttgatcaatacaatagcctgagaacggtcctatttccctcttgcctgcttcagactattctttccacagcactcagggtgatttttctaaaagtcagaaaatccaaactcctcactctgacctacaaggctctgcaatatgatctggccccgctatcacttgaatcccccctttgctgcaggcactgggcttactgctgttcctcccactgcaggcttgctcctccctcaggtttttgcacttgctattgcctctgcctgaaacattcttccctggatcctggcatggatcttcattctttaccccctcagagaagcccttacctgaattgcaacctgccatttctccctttagcctctttctctgattaactgttctgtattgcctgattcctctctagaaggtaagctacagggggtagttttgtctgtcttatttaccactgacaccatattcccagtgcctactaacagtgataacataaggtcttaaaaaattaataatttataaatagcttatattattatttataatagttataactattaaaccataaataatttaactattattatgaacttaaattacagttcaatacataaattaatttatttataaataaatacataatttagccaaaaagagtatcaatacaataaacatctgaagttacaagttttaaaaattaatagccattgtactgacatcatcaatgacattttttttttgagatggaagagcgaagctcttgttatccaggctggagtgcagtggcgccatctcagctcactgtaacctctgctctcgggttcaagcaattctgcctcagcctcccaagtagctgggattacaggcatgcacaccacacctggctaatttttgtatttttactagagacggggttttgctgtatttgtcagctggtcttgaactcctggcctcaagtgcttcacctgcctcggcctcccaaagtgctggattaaaggagtgagccactgtgctcggcatcagtgacgtttaagatagtccaattaacttgggtaaagaatgttgtccttgctctaaaggcacctttaatatacaagaaaagatagtatgtagagtaccataacgatatataaaccaaattagtaattcaaacacccaaggcttataattgtacttaccaatcaaacttgctgtacaaaatattcggccgcttttttcaagaatttgtgaaattttaattgacatgctgcaattgtttcatattctgtgctataagcctggtggactcaagggtgatagtattcttctgaatatattgcaaaaataagtcattaacatgaacaaatattgagaagtgaagttatattcgggatgaaggcctcgcactacgggagttgtctgtattcaaaatcatagaaagcataggtacagaaagtgacaggctctttatctccagatgccttaaaacttcagaagaaaaggttactttgttgatatggatttcaaatagattttcgcctcttctaagtggatggtttcatcaaattcatcaacagagtcatctggcatgatttctggttaaatttgtactgcttggtgccataggcaatatcctttaattgggctgcaagagaagacaacagtttagagatttcaaaatattgacatgagaaaatgaaaactggcttttgaagtgtagaatgagtacttctggtgaacagtctctattttaaattctatgactacactgtttttcttaaataatactttatcgtacaaaaatttatcatttctgttttgacatcacttattaggcgcaacaaaattgcaacttcagttttaatatagcctaagccaggaaaaaggggagaaaaaatcaaaagaagaaaagcgctcttaatgaacagctgagataactacctggatttcacctgttccctgtctctgctccacccattgtcttcactcctataaagtcagtctctctttctgcgcctcctttcctttaacttattaagatttatacttttcttcttcgtggggtgatggatagtttattatcctgatcatgatgatggtttcaccgttatatacagaggccaaccaaatataccaacgtgaatatctgccttgcttttctgtgaaactgctccagaaaaagccaacaatatcaattaattgctagacgcaatgaacgctggtccttgtattacttgatttctttactactttgacactgatgacaatctcccattagtgaactctgtctaacctggacttccatgtattcatcatcttctctgcttctcctcctatccttcttctcattcttttgggatttctcttctctgctagttttctgggcttctgtttttaattattttcttagtctacatattctcatgatgatctcatcaacttttatgacttttgtcattattaatatgctaaaggcttccatattatattttaaattcatatttatcttctcaactccattcctatatttctaaagttttgtttaccctctatgtatctagatatcccacacaacatattcaaaacagaatgtatcatactgtctgtttttttgtatgttttgagacagattctcactctgtcacccaggctggagtgcagtgcggaatctcggctcactgcaacctctgcttcccaggttcaaacgattctcctgactcagctcccgagtagctgggattacaggcacctgccaccacactcggctaatttttaaaatattttagtagatggggttttgccatgttggccatgctggtcttgaactcctagcctcaagtatccatccgccttggctcttcaggttaataagcttctacctcatcaatcagggtgaaaaagggccttcacaattttgttccttatagctttctctccaggttctcctcctttttttgatttcctgaattccagttggatggatctacagtgcagtttctcaaatgtactgcaatacgcatatttagggcatctttccctgctttacttactgcctggaatgccttatattacttttcttagtagtgaattctgtcatctttaaagactccatacctactgtgtgaagtcttgcctaatcttgaggtagaaataggcattctctcctcaatgtttccttgatacctttagattttttagctttacactcttcatagtaaaacataaccatttatttacttgtcaacatcttagggttccatgagggtagtgcctcagtttttcctatttgtattctccctgcccagcactttgttaggatgcattaggggcttgatcatgtttatggagtcaatcaatgaattgaggggacaataaaatatgatggttaaaatttagtaaaacttgaaaggaatgaaaatcccaaacactggacctcccttttaaccaagaaaattccattaaacaaatttttattgagtactacttggataaaaggtacacattgctccttgacttttggaaaaccctgcttcgtcagataaagatattattgagctcttctgcccagatcagagtttctgaaagtgtggtttggaaacccctgatgtctctgaaaccattttggggatctgtgaggtcacaactatttttataataatggtaaaggtaatctgcccttttcatttttatcctctcacaagtgtataatggagtttcttggaggtacatgatgtgtgatatcacaacagattaaatgcagaagcagatataaaaatccagctgtttctattaagccagtctctaagaagatttgcgaaatgttaaaaatttaaaaaattttaacaatgtccctcttcttgaagtatttttttgttttggaaaatataacttaaaaaaggtacttaatttatgttaacacgcaataagtttattattattttaacaaattaaaaatatttaacatttttttcacttttgttatgataaatatcaattaagtataactcatgaataaaggcctctcgaacctcaataagttttaagagtgtaaaattactgctggcatagaccactgaagtaatatggtacgtagtggacgtggacgtgaaagagagacaaagaacttatcactgtagaattacattttggttatggagaatatgcaaaactccaacagctgaagaacacttatatgctcccaaacttacagcttctgagtgcatgagaagaaaactgggttggtaagtgctgagctatttttttcaacatgtagtcttgcacctccatctgaatagcttgcagttatttctaaataaatataaaaaagcatgggccccagaacctctaggggtagggcccaggaaactacattttaaagagttcctcaagtgattttcctacttgctaaagtctaaaaatcactgtaaggacattcaagtagagggatcgctaggaataattagaaccagcttcctagcacaggtgagtattagttaggtttcaaagcagggaagcgtgtatcttggaatcatggtagaaaggaggtttaggagagcaaacagcaagaacaaaggcatggcagcgggcctgagcatgacatatctgcaaaggcaggtggaggacctgtttggctgaggtgcacaggttgcttagaagagaaattaaaaagggtagtaaatttgagtttgtagtaatttatgaagtaatttgaaatcttgcttgcaacacgaatttaaaaagcagtagggaattactaaaaattcttgagtagaaaagaatcaaggcttgtgcagtgtctcacgcctgtaatcccaatactttgagaggccgaggcgggaggacgattgagcccaggagtttgagatgagcctgggcaacataggctctacaaaaaaattaaaaattggaatactgctggaacccaggaggtcaaagctgcattcatgagctagctatgaattagggtaaacacagcaaaaatacactgtaagtgcagatttggatgacattatcaactgttataaatccattcctctagttactgtggaccaaaaaatcgtatatgttgtaccttctagtttaggatacgtgcagccctgatatcaagaagatgaacatactgttccactttgagttcataacttgctgcaaattttccatcttacgggtcactgcctcaacctccatctacaaaataaggaaaataagttttaatacttatgattagttctattttcattattcaaagcaactatgattaagcattttctagatcctggaaatagtaggagctatgaaccatggtttcctgacctcaatagcttacactttagaaaattatgcttggcaatattcacaaatcagaagaaagataaaatccagattcccttttatggagatgtgttttcattttgttaaaagctaagacaatacagtatggcatgacttcaggataactataactcactcgcagaatgtgctaaagctaacaaagggatttcattgccactactcattccctaaaatcagggactttaaaaacattatttgtggcgggcatggtggctcaggcctgtaatcccagcactttgggaggccgaggtgggtggatcattgaggtcagagttagagaccagtctggctaacatggtgaatccccatctctactaaaatataaaaattagctgggcatggtggcggcacctgtaatctcagctacttgggaggctgagcaagagaatcacttgaacctgggaggcggaggttgcagtgagccacgattgcgccactgattccagcctgggtgacaacagcaaaactctgtctcaaaaaaaaaaccaaaaaaacccacattatttgttttaaaactatttattctaactaagtacctagttataaggctacattcagagatgtgatatgttagtagattacaatagatgttaatagataacaggtgataacataagtatttagaaaataaatcatcagaatattatagaaaacttactttccccatttagtgtttacattacctgataatctttattaattttgtgttgcataattagcatgtttcttgtctttccagctcttgcaccgtttctgcatgagttgcttgcagctctctcatagagcgttctaatctttattaatttcactatctactttcactaaaaaggaaaggtctccatttttttgtttttttgagcctaaaataaaaaacatgttttatgactgaaacaaaaatttctaagatgtgttttatgaattaatatagatgtatcaataaataattcattgattgatcaattttcaattcattaattgaaaacagacaaaggaagtcctgatatatatatcaggactgcttcattcctatggaaaaaatgaaatttacctgttaatcaaatttgaatatttggatagacaattggaaagttatagagaaatcaaaaaatagttactttatgacatataaaagaatcatgtacattttttttatttcatttgattaaaatctatgctgtgatgtaaaagaagtgtttttttgtgtctataaataacagaatattctagaattaaaaattatcttcttgagatatttataattcaaattttacttagggtgtgcatcaaggtctcttagggcagaaaatcgatgagttaaatagtaagcagataaaagtaaaatgtttgttataattaaagaaagtgctttaaatgagagttttgaggtctggtttaatgtaactttgatgtcattatgaaatatgtatatgctataactaaagtcacctgatcactttcctgagtcttagtagtgttgacatgttacatacatatttgtaaggatgtactaagtttcagaagatgcaagaataattcattctccaaatgtaagggttacaataagggtcatcattatgctgaaacagttgtatgcagacatgaaaatcacgatgaagttagaaccttacctttataagtaggagagcttcactcaattcatcagcattaatatcattccctgcaatagattaagtaaaagctcacaatgagttatgaatggaaaatacaagagacatccaagtattcaaattatccccatgaaacataaactgactgatgccatgaactaacaaacaagtctacaagacattccagtgcttcaaaatgtccctatggaacataaactacctgatacatgagttaataaactgagtaattaatatatctgtatgctttcgctttgtagtatagtgtttctctatgcataaaatattgagataaaaattctgagttttatttcttaaataaggaataattcacctggttgtacaattttatgcgttttttaagttcatcaagttgttgcttttgtccagatactgtaactgtagttctctattctcttgaacgagtttttcattttgatcttaaaataaagtccacacaattggaaaggtaagtaaaaatcaggtttaaggacacatttcaattactttaattcctgttccacaccagtcttgatctagtattgttctggtcagaaaggaactgagctagcacctcgacaaagacagcaggggaatgaggaataaatgaacactatcatggtctaccatatgattcacttgctcatcaaaaacccaagacataagttcacagtattaattaaggaaattgtggcctctgggacttcaaaggaatgttctatttaaaatacctgagaaatgtgtttcaaaatctgtgattttttacttacttattaaggctcctgaaaagcatgtggaaaaaaattgtcttttagttttttaattgacatctttgaattttattttcccaacttagctatagtatttttattaaaacaaggtaatttccagaacatggtaggggggtgagggatgaaaattacctgttgggtataatgtacattattcgagtgatggttacactgaaaggccagattcatcactacctaatatacccatgtgcacttgtaccctctaaatccataataaaaaaataaaaagtaaggaaattctgaatctgtatttagtcaaccatacttccaacaggtctattcattaggaggactggattcttaagccatgcatggtggtatcaataataattcatatgggtgggcatcgtggcttatgcctataatctcagcactttgggaggctgaggcaggaggatccttaagtccaggagttttgagatcagcctgggcaacacagggagatctcatctcttaaaaaaaaattaaaacaaaattagctgggcatgcttgtagtcccatctacttgggaggctgagtgggaggatctgttgagcctggggagttgaggctgcagtgagccatgattgtgccactcattccagcctgggcgacagagcaagactctgtccccccaaaataaataaattcatatggttctttattcactgagttcatgctactaatcagtcggaatggacttggagctagtgctagaaatggaataatggttatgcttgtctaggtactcagttgctatgacccacaagcagggggtagagtagaatttagaagatagcaaattcataaagagactaatttttcactccctgattaaacatgtttagctttttttaaaaaaagcataatagctagcgaacaaatccacagttttgataatctcacgtacttaagtgtactctttgctagagctcactgtcacactcaggttcctcctttgttgactccctgtggactaactctaagccatgtcatctaaagtatctctacaatttcatcctgctctcaaccatttatgtttatcataagtcttcaatttatgttgtactttttgtttccttttcttaaaaaaatgaacacatttgccaagaattctttgcacaaaggatttgcatactgactgcattttaaacaaaaatatgtttctgacttttataaggcattgtttctcaagctataaatactacatataaataaaaatgttaaattacacagttaggaataatttggatgtttttaatgtcatataattcttggcagtctaaaaagtaaaaaaataaaaaataaaaaaaaaaaacctgtgatcctaggcaatacagagacattttacatcaaggctggcgagtggctcatgcctgtaatcccagcactttgggaggctgaggcaggtggatcgcgaggtaggagttcgagaccagcctgaccaacatggtgaaccccgtctctactaaaaatacaaaattagctgggcatggtggcacgtgcctgtaatcccagctactcaggaggctgaggcaggaaattgcttgaacccaggaggcagaggttgctgtgagccgagattgcgccactgcactccgcctgggcaatagagtgagactacatctaaaaaaaaaaaaaaaaaatcaaatatactgttaaacacttttgtcttattgatagaaggttacaaggttatcctagagtataaattgctttatctagtttactaaagaaaagaatatccaggccgggcacgatggctcacgcctgtaatccagcactttgggaggcagaggtgggtggattatgaggtcaggagttcaagaccagcctgtcaacatggtgaaaccccatctctactaaaaatacaagaattagctgggcatggtggtcatgcctgtagtcccagctactcaggaggctgagacaggataagaattgcttgaacctggaggcggaggttgtggtgagccgagatcgcaccactgcactccagcctgggcaacagaggacactccatttcaaaaaaaaaaaaaaagaatatccaaatgtgaacaatacttaaaaatttgaaggtataggttaaatacttgtctttaaactaaaaattcagatgaataataaatatgatttatatgagataaacttttttgttagagaatagaataagtaagtgggactctgtatttgattaaattaaaacaacatctagatagaatggttaggtaacaaaaagaaggcaaataagtccgaagtatgtaaaaacaaaggtactgaggataatataattttattctctggccagaaaacattttagggtttctaagggtgagctaaagtgtaaagggcatgactgttccatcttatccagacacactgtattttgattatcatttctatgttctggttttccttttctttcatttttcagagcagggttcctatatgttattaggtagaaataaacttatttatttaaatgttccagcctttcctaactgttgtttcaacaacgatatctccattcactgatattttttaacaagggcattattagtggaaaaataacttagtgtgagaagacattactgagtacctgtacttaccttctactgaattttatttagaattatccactacatttttcctttctcaaacttttatttgggacataactcctgggtctttaaaaagtactgaaatgctatagttcaaagagaaatatacttgctgaattataataggcaaaatcaaagcactctgtacaagatgaaaaaaacctccttaccttatgatttgacaaaaagcaggtcaagctaaacagcattttattcaatgagataacatttcactcttttaaaattatgttcttccagcacaccattaataagcagatgcagagaacaattcaactaaacaattttcagagcgcctttgtgctaatatcttcagcttgatcaatataaccatatgcattatgctgaattatgcatttcagctaaagatagaaaggactttcaaaagcaagcccttaaacacatgcagttaatttaagcattaaccaaatgcaaatgcatttacatatccttcccccacatattcacacaatctgaaactaatttgtaccttgataaagaggtgagtattctttaaaaataatttgccagttagatgaatgactacaagaagcagggaaacatcttctggcaaagaacacttgatacatgagaaggtaaatgtatgaagacattcaaagtaaaattaaacagtttcaaaatctgtaatacaaaatggagctttctaaatataaaagattttcttaaatagacagtttcggtttttttgtgtattatttccttggaagaaaggttaaaggctgtaatatttttcttataacccattgtaacattcccacaaagaaacgaaacttaaatccttagacttgcaaatctgaggtattcaaacaaaaataactggaaagtaatgttgcattaaaagtaaggattcagttctagcaatttttctttagaaaataatcggataatgtgtaaaaatttgtgtggaaagatactgttttatgatacttaaactgaagctatttaatattcaatagaagattgttaaataatccatggtacatacacacactggaaaactgtaacgccattataaatgattgtgatgtagatttatattaaggaatgattttacaatatagcaaaaaagcacattgtaaaactacatctatcatttagaaataactctgaaaggacataaatcaatattagcagtgattattttgctaatactttgtgggttgtgggattgatttttctaattacatactggactttttcataatgtacatgagttatgtttattattaaaaaaaattcccaatgataaaaaagccactaaaaaagatgaggaataaattagataaattaaaataagaacgtaatacttagtaagaaccctcagaattaattcaacgacaataaacaggtctaacaaaaaaccaagattttaccccccttaagaaaagcttctttgcaaagatcagttcagatatccaaagataacagctttaggattcttgatatctaagtaaacacagaaagcacagaaataaaatggtttatttcatttcctttccgtttaagaatgggcaatttatctgctcttggaaaagaagagggaatatagagcacttccacatttttacctaaacaataatttattgagcaattacaaggcaaagcactctgttaggtatttgatactgcacgttaaaatcaggaactgtatgtattctgacatgaaaacttaaaaaaatccaccaggtcagaaaacctgtcatcaccattttatccactcacagtcttctaaagaaaaagtcataaaaaaaatctatcatcaaatgtagtcattggtgaataaacattgccctagtgtgtttcattgaaattaagactccattgattatgtttccaatttcagacttgctaaaatgtgaaaaaaaggtcacactgaaatttaaaaatgcctcacttataagatgcaactcaatattagagatgttaaaatatgaaaagataatgttcctatagtcagtgaaatatggcattgtggtctaaataaaaacataagaatactaactagaaagtaactgttttttagtgagtatgtattaaacttttaaacattctcatgcaactgaattgaagttttcaaaagcagcaaccttcttagcacatgactcggtttatctagggcatgagcaacagatataacaacacttaaagcaaataattcatttcccctattgtgcatttgtgtgtaatctatgtgtgtgtaacacagtaaaattcagacttctttaattataattcttttacttcatgagatctgttacttatactgaaacttattagtgattattattttagcatggggcacaaactttctggtatttaaggtcactgtcacaaagtagaattagacatctcatcagagatttccctattcgaactctcaaaaacggcaagctactatttctgccactctctgtcatcttaactagtttttgtgccattacacttgccaccacctcacgtattacatatttatttaattgtgttagtttctccctattaaattcatatttcatgagggaaagacttttgtttctattcatgctgtatccccagaaattagaacagtacctagcactaactggtgctcaataaatactttcaactgttgagtaaagaaaggctcagaatttaggaaaattgaacaattaaaaacaaccaaataagaatagctatgagaaaaagcaattcttttggcatatacactaagctgagtatggaaattttgagcaaccactgaattcatgagagtggatgactgtgtctgtccctcatacatgcggggatactggcaaacagtaggcaccagagtaagtactgactgattcaatgaagaacattagatgtctgaaatgagtaaggcagtggttatttcaaatgtacctctttcagttttaatctgtcaaggatttcagttttgtctgttaagtcagacttcaaggcagtctcgagctggcaatctgcactttcagctgttgctcctttaacttccattgctcttcatgggcagcactaaggcactgcaaaacacacgtgacatgcaaggaaagcttggaaatcagcttcaaccgaaataataaagagaaaagcttttagtggcacagagaccactgtcatcatgtcttaggaattagtaaacatatgctggtctgctgctgttgaaaccaaggcgcctttctcaggctgcggttgggaacatgaaagagtttgtgggatgagcaaaggaactggccttaatttagagctctaagtcagaaaagttggcagtatgcagcttttgtgggactagtaaaggaattcagatactgtcatactccagaggaatccacaattccaaaactcagcaattgacatcggacaaaaccatttctcccacatacaaacctcttaatacagagaaaatggactttccacctgatctttaatttgtgaaacttttaaagagtctgtgataataacacgttcacaaaatattggccacaaaatatagcatattgaaccaccagacaatacctccgatattgattaagaagtagtgataatatgtttttgttaaaaaacaaaaaacaataggctaaaaacagttttagatgtaacacgattgaatgaaaaccagtgctctgtgcctgataagaatgacgaaaatagaattactattcctcataaaagtacagcagtttaaaccatggttaaaatttgctaataatcaagacccagcatatagaagaaagaactggttgaaaaataactagacaacgtacagaaagtgtacaatcaacatcgtttatgccagtggttcctaaacgctgacctaaatactggtagtaggccagctgctactaaggacacttagggagattttaaaatgaagatcccagggcccaggtattcatatttttgaaagctccccagatgatagccaggttttggaaaaactgatcttgatctgaatttcagcgaaaaccattatctatgaagcttgatatgactgaataatcatcagcagctttgaccatttatgtattttaagcccagtaaatacaacaaaaacttataaaatcttgttttatacgatgtgaagtaaatggaaaagaaacatattactggaaattgcccttaatgttgctcccaactatcttcagtttttatcccaaaaaagatacttttctgggaggcatagcttctcaaaagagaacattgtgtattcatttcacattttgaatattttactgcctttaagataacatgaccttaaaataaatggaattatggaagcttctctaaatatgacatctgtttcttctattagtgtctcatttcacttatggaaacttaacaaaatataggatctatatatcaattatttaagttattttatcaaaggtacaatgaccaagactttaatgaaatccaaataaaatatgtattttaatactaaataatattcctttttatgtttgtttttaaaataaagaacaaatataatttcatgtatggccaaattgtatatatcaaacacatccacatatatgcatgaatgtgagtacactatgtgtgtgtgtgtgtgtgtgtgtgtgtatatatatatatatatgtatgtatgtatgatatgcatgtgtcttattttattaaaaacatgtaccacccggaaaaaaaaattagcatgtgaaataggcacaacatacattatatcagatgccaaaaattagaaacagtagtgttccatagcattagtaccagcaaaaagatcaccaacagctaatctggcagaaacatcagaagcttatgtgtttaaattaagaacaatttagcggcctgggttttccaaacccacaaaatactatgtaaatcagcataagtcaatctgaatttagtccactgctatcttccctctaaatttagattacattccactggagtttcatgagaaattccttttgaatttactgtattccgctatgttagagccatctgtgtaactataaatggtgaaccacatctggctccattttctttgtaaggctgtacacatgattaaatctgcatatgagaacagtctttgagaactttttattcatgaaatgtttttgtatattgcctatagtgacaactgaagggggatcatagttagtctttgtcacatttcactgttacatgatgttgcaggactgatcaaatgtcagcctgcagtggaatgccattgctgcttgtggtcaccggcatgtccactggcagacatgggtcagcaaactgtaatacacacccttgaccaaaaacatgataaagatctaaataaagccaaagagttcatctgctcctaagatctttccttctacagaagaaactccatttgttcaatgttcaagggcatcctatgtgagagacaggaaagaatatactctaaatcatccataaagaaatccacagtggctggtacagcggctcatgcctgtaatcccaatgctttgggaggctgaggcaggaggatggctgagcccaggagttcaagaccagcctaggaaacatagagagatcccatctctataaaaaaaaaattgaagacccagtgtggtggcttgtgcctgtaatcccagcactttgggaggccgagtgggcagatcacttgaggtcaggagttcgagaccagcctggctaacatggggaaacccacctctactaaaaatacaaaaattaggcaggtgtggtgacaaacacatgtaatcccagcactcaggaggctgagacagaagaatcgcttgaacctgggaggcaggggttgcagtgagcaagaccatgccactatgctccagcctgggtgacagggtgagattctgtctcaaaaaaaaattaaaaaataataataaaattaaaaattagacaggtcttgtggcacatgcctgtagtctagctacttgggaggctgaggtgggaggattgcttgagtccaggaggtcgagattgcaggagctatgattgcgccactgccctctagcctggacaacagagcaagatcctgtctctcttctccttttttttttttaaatcataggtactttatttagggcctaatgaaaattaaattatatttacatcaggatatttcacttactgaaagaagatgatgccccaaatgtacttggatttgatttctgggaagcataagctgctcatatttgatcacatgagattttatggtttctgaaggttacagggcacagatgctcactttacagaaacagaacacagagcatctatgggttcagtagtgctcttttacattttgagaagtagatgactatcacataataaaaacttgatcacccaattcttaaaaaggttaatatcatcttaaaaactagatgaataccttttaaaaaagacattagtgtctctcaaggagttaatacctcaaaatcacattcaacagatttttttgacccagtctcaaattaactgaatcagagttggatggtatgggggcagagggaggggtgcgatggataggcgaagaagctctgaagaggtggtgaaatctacattttaataagttttccggttatttgcatacattatagtttaggaaccattgcatttatcagttacatggccccaaactaactaacttcaaaagtgaagcacagcattactaaattatagcatactaatataatatgtattacataccacagtatagagtttctctctgacccaacagaaagatataattgcaaaaatgtattctcaacttttaaattgaacatttattaaagttatacttacttcttggcaggtatcaaaagtgttttagcatattaaaaaatgctcatactaaaaagtaacatgagggtttatcttcccacatgattctctaatatgtcatatgtcaagtaataaacacattcaaaattatttgaaaaagaaagatgagaatgcaaactgcaaatcatatttttctcctgaaaactagcaattttgaataacaaacaaatgctgtccttttaaaaacatgttatcattatgactaagaaacagggagtatgtgcagtttttgatgaacattagttgttggcaataacgaataacaggtcatgaaacaaaagagctgtaaagaatctgagagacaatgtagacttttgtcgaattttccaactatacttctaaaatgtatcatatatttcaaaaacattatattagagaattctgagttctgttgactattatgtgtgtttgctgggttttgtgcttatgttacattaatttttttttgacattaaatgttttgacactcattacacacatttacttccatatatctcacataacttcacgtgtgagcagcataacgaagtctgcttttagtgtgacaggaaaaaaatgttatgcaagcataaaacattgaaaaaaaaaaacccttcaaatttatactcttagatcatctttaatatggaaagataaagttttatggtgggaaagtaaatatgagaaaaacatgactttccaaaatttcgtttatacattattcccaggtaagtttgattttttttattccaagtaagttgttcagcaaattttcaaactggggagaagtagaaaatttggaagtaatggccatatggactattttcttctatttagactgtgtaaattatttgaaattacaagatactgaagacattgtaaatcagtaagaatttctggatgtataacagttctgttattccatgaatgtttccctccacatatgcaattttccaatgcaattaaaatcagatagtgaagcataacaaaaaaagattcaagttttagagtttaaaaaaatctgggttttagttctaaactagagtctcagcaagctgtgtgactctgcacaagtcttaatttttctggaatcccaatttcctcatttataaagagggatgatatcttctctaatagggtactgtgcaatttgtatactgacatttaaactttcaaacacacatatgattttaactggtgtctgaacctactgttggtaacccttaatatatcagtcactgtacaaagatagtcccaagtaggtaaataacatagatgatacaaactactaaataatgcctatgttaatttaggtaactttccagaagtaaatcaaaataaaagcctatcccacactccttgggtataatttgtttaatttacaaaatgtaaatttaatttataaaaataagacaaagagctaaaaagttaaagatgcacttgtagctcaaatggttattttctgagtttcagcacatgaccagaagtagtagctgttgaatatcagctataacatatgtatttaatatatattacatttgctttcatgtaaacctgtatttatcatttatcagtatcatatactaaaagacttaaaattacacacacagacacacacacacacagatatctgtatcacttaacaaacttagatgtggggtataattttgtttctaatactaccagaagggattaatttctaaataccataattatgaagtagattaagaaacaaaattgaagcagccctttaaaatgtatctgagataaagatgcttgtgtttctctttataaggaacagagacaattgtaagtggacactttgcttttccctaacagaataactctcagttaataagctggggagtctaagaaagagacaaaagaggttcaaacacaagctctattactttatacatttaaaaggtatgggctgggccagtggctcacccctgtaatctcagcactttcggaggctgaggcaggaggatcacttgacccaggagttcaagatcagcctgagcaacatagaaagaactcgtcactaccaaaaaattaaaaaattagtctgacatggtggcatgtgcctgtggtcccagttgctcaggctgctgagtgggaggattgtttgagcccaggaagttgaggctgcagtgagccatgattgtgccactgactccagcttgggtgactgagacactgtctcaaaaaaaagaggtgggaagtgcctcttatgttacttaattttgcttcatcttccttgtctgcaaaatgggaatttgtaatacatacattcagggtgctgtgaacaatttataacaataaatgtagagtatctagcatggtgtctgtagtttatagttagtgttcaataaatgatagcagtttactggcaacaaagtgatatggtttcttagtagtgataggctactgctcaggttaaataacttattacaatgcctttaaaaagttgtatttcctttatacagtttgcatatttcttgctatcatttgttgctaattctttgacaacatgatctattctgacaacagcaaatgcttacatataaaagagctcaaacaagacatgaaagaacacatggaatcacgatttacctgtcataaagtttatcatagttttcctttaaagttcccgttccttttctaaatcattaattctatcctgcagctaaaatgaaaataaaatacatattaagtaaatattatataaaaccacttgggggtaaaaaaaaacattaaaaaacctatatgagagaaggttaacatgttttaatctcgattgctaaatggtagctgctaaccaaccacttatattgtctgcatttaagtcagcattgatttttcccaagttgttaaataaactgaaattaatattcctgttttaatttagtagaaacgtatgcactgctttatgcaacatggccagaagtcattaaagaatatgttaagagcttgctaagtcccgggaaacatagtatttttacttttcaccatgataacttctgtcattatattcattttgtattaatttacaattagccataaagaattaaaagagttaacttttttttaggttcatggttcaaattgtgttgttatcacaatttactctgaagatacaatttctcacattatctgaaatttataaatagctactgcaccttttgtgaataaatgaataaacaaacttacatactgttttagcccatgaacagtttttcagaaataaacggagtaataattacatccctatggctaaaatgtagatttctgtatctagtatttatttttaagttttattcataagtatattttgcagtcacaactttttccttggatcagattactctttatttccattttcagaattctcttttgatgctagtatgagacgtaaaagattctcccaagatcagaacagaatgcaggcatcttatttcacttccattctcttgggaacaaacttaacaggctacataaaatactacgataataggaagatgagttttcaagaactctctaaaaaaattagataatttcacaaaattactgataatgcagaatacaacaccatctcctcagaaacagatacagtcctgttattttgtttcagtatctcaaatgattaaaagctgttacagttgagaaagttaagttccataggtaatctggcatcagtttcaaaatgtggtttcattttactcaaggatctttaatcctttgggtaaacagtggatcttgccacattgcaagtacagttaaacactgatttgccattcatatattaacaactatattttgctgtgtcaaaacaccatgtacataacttataattttaaataagtacaattttgaaatatctctatttactttttcaaaacagttaccaagaagttgtaatgcaacagatggctaaactctttggagcttacctcttctattcttctttcagaaaacttcatagaatgtaattgtttctcaagctgcagcattttaaacgctgctctttaagttgcatgtttaattcatccccatttgccataaagcatcgtggctgattctgagagttctttgcttctaaaagataaaaagaacatctttaaacattatttttgactaaatgattaaatttgactaaatgatttgactaaatgattacattctataaatgaatttactcccgaagttcaccttatacagattattttttacataacaatgatgtatacgtgctacttatccgtaggagacgctctgaacatgtgtgtgacatgaggagaaaatacagggttatcttagcatagagtcacatattttatttcctcctagtttttgactattgatggtgaccagcaagtaaattcattttaacaataactttttttctttttgctgtgttacattggttggacatgctgtctaaaaatgctgtagcatgggtcaaaaatgctgacccagatattcgaactgaagggattcgctgccacatcgtataaacagccttggatggtcagttttaatttgcatacaattaagttaaaatttccaatttagtaaaagttatgaacttttctaatttttcaaaaatggtctatttatgaccatgctgtaaattcaattttatatactttatgtcacatagtttttttttaaaataaaaaaaggtaaagtcttttcatatagaccatataccatagcatgcaatgcctcacctgctaacttaaatctctcaagtcccactgaagtttttttcactcatttaaatgacacatggctattgagccattcaggtcaattttcgtttatcttgtattattatagaacagtatcttcagccacctttttctaggctccacacttcactgaggtgttgggcttaacctctcaattttttaccctatgtcaacttccaaaagagctgcctgtatacagcagacacctgttattgttggtatttaaactaatacctgggttcactgttaaataaaatcaaaattgtcaaagtgataagagaatgtaaaatcatttttcaattcctttcttaatcttaatcttagaaatggctttcaactacagggatttttaaaatttccttcttctaacactgtagatagcactatcattctcactctctcatcagtctccttttacaaactctcatattatgcagaagtaattaccacttggcatttaaagaggttcctgcaggatggaaaacaaaaccccagagcatggctgaaaaatatttaactattgaattcaacagtgaatttaggcttcaatgaccctttgctttgcatcaatctactgccctccttgtctcgggacttcaaagaaagtttacttcacataaattctgctcaactggaatgtcttggagttcattaattccagaaccttgttaattatgcagtgccaacaaatagaagccctcagatggcatattcctgtggggtcaagtccttgttaaaacaaccatgggcataaagaatcccaagtattgtcaacctgaagggtaaggtttaaaataaatacactgatagttgacgttaagagtaatcaaatattttcaggtatggtagtgaccaaaaaagaaaaaaaaattcaaataaaagaaagttttaacagaacatgatactgacctattcattactttggtctattgccaataattttataaatgcttaaaattgagatatatgcaaatatggcaaaacttcagtgctatgtgtccataataaattcagataaaagagttaaaaataaatttccttggtagaagataatttataataaatatggttattattttagatgacacagatatttataaaaagtccaagcagttaattatttctttagtgcttgagtataaataataaacaatatattaagggaaatgatacacatttgtgaatacaaagaacaatcttcaaaattatgttctagtgttatgataattccatgttaaaaaaacaacttgaatactcttttgaatcctttgcatctctgtaacattgtaataaaataaattatcactgtacctctgaagctgaataaattttccttccattgctgaaagagcattgcttttctctactagctgttatgaagcttaatcatttctacattgtcccgaatatttgaccttcagagttgtgtttaaaaaaagagagacagaagtaaaaaacgcaagttagaagaaaatctatggtggaatcacaattttcaactaatgttacatagaaaatatttatatacttgtacatcagtcaatgaggttttggattattataaatgcaggacagattaattatttaaaacaaaccaataatcattcctgactttcataaccttgaactcacaaagtttgaagggagcccccaaacttcatgactatgtacctctacaattgataatatggatttaaaatcattttatagtatcctgaaagatggcacgaaacacaatagtttttagtatagcaatggtaccattaccgaacttcacacttattttaggaggactatcacgctacttttccctaaatgaaaaatatgcaatacagccattcatcttctacaactctctcgacgcaaatggcatcataagattaccatttattggagtttcctcttgagttttaaacttttcaaaatatttgcaaaaaaagtgacttagcattttatactaacaagtccaaagctggcatttaaatatgttgcagatgtgcctttagctgtaagagatcacttgtgtccacagggtatatagaaaccttatatgttacaatactattttgtatttttcctactagattaaagcaaatgtagaatttaacaggaagatcttgttaaaggttaatcatagatctaatgagtacctgttttcaaaaggcatttattttcttgacagagaaaagttccttaatttatacattttatattaaaaaatattttgttaattttgaagcttcatttcagagttcactttaggaaaaataaatgtaaaaaatttaaaatcagagttcaatatttaaagtaagagatttacttttaaaacttatctagtgtacacatattggaaaaattgtcataatgccctactggaccagaaaatggactacaaagctcacacatctgtaaaccagctgaggacttgaaatacttattttcctctttgatatttgaaagttcattgtattttggcattggacagttagttgtcccacacagaagataaacaaaaccatgaatccaaattttgcccagggtacagtcttaacacatgttaaaataattatatgtctaaaacatgttatctagtagttctgagcacatattcaaaatatactcactaatattcactcagtattacctttagccactaaaaatacatatatataaatataaagagaaaaatacatcttaaagtctaaagaaaatattctttttttcatatttaaagccaaaatataatttacttatttgccccagaattacctggtttgaccactcagcagtaatgacatttattgatatgtaaggacagaatgtgattcaaataatttaaaatcttttcaatatttccagttgtctctgatattttatttttgttttaaagtatgataatttatttattatttttttttgagacggagacttgctctgtcacccaggctggagtgtagtggcgcgatccggctactgcaacctccgcctcctggtttcaagcgattctcctgcctcagcttcctgagagcagggactacaggcgcgtgccaccatgcacagctgatttttttgtatttttagtagaacgggttttcactgtgttagccaggatggtttcgatctcctgacctcataatccacccgctcggcctcccaaagtgctgggattacaggtgtgagccactgtacccggccgcagtatgtgatacttttaagaaaattaagatatatttgaataataaccattaattacagtaacacattaaatctctataatccattcgggcacatagggtgatagaaataacagtttttaattttaatttttttgtaaggcagaaaccagtaagcatatgtcaaaaactttcagtggtttaatcgtgggtgctttcctgaatattttcctaaactccttggagtttaaacttttcaaaatactccaaaaacagtgacagggcattttaaactggtaatggccaacaggtaggtataaatacacttacgtagtatttagacaacagcagtaatgtactttaaacaataccttaagtaacaactggtataataatgttgtacttcaaataaaaagtcagtttgctgcagagtacacctttccgggacaatgctaaacttgtaagtctttaataattacttttacgtatcagttttagggacttattattatgactttatttttttttcatgtaacaatgagaagaggaggataatctgttaactaaaagtgctaggtcagtgataacataaaagttcaaatcagcaatgtgataaatgtgtctagcctttaagaagatgtgcaataaaaattacttcaaacctgacaatcaactcaactttttatatagacgaaatatggtacaagaataatgggaggaagtaagagagaaagaggggagagatgtcacaaaaagatgacaagaaatgtgagaaggatgttgtaggcaacacggagtagggtgtttagctaagtgaccagtcctagacctctgtgcttgtggagcaaggcctcagttggtatttgaagaatagacttagggctaattttatgagtaatattttaagtgacctcccacaatatttttttgccctcttctacacactatgacaggaataccaaatcttcaggatgtgacattctaacagaaagaataatgcatggtaaaaacattcagacattcggatgaactcgacagtcatggaccaaatcacacatgctgcattacacatggtgaaatgatctgcaaacaatatcaagcatactaattaagtgctttgtaaaaataaatttctcaaaattttcatcaagattttgaaaaagtcaggaatgattaagttggaaaatgcagtttcttttctctttcctttttttttttaaaaaaacatgattttaaattatgatcaaatcttataaaactatgagaagattgctggcccatctctagattaagaacaaactgaaataaattagatttcatgtccaaaaaaagtaatccagctcaacaacctgtgtgccaagtttctctcatataatttgaaacagtcagcaataaactctgaaaaaggaatttctaatggaagccttgaaaacacttgactccagcttgctactgggtgccataataaatccagaaacctaaaacctcagatacactggagaagtaaaactttcagcggagctatgtaatgtatagtctaatatgaaagcttaagaagcaaaaatttgctccagtgaaagtttcatatactttattccccaggcattcaattcccctcccccacctttgccaacatttcattccttgctaccatattatgaaagctaaaaaaaagcttcctgatttttgagataaaaatgtcatagtatttaacgtcatttagaagagaaggctttaaaaccaaaagctaggctatgagattcggggaagtagttaggtcaaatatttacgacacagaatgagagactgttttgagtaatagttacaggctgaccaaatttggggcataaggttgaaaaaaccttagggttaaaaaaagcactctagattttcttttcaaacagtggcagacattctgagctgtattgttgaaggaaatgtaggtcattcatagtttttattagggatacacagatacaatcagcagcaaggctatcccctatgactagggctacagaaggctgctagtaaactgatagaataagcttcactaaaatagctgaggaaagtctatttgaaagataatgattttgctaaaattgctacttgacttcataggtgaaaacagtgctctctgatttaagattgctcaaagaaaaaaactgtctgtgtatatttatttgcctctgaatcattactttcctgtggtgttggtcaaactataaatcagaactcagtattttcttactcttaccacccacaggaatggagggacagttttgtcagctctctacatgcataaaatcacactcagtggaagggtactcccaaggctggttgggaacaggaagaactcaaatcctggctcatcttcttatagggaccattttacggtcaagtttaatggattccaacttgagatttacagtaaaagaaatgggaatctgattttttttccttttttttttagatggagtctcactctgtcaccgacgatggagtgcagtgcgtgatctcggctcactgcaccctctgcctcctggttcaagtgattctcctgcctcagctccggagtagctgggactacaggcatgtgccaccacacctggcaggaatctgaaccttaagtcaatatttcagaaagcccaataagaaacatacatttactggcaatgaagttgcaaactgaactaatggttttgtgttgttttcatttcttgatagaattgtgccaatccagtgtctaacgcaggttatttaacaattagcagaaggagggattggcatgatacaggtctctttgggaatacaaacagctaatttagtaggccaaatctttctgaacacaaggtccctagagagaaaacagctgttgtttaaaggcagggaatcatttacccatttcaatctaatcattttacgttcaggtggttaactgaggctcacagaagtaaagaatttggccagagaccttaagtaaggaaacaacactcaaatctcgctctaagagttaaattcttcccactcttcaaagttaaatcttcccactcttctaagttttttcctctaagatcttcctaagttttaactttccctccctatcatgcatacactcatatactagtaactattatctgtgacaatttctgtggtttgttaaagtggcaggaggctatgttaagtcactatcaaggaaatatcttaatgttaataataaaacatgaggataaaagaaatggtatttcagtgtgaaaattttcattgggtgaattctaactgttcaaaataacagtcagagcatggtgaatatattttaaaaaatgacagatcactccctgtgtaacaaggtctgcatggctatccctggtcccagttacccctccatcagagaacagatgtgccctttaaattagggggttgggcaatcaggcaaatccaaactgagggacatttgcatacaactgtcaatgggctataaaagagtgggggaccatttgagaacaaaggatattagaagacatgataactaaatgcaacaacacgtgaccctcgactggatcctagatcaaagaaaataaaacaacaacagctattacaaaaagaccaagctgcaaaagacattattgggaaattggggaaatttggatatggactgtgtattagatgctgtggctgtatcattcattgtaagtgttctgaatgtgatagctgtattgtggttatgtaggaggatgtccttgttcctagagatacttacccgtaactgtacagagggtgaagtgatgtatgcacctaatgggagtaagaagggagagaggtgaagagaagggaagtgaggaatgagtgaagagaagagagagagggaggagaaggagaaataggagggaagaggagatgagagatgttgagagaagaaaacaggctagtgaaagaaggcttaagcaagagcaggccgagtgcaaaaacaggcttgttgtaccattaaaaaatatgctaaggggtgaaaggttatgtgagtgctcactcaactattctttccattttctgaaggtttgcaatttctcaaaatgaaaagttgggcataacctagagtgctagaaataatcttgtatctgtgcagaggggaaagagtgagccctgaaagccaaggcatggcgcaaaggcctctctgttgcgagatttgacagtcggctgtccgccaaagggaaggcaagtcagatgtctgagatacttatgggttaaatttcctccactgggacattatggcagttacatgattctaattaagaaggtaaacaccctaacatttattttaaaaaaacacttagtacaaactattacacatttgtaagagtataaatatttttggagttgaaaaaggtcagtaaatggtaaatcattctgattttaatgttcatgtacatgtgttcactggttactgctttgaatttaattaagacggcctttttaataagcagaaaatgtgcatttttatattgtttaaatttaatatgatttttcttcaaaacaacacagacattcaggctacttgtaaatgatataagattttttgtaatgaggcattatgtagaacatatgcaaaaatcacaactcactctcccaaaatagacccaacaacaggaaaaaacatgattttaataaaaaagagcagcactgggctttgacttcaagcaattaagggctttggataaccaaaagtttatgtcaagctgatgccaaaccaaactggctattaaacacatactatgaagagtttctgtaatattctatgaaaaggctctttgccataatatcaagcactgccactctgaagattacaactacgttaggttcatgtttgagaacaagagtccaacatccagatcagacttctagaatttcaaatctgaaataatgtatccgtgaagaaaagtttaaatatgtttcccattttgtgatttttctctacagtaaattataccaagtttatattctccctaacatttttttcaatagttttccattagtctcaaaaaaattgctgtacatataaaattataagctatgtgtaaacatttaaaaaaggcattgaacatccttatttaagctatttcctcaatttcaacaactgtatttcaagcaacaatatgctattcactatagtatctttccttctaagcaaataacatgtaaattttcaattttataagatcaagtgaggtgggtacacactgatttatttctctggtctctgcaataaaagttcctttgcctgtaatagcattttgtctctgctttaattcttgatgtgacaaaaatagactgctacagagtaaataaatagccccctaaggagggacttacctcttctatgtatacatgttggtgtctcttgttggaatatttatagtaggaaagtatgtacccttgtctatcactctatttcttctgttgctctgtttcaggattgaaggacttttgggtttccctttcagttaacactagctcctaaatgatacatccctttggaaaagggaatggccaatacagtgtccaccttacactaaacttgagaatgtaacagggaaagcaatccttgataaccttgtactcagtggttcagtaaagatggggatgccccaagcttgagcttggcccctatatgaatttttatattcagacaatgtcttaaactggctgttggcatttactaagatcaccatattcagtgttgagaggtctggtcctttagcctgtttctcacaaggaaccattcttggtttttaaagtaggccaaatctaaatcttcttctacagaaatatgaataactcataggtattcaagcttatgctttagccagagttcaaatttatcccctaatttaaatatgattctcaaaaatattcatgtttcttttgtcttgcacttaaagggtatataatgtcactagacatataggatttctcatataatttaattttacacatattttttaggaatagaatttttagagataacactaatctgataaatctatgaaatataaacttcttatatatttttagcccactttttttttaacaagtctgatattaagcatcctttctagcttcttcatacattaccacataagtttagtttgttaaaagatgaataaactctgaactgaaatgaaaagccagaaaatcttacttggtttttctaataagaacctaggcatacaatatgatatcaaacttgttggaaaggagaaaagtaagtacagcaactaggtctggtttaaaaaaaaatccagggaaataaaagagacataataaccaaatgctatgtgtagaacttattggattccaattcaaatgaacagtagaaggacatcttcacagaagtttgaatataaaccattattagacgatatcaaagaactactgtgatttttgttaggtgtgataatggcatggtagtatgtttttaaaaattccttttcagacagaaatagaggttgaagtatttatcagtgagtgacatgatatctggctggggataattcgaaaaataaatgtgaggggatagatgaaacagattggtaagatgttaatagttgttaaagctgagtgatgtgtatgtgggggttcaatatctattctctacttttgagtacacttagttcaaaaaaaaaaaaaagaaaaaaatccagaagggaaaaaataattcaagaaagaatatttaaaaagataaagtattgttgaaagcacaattcaaagcagaaaatgaatgaacaggtactaggaaccaaaaaatggcaaagaagaatgggaataaaatatcgtacattataaaatgtcagagatgacaaaaacaagcaatccctatttataagtggtgctggaagaactggctagccatatgcagaaaattgaaaacgggcccctttctacaacttatacaaaaatcaactcaagatggatttaaggatttaaatgtaaaacccgaactacaaaaactctagaagaaaacctaggtgatatccagttagaatggtgatcactaaaattcaggaaacaacagatgctggagaggatgtggagaaataggaacacttttacactgttgtgggactggaaactagttcaaccattgtggaagtcagtgtggcaattcctcagggatcagaactagaaataccatttgacccagccatcccattactgggtatatacccaaaggatttaaatcatgctgctataaagacacatgcacacgtatgtttattgtggcactattcacaaagcaaagacttggaatcaacccaaatgtccaacaatgatagactggattaagaaaatgtgcacatatacaccatggaatactatgcagccttaaaaaatgatgagttcatgtcctttgagggacatggatgaagttggaaaccatcattctcagcaaactatcgcaaggacaaaaaacaaacaccgcatgttctcactcataggtgggaattgaacaatgagaacacatggacacagaaggggaacatgacacaccagggactgttatgggtgggggttggggggagggataacataggagatatacctaatgctaaatgacgagttaatgggtgcagcacaccaacatcgcactgtatacaatgtaacaaacctgcacgttgtgcacatgtaccctaaaacttaaagtataaaataataaaattaaaaaaaaaaaagaaaacctaggtgatatcattcagcatataggcatggcaaagttttcacaacgaagatgccaaaagcaattgcagcaaaagcaaaattgacaaagggatctaattaaactaaagagtttctgcacagcaaaagaaactatgaacagagtaaacgacaacctatagaatgggagaaaatttctgcaatctatccatctgacaaaggtataataccagcatctataaggaacttaaacaaatttacaagaaaaaaaagccaaacaaccccattcaaagtgggcaaaggacatgaacagacacttctcaaaagaagacatcatgtggccaaaaaacataaaaaaaaagctcaacatcactgatcattagagaaatgcaagccaaaaccacaagagataccatctcacaccagtgagactggcgagtcaaaaaacaacagatgttggtaaggtatggagaaaaaggaacacttttacactgttggtgggagtgtaatttggttcaaccatttgtaagactgtgtggtgattccgcaaagacctacaggcagaaataccattcgacaaggaatcccattactgggtatatacctaaaggaatataaatcattctattataaagacacatgacacgtatgttcattgagtaccagtcacaatagcaaagacatgaaattgacctaaatgccatcaatgataggctagataaagataatgtggtacatacataccatggaatactatgcaccataaaaaggaatgagatcatgacctttgcagggacatggatggagccagaggccacttccttcacaaactaatgcagaaacagaaaaccaaacactgcgtgttctcactttaagtggagctaaatgataagaacacatggacacatagggtggggggaacaacacacactggggctgtcggagggtgaggggtgggaggagggaaagcatcaggaagaacagctagtggacgctggtttaatatctgggtgacgggattatctgtgcagcaaaccaccatggtacacatttattatgtaacaaacctacacatcctgtacatgtacccctgaacttaaaagttggaaattatacaaaaaaagttttttaatgtcatagatgaaaaggcagcaaggagactatctacaggacaactgtaatcttatcacagccaacagattgcaatccaaacttggaatattagggatcttttgggattacaaactggtaccatattatggaatttactatcttttaaggttgaaaaaagaatgctggacttatgtacaagatatgccaacagttgagttcttgtcacccatatttctccagtagttataatcaaatggtatcagaacttcctgcaatcttggcaaatggggtaaatgacatagaaaacaagatgagggtgatttccacgcatcagaagctgcttaaaagcacagcagttagggaaaactgtctttagactagagttcttgacagcagttagtaggtcgagcatagcttatatgaagaatgttaagtaaaaacatgatttttaaatagactagataaacttatcctttatggcacatgataaagtattttaaactaattttgaccttatcaaagtgatatttctttttaacatacctttgatctgtagcttgctgttctcgaagctgaagaagagataactcatttcattttcttttctcctcaactgagttttcaggatctcagccaagtgctctaactccctatctggcctctttgtgactgaataacgttttctctgaaataaagagcctctgtaagacttgtagtttgaggaaaatttttcaatagttaagatcagtgcaaagaaagttcttcatgaaaagagcaagcagaagttaaaaaatttagcttaagtgcctctgcacacagtgaaatagagcagattaaatgtgatgacttggaaatacatacggaacaatgcaagatactgcttttttaagataatgtcctaggcaatggattggactttggtttgattcaattgagtaagtatttttgtggagtacacctactatgtatgccacaatctggtcttcagaatatttatatgtcttgttctttcatatatgcacatctgcttataacacccaaattaacacttcagagagagaggcaggaaatttgccaaatataacttagtggtctctggcatgcatttatctctatcatgtcggcagcatcacactgtaatgagtctcaggaaccggtataaacgttggcttttcaggtgacatcaggtaacaaggttatgtctagtcttttattttcctgcaggctaatcattactgtactgctatttaaaatattcaaaaggaaacatttgaagaccatattattcttaagcaactacttaagtatgatactgtgcgccatgttttcttttctcatgaagtattgttactttttgagatccaggtgaaggcttaaagtggaaccttaccttcatttgtgtaactcacagacactgaaccatgaggcttggattaactagaaaagtaagctaaatgtggcagaagtaacttttttaaaccatatgatgaagaatgcagtgccatagaatcatacgaaaacaaaatctgaaatcctatgtatctgataactccaaacttttatgccactccccaattctttatttattttttttaccaagaaaagggctaattgattcaggatctaaaaaaattacctgtgattttctgggaaaaaaatgttgcctctaaatcttacactattctaactgactggactttatgccattcctcgagggtcaaattataataaagaagactattacataaatccttccattgaggcagctggaaagttcttcattttcctttttctgagaacatgttatataacatctgttgttaccctacaaacatagctgtatttcagtggagcaaactgtttacatataaataaaggaaagggaaggaaaaaaaaaaagacattatcaataaccaaagttctcaaattaccacaaaaaagaacacatcaaatttcttatttctcctctggcttcttcaagtaaactgttgccatattttgtaaacagggatgtggagtttctgctacatctgcatcttggaattttatacctaaaaacaaagtaaaaaatatgattacagaattgaagttagaaaagaaggatctttgatttgctataataaggtatttataataaaatctcttaagtattaagaggtatgtgttttatagtacacagaattaaaatacactgccaaagggaatatgtgatctcagccaccagtaggcattaaataaaacacgcagcaagtattgctcattttacaaatctactgtagaaatcaaattacctagaaataatttattcaacttaagatttagactcctgcagtaatttctgaaataaatcagtcttctattaagttttaacaatgtaaataggttataaaaacctgattttttccccagtgtttgtgatagggttttttaaatttttaaattattcatattccttgcccttaaatgtttaagtaaaaatttttctgtattttgatttattccaccccaataacaaaatccctatttatgaaaaggtacttgagaatggatcatcgcaagaattcctttaaataaaacatttccctgctgcacttaaatataatttttcttatagaaatctgtagaattttacaaagacagtcccattgtttaaaataggcatattcttaattatgtgagttattttacatttatagaataactaaatattagagttaaggtagataaagcatcacagatgattaaggtttttaaatggagaacaaaacaacaaattattcctttagaaaagttaactttttaaacgtgagatttcattgctctgcatattctcgtaaagagaaaatttaaataaagaaaaaagagaattttaactagaacaatggaactattctcgctctttccaaagtagtcaatatctattgctgtaatccagaagaatagaaaaggcttgcctaaaacattaaaatagtttactgtgttagaatttgccaattgtattattttggcataatgctaattcttacgcttttcctacatataccatgaaaaaattcaacattactagtgaaataaaaaataatcaaaacatatcttaaaacttacagtctcatggtgatttgccaatgctatatatatatatatgttatatatatgttatatatatatataaaaccttttaaagattatacataatatttgtacatatcactggggtacatgtggtattttgatgcatgcatacaagtgtaatgatccaatcagggtatttaggatatccatcaccttgaccatttatcatttgtttgggaatatttcaaatctcttctggatatttttaaatattcagtatgctgttgttgccatacagtctactgtgctataaaacactagaactttttcttattttttctatctaactgttctatgtgcccattaaccaacctcctttcatcctccccagcgccccatactcttcccagctctagtaactatcattctactctctaccaatggttacatttcaaaacctttgctttacaaaatctttgttccgttgtttcctcataataagtattgtttctatattacattgatcaccatttagccagtgctttccatcctttatcctgacaaggcacaaacagaaaacagtagtattgtatagcaccttgatggtaaaggttgcttgtggccagagaggggttttagggttcttgccagccatcccaggctgagatattttcctgacaagtctcgcctgtctcagcctcaaagtagtcctggagagcctgttaaagtgtcagttttggtaatgatgcttcaggtttactcataagacggattaagaaagtattcatcactacttaatgctttgtgtcacttccatgtcctgactctatcctgaacagtgagaaaggtctgaatcaccaagagagtacaaatgtaaggagaattaaagtatgtagtcatgtttttaagagtctgctgatctgtggctcttaatttcgctaagggagaaacttccagcaaactctcctgtctgaacagcaatttatagcactagattagctgccattttaattaacattgacaatattatgattttatcaaagagaaagtcaaaacttattttctcttcctaaagacacttaaaagcatgaataatacagaaacaaaactttttttgtttaaatgatctaattagacttcagtttagatttaatgtaaaatctgggcattatagactatttatttatttttgagacttagtctcctctgtcgcccaggttggagtgcaatggtgcatcttggctcactgcaaactccgcctcctgggttcaagtgattctcctgcctcggcttccaagtagctgggattacaggtgcgtgccaccaagcccagctaattttttgtatttttagtgagatggggtttcaccgtgttggccaggatggtctccatctcctgaccttgtgatccactgccttgacctcccaaagtgctgggattataggcgtgagtcactgcgcccagcctagaccacttatttttagagactgtgtctcactacgtcgcccaggctagactcaaactcctgggtcaagtaatcttcccacctcagcttctcgaggactttaggtgtacaccattgtgcctagttgaacattatttttatttagtataaaagatcttgcagactttagagatcatcttgcccgttccagttccagatggcaaaactaaggttcagagaggataggtcactttaaaggtaaatatattattgtgggagccaccatctcctgatctcttatctaagctggattattaccactcattttatagatggggaaaatgaggctgaggtcagtattatcttccatgtaaaacagttctcagtggcagaatgtactttctaatttataattcattatgcttactttagttgtattcgagtctactgccaatctcacatagctaggagtagccaagccctttcatcctgcagctgctcctgcctgtgtggaggccttattgacttcaaaggaactctatctagggaaaagatagtctaacattttggcttcaagagcgaactacaacaaatttttctccctttctgttcatagtgtttttcgtttttttttttttaattcctcaaagaattgaaactaaagttttacatgctatttacatccctaaaaatgtttggtctttatgtaaagtatagtctaaacaaaaaccaattgagctaaaacctaatttcctttcctactagttgaaattttaaaaacgttacttaagatattattgaattgtggttccattataataaagtttctctgtgggtgaagagaattgaaaattttattagaaatatttatgttctatattgagtcttgtctacacaatttaattactttgcacttgggtacattttaggttattaatttttaaagtgaacaaagtgattggcctatgatctttttagagatggaagagacctttatccttacttgtttcaatccttttactttacatgtaagaaaactcagggtcagattgattaggagacttgtctaaggtcaccagccagtaagtgagaaataaggacccaactttttaaacccctggttacatgcacatgccatgtcatgctacgccatccaatgagaaagatttcaacacttttgcaaatttcgaaaaggtctttggatgaaaacttaaatgtgatcattcattacagtaaatgtggtcatatgtaagcaaactagctagttccccacctgcctgagtacagtgggtttaaccaacccaaacgcaattcaactcattttattagtttcacacatctcttacattaaggttatgtggaatgtttttactaaacaaatttggactgatctagtgattcttaaataatcttcactgacaatattattttatcaaagtaaaaattatttttctcttcctaaagacacttaaaagcatgcgtaatacagaagtaaaactttggttttttttgtgttaaacaatctaataagacttcagtttagatttaacgtaagctttgtttacctttcctggggcattcctgtaaaccagcattttcatttgcttttctacgcccagtttaatacgagattgtacattattgtatggagtttgcctgtaaccctgggtttgaagttgtgtttggctgaaatcagtctgtttttgagggtttcattttgtttttcaagctcatgaacttctcttgcagctgctcaatcatttcttccatttccacatctcgtcccagccgcttgggccgccaccaacccgctcatatcttttcttgtcattaactagccgtattaacttggtggcattctggggaaataataaaaagatgaaaaggaatgtgagaagtcagcataaaatccatttgttgaaaggaacataatcactgtgaagacttcagtgcagaacctgaataataaatttcggttttgatgtaactattactgcctgtgaagaatcctttgatgataattgaaaccactggcaacaatctgctttatagcactgacaaataacagtttcctaaggcttatcatttaaggtagtaaagagaggacacatatttactccatatgttcctgaaacgcaatttttaacgcataccttatataggaatgctgtacgcacttaagtgtagttacagattgtggatgtggtgggtatatctgcaatccacagtaagttaaaacttttgaaaagtgtgttaagactgtgcagcattaggtaatatattgttttcagtttctccaggattaagacacactataaatataaaaatttagaatgcataaatgcacacatataaagcccaatgaaaaattcaaaagaaaccaaaatcaccaataaatgttgcttagtgctcaagaaacacttgtgtttaatggtaaaaaataattgatgcaaaagtatcattttaatgctatctttaaatttggacataaattgtgcttttgactctcaggagtttatacctttgattcttttaagttttgataaaaactggttagaaagaacaaagacagaaagggcacatgggggtgatgtaatatacacgtacggaaaacatgcctgacgtgaatggaaaaatcttggcaggacaagaaagaaaaggtggctttgatgagagacacaattcaagactttacaaaattggtcgcacatcttcaatagctgattctagtttatagtgaactatttttataaagacccagacaggagattgaaaataaaaacacacttcatttttctttaatgggttttgctttattttagcgtggttatggacagaagcttttacttaagggaacaaagtgaaataaaaaaacctttaatagctttgggatgtcatagaacaaccttttttctgcctaagcagagtccgctgtaaatgcggtagtaatacatgtctatccacactctggctactcgcctacagcatgtggcatcagggagagctatgcataacataatcagttaagattgtttttctttcccttgaggcacatccattaagcatgctttataaaggatacaggataataaaaacaagatccaagagtaccacaaacactctagtaaaataatcaatggattagttccttttcacctaattccgagaatgatatatcactgggaaatttggccaggtatcacagtccaagaggccacacactctacctggccctttaatgagtttagggtcctaagccccacccaatggccgtgcacaaaagtaaggttgtcatatgaatgagacgtcaacctaaatatctgaattttctttacagagagactttcacacagagatgtagattacattcaaaagaaagacacagatttatataaaaaggcagttaacacccaggtaaaaataaatgaccctaatttttaaggcagggttctttaaattcttcaaatgatattcaaataaactttgtcaagaaacatgattgcatctgttgtctcgtaatagccatacattccatttgctggatttgattattttatcatattaatgatcatacgtgatctggcaaagtctgagtgcttatttaaaaaggtagttttggctagacgggtggctcatggctgtaatcccaacactttgggaggccaaggcagacggatcacctgagtctggagttcatttgagaccagcctggccaacatggtgaaaccccgtctctactaaaactaaaaattagccaggtatggtggcaggcgcctgtgatcccagctactcgggaggctgagcaggagaatcacttgaacccgggaggcgaaggttgcagtgagccgagatcttaccactgactccagcctgggcaacaaagacttcctctcaaaaaaaaaaaaaaaaaaaattaaaaaaaaaaaggtagtttataaaatctacatttatagaaaataaactatttacttttttgttttttttgttttttagacagagtttcgctcttattgcccaagctcagtccaatggcgcgatctggctctgcaacctctgcctcccgggttcaagcaattttcctgcctcaacctccgagtactaggattacaggcttgtgccaccatgcccagctaattttttgtatttttagtagaaatgggtttcatcatgttagccaggctggtcttgaactcctgacctcaagtgatccgcccgctcagcctcccaaagtgctgggattacaggcgtgagccactgtgcctggcctatttactttaaaagataaatttaaagacagttctacccatgtatctaggtcacagtcagtggtgtgaatcgagaggcatttagagcttttgggtcatagtgttcattggatcattattctcgtagcaaagtaaaacgaactttcaggaggttaaatggcttgaacatacataccacaggctagtgcagagagataacagaatgcatacatacaacttgattcctagctcagtccttttcccattaactacatggctcattattcagttgttttttattttctggctatgacaaattactaatgggtcaaggatgtgaattcgattcttttactgaccaattaggcttacaaagaaaaaaattttaggtggtcatagcagactacatgcctcattctgactggctgatgtgtgtgggataatgtcagaaaaggaatcaggcaagtgagtcacaaatcttgaaaacagccatcatcatgactaaacccaactcaaagtaaaaggcctgcacatagcatgccagtgggttgttgaagtccacgagtagaaactgaactggaaccacctccttaggatggattctaagcagaaaaaccctatttcattcttcaatggttgtctcaccttttctttgaacctagaacataaatatgaatacaacctgctcatgattacacatctgaacacactttgtttttaatgccttcccctcagaaaaaggcacagcatttctgaataaaaaagaatgaaagagtatctactcttaagaaatcattttgccaagattttttgcacataaatcaaaagtgacaatactgtttcttcagaaacagtaggactctttgaaatcaatatagaatctagtataacccaagcaaagttaaatatgttccaggactgaagtgatgttttcattagtaaaccccaaatcttaagggaatgtgcattctaacagttagaatagttagttactttttaaaactttcattttaaaatcaagacatttaaaaaacgatgctttggccatttgcttattaaactataaatattaaaccaaaagttatttataggttgatatactaacggcactctattagcttttttcatttaaatagcaaattcagacataataacactcataatctttttggtttattattctagtttgcaagattttccatttttaaaaatgtacttatttacatcctgccttgttccaaacaagattcaaggtggggtattca

SEQ ID NO: 5045 - DNA, 24624 bp, Homo sapiens
tagaatataacagctccctctgggagaccaaaggagagaaaagacaggctaagcctgacgagtgtggctctttctccaacctacgcaatttcctatgaggatttccctttgtaagatttctttccacacaatagctgtccccagattcctcagccatcatgcgcatggctggggatgtgcatcattcttgggcatacctaggacacctgtccatcccctggtggatcttggttcagattttgttgctggtatgttccacataaatcagaagaaaagaaggtgcagggtcatcaaaactcttctgtttattgcgtcagactggagtcaatgtctttccctttataatcaagaggggctcaggagggttgtgaaatgatatttggcaggaaatcaagggaagtgaatattctaacggaaccaccctgacctttatgctttatgagatattcatataaagggaccatggcaaagaaaaatcattttattcatcaaactctagttgagcagagcttgtgttgcagggtgaattatacactgtgaacaaaggtcattttggggaagatcccaggttggatgttgaactagaaaaaaatattagtgggacaactggtaaaatttgaacaagacttgtagattagttgattatatgtgtcactgttagtttcctgtcttaaagattattctatgtttatgtaaggtgttaacatgtgggaagctgcgtaaagggtatatgggaattctgggcaccatttttacaactttaagtcaaaatcatttcaaataaaaagggttaaaaagtcaaattataggctgacaattattttctttggcattttgaaactatttcccactgtgttttggttgctattgagaagtctgagcttacctaataccaattccttcacagatatttcttctgttttttgtcgttttaaaaatctttcgcctcaaaggcacttaaaagatactactatgtttttaggtgacatctgcttgggtgatctttgtggaattcatgtatttgaggattagcatttttcattaattccgaaaatttcggtcttgtctcttcaactattgcctttcctccattcccttttatttgttcttctgcaactctgtcacatgcattttaacttcctcactttgttctccatgtccctgaatatctctgttgatttccatctcactgtttttctgtgctgcattctgagtagtttcttcgaatctgtcttctaatcaataaatgcttttcagctgtgtataaattacttttcaacaaatcctttgagtttctatttctattattttagtttttatatttctaagttttgtttggttcttgtgcaaatatgccaatcaaatttaatacactattgttcctttatttatttatttatttatttatttatttatttttgagatggagtctcgacctgtcacccaggctagagtgtagtggcatgatctcagctactgcaacctctgtctcttgggttcaagagattctcctgcctcagcctcctgagtagctagattacaggcacccatcaccacacctggctaatttttgtatttttagtggagatgggtttcaccatgttggccaggctggtcttgaactcctgacctcaggcaatctgctcacctcacctcccaaagtgctgggattacaggcatgaggcactgcgcccggcctattcctttgttaaacttaattttttctttctttatcttgaaatttactaaatacactaatacattcttttttttttattgagacagagttactctgttgcccaggctggagtgcagtggtgcgatctcggtcactgcaacctctacctgccaggtttaagccattctcctgccttagactcccaagtggtgggattacagatgcccgccactatgccttgctaatttttgtatttttagtagaaaccggttctaccatgttggccaggctggtctctaactcctgtcctcagtgatacacctgcctcgcctcccaaagtgtactaaatacattcttttttattctctattcaattacaatatctgcgttttgttgctctggcttatcgtttattatctggcaacttttgcacattgtggcttattatttgtgtgtattctttgattttgtattatgacctgatattccttggaactttatcaaattggaaattctttgagaactatgtaaaaagtgtttccctttgaggggtgtttttatttgttttgttaggtgcatgggagcactaccaagccagaattgcttaaaatgaaattttctactgaggtttttttttttttttcttgccgcatggatagtgagaatttcagcccaaaacaatatgcttctccacttaagattagaaattatcaatgactttttttcctccctgctttacttgggccaaagccaaaaacaggcatgtgtagccccatcatttacgtctgcaaggagtttgtctccagtttaacctctgaatgggtcctggttttatgtgagttctatgatacaatgtacccgtgcaggccccagactttgtcttccatctccttcataatgtaatgtagtccatgagaagtgatgtagatcaccaacacaaatgaacacatgcttattctggtggattttcactttccgtcatttctggacttcagggaattccttactctcttataaatgcagctgtgcatttaaaaatatgttttgcagattatatagcatttttcattgtgatacacaggctttttgttctgttatatctggtctaccataatgcttgtaaggaaacacatttaatcttctgtgaggtataattattattcccaggttttatgtaggaatatcttagggtcacagaggttaggtgatttttccaacactgtagagatactaagtggtggaggtgaggttgaaataggtctaaacccaaagcaaggcacttttaaaagattaataaagtttgtcgaatgatacttggactaactcctgccgaattaagctagaaattaatataagttctttaattcagttaggaagatcccaaatcagaacaaatcataataaaaattgagatcaggaagcttcctgagtgtagctcctcatatcacttcccacacataagtactgccccatatggcaatcgggaggccccaggaatgcttgctaggtcaggccctgctcctctaagttagttgaaagctccctccctactcagtgactgctctcaacttcttcactgtagctgttggctctcagaacatgatgcccaaagtatagcgcctcggttgctgagtactttgaactgaaagacattggaagggcctccgaagaaagatctctttgacttctcctgccctcttgtctttcatgcttctttctcccctggagtgaaccatggaaactaaattcctcttccgcaagacaatgatagaaactagaagccctttccccaaagcaagccataaacttaggaaggtcactctctcccttctcccttctcatttgaagacccttaatccagagaatcctgccccatacttgcaaagaagaaatgctacacagagagtccaagaagaatttgacccagtctattaccattagatcatactcttgtccaaacacatctctacagagctgcccttcttcatggaacctaagcacaaaaacagttttccctggatctttgggtcttcatttctaaggctctcatatcacataaaactttgattaagtaaatttgttatgcttttctcttgttacttgtcttttgttataggagtgtcagccatgactcttacaatgagtaaggagaggtatacctacctccttttacccctacatgctcttggagctgattatcacagtttgtaatttttcaccttccattcctgcttctgtgtattttgataaatttttgcaggtcagtagacttccctggcagaatatttcctgcttctcaccagcccttaagccaatccaaggaaaacaaaagaaatcataatgctttgtcatatgacaagattacaaaagcagcatccagtggcagaatgcccactgctccgggacacagccaatagctgacttcagtgctccccatccctgcttgtcagtgttagtctaaattgttatcacaagcccagtctgaccaatgaatgtgagtgaggggccatttgattgtcagctcctgattctgcagaaaacacgaaactgagctgtacaaagatgctgataggggctgcagcatgcaattcacttcaccagcagtcactaaggtctgatctcttttctaccatacctggaagatggaatgctggacccagggtatgcatagaaaatgggagttattagaaagcagctttgcttgctttaacccaggaattgtatttctggtatgttgtttccttttaacaattgccctaaaggttcttttgtttaaggagcaggaggatgggggaggttatttctgtctcagcaaaagtcttagaaccagggtctcctcgtttgtaaggaagcaagtaggtccctgacctgggctgggatatgatttgtgatcagccaggcaagagttaagagtggaagtctgtctctctgcccatcttataatatcttaagggtgatcatctgtggtattcttgagtggtattcccattccatctagcatttcattagaattattgtataaaggatgacaggcagaggacattgacatgggaatgctggacctattggatgtttattcattagctgcagttaccccccatagccttttttaatacaaagtaaaaatttagttgacatgtaaaaattgtatatatttatgtgtatagcatgttttaatatatgtatacattgtggaacggctaaatcaaattatttaactatgcattacctcagctacttacctttctttttgtagtgagaacacaaaatctactctccagcaattttcacgtatgcaacatatcattattaactatagtcaccatgatgtactatgtagcctcttaatacggtataatgccttggcaaaacccaaaatccctagcaggtctggattttgagtttggaaatggtccaaggtgcatatactatgtctgtgaataccagagggcaacctttatgggttcctggtgtagggtctatattctaaattctgagagatgaactcctttaggccacagtctttctgccacttatgaacctacaagcaagtttccaggtgttaaatcagctgggaatcatttcagaatttatttcaaatattacattaattcctaggggataaggaatttaaaggaaagtgttcaaatgatcatcttatacatttatatacttttacctttctgtttaccctttgtgactagatattacattcatgagtgaattaaaaatgaactgcagaagttaatccaagagtccatggaggctattcccccatgtgtttaagagacctttgctgtccaggtctgctttaacctgaacaaaatggagctcaccgtgtcagatgctggcagtttgaaagggactgtgtagacctggatggatctctgcccttttgaccagcctcacactgatgtccctcacacttgtcagggaggcatttgcccagatattcctgggcttacagcaaccctgtctacagcagcgctgctaactgggcatggggcttagttggggctcctaggctggaaagacagtcatagttctataatgtaaggataggctgccttcagggggagggtgttcattctaagggaggggctcaatgaacatgtcgagaatagtatggtacggcttagcaattacccactgttcctagtagggaaattttgggaattaatattactgttatagtcccatacacaaaccacacaattacctcattctaacagagttgaaatgtttggatttattgtagcattactatcaggaatacacattattatggtattgctatcaagaatacatataaatacatgcctgaagctataagtgagatagagatattccagggttagtcaaaagttaatctttgagttccagaagtctggatgaaaatagatgagactgcaaattttgttgttaggcagtcaccatttatgacccttggcagggaggcaggaatggtggttatattgtgaactgaatgaaaactgagaactaatcagcatcatgtggcctgaagcatttattgctaccagtgattagttgtaagaccttcggactatgtaactgtatgaactataatgaacatgagaaaacaactcttttttttttttttttttttttttgagaggagtcttgctctgttgcccaggctggagtgcaggggcgcaatcttggctcactgcaactcttccttccaggttcacgccattctcctgcctcagcctcccaagtagctgggactacagtgccagccaccacgcctggctaattttttgtatttttagtagagacgggatttcactggttagccaggatggtctcaaactccagacctcgtgatccgcccacctcggcctcccaaatgctgggattacaggcatgagccactgcgcccggccaaaaaacaactctttaaaaatgtccttagagcaacatgcaaagcttccctgctcagcaatcccaggttggggccccctgtctcctatcctcctacccgtcacaaccaccactgcaggcttctgatgctctgttttcctccttgtctcagttcagttgctctgagttagagaggagctctctgggactggagctgactgcgcctggcccatttcctcactaccatcctcaagctcagatgctgacaggaaaatactgccttgcctgaaggggcatcccttagcaggcggcccagttccttctcataacatttggctgctgcagcagatctccattctgcttatgaattaatccttgaagataccaataatttggtgcatttgtggaagcagattttcagatacattctgtggttggtctttgatctcttccttgtcattgattttttgcttatggacaaaccctctaaaccatgttgcacagcagtgtcttcagactcccattatatttctgaaggttgcagtagcgctgatgggattgttgcttttcagcatcaggacttccttattgaatggtgtctgataacattccgtctccaggaactcagcgagatcgagtatgcattcagaggattcagtcccttctcaagagctttattcgaatagtccatagcaattgctttagtgcttcaatcatctctttatttccactagcttcagattctcctgtattcgcatttgtcttacttttgccttgtagcagcacccaatctggtgatagaggtagccattgttggtgtggattccaacacccgttgaaacagttcaatagctttgtctaggtcaccttttttctgtaaaatttggctgcactgcggaggacatctgtttggcaaggagacttttccaagcttcttcaacaaactgctctccttcagcttctttattcatcttctgcagtttcaggcccagagaaccttgacgtattggttatcaggactcagctcaatggcctgcttcaaaacatcatagagaactgtttctctgggtgattatccagatggtacatcgcaattgccagtccagagagaattctgggttgttgggcttttcttccagagccttctcaaaacacaccttcgcccttcatttcttccacacttcagttgtgtccacccttcctcacagtcaagttcagaatactcatactgtatggatttgaaaatttcttgcaggtttgtttcaccttatctacataaatctgacatctgagagtctgcccaagtgatagtagacccaggcgtagtttccccaagtgactagattctgatttctgcttggtcagcatgttcttgctggattaactcttcagcttgccgtaagattccagggctgcctcgttgttaccatctaggtgttttatgtaggccaacaagttgtacttgtagctttgaactcagtgtttaaaaattcaatctggttacacactctatcttctagacccttgagacactgtcttccttgaataagttccaggtgaaatggcatttcagctgtggaggattttctccagggaattcttggtgacctcactgtggagaaaataaacatggtcactggatgtacactgccaagcactgcaccctgtgatcattaattttatatgtcaattgaactggccacaggatgcccagatatttggtccaacattatttctgggtatgtatgtgaggttgttctggaagacatgaacatgtgaattggtggactgagtagagcagattgctctccccagttgggtgggcgttatccattctgttgagggccttaatagaacaaaaaggcagaggaaggggaattctccctctgaccgactgcttgagctaggacattggtctttttctgcccttagacagacttggactagaactttcaccattggcttacctggttctcagacttttagacttggatgggactacaccatcaactttccttggtctccagcttgcagacaacagattatgggactgccagtctccataatcaggtgagccaattcctcataataaatctctttatatatagatgtccttgacttatgatggggttatatcctgataaacccatcataaattgaaaacattgtaataaaaagatgcatttaatacatctaacctaccatagcttagcctagcttaaatgtgctagaacccttacattagcctacagtggggcaaagtcacctaacacaaagcctattttatataaagtgttgagtatctcatgtaacttattgaatactgtattttaagtgaaaaacaagatggaattatcacttttgtaccatcacaaggttggaaaaattgtaagttgcttcctacatcacttttctttagctacagtctgtgcagacacccacaaagcacatcccttacaccgtgtagcagatatgcaggaggtgaggtaagatgggtaagaggaggcagcttcagtgacaggaatgagatctctctcacgctgctcaattaccaagtcagccaggaatggtgactcatgcctgagtcctagcactttgggaggccaaggcgggtggatcacctgagcccaggattcaagaccgcctgggcaacatggcgaaagcctgcctctactaaaaatacaaaaattagccagggatgtagtacatgcctgtagtcctcgccattcgggaggctgagacaggaggatcacttgagccaggaggcaaaagttgtagtgagctgagatcacaccattacactccagccagggtgataggtgggaccctgcctcaaaaaaaataaaagtaagaataaaaattaaaaaataccaagtcattctcattccttgtacattctgggtaaggtttgtttagctatcccatgactctttattgggtacctctttttgtcactttattagatattatggatactaagaaaaatagagattatccaaccttctctgcccgccaggtgctttcagttttgttaggagacatgtaaagaaataaagcccagatatgtctgccaacatgttatgtgatttaggtatttttcccttcatcttttccccacttacaaacagacccacggaggctcagcttgagtctgactgaagtagtctccccacacacaggccagattcccagacagaatgaatttgttgcaacaaacaaacaaaatggactctttttgttttgtagttggaagatactaaaggagatcacttgccttatttagctggataattgcaagagttctctaagtgtgttcccattatctacatttgcctggggcttgggctgtagtccctcactcttgagtttgtgcttcttccttcttaccagtggagtcacggcaccataaattggaaagaacctccagaaatcattaaaccaagtgtccttatttttggatttcacagaaagcacaatttcagaaaaaaagttatgaaccaaatagggctgctaatgtatctgaaaagtaccaaccatctattctgaccaatattttattttaaaagatagaaaagaaagaattttcttgccactgaaaaagtaatctcagaataaacaaaattctttaaattgaatgcattttgtctacaaggagccattgactttatttgcaatttaccatggacgagcactggccctcacacgctactgcaagtgtactgatctattatacttcctgtctgtctctccagtaatgctgatcaaaccatttttggcccaatatgattgcacatgaaatgctttatagtgagagatgcagaacaactcaagggcaatgggagtgaggagggaagttgccatctacatccggctagcctcttatgtgtgtgctttgatttggggacagtccttttccttttcttggtccctgtctagggttcagtgtcaatatcttccctgtctattatagggtccttcctttcttccttccttctttcctccctccctctcttcctccctccctattttccttctttcctcccttccttccttccttcctccctccctcccttcctccctccctattttccttctttcctcccttccttccttttttgcagagacagggtctcactatattgcccagagtggtctcaaactcctggtctcaagcaaccttctgcctcgacataccaaagtgttgggattacaggtgtgaaccaccacacctggcctaggggttttcaatttggctttacctgggtattctaactaccctgtatgaaggactacagtcaaaagtcaagttagcaattatttaaaaaatgaataccaaaagtaagttataacgatataattgaacaactctgcttatatctgttatgccactaaatcataataaagtcatggaacatgagttaactttgctgatgtgtgaattaggaaggttaaaaggagaaagtgtgagtctagatcaatagaatgtatctgcagatttgtaggtacatatgggtgcctgaaaaaaatagcgaacactctagtaattaatagagagtatccagtggacctgcaggatgacaggtgatgttgatgtattgttggatgtatttgcctcaacgaaaccggaaaccaccttgcaagtctgatgcactatctctctctcttttttttttttttttggagggcagaaggctttgacatatcaatcaccagggatcttaccaaactaaattttaagcacttatagctcaagattctccctctgaatgaaacatacttccaccctgtcatgtgtcagcttcagaagatatcaattgctcaagaagtgttggacaagcagaaaagcacactgaacatttctggacttgtgaaagagctctgaattggatctctcagggatattccatccccaccaatgctttaccaatgcgagagctggccagctgagacatttaatgataacatggaacaatttattcaggaagatagtcaactactcatgggctttatgattataaaacccactgaaaattgggtcccttgattctcttgatttttcctagccttactccctaaagtctccaatttgatgaggtatttgatacttgatctctccttgagtaaaatttggagcaaaatatattggactggaaggcctgagacctcgataagaagaaactgaaccccagagccacaggtcaggaggttttcattataatactattgccctcttaaaacaatactccaattgccaaggtttcctcacttaataatttatctcatatgtgtttttgaaattactctgaatacttcttatatgtataaataagttagttaacagtaattaatgcagatattaaataaatacaagcaggcaggtgggatgatgactacagtcacttgataaagaacagcaggtggccgggcgcggtggctcacacctgtaatcccagcattttgggaggctgaggcggtggatcatgaggtcaagagttcgagactagcctggccaacatgatgaaaccccgcctgtctaaaaacacaaaaattagccgggcgtggtggcaggcgcctgtaatcccagctactcggaagccgaggcagaattgcttgaaaccggaaggcggaggttgcagtgagccaagatcgggcactacactccagcctgggcgaaagagcaaaactccgtctcaaaaaaaaaaaaaaaaaaaaaaaaaaaaaaaagaataaaagaaaaagaagaaaaaacagaatagctaggttcaggtgaacttggggagtagaatgccagtcctacctggatctgcatctagtagaagaccttaggggataggattccctcaggtccagaaagagatttcccatgacctcggattgcagacataagtttcgcttactaaagcagttaaagctagtgctgctagtccttaggaaatccccagaatcacatagttacagtctctcacctaacccagatcatgaccacctgtcttgcccacagactcagggtagataccacatctccttcccagtcaaagctattactagagtagaatcttgaaatttcagaaagtggctttcttgaagtggtaagagtggggatttccccactcttgtctgcactgtgcagcttgtccccagcatgtgctggttatgctccaactgactacgtgaaggaactgcagacctgtgctcagttggttggtcagaacaggcccaatccaaggagtccatcacttcaaaagcaagtgaaggaactctccagagccggacttctcaacctttaatgtacatatggaccaaacatctggagatctttttaaaatgcagatctggattcagataagctgggatgttactttcttacaacctcccgggggatctcagcttcagaccacactgtgagcagcaaggctctggaagacttccctttttggcagtgatttccaatcaccagtttctcatacttaaattacctttaaacagtcaaactttgctttatttttattttatttttgtttttttgtaggtctcacttgttgccaattctggtctggagcccctgggctcaagcaatcctcttgcctcagcctccaaagtgctgggattacaggcttagccactgtgcccagaaacaagctttgctttatttcacattcttcccacccctcccccctcctgcctcttggggtttcctccttcacatttacacaatacaatgcaggaagccttgtatgcatttaaggaagagaggatttggagatggacatttttctgtaagccattcagtatgcctatgaagtacttgtggtcctctttaaatatatgttttttctggaccttatttctgttttactcaatcaggatttcagaatgcaggacctagaaattgcattctattagaagactcaggttgatatgattcaggccactcgcagaacacagtttggagactgcaagcaacaccttctccctgttcattgatcacgtgggaggcttagcaggtcatagacctgctagaggacaactcaagtagacatatcccccaattatgaaaaagtgcatttaaggtaaaagtgacctcaacataaattggaattttgcagtgctgaattaattattgacaatttgctgagaagcaagcatggtttaaaaataaccacagtcacaacaaaaccacaaaccctgacttaggctttctaaatataagaaacaaaagacgaaccagaacctccagtaacttcctccaggccccagctttcactggcccgattttacctgaaagcatctgagcatgggctcttaggatctctcaatatgccccgtcccttcccagctcccagctcccatttccctgtgtccttggctgcctaactctatacatcacaaagagctacagaaataaaaatgcatgaattggtaggcagatttatgcttgaattagataaatgcatatttcatctctaagcaaacactgaaaagcataagtcaggaagttgtacataagaaattctgtttcctatcagagaagcagggacttttacctcatgatggctgtttccctgcagttctgaaaagctggggtcccggttgatttttttttagcttactgattccaagcaaatgctgaagaggtttccacccagggtgctgttagtctgtgcttttatgaaaggggaaaggaaagtgaaactgatggaaccctatcaagatccccttgaggggaaactgaaacagaatctgtgagaactgagctcactcacgccaggaacatgtccagacagatttggaaaactgtggtttgaaagttgtaaaaaggcactgtaaaaagaaataaaattttagaagcttccaaatgtgttatgtcaagaggcaaagttaagccctgaaaacgactcacgtaacgtgactgttttttttctcaggtgcatgactgttgctctttgacctgttggtgaggggttacatgttaaccagactccctagtctcactgcaatttctgcctctcggttcaagtgattctcctgcctcagcctcctgagtagctgggattacaggcgtgcaccacctgcctggataatttttgtatttttagtagaggcggggtttcaccatgttggtcaggctgtctcgaactcctgacctcatgatctgcccgccttggcctcccaaagtgctgggattataccttgcaccaccgtgcccggcctcagacaacctagtctttattaaaacgtagacctcatttatggaaatagagacccttttgattgttacttttttttttttttttttttttgagacagatctcactctgtcatccaggctggagtgcagtagcacgatctcagcttactgcaaccttgcctcccaggctcaagcgatcctcccatctcagcctctccagtcaatgagactataggacgtgccaccacgcctggctgatttttgtatttttagtacagacggggtctcactatgtgcccaggctggtctccaactcctgagctcaagcatctgccctcctcggcctcccaaagtttgggcttatgggtgtgagccactgcggccagccatgttacctctttacaaaagaatataagcaattcccttggactgtaatcaatagtagccaatcaaattgtatatctgtatgttacctctgtatggaaaatgttggccaggcacggaggctcacgcctgtaatctcagcactttggaggccaaggtgggtgcatcacttaaggtcaggagttcaagaccaacctgaccaacatgcaaaaccccattgctactaaaatacaaaaaaattaaccaggcatagtggcgtgctccttagtcccagctacttgggaggctgggtgggagaatcccttgagcccaggagtctgaggcgcagtgagccatgatcgggccactgcactccagcctgggtgacagagtgagactctgtccaaaaacaacaacagcaacaacaaaaacaacaacaacaagagaagttgtcattctgttgacacctctgtctttgcctatgtaaacagtcctcatttttctctacactggaagtactgtcaccattcttgggtgcagctctactcctgggactgctgccctcaactttttgttgaataactcttttaactggatcctgagccttctgattattgtatattgacagtactgactatgcgtcctactcccagagattctggtgcagtgaatctgatgtgagcttagaaacctgtgtttcacaagtgccttggaaattcagtgcaggagttcctgtaccacattttgagaagtgctgtatagaggtattttaaaaagcagttttcccctttatttatggagctaatgtggtgaattagcagcattatcaggcatcttgagtgaagggaagaaaaccacaggacacctggatttcaggacctctttgcttagttctgggatatttcttgagtcatatcactgagcctcattccctttccttaaaatgccctaggatgaatttccttttcccttcatccaaatgatagaaaattatccctggggagaaccactttcacccttctccaagatctgggttcagttcttgtggctttgccactctaaggcatgggtaaccatcaaaggctggcccttactctccagataggaagccctccctggccccctctctaaagtgagcatagttgaaagcattaagatctttcaccttttgccattgggcatagagtcagatgatcagcagtagagtttggtgcctccattaatgactctctctgacacctgctctctatctgatgtcttgggcaagtaatttgcccttctaagccccatttggtcatctagaaaatgaggctaataatagaaataatagctcttacttcctagggctttggaagggtgatatgaggtcatgcgtaaaacgtgtttaacacagtgcccacttgtcagcctctgagcccaagctaagccatcatatcctgtgacctgcatgtacacatccagatggcagttcctgccttaactgatgacattccaccacaaaagaagtgaaaatggcctgttcctgcttaaccgatgacattatcttgtgaaattccttctcctggctcatcctggctcaaaagccccctactgagcaccttgtgacccccacacctgcccaccagagaacaacccccctttgaagtaattttcctttacctacccaaatcttataaaatggccccacccctatctcccttcctgactttcttttcggactcagcccacctgcacccaggtgaaataaacagccttgttgctacacaaagcctgtttggtggtctcttcacacggacttgcatgaaaccactaactacagacacaaagaaatgttaccaccatgattgctggtactaatatatttgtgttataattttaatgaatttgtgagtgtgtaaagggagcaacagagttcctcagtggatggggcagaggaggtgcccatcagctggcacgtgccagtgagttctccaggtgattttcccatttggaaattttagcacaactggggaggagcagcccaatctcttcctgttcctatagcctctggaaatagagcaccttgatgtgaacctgagtccagcatagttcagagagcccccctcagacctcctcggtcagtggctatagacacacctaaagacaggaccctgtaaaacctttcctgcaagctgctactaagacgccttgctctctggtcaatcccactcacacagacacaattaacatcactttgaccaggaacttattctatataaaagggtattctatatactgaggtatttggcagtgattcctcttacccatctcatccccaaacatgacattgcagagcatcttcaagtccttgggcagagtaaggtagggaatccagttttccttttctgcccccctgaatggtcgatggggtttccctccctggcaatcacctcctcactcctttcctagagatgcttggtgggaaaggcaccttttctcttagttctccctaacatgctatcccctgaagaactccaggaggacaatattaaatttaaaaatcaagtttactgagattatgctttatatacaataagatgcacccatttcagtgtatagtctgatgagttttggtaaatgtttatgcatatgtagccaccatcactactccctatagactattcctatgattctaaaaagattcttttgggagccttcctactcaaccccaccatctccaggcaaccactgatctgcttcccaccattagagattagactagtttagataatagattaggtcattacacttttgaggagaaattctttttttgctgctgaccagattcactacatcaataaaaataaatgctaagctttgggtttgtttttatataagaaatgcaaaaatgcccatttgtaagaattgtttcttccacttcccaccttaaagtaatgcaacgttcagggcaaaattgccttcttcatgagtgggtttgcagtactgattgtatctttcacatatctgttgaaaataaattcctccttttaaaattacaagaaaaaaagcctgtgacttaacttttcaaacaaaatgacaataacagaaaaacccaaaagagtaattcccttaggtctaccttgaatcagccaagtttgtggctgagtgaaatacaccgctcctgccaagccttcctctattgcaggaaatagctgcacacagggaggaaacatgagctgatgcattccccaccctgctccccccatgtagttccgtagggaaccattccagaaacttaagaagcctgtgtgtacacaaaaaaagccacagggaaaaacccctcaaacatcttacaaatgctcagactgataaagaatattgaatctataaacatcaggacaattcaggaatgtgcctgcacagtaagaaactcacttacaatttgcactcaaaaacaagcatgattatgcattcttatttcactgacctcatgctgccctctgtgtctctgctgttccgaaaagctggtgaccaggctgatttgttcttcagagtcttcctgtctgcctcaagtaaatactgaaggaactatataaaggggtgggagagtaggcacgcatcagctgatgttttctccgtttttgagtaattgcttttaggggaaggaagagaaactggaaagtgaaactaatttaaaatcgttgggaggaggaaaatgaaacctaacggttgagacctgcaatggctgagccagagtacgttattcaaaactgtgactaaaatttgttgagagaatgtggaagcattcctaatgtaaaccaaaaaattaaattctaaggccatactcccaaccatgtgactggacccctgcttttggccaagggcattccaaagttaacctgaaaatgatgtgaaggggaagctggatatgcctcattacatcctttttccttttggaattactatagaacacactctttttttgtttttgtttttgtttttttttgagacagagtcttactctttgcccaggctggaatgcagtggcatgattgcgtctcactgcaacctctgcctcctgggtcaagtgattctcttgcctcagcctcccgagtagctgggattacaggcacccaccaccagcccggctaatatttgtatttttagtagagacgaggtttcgccatgttggtcaggctggcttgaactcctgatagcaggtgatccaaccaccttggcctcccaaagtgctgggattacggcatgagccactgcacccagccagaacatgctctttttaagtgtattaagaaacatttcaacctattctctctgaagcctgctacttggaggcttcatctgcataataaaaccttggctccacgacccagacattcctttctaatgattgtctattgaatttctattggatgtctcaaacattcctttctattgataataactctttcaacaaattgtcaatcagaaaatctttgatctgcctatgacttggaagctgccccgcttccctgtttccaattgtcccacctttctgacctagccaatgtacaccttacatgtattgattgatgccttatgtctccctaaaatgtaaaaaccaagttgtggcctggcacatgttctcaggatctcctgagggctgtgtcacaggcataggtcattcatatttggcttagaataaatctcttcaaatgttttacagagtttgacttttttgtcaacattaggtatctgaccatcagtctagggtggggcccaggaaacagcatttttaagccaattcttattatttttaaaaattttttgtggacacatagtagatatatatattatggggtacatgagatatttgatgcgagcatacaatgagtaataatcacatcagggtaatgacttcaagcatttattctttgtattacaaacaatccaattatactcttttagttatttgaaatgtgcaataaactattgttgactatagtcatcctcttgttctaacaaacactgatcttattaattctatctaagtatatttttgtacccattaaccatccccacttcccccctactactcttcccagcctctagtaatcatcattctaatctctatctccataagttcaatgtcttaatatttttagcttccacaaacaagtgagaatatgtaaaatttgtctttctgtcctggcttaattcacttataatgacctccacttctatccatgttgttgcaaatgacaggtctcattctttttatggctaaagagcactccgttgtgtaaatgtaccacattttctgtaccattcttctgctgatggacacttaggttgcttccaaatcttggctattgtgaatagtgtgcaataaacatgggagtgcagatatctctttgatgtactgatttcctttctttttgattattcctggcagtgggattactggatcatatggtagttctatttttagtcttttgaggacctccgaactgttatccatagtagttataatagtttacattcccaccaacagtgtacaaagtttccttttttccacatccttgccagcatttgttattgcctgtcttttggataaaagaattttaaccagggtaagatcatatctcattgtaggtttttttttaacttatattttattgcaggtatacacgtacaggtttgttatttaggtaaattgcatgtcatgaggctttagttacagattatttagtcaccccactcataagcatagtacatgataggtagtttttcagtctctctcttcacccattctttaccctcaagtaggccccagtgtctgttgttcccctcttttgtccataatgttcagttcccacttataagtgagaacatgcagtatttggttttctcttctgcattagtttacttaggataatggcctccagttccattcacattactgcaaaggacagatattcttttttttgtggctgcatagtagtccatggtgtatatgtaccacatttccctatcctgtcttctgttgatgggcatttaggttgagtccatgtctttgctattgtgaataggctatgatgaacatacttgaacatgtgtctttatggcagaatgatttatattcctttggtatgtacccaataataggattgctgggttgaatggtacttctattttaagttctttgagaattaccacattgctttccatagtgactgaactaatttacattctcaccagcagtttgtagtgttcccttttctctgtaacctcaccagcatctgttatttttgttgactttttaatatagtcattctgactggtatgacatgatatctcattgtggttttgatttgcatttttctatgattaatgatattgagtattttttcatattcttttttttagggtatctgaaggaagaatttattttctttttttattattatactttaatttcttgggtacatgtgcacaatgtgcagtttgttacataggtatacatgtgccatgttggttcatatgtttattgcggcactatttcaatagcaaagacttggaaccaacccaatagactgggtaaagaaaatgtggcacatatgaccatggaatacaatgcatccataaaaaaggatgagttgtgtcctttgcagggacatggtgaagctggaaaccatcattttcagcaaaatatcacaaaggacagaaaaccaaacaccaatattttttcatattcttattggccgcatgcatgtcttcttttaaaaagtgtctgttcagtcctttgcccactttttaatggagctgtttgcttttttgcttgttaatttgcttaagttcttatagattctcaatattagacctttggttatgcatagtttgcagatattttctccctctgtcagttgcttgtttactctgttgatagtttcttttgctatcagaagctctttagttaattaggtcccgtttgtcaatttttggttttgtcgtagttgcttttggtgtcttcatctgaaatctttgctggtttctatgttgagaatcgtatttcctaggttatcttccagggtttaatatttttaggttttacatttcatccatcttgagttgatttccatatatgatgtaagaaggggtccaatttcagtcttctatatatggctagccagttatcccagcaccctttattaacagggaatcatttccccattgcttgttcttgtcagctttgttgaagatcagatggcttaggtgtgtgcccttaagtttgggctctctattctgttccattggtctatgtgtctgttttgtaccagtaccatgcattttggttactatagccttgtagtatagttcaaagtcaggtacatgggctctctattctgttctattggtctatgtgtctgtttttgtaccagtaccatgtattttggttactgtagccttatagtatagttcaaagtcaggtaacatgatgcctccagtttgttctttttgcttaggattgctttgggtatttgagcactttttgttctataggaatttaaaataggtttttctaattctatgaagactgtcattggtagcttgttaggaatagcatgaatttgtaaattgctttgggtagtatggccattttagcaatatcgattcttcctatcatgagcatttccatttgtttgtgtcatctctgatttctttgaacaatgttttgtaattccattgtagagatctttcacctcctgcgttagctgtatttctaggtattttattcttttttggctattgtgaatgggattgtcttcctgatttggctctcggcttggattttgttagtgataggaatgctactcatttttgtatgttgattttgtatcctggaactttgctgaagctgttattagacctacgagcttttgggtagagacgtgggggttttctaggtatgcaatcaaatgtctgcaaagatagatagtttgacttcctctcttcctatctaggtgccttttatttcatctcttgcctgcttgctcatgctagcagtactctgttgaataggagtgctaagagtgggatccctgtatttttccagttctcaaggggaaatctttcagctttcgcccattcagtatgtgttgaccttgggtttatcatagatggctcttattatctggaggtatgttccttcaatactagtttgttgaggatttttaacattaatggatgttgaattttatcaaaagccttttcttatctattgagatgatcacgtggtttcagttttaagttctgcttatgtggtgaatcacattattgatttgtgtatgttgaaccaacagaaacaagaattttataaaggaatgggaaatagaatttggctgtgggacataaattggaagctctagcaggcatggcttgcctggctacagaggccagggtaggtggggttgcctaccttgcctgaatgtttcccaggacaacaggaggtgtgctctctggctgaattcagacagaagtggaaccactgggatggaagctctagcaaggttgcctgcctggcaaccagtggcaggggtagatgtagtcacctgtcttgccctccagggcttcctgggagaacaggaggctatggtcactggctgagttcagacagagaagtaggacagtaggctggaagctggcaccaagccccatccagaaagggtttgagatggggcaatcttctgctcctaggcactgggactgcagcctttattgggctatggcaccagtgctggtcttctgggggcacaaggcttgcagaagtctccttggactagagagttgccctccaaaatgtctgggggctctctgcctcagtctagaagcacggtggtggggtcgggggtgggcaggggtttaggggcattctcccatttccagtcttgcacaggtccctgtcgagagtgtgaatcccctaggggttctcactcactcaccctttccagtgttggagaaattctcctggatccacgctgacccggacaggctggtatctagcttcacccctttctgctctctgtaatccccttacatctgaaggatcccgaatccctgacatgatttctcagatgattggcctgcagggtcaatgctcctagcccttttgtttcctttccgtgatagcctggcacatgagttgcttctagtttaccacttaaccccgagctcgaaactgcattttttaaaattttactttaagttctaggatacattgcacaacacgcaggtttgttacatatgtatacttgtgccatgttggtgtgctgcacccttaactcgtcatttacattaggtatatctcctaatgctaaccctcctccctccccctacccatgacaggccccagtgtgtgatgctccccatcctgtgtccagttgttcttattgctcgttccgacttatgagtgagaacatgcggtgtttggttttctgtccttgcgatagtttgccagaatgatggtttccagctt

SEQ ID NO: 5046 - DNA, 100000 bp, Homo sapiens
gcaagaaggtaataatagcttacaacaacagccaaggaagttagagtcaggtgatgtttgttctctatagaaaccaaaaatagggtcttaagcgtgagctgcgggattctccttgcatgcaacccgcaaacaaatgccctcctttctcttgttgcaaaaccccactgtgggtgtttgctttactgggctgggcaagtggaccccagttttgttcagtagcagacaatgtgagcatgtacctctttatgcttaaattgcatgaaaatgtttttttggtgaaagtccttttgtccttttgtatacactttttccagttgaaagatctgcgtgagaatgggatataactgaacaaaatatatgattgctgaataggactctctgactttgtcgcaatggaaaaaaatagaaactcacccccagggaggcataaaggagaggaagtcattaacaatctttttgtttttcagaactgtcctggaagatttcccttctgtctgacggaaatcttcccacgctgtctttccaaactccacttaatgctttgaattcagattgctgagcctctgagcacaacagacagcactggggttgaggtggggatccactctggaactttccatccagaaaacctcagatgtcttcctcactctgtgtttggaactgatagcttgaaggcagttcctctgaaagcaaggacttcagtgtatttttggactggaatggaaaccttacggtggtaggccccaccatggaaggccacatggtggggttgtaaacctgtactgcctaaggcatgtcccgcttgggctgccatgcatgtcctctggattgtgctttgtgtctgtgtgtacctgactgtcatgacactgtctcagcccaggaagggatcaggtccactttactttcctggcctcagctgtgatgtgccaccaggttaaaagtttatatagacatgtacggaggaagctctctggacttctaagatagacctttataattaatcgatttgtttaagctggctaaattcaggatccttaaaagaggataaatactgaatgtattgaaaaaactgagatcaatactgacagagatcctagaaataataattttactataaagttccttgctaaggactaaggggatggaccatgcagagttagcatggcaagtttgaaactgtatctttagaaagacttgcttgcaaggttggcccttggctaacatcagggaacttggattttaagttttctagctattctataaatgatatgggtggcttactatgctaagactgtttagcaaatgatggagtttatgctaacacttgctttccttctcgaagtctggaattttggtaatgctaggcagagggtgcatacatgatcagtccccagtaaaacccttgggcacacagtcaactggcttcacatgtgttgtcacaatttgatgctggaggaattaagcacaacctgatgctctaccggccctcttggaaacctatacctgattttctttggacttggccccatgcacttttgtctgtgctaattttgctctgtatacttttgttataataaggcttagctgtgagtagaccatatgttgaatcctgctcatctttccagtgaatcatcaaatctaggggtagtcttgagaccctgatgtcaatttcctagaattctctttagaaaaaaacaatgcagcaggctatagaatataacagctccctctgggagaccaaaggagagaaaagacaggctaagcctgactagtgtggctctttctccaacctacgcaatttcctatgaggatttccctttgtaagatttctttccacacaatagctgtccccagattcctcagccatcatgcgcatggctggggatgtgcatcattcttgggcatacctaggacacctgtccatcccctggtggatcttggttcaggttttgttgctggtatgttccacataaatcagaagaaaagaaggtgcagggtcatcaaaactcttctgtttattgcgtcagactggagtcaatgtctttccctttataatcaagagggactcaggagggttgtgaaatgatatttggcaggaaatcaagggaagtgaatattctaacagaaccaccctgacctttatgctttatgagatattcatataaagggaccatggcaaagagaaatcattttattcatcaaactctagttgagcagagcttgtgttgcagggtgaattatgcactgtgaacaaaggtcattttggggaagatcccaggttggatgttgaactagaaaaagatattagtgggacaactggtaaaatttgaacaagacttgtagattagttgattatatgtgtcactgttagtttcctgtcttaaagattattctatgtttatgtaaggtgttaacatgagggaagctgcgtaaagggtatatgggaattctgggcaccatttttacaactttaagtctaaatcatttcaaataaaaagggttaaaaagtcaaattataggctgacaattattttctctggcattttgaaactatttcccactgtgttttggttgctattgagaagtctgagcttaactaataccaattccttcacagatatttcttctgttttttgtcgttttaaaaatctttctcctcaaaggcacttaaaagatactactatgtttttaggtgacatctgcttgggtgatctttgtggaattcatgtatttgaggattagcatttttcattaattccgaaaatttcggtcatgtctcttcaactattgcctttcctccattcccttttatttgttcttctgcaactctgacacatgcattttaacttcctcactttgttctccatgtccctgaatatctctgttgatttccatctcactgtttttctgtgctgcattctgagtagtttcttcgaatctgtcttctaaacaataaatgcttttcagctgtgtataaattacttttcaacaaatcctttgagtttctaattctattattttagtttttatatttctaagttttgtttggttcttgtgcaaatatgcctatcaaatttaatacactattgttcctttatttatttatttatttatttatttatttatttttgagatggagtctcgacctgtcacccaggctagagtgtagtggcatgatctcagctcctgcaacctctgtctcttgggttcaagagattctcctgcctcagcctcctgagtagctggattacaggcacccatcaccacacctggctaatttttgtatttttagtggagatgggtttcaccatgttggccaggctggtcttgaactcctgacctcaggcaatctgctcacctcagctcccaaagtgctgggattacaggcatgaggcactgcgcccggcctattcctttgttaaacttaattttttctttctttatcttgaaatttactaaatacactaatacattcttttttttttattgagacagagttactctgttgcccaggctggagtgcagtggtgcgatctcggccactgcaacctctacctgccaggtttaagccattctcctgccttagactcccaagtggcgggattacagatgcccgccactatgccttgctaatttttgtatttttagtagaaaccggttctaccatgttggccaggctggtctctaactcctgtcctcagtgatacacctgcctcgcctcccaaagtgtactaaatacattcttttttattctctattcaattacaatatctgcattttgttgctctggcttatcgtttattatctggcaacttttgcacattgtggcttattttttgtgtgtattctttgattttgtattatgacctgatattccttggaactttatcaaactggaaattctttgagaactatgtaaaaagtgtttccctttgaggggtgtttttatttgctttgttaggtgcatgggagcactaccaagccagaattgcttaaaatgaaattttctactgaggtttttttttttttttcttgccgcatggatagtgagaatttcagcccaaaacaatctgcttctccacttaagattagaaattatcaatgactttttttcctccctgctttacttaggccaaagccaaaaacaggcatgtgtagccccatcatttacgtctgcaaggagtttgtttccagtttaacctctgaatgggtcctggttttatgtgagttctatgatacaatgtaccagtgcaggccccagactttgtcttccatctccttcataatgtaatgtagtccatgagaaatgatgtagatcaccaacacaaatgaacacatgcttattctggtggattttcactttccttcatttctggacttcagggaattccttactctcttataaatgcagctgtgcatttaaaaatatgttttgcagattatatagcatttttcattgtgatacacaggctttttgttctgtgatatctggtctaccataatgcttgtaaggaaacacatttaatcttctgtgaggtataattattattcccaggttttatgtaggaatatcttagggtcacagaggttaggtgatttttccaacactgtagagatactaagtggtggaggtgaggttgaaataggtctaaacccaaagcaaggcacttttaaaagattaataaagtttgtcgaatgatacttggactaactcctgcctaattaagctagaaattaatataagttctttaattcagttaggaagatcccaaatcagaacaaatcataataaaaattgagatcaggaagcttcctgagtgtagctcctcatatcactgcccacacataagtactgccccatatggcaatcgggaggccccaggaatgcttgctagggcaggccctgctcctctaagttagttgaaagctccctccctactcagtgactgctctcatcttcttcactgtagctgttggctctcagaacatgatgcccaaagtatagcgcctcggtggctgagtactttgaactgaaagacattggaagggcctccgaagaaagatctctttgacctctcctgccctcttgtctttcatgcttctttctcccctggagtgaaccatggaaactagattcctcttccgcaagacaatgatagaaactagaagccctttccccaaagcaagccataaacttaggaaggtcactctctcccttctcccttctcatttgaagacccttaatccagagaatcctgccccatacttgcaaagaagaaatgctacacagagagtccaagaagaatttgacccagtctattaccattagatcatactcttgtccaaacacatctctacagagctgcccatcttcatggaacctaagcacaaaaacagttttccctggatctttgggtcttcatttctgaggctctcatatcacataaaactttgattaagtaaatttgttatgcttttctcttgttacttgtcttttgttataggagtgtcagccatgactcttacaatgagtaaggagaggtattcctacctccttttacccctacatgctcttggagctgattatcacagtttgtaatttttcaccttccattcctgcttctgtgtattttgataaatttttgcaggtcagtagacttcccaggcagaatatttcctgcttctcaccagcccttaagccaatccaaggaaaacaaaagaactcataatgctttgtcatatgacaagattacaaaagcagcatccagtggcagaatgcccactgctccgggacacagccaatagctgacttcagtgctccccatccctgcttgtcagtgatagtctaaattgttatcacaagcccagtctgaccaatgaatgtgagtgaggggccatttgattgtcagctcctgattctgcagaaaacacgaaactgagctgtacaaagatgctgatgggggctgcagcatgcaattcacttcaccagcagtcactaaggtctgatctcttttctaacatacctggaagatggaatgctggacccagggtatgcatagaaaatgggagttattagaaagcagctttgcttgctttaacccaggaattgtatttctggtatgttgtttccttttagcaattgccctaaaggttcttttgtttaaggagcaggaggatgggggaggttatttctgcctcagcaaaagtcttagaaccagggtctcctcgtttgtaaggaagcaagtaggtccctgacctgggctgggatatgatttgtgatcagccaggcaagagttaagagtggaagtctgtgtctctgcccatcttataatatcttaagggtgatcatctgtggtattcttgagtggtatgcccattccatctagcatttcattagaattattgtataaaggatgacaggcagaggacactgacatgggaatgctggacctattggatgtttattcattagctgcagttaccccccattgccttttttaatacaaagtaaaaatttagttgacatgtaaaaattgtatatatttatgggtatagcatgttttaatatatgtatacattgtggaacggctaaatcaaattatttaacaatgcattacctcagctacttacctttctttttgtagtgagaacacaaaatctactctctagcaattttcacgtatgcaacatatcattattaactatagtcaccatgatgtactatgtagcctcttaatacggtataatgccttggcaaaacccaaaatccctagcaggtctggatcttgagtttggaaatggtccaaggtgcatatactatgtctgtgaataccagagggcaacttttatgggttcctggtgtagggtctatattctaaattctgagagatgaactcctttaggccacagtctttctgccacttatgaacctacaagcaagtttccaggtgttaaatcagctaggaatcatttcagaatttatttcaaatattacattaattcctaggggataaggaatttaaaggaaagtgttcaaatgatcatcttatacatttatatacttttacctttctgtttacactttgtgactagatattacattcatgagtgaattaaaaatgaactgcagaagttaatctaagagtccatggaggctattcccccatgtgtttaagagacctttgctgtccaggtctgatttaacctgaacaaaatggagctcaccgtgtcagatgctggcagtttgaaagggactgcgtagacctggatggatctctgcccttttgaccagcctcacactgatgtccctcacactcgtcagggaggcatttgcccagatattcctgggcttacagcaaccctgtctacagcagcactgctaactgggcatggggcttagttggggctcctaggctggaaagacagtcatagttctataatgtaaggataggctgccttcagggggagggtgttcattctaagggaggggctcaatgaacatgtcgagaatagtatggtacggcttagcaattacccactgttcctagtaggaaaattttgggaattaatattactgttatagtcccatacacaaaccacacaattacctctttctaacagagttgaaatgtttggatttattgtagcattactatcaggaatacacattgttatggtattgctatcaagaatacatataaatacatgcctgaagctataagtgagataaagatattccagggttagtcaaaagttaatctttgagttccagaagtctggatgaaaatggatgagactgcaaattttgttgttaggcagtcaccatttatgacccttggcagggagggaggaatggtggttatattgtgaactgaatgaaaactgagaactaatcagcatcatgtggcctgaagcatttattgctaccagtgattagttgtaagaccttcggactatgtaactgtatgaactataatgaacatgagaaaacaactcttttttttttttttttttttttttgagatgagtcttgctctgttgcccaggctggagtgcaggggcgcaatcttggctcactgcaacccttccttccaggttcacgccattctcctgcctcagcctcccaagtagctgggactacagtgccagccaccacgcctggctaattttttgtatttttagtagagacgggatttcactgtttagccaggatggtctcaaactccagacctcgtgatccgcccacctcggcctcccaaaggctgggattacaggcatgagccactgcgcccggccaaaaaacaactctttaaaaatgtacttagagcaacatgcaaagcttccctgctcagcaatcccaggttggggccccctgtcttctatcctcctacccgtcacaaccaccactgcaggcttctgatgctctgttttcctcctcgtctcagttcagttgctctgagttagagaggagctctctgggactggagctgactgcgcctggcccatttcctcactaccatcctcaagctcagatgctgacaggaaaatactgcctagcctgaaggggcatcccttagcaggcggcccagttccttctcataacatttggctgcttcagcagatctccattctgcttatgaattaatccttgaagataccaataatttggtgcatttgtggaagcagattttcagatacattctgtggttggtctttgatctcttccttgtcagtgattttttgcttatggacaaaccctctaaaccatgttgcacagcagtgtcttcagactcccattatatttctgaaggttgcagtagcgctgatgggattgttgcttttcagcatcaggacttccttattgaatggtgtctgataacattccgtctccaggaactcagcgagatcgggtatgcattcagaggattcagtcccttctcaagagctttattcgaatagtccatagcatttgctttagtgcttcaatcatctctttatttccactagcttcagattctcctgtattctcatttgtcttacttttgccttgtagcagcacccaatctggtgatagaggtagccattgttggtgtggattccaacacccgttgaaacagttcaatagctttgtctaggtcaccttttctctgtaaaatttggctgcactgcggaggacatctgtttggcaaggagacttttccaaggttcttcaacaaactgctctccttcagcttctttattcatcttctgcagtttcaggcccagagaaccttgacgtattggttatcaggactcagctcaatggcctgcttcaaaacatcagagagaactgtttctctgggtgattatccagatggtacatcgcaattgccagtccagagggaattctgggttgttgggcttttcttccagagccttctcaaaacacaccttcgccctttatttcttccacacttcagttgtgtccacccttcctcacagtcaagttcagaatactcaaactgtatggatttgaaaatttcttgcaggtttgtttcaccttatctacataaatctgagatctgagagtctgcccaagtgatagtagacccaggcgtagtttccccaagtgactagactctgatttctgcttggtcagcatgttcttgctggattaactcttcagcttgccgtaagcttccagggctgcctcgttgttaccatctaggtgttttatgtaggccaacaagttgtacatgtagctttgaactcagtgtttaaaaattcaatctggttacacactctatcttctagatccttgagacactgtcttccttgaataagttccaggtgaaatggcatttcagctgtggaagattttctccagggaattcttggtgacctcactgtggagaaaataaacatggtcactgtatgtacactgccaagcactgcaccctgtgatcattaattttatatgtcaattgaactggccacaggatgcccagatatttggtccaacattatttctgggtatgtatgtgaggttgttctggaagacatgaacatgtgaattggtggactgagtagagcagattgctctccccagtagggtgggcgttatccattctgttgagggccttaatagaacaaaaaggcagaggaagggaaattctccctctgaccgactgcttgagctaggacattggtctttttctgcccttagactgacttggactagaactttcaccattggcttacctggttctcagacttttagacttggacgggactacaccatcaactttccttggtctccagcttgcagacaacagattatgggacttccagtctccataatcaggtgagccaattcctcataataaatctctttatatatagatgtccttgacttatgatggggttatatcctgataaacccatcataaattgaaaacattgtaataaaaagatgcatttaatacatctaacctaccatagcttagcctagcttaaatgtgctcgaacccttacattagcctacagtggggcaaagtcacctaacacaaagcctattttatacaaagtgttgagtatctcatgtaacttattgaatactgtattttaagtgaaaaacaagaaggaattatcacttttgtaccatcacaaggttggaaaaattgtaagttgcttcctacattacttttctttagctacagtctgtgcagacacccacaaagcacatcccttacaccgtgtagcagatatgcaggaggtgaggtaagatgggtaagaggaggcagcttcagtgacaggaaagagatctctctcacgctgctcaattaccaagtcagccaggaatggtgactcatgcctgtgtcctagcactttgggaggccaaggcgggtggatcacctgagcccaggattcaagaccacctgggcaacatggcgaaagcctgcctctactaaaaatacaaaaattagccagggatggagtacatgcctgtagtcctcgccattcgggaggctgagacaggaggatcacttgagcccggaggcaaaagttgtagtgagctgagatcacaccattacactccagccagggtgatagatgggaccctgcctcaaaaaaaataaaagtaagaataaaaattaaaaaataccaagtcagtctcattccttgtacattctgggtaaggtttgtttagctatcccatgactctttattgggtacctctttttgtcactttattagatattatggatactaagaaaaatagagattatccaaccttctctgcccgccaggtgctttcagttttgttaggagacatgtaaagaaataaaacccagatatgtctgccaacatgttatgtgatttaggtatttttcccttcatcttttccacacttacaaacagacccacggaggctcagcttgagtctgactgaagtagtctccccacccacaggccagattcccagacagaatgaatttgttgcaacaaacaaacaaaatggactcattttgttttgtagttggaagatactaaaggagatcacttgccttatttagctggataaatgcaagagttctctaagtgtgttcccattatctacatttgcctggggcttgggctgtattccctcactcttgagtttgtgcttcttccttcttaccagtggagtcacggcaccataagttggaaagaacctccagaaatcattaaaccaagtgtccttatttttggatttcacagacagcacaatttcagaaaaaaagttatgaaccaaatagggctgctaatgtatctgaaaagaaccaaccatctattctgaccaatattttattttaaaagatagaaaagaaagaattttcctgccactgaaaaagtaatctcagaataaacaaaattctttaaattgaatgcattttgtttacaaggagccattgactttatttgcaatttaccatggacgagcactggccctcacaccctactgcaagtgtactgatctattatacttcctgtctgtctctccagtaatgctgatctaaccatttttggcccaatatgattgcacatgaaatgctttatagtgagagatgcagaataactcaagggcaatgggagtgaggagggaagttgccatctacatccggctagcctcttttgtgtgtgctttgatttggggacagtccttttccttttcttggtccctgtctagggttcagtgtcaatatcttccctgtctattatagggtccttcctttcttccttccttctttcccccctccctctcttcctccctccctattttccttctttcctcccttccttccttccttcctccctccctcccttcctccctccctattttccttctttcctcccttccttcctttttttcagagacagggtctcactatattgcccagagtggtctcaaactcctggtctcaagcaatcttctgcctcgacataccaaagtgttgggattacaggtgtgaaccaccacacctggcccaggggttttcaatttggctttacctgggtattctaactaccctgtatgaaggactacaatcaaaagtcaagttagcaattatttaaaaaatgaataccaaaagtaagttataacgatgtaattgaacaactctgcttatatctgttatgccactaaatcataataaagtcatggaaaatgagttaactttgctgatgtgtgaattaggaaggttaaaaggagaaagtgtgagtctcgatcaatagaatgtatctgcagatttgtaggtacatatgggtgcctgaaaaaaatagctaacactctagtaattaatagagagtatccagtggacctgcaggatgacaggtgatgttgatgtattgttggatgtatttgcctcaacgaaaccggaaaccaccttgcaagtctgatgaactatctctctctcttttttttttttttttggagggcagaaggctttgacatatcaatgaccagggatcttaccaaactaaattttaagcacttatagctcaagattctccctctgagtgaaacatacttccaccctgtcatgtgtcagcttcagaagatatcaattgctcaagaaatgttggacaagcagaaaagcacactgaacatttctggacttgtgaaagagctctgaataggatctctcagggatattccatccccaccaatgctttaccaatgcgagagctggccaggtgagacatttaatgataacatggaacaatttattcaggaagatagtcaactactcatgtgctttatgattataaaacccactgaaaattgggtcccttgattctcttgatttttcctagccttactccctaaagtctccaatttgatgaggtatttgatacttgatctctccttgaataaaatttggagcaaaatatattggactggaaggcctgagacctcgataagaagaaacagaaccccagagccacaggtcaggaggttttcattataatactattgccctcttaaaacaatactccaattgccaaggtttcctcacttaataatttatctcatatgtgtttttgaaagtactctgaatacttcttatatgtataaataagttagttaacagtaattaatgcagatattaaataaatacaagcaggcaggtgggatgatgactacagtcacttgataaagaacagctggtggccgggcgcggtggctcacacctgtaatcccagcattttgggaggctgaggcgggggatcatgaggtcaagagttcgagactagcctggccaacatgatgaaaccccgcctgtataaaaacacaaaaattagccgggcgtggtggcaggcgcctgtaatcccagctactcgggagccgaggcagaattgcttgaaaccggaaggcggaggttgcagtgagccaagatcgggcactacactccagcctgggcgaaagagcaaaactccgtctcaaaaaaaaaaaaaaaaaaaaaaaaaaaaaaaagaataaaagaaaaagaagaaaaaacagaatagctaggttcaggtgaacttggggagtagaatgccagtcctacctggatctgcatctagtagaagaccttagggaataggattccctcaggtccagaaagagatttcccatgacctcggattgcagacataagattcgcttactaaagcagttaaagctagtgctgctagtccttaggaaatccccagaatcacatagttacagtctctcacctaacccagatcatgaccacctgtcttgcccacagactccgggtagataccacatctccttcccagtcaaagctattactagagtagaatcttgaaatttcagaaagtggctttcttgaagtggtaagagtggggatttccccactcttgtctgcacagtgcagcttgtccccagcatgtgctggttatgctccaactgactacgtgaaggaactggagacctgtgctcagttggttggtcagaacaggcccaatccaaggagtccatcacttcagaagcaagtgaaggaactctccagagccggacttctcaacctttaatgtacatatggacaaaacatctggagatctttttaaaatgcagatctggattcagataagctgggatgttaccttcttacaacctcccgggggatctcagcttcagaccacactgtgagcagcaaggctctggaagacttccctttttggcagtgatttccaatcaccagtttctcatacttaaattacccttaaacagtcaaactttgctttatttttattttatttttgtttttttgtaggtctcacttgttgccaattctggtctggagcccctgggctcaagcaatcctcttgcctcagcctcccaagtgctgggattacaggcttagccactgtgcccagaaacaagctttgctttatttcaaattcttcccacccctcccccctcctgcctcttggggtttcctccttcacatttacacactacaatgcaggaagccttgtatgcatttaaggaagagaggatttggagatggacatttctctgtaagccattcagtatgcctatgaagtacttgtggtcctctttaaatatatgtttgttctggaccttatttctgttttactcaatcaggatttcagaatgcaggacctagaaattgcattctattagaagactcaggttgatatgattcaggccactcgcagaacacagtttgaagactgcaagcaacaccttctccctgttcattgatcacgtgggaggcttagcaggtcacagacctgctagaggacaactcaagtagacatatcccccaattatgaaaaagtgcatttcaggtaaaagtgacctcaacataaattggaattttgcagtgctgaattaattattgacactttgctgagaagcaagcatggtttaaaaataaccacagtcacaacaaaaccacaaaccttgacttaggctttctaaatataagaaacaaaagacgaaccagaacctccagtaacttcctccaggccccagctttcactggcccgattttacctgaaagcatctgagcatgggctctcaggatctctcaatatgccccgtcccttcccagctcccagctcccatttccctgtgtccttggctgcctaactctatacatcacaaagagctacagaaataaaaatgcatgaattggtaggcagatttatgcttgaattagataaatgcatatttcatctctaagcaaacactgaaatgcataagtcaggaagttgtacataagaaattctgtttcctatcagagaagcagggactattacctcatgatggctgtttccctgcagttctgaaaagctggggtcccggttgattttgttttagcttactgattccaagcaaatgctgaagaggtttccacccagggtgctgttaggctgtgcttttatgaaaggggaaaggaaagtgaaactgatggaaccctatcaagatccctttgaggggaaactgaaacagaatctgtgagaactgagctcactcacgccaggaacatgtccagacagatttggaaaactgtggtttgaaagttgtaaaaaggcactgtaaaaagaaaaaaaattttagaagcttccaaatgtgttatgtcaagaggcaaagttaagccctgaaaactactcacgtaacgtgactgttttttttctcaggtgcatgactgttgctctttgacctgtgggtgaggggttacatgttaaccagactccctagtctcactgcaatttctgcctctcgggtcaagtgattctcctgcctcagcctcctgagtagctgggattacaggcgtgcaccaccagcctggataatttttgtatttttagtagaggcggggtttcaccatgttggtcaggctggctcgaactcctgacctcatgatctgcccgccttggcctcccaaagtgctgggattatagcttgcaccaccgtgcccggcctcagacaacctagtctttattaaaacgtagacctcatgtatggaaatagagacccttttgattgttacttttttttttttttttttttttgagacagatctcactctgtcatccaggctggagtgcagtagcacgatctcagcttactgcaacctcgcctcccaggctcaagcgatcctcccatctcagcctctccagtcaatgagactataggccgtgccaccacgcctggctgatttttgtatttttagtacagacggggtctcactatgttcccaggctggtctccaactcctgagctcaagcatctgccctcctcggcctcccaaagtgtgggcttatgggtgtgagccactgcggccagccatgttacctctttacaaaagaatattagcaattcccttggactgtaatcaatagtagccaatcaaattgtatatctgtatgttagctctgtatggaaaatgttggccaggcacggaggctcacgcctgtaatctcagcactttggaggccaaggtgggtgcatcacttaaggtcaggagttcaagaccaacctgaccaacatgcaaaaccccattgctactaaaatacaaaaaaattaaccaggcatagtggcgtgctcctaagtcccagctacttgggaggctgggtgggagaatcccttgagcccaggagtctgaggctcagtgagccatgatcgggccactgcactccagcctgggtgacagagtgagactctgtctaaaaacaacaacagcaacaacaaaaacaacaacaacaagagaagttgtcattctgttgacacctctgtctttgcctatgtaaacagtcctcatttttctctacactggaagtactgttaccattcttgggtgcagctctactcctgggactgctgccctcaactttttgttgaataactcttttaactggatcctgagccttctgattattgtatattgacagtactgactatgcatcctactcccagagattctggtgcagtgaatctgatgtgagcttagaaacctgtgttttacaagtgccttggaaattcagtgcaggagttcctgtaccacattttgagaagtgctgtctagaggtattttaaaaagcagttttcccctttatttatggagctaatgtggtgaattaacagcattatcaggcatcttgagtgaagggaagaaaaccacaggacacctggatttcagtacctctttgcttagttctgggatatttcttgagtcatatcactgagcctcattcccttaccttaaaatgccctaggatgaatttccttttcccttcatccaaatgatagaaaattatgcctggggagaaccactttcacccttctccaagatctgggttcagttcttgtggctttggcactctaaggcatgggtaaccatcaaaggctggcccttactctccagataggaagcccaccctggccccctctctaaagtgagcatagttgaaagcattaagatctttcaccttttggcattgggcatagagtcagatgatcagcagtagagtttggtgcctccattaatgactctgtctgacacctgctctctatctgatgtcttgggcaagtaatttgcccttctaagccccatttggtcatctagaaaatgaggctaataatagaaataatagctcttacttcctagggctgtggaagggtgatatgaggtcatgcgtaaaacgtgtttaacacagtgcccacttgtcaggctctgagcccaagctaagccatcatatcctgtgacctgcatgtacacatccagatggccgttcctgccttaactgatgacattccaccacaaaagaagtgaaaatggcctgttcctgcttaaccgatgacattatcttgtgaaattccttctcctggctcatcctggctcaaaagctccctactgagcaccttgtgacccccacacctgcccaccagagaacaacccccctttgacgtaattttcctttacctacccaaatcttataaaatggccccacccctatctcccttcccgactttcttttcggactcagcccacctgcacccaggtgaaataaacagccttgttgctccacaaagcctgtttggtggtctcttcacacggacttgcatgaaaccactaactacagatacaaagaaatgttaccaccatgattgctggtactaatatatttgtgttataattttaaggaatttgtgagtgtgtaaagggagcaacagagttcctcagtggatggggcagaggaggagcccatcagctggcacgtgccagtgagttctccaggtgattttcccatttggaaattttagcacaactggggaggagcagcccaatctcttcctgttcctatagcctctggaaatagggcaccttgatgtgaacctgagtccagcatagttcagagagcccccctcagacctcctcagtcagtggctatagacacacctaaagacaggaccctgtaaaacctttcctgcaagctggtactaagacgccttgctctctggtcaatcccactcacacagacacaattaacatcactctgaccaggaacttattctatataaaagggtattctatatactgaggtatttggcagtgattcctcttacccatctcatccccaaacatgacattgcagagcatcttcaagtccttgggcagagtaaggtagggaatccagttttccttttctgcccccctgaatggtcgatggggtctccctccctggcaatcacctcctcactcctttcctagagatgcttggtgggaaaggcatcttttctcttagttctccctaacatgctatcccctgaagaactccaggaggacaatataaaatttaaaaatcaagtttactgagattatgctttatatacaataagatgcacccatttcagtgtatagtctgatgagttttggtaaatgtttatgcatatgtagccaccatcactactccctatagactattcctatgattctaaaaagattcttttgggagccttcctactcaatcccaccatctccaggcaaccactgatctgcttcccaccattagagattagactagttttgataatagattaggtcattacacttttgaggagaaattctttttttgctgctgaccagcttcactacatcaataaaaataaatgctaagctttgggtttgtttttatataagaaatgaaaaaatgcccatttgtaagaattgtttcttccacttcccaccttaaagtaatgcaacgttcagggcaaaattgccttcttcatgagtgggtttgcagtactgattgtatctttcacaaatctgttgaaaataaattcctccttttaaaattacaagaaaaaaagcctgtgacttaatttttcaaacaaaatgacaataacagaaaaacccaaaagagtaattcccttaggtctaccttgaatcagccaagtttgtggctgagtgaaatacaccgctcctgccaagccttcctctcttgcaggaaatagctgcacacagggaggaaacatgagctgatgcattccccaccctgccccccccatgtagttccgtagggaaccattccagaaacttaagaagcctgtgtgtacaccaaaaaagccacagggaaaaacccctcaaacatcttacaaatgctcagactgataaagactattgaatctataaacatcaggacaattcaggaatgtgcctgcacagtaagaaactcaattacaatttgcactcaaaaacaagcatgattatgcattcttatttcactgacctcatgatgccctctgtgtctctgctgttccgaaaagctggtgaccaggctgatttgttcttcagagtcttcctgtctgcctcaagtaaatactgaaggaactatataaaggggtgggagagtaggcacgcatcagctgatgttttctccgtttttgagtaattgcttttaggggaaggaagagaaactggaaagtgaaactaatttaaaatcgttgggaggaggaaaatgaaacctaacggctgagacctgcaatggctgagccagagtacgttattcaaaactgtgactaaaatttgtttagagaatgtggaagcattcctaatgtaaaccaaaaaattaaattctaaggccatactcacaaccatgtgactggacccctgcttttggccaagggcattccaaagttaacctgaaaacgatgtgaaggggaagctggatatgcctcattacatcctttttccttttggaattactaaagaacacactctttttttgtttttgtttttgtttttttttgagacagagtcttactctgtgcccaggctggaatgcagtggcatgattgcgtctcactgcaacctctgcctcctgggtcaagtgattctcttgcctcagcctcccgagtagctgggattacaggcacccaccaccatcccggctaatatttgtatttttagtagagacgaggtttcgccatgttggtcaggctggtttgaactcctgatagcaggtgatccaaccaccttggcctcccaaagtgctgggattacagcatgagccactgcacccagccagaacatgctctttttaagtgtattaagaaacatttaaacctattctctctgaagcctgctacttggaggcttcatctgcataataaaaccttggttccacgacccagacattcctttctaatgattgtctattgaatttctattggatgtctccaacattcctttctattgataataactctttcaacaaattgtcaatcagaaaatctttgatctgcctatgacttggaagctgccccgcttccctgtttccaattgtcccacctttctggcctagccaatgtacaccttacatgtattgattgatgccttatgtctccctaaaatgtataaaccaagttgtggcctggcacatgttctcaggatctcctgagggctgtgtcacaggcctaggtcattcatatttggcttagaataaatctcttcaaatgttttacagagtttgacttttttgtcaacattaggtatctgaccatcagtctagggtggggcccaggaaacagcatttttaagccaattcttattatttttaaaaattttttgtggacacatagtagatatatatattatggggtacatgagatatttgatgcgagcatacaatgagtaataatcacatcagggtaatgacttcaagcatttattctttgtattacaaacaatccaattatactcttttagttatttgaaatgtgcaataaactattgttgactatagtcatcctcttgttctaacaaacactaatcttattaattctatctaagtatatttttgtacccattaaccatccccacttcccccgtactactcttcccagcctctagtaatcatcattctaatctctatctccataagttcaatgtcttaatatttttagcttccacaaacaagtgagaatatgtaaaatttgtctttctgtgctggcttaattcacttataatgacctccacttctatccatgttgttgcaaatgacaggactcattctttttatggctaaagagcactccgttgtgtaaatgtaccacattttctgtatcattcttctgctgatggacacttaggttgcttccaaatcttggctattgtgaatagtgcgcaataaacatgggagtgcagatatctctttgatgtactgatttcctttctttttgatgattcctggcagtgggattactggatcatatggtagttctatttttagtcttttgaggaactccgaactgttatccatagtagttataatagtttacattcccaccaacagtgtacaaggtttccttttttccacatccttgccagcatttgttattgcctgtcttttggataaaagcattttaaccagggtaagatcatatctcattgtaggtttttttttaacttatattttatggcaggtatacacgtacaggtttgttatttaggtaaattgcatgtcatgaggctttagtgacagattatttagtcaccccactcataagcatagtacatgataggtagtttttcagtccctctcttcacccattctttaccctcaagtaggccccagtgtctgttgttcccctctttggtccataatgttcagttcccacttataagtgagaacatgcagtatttggttttctcttctgcattagtttacttaggataatggcctccagttccattcacattactgcaaaggacatatattcttttttttgtggctgcatagtagtccatggtgtatatgtaccacatttccctttcctgtcttctgttgatgggcatttaggttgagtccatgtctttgctattgtgaatagtctatgatgaacatacttgaacatgtgtctttatggcagaatgatttatattcctttgggatgtacccaataataggattgctgggttgaatggtacttctattttaagttctttgagaattaccacattgctttccatagtgactgaactaatttacattctcaccagcagtttgtagtgttcccttttctctgtaacctcaccagcatctgttatttttgttgactttttaataaagtcattctgactggtatgacatgatatctcattgtggttttgatttgcatttttctaagattaatgatattgagtattttttcatattcttttttttagggtatctgaaggaagaaattattttctttttttattattatactttaatttcttgggtacatgtgcacaatgtgcagtttgttacataggtatacatgtgccatgttggttcatatgtttattgcggcactatttgaatagcaaagacttggaaccaacccaatagactgggtaaagaaaatgtggcacatatgcccatggaatacaatgcatccataaaaaaggatgagttgtgtcctttgcagggacatggagaagctggaaaccatcattttcagcaaaatatcacaaaggacagaaaaccaaacaccactattttttcatattcttattggccgcatgcatgtcttcttttaaaaagtgtctgttcattcctttgcccactttttaatggagctgtttgcttttttgcttgttaatttgcttaagttcttatagattctcaatattagacctttggttatgcatagtttgcagatattttctcccactgtcagttgcttgtttactctgttgatagtttcttttgctatcagaagctctttagttaattaggtcccgtttgtcaatttttggttttgtcgtagttgcttttggtgtcttcatcagaaatctttgctggtttctatgttgagaatcgtatttcctaggttatcttccagggtttaatatttttaggttttacatttcatccatcttgagttgatttccatatatgatgtaaggaggggtccaatttcagtcttctatatatggctagccagttatcccagcaccctttattgacagggaatcatttccccattgcttgttcttgtcagctttgttgaagatcagatggctgaggtgtgtgcccttaagtttgggctctctattctgttccattggtctatgtgtctgttttgtaccagtaccatgcattttggttactatagccttgtagtatagttcaaagtcaggtacatgggctctctattctgttctattggtctatgtgtctgtttttgtaccagtaccatgcattttggttactgtagccttatagtatagttcaaagtcaggtaacatgatgcctccagcttgttctttttgcttaggattgctttgggtatttgagcactttttgttctataggaatttaaaataggtttttctaattctatgaagactgtcattggtagcttgttaggaatagcatgaatttgtaaattgctttgggtagtatggccattttagcaatatcgattcttcctatcctgagcatttccatttgtttgtgtcatctctgatttctttgaacaatgttttgtaattctattgtagagatctttcacctcctgcgttagctgtatttctaggtattttattctttttgggctattgtgaatgggattgtcttcctgatttggctctcggcttggattttgttagtgttaggaatgctactcatttttgtatgttgattttgtatcctggaactttgctgaagctgttattagacctacgagcttttgggtagagacgtgggggttttctaggtatgcaatcaaatgtctgcaaagatagatagtttgacttcctctcttcctatctaggtgccttttatttcatctcttgcctgcttgctcatgctagcagtactctgttgaataggagtgctaagagtgggctccctgtatttttccagttctcaaggggaaatctttcagctttcgcccattcagtatgagttgaccttgggtttatcatagatggctcttattatctggaggtatgttccttcaatattagtttgttgaggatttttaacattaatggatgttgaattttatcaaaagccttttctgatctattgagatgatcacgtggtttcagttttaagttctgcttatgtggtgaatcacattattgatttgtgtatgttgaaccaacagaaacaagaattttataaaggaatgggaaatggaatttggctgtgggacataaattggaagctctagcaggcatggcttgcctggctacaaaggccagggtaggtggggttgcctaccttgcctgaatgtttcccaggacaacaggaggcgtgctctctggctgaattcagacagaagtggaaccactgggatggaagctctagcaagtttgcctgcctggcaaccagtggcaggggtagatgtagtcacctgtcttgccctccaggtcttcctgggagaacaggaggctatggtcactggctgagttcagacagagaagtaggaccgtaggctggaagctggcaccaagccccatccagaaagggtttgagatggggcaatcttatgctcctaggcactgggactgcagcctttattgggctatggcaccagtgctggtcttctgggggcacaaggcttgcagaagtctccttggactagagagttgccctccaaaatgtctgggggctctctgcctcagtctagaagcacggtggtggggtcgggggtgggcaggggtttcggggcattctcccatttccagtcttgcacaggtccctgtcgagagtgtgaatcccctaggggttctcactcactcaccctttccagtgttggagaaattctcctggatccacgctgagccggacaggctggtatctagcttcacccctttctgctctctgtaatccccttacatcttaaggatcccgaatccctgacatgatttctcagatgattggcctgcagggtcaatgctcatagcccttttgtttcctttccgtgatagcctggcacatgagttgcttctagtttaccatttaaccccgagctcgaaactgcattttttaaaattttactttaagttctaggatacatggcacaacacgcaggtttgttacatatgtatacttgtgccatgttggtgtgctgcacccataactcgtcatttacattaggtatatctcctaatgctaaccctcctccctccccctacccatgacaggccccagtgtgtgatgctccccatcctgtgtccagttgttcttattgctcattccgacttatgagtgagaacatgcggtgtttggttttctgtccttgcgatagtttgctagaatgatggtttccagcttcatccatgtccctacaaaggacatgaactcatcctttttatggctgcatagtattccatggtgtatatgtgccacattttcttaatccagtctatcatgatggacatttgggttggttccaagtctttgctattgtgaatagtgctgcaataaacatcgtgtacatgtgtctttatagcagcatgatttataatcctttggatatatacccagtaagggatggctgggtcaaatggtatttctagttctagatccttgaggaatcgccacactgtttccacaatggttgaactagtttacagtcctaccaacagtgtaaaagtgttcctatttcccacatcctctctagcacctgttgttactgactttttaatgatggccattctaacgggttgagatggcatctcattgtggttttgatttgcatttctctgatggccagtgataatgagtctttttcatgtgtctgttggctgcataaatgtcttcttttgagaagtgtccattcatacctttgcccactttttgatggggttgtttgatttttttcttgtaaatttgttgaagtttttgtagattctggatattagtcctttgtcagatgggtagattgtaaaaattttctcccatctgtaggttgcctgtccactctgatggtagtttcttttgctgtgcagaagctctttagttaattagatcccatttgtcaattttggcttttgttgccattgcttttggtgttttagaatgaagtccttgcccatgcctatgtcctgaatggtattgcctaggttttcttctagggttttatggttttaggtctaacatttaaatctttaatccatcttgaattaatttttgtataggtgtaaggaagggatccagtttcagctttctacatatggctagccagttttcccagcacatttattaaatagggaatcctttccccattgcttgtttttgtcaggtttgtcaaagatagatggttgtagatgtgtggtattatttctgagggctctgttctgttccattggtctattctctgttttggtaccagtaccatgctgttttggttactgtagccttgtagtatagtttaagtcaggtagtgtgatggctccagctttgttcttttggcttaggattgtcttggcaatcaggctctattttggttccatatgaactttaaagtagttttttccaattctgtgaagaagtcattggtagtttgatggggatggcatgaatctataaattaccttgggcagtatggccttttcacgatattgattcttcttatccatgagcatggaatgttcttccatttgtttgtgcctcttttatttcattgagcagtggtttgtagttctgcttgaagaggtccttcacatccttgtaagttggattcctgggtattttattctctttgaagcaattgtgaatgggagttcatcatgatttggctctctgtttgtctgttattggtgtataggaatgcttgtgatttttgccattgattttggatcctgagactttgctgaagttgcttatcagcttaaggagcttttggctgagactatggggttttctaaatatacaatcatgtcatctgcacacagggacaatttgcttcctcttttcctaattgaataccctttatttctttctcctgcctgattgccctggccgaacttccaacactgttttgaataggagtgttgagagagggcatccctgtcttgtgccattttcaaagggaatacttccagtttttgcccattcagtatgatattggctgtgggtttgcataaatagctcttattattttgagatatgtcccatcaatacctagtttattgagagttttagcatgaagggctactgaattttgttaaaggccttttctgcatctattgagataatctgtggtttttgtctttggttctgtttttatgctggattacatttattaatttgcatatgtgaaccagccttgcatcccagtgatgaagctaacttgatcatggtggataagctttttgtgtgctgctggattcagtttgccagtattttattgaggatatttgcattgcatcgatgtcatcaggggtattggcctgatattctctttttttgttgtgtttctgccaggctttggtacaggatgatgctggccacatcaaatgagttagggaggattccctctttttctattgattgaatagtttcagaaggaatggtaccagctcgtctttgtacctctggtagaattcagttggaatccatctggtcatggactttttttggttggtaggctattaattattgcctcaatttagaccctgttattggtctattcaggaattcaacttcttcctggtttagtcttgggaggggtatgtgtccatgaatttatccatttcttctagattttctagtttatttgcatagaggttttatagtattctctgatgatagtttgtatttctgtgtgattggtggtgatatccccttatcatttttaattgcatctatttgattcttctctcttttcttctttattagtcttgctatggtctatcaataatgttgatcctttcaaaaaatcagttcctggattcattgattttttgaagggttttttgtctctatctccttcagttctgctctgatcttagttatttcttgcctctgctagcttttgaatgtgtttgctcttgcttctctagttcttttaattgtaatattagtgtcaattttagatatttcctgctttctcttgtgggcatttagtgctataaatttcccttatacactgctttaaatatgtcccagagattctggtgtgttgtgtctttgttctcattgtttcaaagaacatctttatttctgccttcattttcttatgtacccagtagtcattcagggcacgttgttcagtttccatgtagttgagcagttttgagtgagtttcttaatcctgagtctagtttgattgcactgtggtctgagagacagtttgttataatttctgttcttttacattgctgaggagtgctttacttccaactatgtggtcagttttggaataagtgcaatgtggtctgagaagaatgtatattctgttgatttggggtggagagttctgtagatgtctattaggctgcttggtgcagagctgagttcaactcctggatatccttgttaactttctgtctcgttatctgtctaatgttgacagtggggtgttaaagtctcctgttattattgtttgggagtctcatctttttgtaggtctctaaggacttgctttatgaacctgggtgctcctgtgttgggtcatatatatttaggatagttagctcttcttgttgaattgatccctttaccattatgtaaggccttctttgtctcttttgatctttgttggttaaagtctgttttatcagagactaggatgcaaccctgctttttttattttccatttgcttggtagatcttcctctatccctttattttagcctatgtgtgtctctgccatgagatggctctcctgaatacagcacactgatggttttgactctttagccaatttgccagtctgtgtcttttaattggggtatttagcccatttaatttaaggttaatattgttatgtgtgaatatgatcctgtccttatcatgttagctggttttttgctcgttagctgatgccgtttcttcctagcaccgatggtctttacactttgacatttttgcagtggctggtaccggttgttcctttccatgtttagtgcttccttcaggagctctgtaaggcaggcctggtggtgacaaaatctctcagcctttgcttgtctgtaaaggatttatttctccttcacttatgaagcttagtttggctggatatgaaattctgggttgaaaattttctctttaagaatgttgaatattggcccccactctcttctggcttgtagagtttctgcgagacatctgctgttagtctgatgggcttccctttgtgggtaacctgacccttctctctgctgcctttaacattttttccttcatttcaactttggtgaatctgctaattatgtgtctggaattgctcttctcgaggaatatctttgtggcgttctccgtatttcctgaatttgaatttagcctcccttgctaggttggggaagttctcctgcataatatcctgcagagtgttttcaacttggttccattctccgtgtcactttcaggtacaccagtcagatgtatgtttggtctttcacatagtcccatatttcttggaggctttgttcatttctttttactcttttttctctaacttctcttctcacttcatttcattcatttgatcttcaatcactaataccctttcttcagttgatgaattggctactgaaggttgtgcatgcgtcatatagttctcatgccatggtttcagctccatcacatcatttaaggtcttctctacgctctttattctagttagccattcgcgaatcttttttcaaggttattagcttctttgccatgggttcaaacatcctcccttagccgaagaaatttgttattaccgattgtctgcagccttcttctctcaactcatcaaagtcatctccgtccagctttgttccattgctggcaagcagctgcattcctttggaggagaagagcactctgattttttagaattttcagcttttctgctctggtttctccccatctttgtggtttatctacctttggtctttgatgatggtgacatacagatggggttttggtgtggatgtctttctgttttttagttttccttctaacagtcaggaccctcagctgcaggtctgttggagttgctggaagtccactccagaccctgtttgcctgggtatcaccagtggaggctgcagaaggcaaatgttgctgcctgatcctttctctggaagcttcatcgcagaggtgcactctgcctatgaggtgtcagtcagcccctactgggaggtgccttccagttaggctactcagggagggtaacagactaactcccacttgaggaggcagtctgtccattctcagatctcaaactccggctgggagaaccactactctcttcaaagctgtcagacaagggtgtttaagtctacagaatttctgctgccttttgttcagctataccctgccccagaggtggagtctatagaggcaggaggcctccttgagctgtggtgggctccacccagtttgagcttcctagccactttgtttactactcaagcctcagcaatggtgggcgcccctcccccagcctcactgccgccttgcagtccatctcagactgctgtgccagcagtgagcaaggctccctgggcatgggaccctctgagcaggagcaggatataatctcctggtgttctgtttgctaagaccgttggaaaagcgcagtttagggtgggagtgtctcaatattccaagtaccatctgtcatggcttcccttggctaggaagggaattccctgactccttgcacttcccgggtgaggcgatgccccgccctgctttggccacactgtgtgggctgcacccactatctgacaagccccagtgagatgaacccagtacccagttggaaatgcagaaactaccatcttctgcatcactcatgctgggagctatagactgagctgttcctatttggccatcttggaacctcctctgaaactgcatttttaataatgtcttaggagattctgatgtaggggtttctgggagccggttatatgaaagacttccaaaatgtttgtaaaaaaaatagtagttttagtatacatatgtaactaacctgcacaatgtgcacattaccctaaaacttaaagtataataaaaaaaaatagtagttttgtccagtaaattgtccccagaagtaaatttagacctagagacctagatttaattatctctgtttactttactagtttcgaattttccaggggccatatcattgagccagaatttcctttttgcctcacactaaactacgaagccaggccctggagggatctgtgagctgtttagctttccaagctctggataatatttagtttacccagctgtaaaatgggcaaaagtaatacacatattattgtttaatggaggattatatatttatgctttgagctctgaaggagttgatactaccctgagaggtttttttttcttttcatttttataatacttcccaaccatgatgtaaatattcataaaaacctaggagtatagttgtcatgactaatttgataatgaaggaattgttagctagaagcgtttcctcatcctgtagctgcacaaagcagagactcttgtgtagcaaaattaacatgacatatggtgttccaacaacagagtctcatgagatacttcgagttcagaggttgttatagtctaagaaaaaacctgcaacttggaaaagtctaattctgattggttgtttaacttaacaatttgttatttggtgataataaagtgacatatctttataaaaggtacatatatttgtgatatcataaaggtataaataccatccttatacccagttagaaggtgcctttggccccgtgctttagaggtcccatatatcacagatacaaacatgtaaaattttgaaagaacaaatagcacctctgttctcagaatccagtgcttaattctggtagaattggacttgaaaccctaaacatccagcccgggaaaagttgcctatcttcccttctttgctcacaatgaatggagattatatcatgcattttgtgcattgtgagggagctgatttttagagacagattctgctttggagttcagagagattgtagcaataaagatcagagaaaaggcaaattcagcaaactgctcaaagactgtcttcaccagaatgcaatagattcttatgtaatgaataattatttttccagtacagtaggaccattgtccattttcttgcttttctttttgttctaattcctggctcaaaaagtactcatgattagcagtatttgcaacagttgcacatggtgactgaataacattctgcatcattaagaattcatactattcttttttttctttttgacagagtctcgctctgtagccaggctggagtgagtggcacaatctcggctcactgcaaccttcacctcctgggttcaagaaattcacctgctcagcctcccgaatagttgggactgcaggtacccaccaccatacccacctaatttttgttttttagtagagatggggtttcaccatgttggccaggatggtctcgatctctaaacctctgatccacccgccttggcctcccaaagtgttgggattagaggcgtaagccactgcgctcggcataaattcacattattcttaaacttgtacacatgcagatttgaacttacatatggatcaaattctcttctgtatttggactctttctttgtgccaatttgccaatcagtaaggttctgcgtatgagtatttaaatataaaatcagatgggaccagattttcatagcacacccaatcagaaaatagaatacataacttatctaacatatctaccgaatgtgaaagcaatgacagattcaaaatgctactaataaggatacaacacaatgaaaacaaacttagaagtaaaaataataacaaaagaaaaattttctttattatatttggaataagagtgcccatttttaacagcataataaaatataattcacatatcatataatccactcatttaaagtatacaattcaatactttcattatattcacagttatgcaaccagcaccacaatcaattatagaacattctcaactgtcatctcccatcgtcacaaccccctcccctagccttaggcaactgctaatctatttctgtgtctataaatttgcctccgttccacatttcatataaacagaatcatacaatatgtactttttaaattgccttttgtcactttgcatgttttcaaggttcatctgtgttgtatcagtatcagtaagtacttcacttatttttgtttccaaataatattccattatgtggctctacatatttaatttatcaattcatcagttgatgggtccactttttggccatcgtgaataatcagctatgaacattcatgcacaagttttgtgtgaacctatgttttcatgttttccttttcttacatatgtatctaggaatggaattgctgggtcatatggtaactatgtttaaccattgaagaactgtccaactattttccaaagtggctgcaccattttacattaaacatacttattttgaggtaatacagattttcttatctgagatctcaagagatgagttactgaaagagaggaaggctgtaggaaggaaaatgtgctggtatgatcttcatttctgactaaaggataaacgaaaaatggaaccagattgaattggttgcagttcagtctatacctctgctattcaaggttagtttacagactacaggccttgttttgacctgagagcttgtgagaaatacagagtctcggctccacccagatctactgaatcatagtctacattttaacaagatcctcaggtgattggcacatgaaagtaggcactgcacattaaagtctgagaaatactggtctagttagaactcagatattctacaggtaataacatgtaagacagtgctggactacacacaaaagtgtgtgccgtgtgattgaaagctagagtgtattctaggtatgcaagccatgtcctctgccagtcatttctccctcctcccatgtctccttcttggataatttgctctcattcctgcagaaagcatcactctaagcccctgctttctctggaatatgatctcattctcttggtcaactggattatattattattattttttttttttgagagggagtcttgctgtgtcacccagcctggagagcgtggtgcaatctcggctcactgcaagctctgcctcccaggttcacgccattctcctgcccagcctcccgagtagctgggactacaggtgcccgccaccacgcctgtctaattttttgtttttttagtagagatggggtttcaccgtgttagccaggagggtctcgatctcctgacctgtgatccgcccgcctcagtcaactggattctattggtaatggatattgacttgaaatgaacaaacagatatttctttggaattttgatcagaagaaagtgattctagaaagtctttatgaattattattattatttattttttgagacagggtctcatctcactgtgttgcccaggcgtagtgcagtggcacgatctcagctcactgaagcccccacctcctgggctcaagtgttctcctacctcagcatcccaagtagatgggactacaggtgcatgccaccaagcccagctaattttgtattttttgtagagatagggtttcaccatgctgtccaggctggtctcgaactccgggctcaaacaatccgctcacctcagcctcccaaagtgtggcgattacaggtgtgagccctgcacctggcctttgttgaattattaggagaagagataaataacctggtaggcatgtttccacttcatgcacagagacgcaaagtcatctctagaaagagaaacttgaaggaagaagcgtaaagggaagataaaagtgagaaagaaggagagaaaaaggaagagagagatggtgggacagacagagagagaggagagaaaactagcattctgggtgtggagaggatttccgtcatcagattccacacttgaacattttatttttctgtgatctatacgccagtgccttttttggaatatatgcatgcactcatcagattgacaaaaattaaagactggtaacattcagtattgtgaagatgctgaaaacagtatttctcatacattgctagtggaaataataatttccttttaacacctagacaaatcaactcttttccataacctaaaagccttaatcattatttaaaattttctatttaaatattctagtgaactctagttttccttaatcaacaattagaagatatatacaaagttttatacatatgttttaaagctccaacttatgtaggtgtttcactaaatgcaaaaacgtacaagtaggtttgagggtttttttttttttttttttttttgagacagggtcacctctgtcacccaggctggagtgcagtggtaccatctcactgcaactaccacctcccagttcatgagattctcctgcctcaacctcctgagtagctgggattacaggcacacaccgcatgcctggttaatttttttttgtattttttttggtagagatggggtttcaccatattgacaggctggtctggaactcctgacctcaggtgatctaccctccttggcctcccaaagtgcgggattttaggcttgagccaccacgcccagccaggtttgagtttttaaatgtagtgcttatgacaaattagtaagtttaatttaaaaatgagaaaggaaaatgtgtgctcagtggtttatatcacagtgcctttgctctgtaatatctgtgaatcaaaagcagaacataaataggctatttacttgggatatccaggattctggaaaggtaaagaaagacttttcaaatattttaatagattatatctgtataaacacactggggccaatttccagatctctagaagggtttcagaatttctaggttcagggcagaatttactatatatttttacattttactcagaaataacaaaactatgactcattatgtttccaaaacaagtgagacataaaccaaggctctggggtcttttgtatcgtttacctgtttggtagcctccttttcaacagcagcctacagagaaccagagagaagcagaactgtttgggatttgtttccacaggcttccaacaaatcctgcctctggttcttctctagtcttaagtcctgtatgtaaagcagctgaagggaggccccatgtagagctagaatgcctctcttacaagtgcatgcacctaggtacatctaaggattttagtgggtttcctctttgcagcctccctagaaggtgtagataatcagcaatgaggtagctgcactattaacatggggaaaatttcttacatattagtctaagttagtcccttttccaaaaagggcaataggcaaatgtaggttgcaaactgcaaccctcagattggcatccaaggttgattgcacgtaggtagggatcctaacacaaggcctatctgtgttataatcagaattctaatgcttccagtttccagttgcactggatccagttgtattggatatgtcaattgacatagggtatgaaggaggtgaaagtgcagcatgactcaaggtcagctgtccccagggactgtgtctgagctctatgagaaagacaagcagaagtgatgaatctttttcactgaggactctgaggcagagaaataataagaactacttggaaccaacacagagataagaggaattcttctcactctttcactggactaacacacttgaaaacattgttggcagagatattagtactctcaaggtggcaatcaatacagagaatgtgaaatgtattgaaggcagttttaggggcaatggtcattgatggatatggtgttgaagctacataagtagcagatgtggtccgataactctgataaacgggttcatggcacataggagacatctactaggggcttgccgtgttggatgaatatatgaagggagtcaatgtcctgccccgggaaatgtggctaaaaggctgggaattacaagtcaagcccaattaagtgacttcatttgttattcttggatagtgaaatttcaggaaactggagctatgtacatattttcattgttttccaatcatttgttaactttaagccctcatattaagtgtaatatgtttgtttcccttttctacccttcttgctgttttcccactaagggtcctgttccagcaagggctggaggcatgacatgcaaggacaagattacatacatccatctttagcacacacaggtacaagggtcctctctcaaggtcggcatacctgtccattttaaccttccactcagaatacggtggtgttccttcccaggcaccagatgtagtcctaatttactcagatcaaggtgagctaatcttcccctgaaacatacacttgtccattttgatccaatgaaatgagtttacctttgcgttggtgtgatttgtgttttccattagaggcctcttgaaaaataatagagattttgggcttcttgtctcttcctattctttacttaatagggaagactctttaacatgcatttggattcgtccaggatggggcataaaatggaatcagtgacttttatttctcataacagaggtcagatagagaaaatgtgatgaaagcacaaaatttaacaaagaaaaggggagcagcccacccacatcaaggtggagacagaatgtctgtgttcacgtaggtcaatggtagcaggtggcagatgcagctgttatccgaagccctggactcttaaagctgaggaaaaagttttgttctgttcagtgattatgatagtagaccagtcgaggttatttggatttggttcacacctgtgtaacgttcatttatcagtagctgagtctgaaagatttaaagtacagcaaaattccagatgaaccaaacactgctttatgttttatcatatttaggttatttattaatgaaaatatatgacatttcaggaatacaaattttgcaccctgatgacctcaaatgcgtgcaacaagatgtttaatacgaaaataacacaaaaactgttgttacagtggttagaatttttaactttaaaaaaccatgatttgtattgttttaattgcacaataaaataatgttgatatatacttaagcttaaattattccaacaggcaaacattttccaacccagagtgtggctgatgctgggtcagctgactctttttggttcacaccaactttgatgtctaggctattcagcatctacctagaaaatctcaacgttccaagcataccgtgaattttgtgatttctcagaagattttcggagttaaaagaaggtttatatcacttaatatccaacatttctaaaggggggaaaaccccaccatctattatcatgacatttcccaagtccttgcaccaggcccttagtcaccaggttcccacgttttgttgtttcctaccgtctcaaaccaggttcatgaaagcatttgaacagagttcagtcttcatttacaaaaaaaaaaaattcctaatagtggctaaaatactgcaaatttctccattcgattacatctacaaagataaaccagcattcctttctctttctctcttttggttacttttcccctaccctactggtggaacatttattttttcacacaggttttaaagaaatacattatgttggttctagtgtattgtacagaatccattctcattctttacttgctacattatgactatgagggggcagagtagaggtgaactctctgtatacttgctgaaagtcttcttgtacacattgcttttgtacccgtcgcttctagctatgtatcttcctgttctctgccctcgtctcaaactatttgccacctcaattaatcaggcacttgaattcacattgtgtagaatactcaaggttgatatagactgggaaggaggaggaaggaggcagagataagcgatgggggatactgagccctattagactttggtcccccagcttttggatgaacttagcacattactggctatgcaggactacctctatgggatgcaaaatgactccaagtatggaacaacattgcaaaaatggacttcatattacatgaaggatttggctgctttatataaatatagaaacaagcccagtggattactcactaaaggtgactaagcaaatgttacagttcaaattgcactcaagaagtcaatcgagaataattctatcaccaagcccgtggacctaccccccaatctggtccctctcccagaactcttgggctctctcaagacccagcaattcaggtgttaacataaccctgtccagtggtatggcagtgtcttagtccaatcttttgccataccagtcattacatattttgaataccaacttgtggaggaatttcagctccctttcagcagtagcctagtgggcaccacatctctattcttcttccccattccagcttgatgctgaagggatgaggcttccagactccaaacccctctcaggtcttcatctgcttgttgcattttttcattcagctcctgaaggaatgccaagacatgcaagcctcagaatctgctccatttttagaaagtcgcattttggcaattttttgcagtttgttttcatcttttctttctcccttgatttctggtttatttttacaccctctataaagtggtgatggccttgtcttcacacttcatttggtacagctgaaagttgccataccgcagatggacagttgtttcgctacaggagtaagctctttactgaattccttttggaagtaatactctgttcttcatactgatctgctagagcatggaggctggcaagaatggaacagacacggaagaattatcattggcctcatcagctttcttcagatgagccacagcgtgtcctattagttccataactttcttttcccatacattccattctctcttagattcattacttggaagacttttgcctatagcagcacccaatttggcaatgcaggtaggcattgtttggtatgtattctaaagctttttaagcagttcaatcgctttgtctggctcatcttttcttcgataaaacttggctgactgcgaagaacatctgttacacctggggctttctccaaggcttcttcaactaacttcttccttcaccttcctcttcaccttcttcacgcatcttatgaagcttcagagccaggaggatttaaggtactggttgtcaggattcagccgaatggcttgcctcagagggtcaatggcgtctgagatggtggccagttgtccagacggtagcttgctattgccagtccagaggtgaatttgggttctttggcttcttttccagagccttctcaaagcacaccttcgctctttcattttgtttcctccacactttaaccgtgtccacccttcctcacagtcaagctctggactctcaatctatagggactggaaaacttctcacagacatgtttcaccttgtctacataaatctgaagtctgagagtcggcccatgtgatagtagacccaggcatagtttccccaggtgaccagactctgatttctgcctggtcagcatgctcttgctggattaactcttcagctttacgtaagcttccagggctgcctcgttttgccctttgaggtgctttagataggccagtaggttgcacatgtggctttgaattcacgattctgaaactcagtccggtaaaatactttgtcttcaaaatatccaaggagttttctccctccatcaagttccaggtgaaatggcattttagttgccgtagctgctctccaaggaattcttattgttctcactgtagggaaaaacacaaagatggacttgagacacagatttatatgtcaagaaatgggagcatggcaaataaaatgctcctcctcctaaggctgttaacacaaatcaaagaaactccccttcttttctttctataatatgtttttcttattgttaattcctgcatgtggtagcaggagtttagggactgtgggcagcagaagaatagggcgagggcagtgggttgttctctgagtctgtggctaggttttcatgaataagacagttttgttaaacagctctgccctctctgctttcgagggtctctgtggaggcttggttttattatgtagttttaaagaagtaagtctttttcattgctgtttctgttcttcattcttcccagctttacttttgtactttgaaaatttcagctttataattttttattcttttaatgtttgccatggtgattttaatttctcatccctccgaaatgcagcttcattttatctttgatatcttaattccttagttctccttcatttgcctttaaagaaatctttatcactttcgatttttgtctatttcagcttttaatatatccttcatttattttgtctattcaaactttctgagctttatcagattggttttattttgtattggtttattactttaacatgctacattctcattttttctgtgaatttttccattttaaccatttgaatcttattttcaaccattcttaattttactcattttatctgcttttgtattattctctcatttaatttcaagtattatttatgttgcaatgtcttaaacatttattttggaataaaatgtaattttttttcctcccctccccccatacctctatttcttaaactggtgatttctgttcttaacacatctcattgagttgctctttaataattttgtactttattgttttaattttttttttgaaattttatttttctcttctggttttgcttttataataaggggcaagaagtgcagctacagggaaggctcacaaggccatagctccttttcttatagaaagagctcttttttctttagggtacccttatgactctcctgaaagattttccattccctttagtgttggtcctcaaaataaataaataaaccaaaatcaccaaaccaaaaaacaaaacaaaacaacaacaaaaaaaccccgaaaaaacccagagaacaacaaatgagcaaaagcctgtatttcgaattactttggagataaatagtattctatgcccaaattatttctcaacactgtctgtgtattggagtctctgtaatgttgccttttcttattaaatttttttttcgtggtatctatacagcaacccttgtatcaggagctgtatttctaaaagtatggcttcttatacaaccaatagatatctggaatgtcatgcaatgtggcaggatcattatgaaacatatgtctagatagaagattatgtgacccctctttctaactgcccctctcctcccactttttataccactgcttcccactcccattttgattgggaatcttcctgtaactcactaagaataaaaacagatctgtttggacatgagcttttcaacgggaatgcatctgcattaggatgcctgataccaagccaagcactctccggggctcccgcgcctggggttagttcatcaagggacttagacaacctggctctttgctaagacctatttggagctttgaatggaggcgggtccttcctataaactcctgcctattttccatcctatttttgtttgtttgtttgttattctgcctgggatagttaagtctccatttgttccaagaaacagaggtgagcaggaatgatttaaagttactagagtgcttcacaggaccatgggtaggactgtagtgaccccaggggatcagaacaggacactggggagcttggagggctcagaccctgtgttttctccatgtgatctcagtcacactctctactgcattcattacagaatatggtgagtcctacagaatatgccactctcagaccccaagcatgtgcagcacgcatcctaacacctgaagactcactatagttccttgctccctctcaattctatttccaacttccagttgagtttgggagctcattccctaacacataaactccttagctcctttctcattttacaaaagaaacagagagagtaaataaattgaggttatctccaccatataaaacataaagtctattgtgcatttgcaggatagagtatttaatatacacacttaggtaaaagccctttgagcagccatttaaaaggcatccaactcactgcttgattttgggtttttatttccactggtaagttagagaagctgatgccagaccttgcttcctgggctctggcttgtgaggacctattctcccgattcctatagaagttccattgtatacacaacaacaacaatttcttcctttgcctcttatctggatgaaagccacagtacattatcaaccaggctcagaactaatgctaccaccgcagtctcagaatcactgaggagcttttagaaacacacatcctcagactctaacccagacccacttaatgagaatctctgggagtcaaccctaggactctgtccttaataagctgtccaggcaatttttatgcatgctcaatttgagaaccactgtcttagggcacaagggcaatgcccagtgaaagtcacaatagataagaattaaggaaagaaaggacagatgggtctgtattgtaatgggaaaaattctaagataaaccatgctaaaattctaagaaataagaaaagggttctatagattctgggtgactacaaaaaaagaaatctgtaaatatctcaaatcttttttttttttttttgaaatcaggcagaacattagactagcaggaaataatatcgtttcaagaagagaaatcaggaacctcacagacagaggcaaggtgtctcataggaagtaagcacaggggttggtaacacgggattccagagctccaggatgagggttaggcaaccaggtccggccaccccaccttcaaactggagaaaatatttccttcctattcaatgagctaacacttcctctccagggcagtctcatgttttggggatagagggaatgttagaggtgagaacagaactattttctccaagcactccatctctaattcatctcaggaggcattttggggtgaaaatatttaagtttaccagcccttgtgcaaatctgagtgaagaactacattaaaagtaaaattcacctttgcaggaagtggggtttgctattctgttatatctttaacagtatctgctgaaaagaacccttttgttaaataattgtattacaagtcccaacttaatcctttcaaatatgaaataagacagggtcagtgcacaagagcaatgccccagacccatctttaagtgaagcaccaggccgatgaaacatcatccctctctgctgcctttttctctgattgcaactcaactccccaggcgtgcagttctggagatgaatttaggaagctgccagtgtgaagcagaaaattgttcaggagggaacaaaccaccattggtaagacagattacaaccaacagaggtagaggcatagtaaggctataaacaaacactaaaatggagctggcctctttgggaacatagcttctcaggatttgcattggacaagatgactcaacagcactacgaatacgaagggaaaatatttacctcatggttgcagtgcaattctcagctgttcggcaggctcggttcaggcagctgcactcttcagaaatcttcctcttctgccaccaataaatgcgaagagacctatatatacaagtggcctctggttcctttttgtttgtttcccttcagctgcgttacaaaagggaaagtgaaactagaaagtgaaattggcaggactctttttcttttttctttttattatactttagaggactctttttcctccggagctgagttgtgatcagagaaaaaggcagcagagagggatgtttcatcggcctggtgcttcacttaaagatgggtctggggcattgctcttgtgcactgtccctctcttatttcatattcgaaaagattaagttggggactgtaatacaattatttaacaaaagggttcttttcagcagatactgttaaagatatacacgaatagcaaaccccacttcctgctaaggtgaattttacttttaatgtagtccttcatctagatttgcacaagggctggtaaacttagatattttcaccccaaaatgctcttgagtaaggccaagcccagctgcgtagtgagttagaagaacttcctctttgtggaatgtactgatggatcaagggagcacaactcctaggaggacacatttacaaagctccctgccttgtgattacatattaacccatctttgctctgccttataccaatatgatccacaggccactgtaaggagagttatttagcctcgacagggcaggggattttagtctgaatcattgctgaatctccagtcctgcaaaacaacctgcacattgcatggtatggcaagcattccaaaagtagttgttgacaaatgaatacatgattagaagcatgggcagtgatgtctgtctatctggatttgaaatcacttccacctttatgctatgaaactctggggaaaattattgaatgtctctgcttcggtttgtaaattgggaataatacaactactggtttattgtggtgttgggaggatgaaatgagagatacgtgaaatgtccttagaataatgcctggcagtaataagtaaatgctagtttctatttaattattaactaaaatcgttaaccaaagtgatcagaggggaaactctttttttcaggcggagtgcagtggaaagatcctggcttactgcaacctccacctccctggttcaagtgattgcctcagcctctcgagtagctgggattacaggcacgcaccaccacgcctggctaattttgtatttttagtagagatggggttccaccatgttggccaggctggtctcgaactcctgattcaggtgatctgcccgccttggcctgccaaagttctgggattacaggcgtgagccaccagcccggccaggggaaatttcaatgttggctttttccagaactttatctcctctgacattaacaatccatcacaattactgacctaagccaaacaattcctaacatctccttatgttctggcttccccaagccccacaatattttccccctttttattgatgtataataatttacatattatgagttgcatgtgagtgtttgttacgtgcaaagaatgtttaatgatcaagtcagggaattggggtatgtatcaccttcagtgtttatcatttttatgtgttggtatcatttaaagcctctcttctagttactttaaaatatacataatattgttgctaagtatagtcaccctagcggctatcaaacattagaacttattttttttatttaacggcatgtttgtacccataaccaactctcatcttcccaccaccccccttcccagtctctggtatctattattctattctcatgtccatgagataaagttttttagctcccacatttcagtaagaacatgcagtatttgtcttctgtgcctggcttattgcatttaacataatggtctccagttccaactacattgctgcaattacatgatttcattcctctttaatggctgaataatatcccattgtgtatatatacatattttctttatccatttgttcactgatgagcacctatgttgatttcatatctttgctatatgaatagtggtgtgatgaacatgtgagtgcaggtatccttttgatttactgatttatttcctttggatagacatccagtagtgtgattgctgggtcttatgaaaattctatttttattttttgagagctttccatactgttttccataatgactgtactaatttacattcctaccacagtgtataagagttccctttcccctgcatccttgccagcatttgttattttttttttaataatagccatactaactggggttagatgatatctcattgtgatttttatttgcatttcttggggttgagtgatgttgagtattttttcatatgcctgttggtcacatataccagagtcctttataggtgatgagatgcttttcctttgctgtctttaaaattttctttttgtcacgactttagatagtttgactataatgcgccatggagaagaacgtttttcactgtatctgatggggattgctgggcctcctgtatctggatgtctaaatctcttactagacttgggaagtctcatctattatttcattacataggttttcaaaccctttcagtttcccttcgcctttgggatactgataattcatatatttggtcaccttatggtgtcccatagatcgtgaagactttttcatactttttaattctttttttttctttattttcgtcttattggattatttcaaaagcctgtcttcaagttctgatgttttctcttctgcttggtctagtctactgttgaagcttctgtatattttgtatttcattcaaggaattcttcagttccagaatttcagtttggttattttatgatacctatttctttggcaaatttctcattcatatcctgaattgtttctccgattctgtgtattgtttgaattgtattggatttggaaatctcttgtatcttgctgagcttcttagtattttttatatatacatatatattatttttttattttttatttttttgagatggagctcactctgttgcctaggctggagtgcagtggtgcgatctctgctcactgcaacctctgctccctggttcaagtgattctccttcctcagcctctcgagctgggattacaggcatgtacaccatgcctggctaatttttgtatttttagtagagatgggttttcactatgttggccagctggtctggaactcctgacctcaggtgatccaccctccttgtcctccctaagtgctggattacaggtgtgaggcactgtgcttagtataattttgaatagtttttcctggatttcttttgattgggatctgttgctggggaattgtattcctttgaaggtatcatatttccttgctttacatgcttcctgtgtcctttcactgatatctgagcatctaatataatagtcacttcttcaatttttgaatttgcttttgtaggggaggactttttcctgaagatatatcaacaatatggttgagtaaggcacttcaactttgattctgagtgtgcatggtagtgtagcctctgtaaatttatttggctgtgatcagtgatatatatgatttccttgatggtttagggtggggttattcttggaggctatcgtgacattttactgggaacagggttgccatgtgggccagtcttaggccccagtggtggcagcagtgggttgaggatgtctgatcttcggccccagaacaacaacactggcactggtgttagtgggaccaggtaggctaattcctgggcccccagatagcttctcagatgctgatagtggcagcagtgggccaggtgggtgagtgggttctcaagtccctggcagctgatgtgatctgggcaatggcagtagccaacggtgggacaaacccttgggttctataagtgtacactgatgttggcagtggctgtggtgcagggttgccacctataccacagaacacagctctcaggctctttcattctctgtaatagcaaccccgcagcactgtgcagagaaggagagacgctgttctttaggtgtgagcctaggcacagaggccatgcgtccagtggggtgcagtcaccactcacagcaccagacaggcggccatctggcttccctgccccagcctctgtagtagcatcagtggctgtgcctgcagcagtgtgtagaggacaagaaggggctctgcttctacatgtaagcccaagcacacagcctgcttcactagtgggagagtatctcactatcccttgtgaggccgagtacagagtttgtggtgctgctaagggtagggtcacttctcacagcccaaacaggaggctctggaaaggacatgttttagtttcctttgtatcaggggctgtcttttggcacattgcaccattctttccctggggagtagtactccctgtgggctggggtgctgggacactgtattacctttgggtctagccagtgctgtgtcactgtagcccactgggtggaactgggaaatatcactgggggctcctgggatatggagatatgggagctgcggttcccagataggatgtaattccatgactatagtctcacaatggtgccgcttaggtcttgggggagcgagagacccagcgtgagttccctgtctcatgaaatacccttgtggggtctccaaatcacacccatactggtgtcagagtttgtatgggtagagaaactctctcatgtttcagattgcacagtttgcaggagggatgtggactgctgaagttctctcatttgacctttccctgaaatgcaaggccctctgttatcctggccaatctcagccaagctggccacttgataccttcttctctgcgccttgggtgtttcccatgacttctctgttgaattctagtgttgtctcctagatgtctattcgaggtataattatctattcataattttggttcttctttctagagagggtggggtctgatgtctctagtcagccatcctgaaccagaatccccaccatattttaaatccctgttgttgccctggtatttgacatccccaaatcacaatgtacagccatagtgttttgtaatatagaagaaatgtattttccttattcatacccttagtcacaaagggggtaatcatgtattaggcccaaaagaaaataatagtacctcaaagattgaggtcagaaaattacacaaagcaagatagaacacattctccagcaaaactgaggttgttaaggtaggttattcagtcttgggaaagttatttaccataattttttttctgcctagggcagggaggaaaaagaaactatcctcctaaaaagtctccaccctttgattaggatgcacagctaagcctgtcccagttggaaaccttacttttgtgtcttacgcaagagtttcaagttccttttctgtttacaagttcttcttttcttttttttttttttttttttgagacagtctcgctctgttgccaaagctagactacatggtgagatcttggctctctgcaacctctgcctaccgggttcaagcagttctcgtgcctaccctcccaagtagctggctacttggcccagctaccaggcccagctgatttttgtattttagtagagatggggtattgccatgttggccagtctggtcatgaacttctggccttaaggatctgcccgccttgggaagcactcccaaagtgctaggattacaggcatgagccacagtgctggcttctatttacaagttctattaggtacttacagaaatgtatgttaggtttttaagaatgctgaaataggaaagtggaaatgctgtgggtttggtttgatttattttttgaactcgtattcaagaaaactattggataggaattttaaaatcttgtgaataaaggtactggttgggagaagcatagagaaaggttttgccatggtcactgtgctttgaaatggttgagatactatttacacttcagaaatttgtatggctagtgcctgtatataatgttaccacagcaggtagcatcagctgatttagtagctgggttagtgtgagactatgcatgcaatgtgattgcaaatagcaactgaaaaggaaaaccaactttctcctggtgttatttctattttgagaaaatgaacttattagaaagagttctgcctaacctcgttgctacaaatatatatgtgtctttttccggaatataggccctgttcatatttcctagaacaatagatttcatttatatagaatatagtttgcttcctgttcctggaatgggttacatcaactacagatggtataatgcaataattccatattgctacttgccaccagcaatatcagcatcacctggaagtgcaaattcttaggcccattctagactgatagaatcagaaattccagtgtgggacccagaaatctaggtgttgatagccttccagataattataatggatgctaaagtctgagaaccaaataatatattgaatgaagcaaaaatacttttacttctataaaatgaaactctatgctttttccttgagatttttaaaaaatttgaccctcttttttgttttgagtctatttttaactgaagttttgtccacctgaagagctggtgactgttcaatagtattcgcacttgttagaggaatacttaggtagcccgtgggttctcttgatccccacaatgggctgtaatttgaaaacaatgtgttcccacctattgacattcccttctgtactcattcacaaatacacgtttaaaatggtcttccacatgaactcaaaaatattgatatagttaataaaatagctccccattcttttttcctttccattccttcctttcctttcctttcctttcctttcctttcctttcctttcctttcctttcctttccttcatttcatttcctttcctttcttcctttttttcttttttcttttcagacagagtcttgtctgtcacccaggctggagtgcagtggcgcaatcagagctcactgtcgccttgacctcctcccaggctcaagtgatcttcccacctcagtctcctgagtagctgggatcacagatgaggccactacacccagctaattttttatttcttgtagagatagggtctcactatgtttcccggctgctctcaaactcctgggatcaactgatcttcctgcttcagcatcccaaagtgctggattacaggcataagccacagcacttggccagctccccattcttattcttttttcaaaattaattaaacaccatttcttcttgctgtggtttgaatatgtcctccaaagttcatgtgtggaaacttgatccccaatgtggcagtgttgggaggtgggacctaatgggaggtatttggttatgggggcattgtcctcttgaatagattaatgccattattgagggacggagttccattaaaaggatgacttcaaccttctcttgctcaccctcaccccctatttacccttccatcagggatgacccagtaagagggccctggccagatgtggccccttgatcttggactttccagctccagaaccatgtgtccataaatgtctgttcattataaattacccaatctcccaatctcccatctgtggtattctgttatagcagaaaaaaatggactaagacatttttcagcattattttttagactgcagttgggcagtctttgagtggaaacttgatgcgggtaaatgacttttctttccatagtcctattcagaaataagaccatgctaaataaacttctgctgggacaattgtacacttatccctgttagaacactaggagtatttgtttcattcattcattcaccattgttcatcaaatcaatacttactgagaatctactatgtgccaggcaccattctaggctctaagatacatcagtacacaaagatctctgtcttcatggagcttatattctatcaggaagaatggcaataaacaactgctttggactgaattgagttcccaactcctttcccaaaattcacattgaagccctaaccctcaacgtaactttgtttggagatagggcctgtgaggaggtattaaggttaaatgaggtcttaagggtggggcccctaatctggtaacccctaatctggtaaactgacgtcttcatacaaacaagaagaaaaagaagagacctcagatatctctctctctcctctctctctctctctctctctctctctctctcgtctcacacagaggaaaggccatgtgagataaagaaaaggctgccatctccaggtcaggaagagaggtctcaccagaaaccaactggacttctagcatctagaactgtgagaaaatagatttctgttgcttaagccacctagtcgtgatttttcattatggcagccaatgtagactaatacaataataaataaattagacaattgggacaagtccatggggaaaaaaaagagtaagtggagaccgtaagaggaattacatatggtggagaaaagggggccgggatctgactgctgctgttaagtaatagagatggaaactggttagtctgttctcatactctagaaagatactacctgagactgggaaagaggtttaactaatcacagttccatggggagggctcaggaaacttgcaatcatggcagaaggcaaaggggagcaaggcaccttcttcacaaggcagcaggagggagtgaatgtaagcagaggaaatgtcgatgcttataaaaccatcagctctcatgaaaactcactcattatcatgagaataatatggggaaaccacccctatgatccaatcctcccatcaggtcctgcccttgacacatgaggatatggggattataatttgagatgagatttgggtggggacacaaagccaaaccatattagaacctttctgtgcctcaatttcttcatttttaaaatgagaattgtgcccaggtacagtggtcatgtctgtaatctcagcactttgaggggcagaggcaggagaattgcttgaggccagggtttgaaacaagtctgggcaacatagcaagaccctatctctacaattaaaaaaaaaaaagtagccaggcatggtggcatgagcctgtcctcctagctacccaggaggattgctttagccaggagtttgaggctgcagtgaaccaagattgcaccattgtactccagcctgtgtgacaaacgtgactaggtctctaaaaaagaaaaaggaattatgttagtatttaccacatagggtttgtggagattgagtggactactatgtataaagctctgagaacagtgcttggcacatggaaatgcccaataagggttagttattactaccttctactgccacccataccatttaccattttgaataccacttacttctagggccaggggccactcacctgaaagtggtctgttctctatgtggagctttgactatagtattatcaggtattggtggctgccgctggattgctatttagatcctttttttctttttattcgctttgttggccacagtgagaaactgggatgctactcagaagaagacaaatcagtgcctctgtacaaagggatctttgtgctgccaaaagagtagaaagtttatcccagaaccaaaatatttcagaattgtggaaaatcaagttttggaaacctctcaaaagaagaagaaatattgctatcacagaatccctgaattagtatacacctagccgtgtaacaaagatgctcaaaaacataaatgacactgtaaaagaagtttatttcttgttcaataactgtccaaggctggtgttcctgggcaacttccagttctcttccatgcaatgattcaggacacagagttcttccatcctgtgactctaccatcccctagagcctggaaattgagataaagagggtacacctgattcttaaccatctttacttggaaatgacatacatcacattcctcacattctattaggaagcactagttcatggcccacctggggagaagtgaaggttagtcatgtagctgcagagtaggaagcccccttcctggtgacgacttcatattatgaaggggaacactaatttggaaggatcatgagttgtttccacaacagtatcctgctctggccctaaaaaccatgtatacacttcttcccaaacatagaacataatgggacctttcccaggggagccacccacagtcaaggaatcattgcactcagctcatggtcagggatttctgagtaaagcacgtcctgcctaaaggtcagtatgtgactccttgtggtctcatgcttaaaagaaaaaaaaatcaaaaggctagttaagactatataactcatgtgtatcatggtatcatgtattgtggtagttaactataataaatactttaaactgaaaaaagacagcatggaagaatctcagggtgtgcaacaaatcacaaaataggcaccaaaagagttatatgtggttacctctggagactgggaatagggtggaatggggaagggggttgctatgtctcctaccttgtagatcacgttgacttttaaatgatgtgaatgtatacatttaattaagctaaaaaggaaggaatctggaaggcaggaggaaggggaaaaaatgaggaagaagagaatggagggaaggaacaaaggaaggaagtagaggaaggattggagagaaggaaggaaaaaaggaatgaaggaggaaaggaaggaaggaggaagaaaggaaatgaaaaaaagaacaaagaaaggagaccgagaagtcatcctacatccacatccatattttgcaatattattatgaagctctcaatacccatgtcattgaaaaattgaataatatcagaaaacactcacaatataatgttaagtgaaaggataagatgaaaccaacgtaacatacacccttaactttgaaatattttccaaagaaatctattttatatagtttcatcttttccacgtgaagagaccaccaaacaggctttgtgtgagcaataaagctttttaatacctgggtgcaggcaggctgagtctgaaaagagagtcagtgaagggagatagggccgggccgttttataagatttgggtagatagtggaaaattacatcaaagggggttgttctctggtggcagaggtgggggtcaccaggtgctcagtgcgggagcttttgagctaggatgagccagaaaaggaatttcacaaggtaatgtcatcagttaaggcagggacaggacgttttcacttttttgtgattcttcagttacttcaggccatctggatttatacgtgcaggtcacaggggaatgttggcttagcttgggctcagaggcctgacattcctgtcttcttatattaataagaaaatagcataaaatagtattgaagtgttggcagcaaaaattttgggggtggcatggagagtaatgggcgatgtttctcagggctgcttctagagtgggagagattaagctgaagaaagatttgtggtaaggggtgatactgtggggttgttagaaggagcatttgttgtataggatgatggtgatggcctggatacggttttggatgaattgagaaactaaatggaagacataaggtcaaataagaggaggagaaaaacagataataaaggactaagaattgggaggacccaggactctaattagagagtgtccaagggggtccaagagggtttagtgtaattacttgcttggttgcaagtttttaggctctatctttgagttttttttattgttgtcatataccaggccagatgatttaggtaaaaacagcactcttcatgtgaaaatatacagagtcccccccccccttttttttagcagtgagtaagtcaaggcctcagcgattttgtaggaaagagaaatgcaaagccgcaattgtttgttaaagaaggattagaaatggctaggagagagtgactgagattgataggtggtggagatagctggggagaggtagagggtggcctaagaatgggaacgagaataagataagtgtaaaagtaaagaataggacttcatcggggtgaaagtattagagtatactttgtaccaaagatcttctatccgttcaaacagagacttaagggtggcagtttgaggtaaaaccggcgccactgaataccaagagcctgagaaactgcttgggtgatttgactaataaaggccgttcgttattagactgtatagaggtggaaaggccaaacagaggaattttgtctcacagagggaagaaatgaccatggtggccttttcagaccctgtgggaaaggcctctacccatccatgaaagtgtctacccagaccaaaagggattttagtttcctgacttgaagcatgtgagtaagtcaatttgccagtcctgggaagaggcaaatccccgagcttagtgtgtaaggaagggaggggcctgaacattccctgaggagcagtagaatagcagatggaacactgagaagtgattccttaaggatagatttccatgatggaaaggaaatgagaggttctaagaggtgggctagtgcttgtaacctacatggaagaggttatgaaatgacgatagaatagaatgggcccgtgagctggaaggagatattttccttggtccaagaaccatttgccttgtgtgggaagagattgaaggtggaagtttcagtgggagagtaggtgggagtgaccattgagaaggagaaaaactggcgtgaaggacagaagttggaatgctagctgcttctttagctaccttatcagcataagcatgccctgagcaatgggatctgatgccttttgatggcccttgcagtgaatgactccagctcctttggaagtaaagcagccttgagaagagtttttattaaagaggaattaatgatggagacccttgcgtagtgaggaaacctctttttgcccatgtaacagcatggtggtgcaggataggaaggcatatttagagtcagtataaatattgatgtgtggtacttttgcaagagtgaggcccgagttaaggcaatgagtttggcttgctgagagataatggagggggcagagtggtagctcaatgataggtgtggaagatactatagtatagcctgcctttgctggtgagtggagataggcctggtggaactgccatcaataaaccaagtgtgatcaggatgaggaacaggaaagaggaaatatggggaaatggagtgaatgtcaggtagatcagagagatacagtcatgggggtggggccagcctaaaacaataaggtcaggttgtttggacagaaaggctacaggatgcagtctggctcttgtgtaagaattttgactgcacagccctgtactttcgctgtgtgtaatgaaagggttgggatgagttagggagagctagcatgggggcagcttctagggctgtttttaagaatggaaagaggagtggcaaaaggatttaggatctatggggtcagctaggtttgctttttcagtttacataatggtttagtcaggatggtaaaactaggtatccaaaggtggaaatactaaccatgcctaggaaggaaagcagttgttttgtagaaggagttggggtttgggagattgtcagacatgatcagcagggagagcacatgtgttttcatggagaattatgccaagatagtaacagatgaagaagaaatttggacttgactgaagtaatgggggctgtccgcaaagcctgcagcagtacagcccaggtaatttgctgagcctgatgggtgtcggggtcagtccaagtgaagtgaaaagaggctgggatgaagggtgcaaaggaatagtaaagaaagcatgtttgagaccagaacagaatactgggttgtggagaggttgtggagggaggtattgaggacaaaagaggtacgagttgggcactacagggtggataggcaaaacaatttggttgataaggtgcggatctgaactaacctgtaagacctgtctggtttttggagaggtaaaatgggggaattgtaagagagtttataggctttaaaaggccatgctgtaacaggcaagtgataacatgctttaatctttttaaagcgtgctgtgggatgggatattggcattgagtggtgtaagggtgattaggtttaatgggatggtaaggggtgcatgatcggtcaccaaggagggagtagaggtatcttatcttgtgggttaaggtggggggatatgaaaggaagacatgaaggaggctttgggttgggagaagggtggcaatgagatgtggctgtagtttaggaatagtcagggaagcagataatttgttaaaatgtctcagcctaataagggaactgggcaggtggggataattaaaaaagggtgctaaaagaatgttgtccaagttggcatcagagttggggagttttaagaggtttagaagccggccgtcaatacccacaacagttatggaggcaagggaaacaggaccttgaaaagaaggtatgcagagtgggtagcctctgtattgattaagaagggaatggacttaccctctactgtagagttacctaaagcatctgtgatggtccaggaggcttctcaggtgatcgggcagtgtcatcttcagccactaagcccagaagatctgggaagaagtcaatcagagagccttgggccaggttccaggggctctgggagtggctgccaggtgagctggacagtctgattttcagtggggcccacacagatgggacacagcttaggaggaatcccgggctgtgggcattccttggcccatggccagatttctggcacttgaagcaagatcctgatggagaaggtcctctaggaatgctgactgctgcggcttaggcattttgaagttcttgtgtgctggagatgtggctggggtttcctcacagtggaggcaaggaattgcaactcagaaatacattgttacttggctgactctacctattattgtacaccttgaaggcaaggttaattaaatcctattgtggggtttgagggccgaatttaatttttggagttttatttaatgttgggagcagattgggtaataaaacgtatatgagaataagacggccttttgacctttcagggtctagggctgtaaagcatctcagggttatgccaaacaagccatgaactgggctgggtttttatatttgatgaaaaagagcctaaacctaactgatttgggagaggttggataaagaaaaaggagcattaaccttgactatgccttagctccagccacctttttaagaggaaattgctgggcaggtccgggagggctagtcgcagacgaaactggaagctggactgggtgtgaggaggggaggtgatagaaggattatagggtggggagcggaggctaagggagaattggaactggctcggcctggctaggagcagcctggggggaggggagaggtcagatgggtccgtagaaaaggaagattggaaagacttagtgacactggggttggaactgaggggacaggcaggagggaaagaaggaagatttgggatgagttgcatgggaacagagattagggagggacgagggaccgatgtgtaaaagaatgcctggacgtcagcacctcagaccatttgcccatttttcgacaaaaattatctaggtgttgtaggatggagaatcaaaagtgccattttatggctctttggaaccactgtcgagtttgtattggggttaatggcattgcagaagaaaataaggcatttgggttttaagtcgggtgtgagttgaagaggtttaagttcttgagaacacaggctaagggagaagaaggaggaatggagggtggaagtttgctatagtgaaggaggcaagtccagagaaaagagagggtagagacacagagagaaggggtgggggttcttgcaccccaggaacatggggaaggggtggggtgtttgtcccccagggaagggagagaaaagagagggtagagacacagagagaaggagtggggggtgcttgccccccagaaagtggagaaggggtagggggtccttgccccccaggaaagtggagagaaaagagagggagagacatggagagaaggggttgggtgagcagccctgggctgcaaatgtgggtgagcagcaaagcaggtgtccccacaattgccttgccactaagggaatgtgggtgaatgaccaaggaggcatccccacggtgatcagacaccaatgaaatgtgggtgaataatcaggcaggcatcctgcagtgattaaacaccaagggaagactgtcttcccgaatctgtgaccagcactggagtttgagtccacagataaaacacatctcccgtatctctaccaaaaaaggaaaggaattgaattaagagaagggaaagattgaagtgtggtgccgagattgaaaggagaaagaggttgaggatagtgagagagattggagaagagagtaaagacaggccacttacccgatttaaaattgtgagatgttccttgggctggttggtctgaggagcagaggtcgtaggtggatctttctctggaacaaagagcaggaggacaggggattgatctcccaagggaggttccccgatccgagtacggcaccaaatgtcactcgcgtccatgtgaagagaccaccaaacaggctttgtgtgagaataaagctttttaatcacctgggtgcaggcgagctgagtccaaaaagagagtcagtgagggagatgggatgggctgtttttataagatttgggtagatagtggaaaattacagtcaaggcggatgttctctggctggcaggggtggggggcacaaggtgctcagtgggggagctttgagccaggaagagctgggagaaggaatttcacaaggtaatgtcatcagttaaggcagggcaggccattttcacttcttttgtgattcttcagttacttcaggtcatccggatttatactgcaggtcacagggtatatgatggcttagcttgggctcagaggcctgacatatagcgtaacaggtgtacacagaagcataatgtttaaatattttaatttcagtgggtgatataagggcagtatgattttttttcgcttatacttgctggcatttttccaaagtttctttagtgtgctatagtattcatatcctgagaaaaatctttcatgattctaatctttttattattattatttttaaagatcactgagaactaagagcaaaatgcaaagggagatctttttgaggtctgacaagcccagcttcactggaggcttttaggggcctcagaggtgtagatgctggtttagtgctgactgtggctccttagaaaagaaccagctaaatgcagcctgtcctttgctagagctgcaatgctgagctctgacacagagaaaccctgcctctatgatgaatatagcctcatgctctgactttcaaatgaaaaacagaaacacacatgcttgttaagaacgtttcagcctggtttcatcattaactgatgaaaatgtgcctgcaaggacagaatgaaatagatttgcccctcctctccagcaacccctcctatgagggacgttcgtctctggctccaggctctggccacttccggttaggattgctaaaggcttccatcagggaatgttgatatgagtctggaagcgccacaattttaaaatgcctgaattaacaagaaacaagtattctctaagatatgttaaatatttagcagatgcccaaatccagcacctaagaaaatctaccttgaggttttcaaaggcacacaaataatttcaagggataaatgcaagaaaaaatcctttacctcatggtcgcaggctgggcgtgcactggtgtcctgcagtgttctggcaaaggctgatttgctgcttagaaatctgcctggctgatggcagattcagaggaaaggaagcactgtgctgctgatgaaggatacctttatggtacttgcaaatatgaaatggaagtgtatcctggcaagtacaaacaacataactacactgtttcctgctggagggaaaggagatttcagcagggagagctttaatctttctggctgggactcaactggaacaacgtttagggggaatagtgtgtaaggaagttcaaggtagatgaaatttactagaaggaggattagcaatgtagtggtcagagaaccagaaatctaaaaatgacccaggactagggtggattccggagaactgttgtcatcactagctaatattaatagtgacacagtagctaatgttaaaagaaaaaccttagacaaattaaatttagtagagtttaattgacaaagaattattcaccaatcaggcagacttccgagccagagtggcctcagagagactccgtgcagctgcctggtagaagatttatggacagaaaaaggaaaatgacctataaaaaacaaagtgaggtacagaaatggaagtgttggttacagcccagcatttgccttattttaacatgtttgaatggttggccacctttgattggccaaaactgtgagtggcacaggagtaggttaagtctgtttacacatccagttaggttatagtttactatgtacagaaaaactgtcagggtaacttaaaatatgcaaggaggcagctttaagtgaaacttaattcaacactaatattgatgagaatttttgctcagggctttataggacttacctaatttactccattttacactcatggaaatatggccatttaacagatgagtaagagaagattcagagaacttaagtgatatgccaaggacagaagtccaggtctgcccaattctagaacttcccttgttcagtgtgttccttagtgcagcaagtctctggatctaaactatatagtttctgatttcaactctgaaatgcactcttgtgtgaacttgcatccgttcttcatctgtaaagagtggtagcacctatttcataggttgttgtgaagctcttagaatagtgcctggcacataatggattcgatgaaagtatctgtttctttctttcttttttttttatttttttgagacggagtttcgctcttgttacccaggcggagtgcaatggcacgatctcggctcaccgcaacctctgcctcctgggttcaagcgatttcctgcctcagcctcctgagtagctgggattataggcatgcaccaccatgcccggctaattttttgtatttttagcagagacggggtttctccatgttggtcaggctggtctcaaactccaatctcaggtaatctgcctgcctcagcctcccaaagtgctgagattacacgcatgagcaccatgcccggccaaaagtatctgttttcatttgctgttcagaatgagttttggcctcgctgtatttcctacttctgtcaccaactgtttgtgatattagataaatcataaaacaggctcagttttatgctcagagaaataaaaatcgttggtctggatgatccttccaggaccttctcagtatgaaatatgatgactaacatttcatgaatccatatcctggaatcaagttcaagtgcaaaccagtctaggtctgaggttctgggaaagtcacagtagttctgtgccttggttccatctctgtggaatgagaagagtaaagttgattaactcttgcctcatcaacagcaacatgtagaccctgcatgtgaatgcacatggaacactaaagggaaaactctaatagtaccatactgtttattctgatggagaaccaagagccagggttgaatatctcagccaggaacactagtagggatagtatgtatagttctcagtagctggccctatgatgttcatgccagaggactgatttcataccccaatagtgtggcttattgccaaataccatcatcatacatcctgcctatactttccctaaaactggcatttatgacctaaactggttccaaactgagatgttttcacaactattgagctgagaaagtcagacaaaaagtgcagtagcgaagtgtttgtttggtttcggaatatcagtgcttgagttcacatctgttcctaccacttaccagtggtttgaccttggtaattacttgatctattggagccttagtttccacatctgtaaagtgttgagtattgatacaaccttgtggagttaaagataaattttgcagtgggcacctgttaaaatgtcaagagagcttttattttttttcaagactattacaatgagagagacagactattgcaatatgggagaagactaaactcaacactgaatacaacaagtgtggatttgtagtcaacaggccggatgaagagtggatggaaaattactaaaaagaacttgcttagatatcaaggcctgggaaagaagtcttaattgtatatcagggtgggggggcattcttgataaagtggctcagcaggattctttctaaaactggtctctgaaggagaaggatgagagccatgttgaggcctagtcaagaagaggctctgactaaaaaggaacctgcctaaagtttggtcaaggagggaatccttctcaagagtgcaaatacttaacagacaaatatttgccttctttttaaaatcataaatagccactgttttaaaaccaaagttatttattatttcctctgtggcatgaccatagttggaaatatattacgtgctttttcttcttgtacttctttgtttaagacttttcacctataatatctgaggcagagtttctttagggtaaattgggattataatagctggaatgcaaagaggtaaacagaataatattcagccatgaattccaaaattggccattgaaaccaacttcagaaatgataccataaaaaacactggagcagcttagtcagaaatttctactttggaataataacgaggaagaagcatcagataaaacatcctcacacattctatctttagtgaaaccagatggtgaagaaaattcagacttccaaccgacacataaatatgggctacggtcaaaagtagcagaaatcagcaaaccaacatgagaaactctgactggagatgaatgggtgaagctgggaccaacttaaaatgggacagtgtttggagatggcagatcacaaaattagaattgagggtcccctcctaggaggaccgtcactctgagtgcaaacttctgaaagcagaaatgtaatccagctgtgtttaacgcaggcgaggcagtgggaggcgaagggagaatgtacccaggagacccctcccctgccttcagtgtctcaaggaacctttcctgtttgcctgagagcacgttcactttttacctgactatgagggagattcttccttttgtttttttctttgctacacattgatacccttaaattttttcatatgttttctaattataaaaataaaaatctatatattataaattcatcagtataaacaaataaaagtctgaagttaaacttggatcataatgtgctttaatcactccccatccatgtgttttgtagctgtggttttcaattcaatgataaatcttgggtatctctccatgtcagtcttataatcttgctattttttttcaaggacaacatttaataggcatattttaatgtttattaatgtatttttgctggacatttaagtcattttcagattatcactattacaaacaatgtgaagtgaatatcactgtatgtccgtctttgtacaattgtgtgggtttttcaatacgatcattccggaaattagaatttccaggtcaaagaaattgaccagatgcttcacaccatgtctaaatcctggccccattttttgtccaaaatggtgttgagttgctatttaattcacacttgctaccatttcccacttccttacttaagtacagtgtgtataggccaggtttaggctggaaatccctccttccactgtcaattctgttacccctctgggagcatgggaaggtcacttttgtttgtgggtttatattttcctattactttctcaggaaatgaatgaatttttctatcaatgttctctatcatcccttgtggtttggctcgaagccctggtctccaatcaagggtcatgcaggaacttggctcctgccaatacatttagaaatctggaatccttccataaatgcaaacccttacactcccatctttccctatattctgccacctggtagaaagcaaatccctgaatgttctccaaaactctcttccaaccctaggaccaccaaaggcctccctcacactcttcattatctgctaattcattctctctctccttttctagaaaatagtcctctttggcttaactggtggaaattacactctcagtaagctaagagggaaggaataagaggatataccatactatggcagggagggtggtgaaaggccagggttcatttcagctttaaagcactggagctccaaaggacacaaatcatcacatagaaactcatgatcagtgcactttagaatgcttctcatctcctttgggggttattctatttctattaatgtagtcaagaatggtggctatttttctgggcagattattttggtactaactggtctttcacagaagccattttctcaagtatgttctacatagctacaagcaattgttggtaaaaacctgttaccattctgtatgtttccattatatattgtctctgtgtgtgtgtgcatatgaaagaagactatatattatttttatcaaaatatattagaccatgtacattcttttaattatactatatataaaagtaattttatattacatatttaaaatataaacatatgtaaataatattactataacacatatgtaagtaatatatatttgtgttcttccataattactttttttaacctagactgaagattttacatttttcacaattaattatattttatgagacttcttacttttccaaagcataaagaactatttggagcctgttttgtaattttatatttttggttaatattccaaactaagataacattgccaggtcttccggtctgaagcaaaatagagcagcattttagttgtgtggccctggggaacttgcttaaccctctttccctctgcttcctatcacagatgtttattgtaaggattaaatcagctaaaccagaaaagcctcagggatggtgcctggcaaactgcacgctgttaatacatgttagtggaccttctccacaccttcctgctacactaaagcagagagaattacctcctgaatcatgtttgcgaacttctgggcacagtgactcaactcccagctattcttgtcatggattttttctcttgagccaatccagccatggagatcactggtcttgtgacttattttttctctttcagtatgaatcattagaactgagaaaatgaaaacattcctgttattacttcctgagagaaagaaactagtaacatgctttggtaggaattgttcttctttttcctgctgtgtccctcttgctggtccaccagggctcttggtcctgagcctgatttacaccaggagcataatctgatcaaaaagaggaaactaaagaaaaaaggcaggattgtatgaggggttctcacaatggcagtacataatccttatacctcgtattatgtagacccctgtgtttccaagttacctttgtaatttaggtagtgagcacgaaacacttaaaaaaacacaaatgaaaacaagagaaaggaaagagtggggagggtttgtttatttttgaaaacaacgacaacaacatagagtaaaagttaccaggtaagtcaaatatagtagtactttgttttcttggaagatgaatgaaagaagtcaccttactgcctcaatccagtcatatccctgaacccaatcatgaccagcagaggttgttctaaattgtttctccaatatagagataattgccaataatttttcagtggttgttttctgtattctctgtatttttagggaagctgaactcagaaaacatactttgtccatctagccatccatttatcttttggatccatctttattcattcattaattcactcagtcaatatatattgaatttcaaccagtgtcagacactgttccatgcctctaatgttctgcgtataatgcaagtaaaactaaagaagctaacatttattgatccctaccgatgtgccagtaaccctcttaggtgttttacttaaatatgtgtttaacctctgaaacagctttatgatatatattgtgattatctgctttttaatacgagaaagcagactcaaaaggattacataacttgtataagatcgcacacttgtaagtaaaatgcagtaatgcagaaatgcagtaacgctatttcctctcgtattgcagccactccatcccagcgaaccttcctactgcatgcaggctttattcttccatcactttcctcctctgttctaaatgacattttcacccccatttcctggatacttccttcttttaatacacagtaagttatgtgactgggtttggcattcatctaataaaaacagccattaggtatatattcaataacatttagtgaagccaactgatgagctctggggtgagtactagggattcagcagtgaatagacggagggtcgagacagggctctgggggctaggctgccttcgttcgacctcagacctccactcgctagctcctctagccattatttagtatttctgttgcagtttcctcatctatcaatgggaataataatggtaattattaattaattgatattctaattttcaattaaaaatcaatggagttgtcaggattaaatgactttatacatgcaaaccacttagaataacactttgagccactaaatattaaataactggcatatgttattattattagatggatcctaccctcaatgccttacagtttggtagacagaaaaataagtctcttccaacgatactgttaaactaacagaaacttggttaaggtcatttgatcatctaaggctctacaacagtacagttttacagtcttattttaaaatgttcccctctaatccataaagatatctcaagatagggcaatgccatacttggtgtattatagttaaccaatactgtatgtggaacataatgtggtgtgatactttgaatttgtgtctatctgctgttaaagagcctggctgctaattgagtttctggaaaaagtgagaaatgtcttagctcaggctggtataacaaaataacagaggctgtaactacaatcaacttgcaagtagaagatctttgcttcaaacctagcagtctggctctagaaatcaggactggatgagggtgaagtgagtgagggcctagggcataaaatttaaggagatacttactctgaggtagttcaagtgctgaccacacatttgcaagacgtgagagtgagtgtcttcttaatggcattaagtgccttgcttaccttacctatctagtcccagccctatccagagcctacctttacaactctaccttttaaagcttaacatcctctacaaaattatactatggagtagaaagttgtactgtgaactgagctggcattattctcacacaagctatgtacttgagcatcaaagtagtattaaaatagatgcaatcataacataatctccatacactgcagttagaaagttattatgaagcatctggtatatctggacatacaatcatcaagtcacctgatagccctagagcggaatgaaatttgagaggatcatttggtaaaaggcatatactttaaaaaaactgaggctaaaaaagtaaaataattttcacaaaacgacagagccagaattggcagaaatgaaagtagtcactagttttctaatcccagtttcactcgatatctctgattgtgtattagtcaggatcagcaacagaggcagagccactggaagggatatacacgtttcttttgggtatttgatctttgcaattgtgggagctggccaagccggttctgtaaggctcttgatttcatgtctggtacgaagcttcaagtacataaggcaggtggaaaaaatgggaagatggatgaatgtccagtggcaggacaaggacaggctggaaccacaaccacgagctgcagttccacaaatacggactagacccaagtcagctctcactgcctctaacccctcctgcaggagaagcaggagcccttcatatggagctaactacacacctggcccaggattcagagatgctgaaggaggattcaggggagttggagtagttgcaggtctggtacaccaaggagttaacccaggagatgggccatagtatctgtggttcacaaacacacctgcttgaacgttccaagcataaaaaggctaaatagttgttcttttccaccctctaaatcacatgcaaaaatgtctactgactcatcctgactgaaaaacgaggaaattctgggaaacacagttcagcctagctgagttgagacattatttattataagccccgacagtttcaactctacttctttacctagctcagacactgtcatgtgagcctttggcagtgtctcttaagatagaatgccttttcattttaagaaaacattaaagaataaaagcattcttgacttctgcaatgatggcagaagtcatagcaccagaagcctcttctaataagcagcagcatcaacaaattaattcattctgcatctttgtgtgttataggaggaagaaaatccaataaagtctgtctcaacagaggtcacctcccacccatcagacacggaaattccagacctgctgggagttctggtggccatccttatccctagtctcttgtcattgttcaaggatagggaaaattcctctcaacctgctagatttcagcagcaataaacgggattgtttataggtcagtgagcccaggatactaagggacagacatcagtcaaaagcattttccaaaaaaatctttatattttaatcaaatcactataaagacatgatgtgtcctagtttctcagatgttcacccaacagtctctttctttaacttctgggctgcctttcagaactgagcagagttgtatcaacacaaaagactgtctggactcaggcaccgtacacataccccgtcactgctcctctccttgaggtaatctgttttttctctaatcatctccaaatgattgataatgttgatacccactataagtttttctttatcatttggacattaaaaggtgagtttcctgtgttctttaaaaggacaatagaaagcaatcctttgctctactttagacctttattattacttaattaaattaatctcacaggaaatgttaaatcatttcaaataaccaaaaaatcccccagtgagcttctgacttttgtccaagggccactggcacacaaactccagtagttcctatagttttatgtgtccatggatcccaggaatgtgacttatgtctataatgctgttctatagtggcagtggcaaatttttctgttaagagctaaatagtaaatattttcttcggctttgtgggcagtatggtcttgtatcaactactcaactgtgctgtaaaagtagtgtaaaagcagtcatagacaatacaattccaataaaactttatttacaaaaacaggtggcagactggtttcagcccacgagctgtgtgtgttaacctttgctctctggccctatgaattcttcatgttcacagagcatcttgaaaaatgaggcccaataaaatacctggttttatttcaaatctgccttcttgctgtaaatgactacagctcaggaatatctcaatgaatacccacacatgttatctgtctttacattggctaaacctttgactagattatgagtactgtcctgtcagttgtgattcttctttccctagcagctcctcacagctccccaattcacaatatttttctcagcacaacactttccagggtgtcaaatgttcttaaccatcagctctgttttctcagagcctttgttgatgctttacagaagctaggtaaattgggttccagtgctcctggtctcctgagctcctgctacattgacactgtgttatgccacttgtgttgatccagatgtgatattaacttcccagtacccccaaaacagtccacatagtgccacaaatgcttcctctggctcatccagcaacccctacctctgactccattccatttttccagaggacactcagctcatcctctcatcttcctcctataatgagggacatatgttctactctgactctagaaaatgtatcaagttaatttcttttacaaaaaacaaaggaaaaatagaaaggaattccttatgcttccctcccctccaccaaaagaggaattctgatttaactgtttagtcttcatttctaagacagggcacaaggttgtagctagtgtttataactctttcttttacctatcttcagagtgaccagacaacctacagaatgggagaaactttttcaatctatgcagctgacaaaggtctaatatccagcatctgtaaggaacacatttataagaaaaaacaactccattaaaaagtgggcaaaggacatgaacaaacacttctcaaaagaagcatacatgcagacaacaatcaagtgaaaaaagctcaacattactgttcattagagaaatcaaattaaaaccacaatgaaatatcatctcacgccagtcacaatggctgttaataaaactccaaaaataatagatgctggcgaggttgtagagagaaaggaacacttttacactgttgtgggagtgtaaattagttcagccattgtggaagacagtgtggtgattccccaaagacctaaggcagaaataccattcaacccaacaatcccattaccgggtatgtacccagaggagtaaaatcattctattataaagacacatgcacgtatatgttcattgcagcactattcacaatgaaaagacatggaatcaacctaaatgcccctatgatagattagataaagaaaatgttgtcacatacactatggaatactacgcagcaataaaaaggaatgtgatcatgtcttttgcaggacaaggatggagctggaggccattatccttagcaaactaacacaggaacagaaaaccaataccgcatgttctcacttataagagggagctaaatgatgagaacacatggacacatagggggaacaatgcacattggagcttactggagggcagggggtgggaggagggagaggatcggaaaaataactaatgggtactacgcttaatacctggatggtgaaagaatctgtacaataacccccataacacacatttacctatgtaacaaacctgaacattgtgcatatgtgccccgagcttaaaacaaaagttttttttaaattttttttttttaagacagagtctcactctgttgcccaggctggagtgcagtggtgcaatcttggctcactgcagcctcagcctaccaggccaagtgatcctcccactgcagcctcctgagtagctgagactacaggtgcgtgacaatgttctggttagtttttgtgggtttttttttttgtagagttggggttttgatatgttgtccagctggtctcaaacccctgaggctcaaatgatctgccggctttggcctcccaaactgttggattacaagcgtaagccactgagcccagcctatgacttccttcttttaccacctgttcctattacacttgcccttggcaaacactggttcttgtcatgactccttatctggtgagctgcccataccttcattcttaaagggtcactgccattagcagtcctcactgcattgaattgtttcattttaatattgatttcaggatatggaaatacaaagaggcaccccagaagacctccgcaagccaccatactcctccttaccctcactgtgtggtagcaaccccattttcccttcaagccaggataaatcacccatcagaacaataatcaccttttttaagcctgctggttaattgcataaggagtacaaagtggctggggacagttttactttccaggttaatgaagctacaatcaatgtaaatccatcactctggtcatctctccttctaggaacaatgaacatccaggtgaccgttcaaagctctttccactgggggaatgtcccataaccactgtccttcagaatcatcctaaatgtgacaggagtactgcattggccatttttgggtgatgccagtgtattgtgcaaaccatctataaagtagaccaaatagtctcttcctcagtcaactggtcacatggaactcccatgagaagacagatgagagagaaggggcaatgtagtatgagtaggggtcacaggaatttgctcatgtgacttgtgccttcaggacctacataagtctaatttcatttaccacttcctgtgatggaatactgctgtgcacactcaactttaaggtttgatgggtcagataacatccattcatagctcaggtcttgggccatcgttaaacattcagtctctactagagccccaaagaagccagccactgttcatcaaaagaatagttatctgcaggggatgacatagctgtgctcaagatcctaagggtatcttctgtgatttacctgctaaaggtgccatagagcctccctattgtcacagacacttcgagcaccatcagatctgttgggtcgtataacatgagtagcagagagcttgcctttagcttagagctgttgcattctcttgttctgggccctactcaaagctggagcctttatggttattcaggaagtgggctagaggagcaggcccaaatgaggtatatgttacctccaaagaggtccactaggatcagtgcctctttttcagtggtagaagaaaacagatcagaaatgtatccttcatattggaaaggatatatcaacatgctccagaaaatggacttcggaaattgcaataaggtggcagtcctctgaatttataaggggtttatttcccacccactgtgtcttgccaaggtgtctagaatgcttgctatttcctgcttacttggtctaaatcagcaatactgtcagtatcacattggaccacatgatgtattgtgaaatggagaagtgataagtttggcaggtaaaaatctttgcagttctggagaattacatatccctaaaatgggacaatgaggtggatttctggccctgactggtggaagcaaactgcttcagctgatctttaccaacaaaatagacaatataacatttgtcaaatatattgtggcacaccacatgctagggaatgtgcaactttctccaaggaaaagacatttagaatagtagctaatttggagtgaccacctggtaagttttaataatccacagctattcaccaaggtccatctgcactttgcacagacataatgagcaatccttcaaagaggaagaaattggagtaaaggtcacacaacttatgtctgaccaaatacaaagctgtgtgtctccaaagtctaggcccacatacccacaactgaagaccttagggctctgtaaactcatcaggttgctacctacaaatctgtacctgcagattcattactaaaattagtctcacattttagtaaagaataaagtttaaaaaaacctcatcctcccccaaattttaatacagcaaagtatggagagtcagttataggacattaacctttggtaaggaaattatatttttgaagctacaattgcattgctgtattgccaacgcatcgctttaaatttccccaaagaggaacatataagcttcagaaactccagtctctcatgtacaaactttcatgtcatttaaagtattatatggttgacttcagagaaaattaatgattatgtcatcaaagttttattgtcgaatatgttgaagcctttgcacaatgttgaagagaagaataaaatattaattagacaaaaaaaaaatccttaaagatatacctacattagacctaaaagttttgtttctaggactgatcctagtgaaattaccatggatatagagcgtatcctggcttaaaaaatagaaataactaaacttcttaaagtattattattatttttttgactctgtcaccaggctggagtgcagggtgagatcttggctcactgcaacctctgcctcccgggttcaagtgattctcctgcctcgcctcccgagtagctgggactacaggcatgcgccaccacgcccagctaatttttttttgattttttagtagagacggggtttcactgtgttggccatgatggtctcgatcttttgacccaggtggtccacctgcctcagcctcccaaagtgctgggattagaggtgtgagccaccgtcctggccctaagtatttttaaataaagtaaatcatttaaagtatttttatacttttttttttttgagacagagtctgtctctgtcgcccagactggagtgcagtggtgctatcttggccactgcaagctccgcctcccaggttcacaccattctcctgcctcagcctcccgagtagcgggactacaggcgcccgtcaccgcgcccagctaactttttgtatttttagtagagacaggtttcactgtgttagtcaggatggtctcaatctcctggcctcgtgatccacccgcctcacatcccaaagtgctgggaagcatttttaaataaagtacatcattcaaatgatttaaagtaatcattgtaactccagatgacaaaataatacatgcaaccattaaaaatgatttcaaaaatactgaatgacatatttagatttctactattgagtgggaataaaagtagataactaaaaatatatatagcttgagcctatttttgtgaaattatgtatcagaggaaaacaagtttgaagtacataccaaaatggtaactatattgaacctacatagtaactagaatccattaataacagcaaataaattggatttataaaaaaaattactgtcaggaaaaatatttaaaaaacacatcaactaacatctattgagtgcaaggcactattctaagcacttaacacatattatctttccaaaatttgagatgtccctagacaatattaattctattttacagaagagaactctaatcaagaagaagttaaaaatcttacactagtttgcacagccagcaaattgtagattttgcttgaatgtgggcagcctgacccctgagtctgcactcctaactacaatcctggacctcctttttcctcttccaaaggagagtggataaagatcatatgaaggatatctcccatgtagtatgagtattggggcacacattacatgaacaggagggttgaagataattttaaaatagatatttgtgggagtaaacttgatgttcataaacaaagatattttaagtttcatactcatagcacccacagcttattccccattccttaactcccctgagttccactttccattattctccacctgccctataaagtgggaggtttacagcagagactatacttgccggttccagtgtcctcggctactggttgggttttgttgacaggcggcacctgcaggagattgaaaggatggagaagtgatggtagagtaattatttctttcttttttttttttttaagtttcttttttttttttattatactttaagttttagggtacatgtgcacattgtgcaggttagttacatatgtatcatgtgccatgctggtgcgctgcacccactaactcgtcatctagcattaggtatatctccaatgctacccctcccccctccccccaccccaccacagtccccagagtgtgatattcccttcctgtgaccatgtgatctcattgttcaattcccacctatgagtgagaatatgcggtgttggttttttgttcttgcgatagtttactgagaatgatggtttccaatttctttggttcctccctgctgggactgcctggagcaggctgtgtcagtctactaaggaataattttccttcagggaagcttctgtgagactttctccttccattttccagtaacaatctcatctctctggcctaagggtggttaacagctgaactgctactacctggggctactgcactatcttatgctcccctgcccaacaactgttaaatagtctgtttgcaaatcagctgtctttgaatcattcattttgaatgcccttgttaggatcctgacatacaagttgtgattcctgtgttcataaagtgacactgagtattttggaaacacatcacgtgaacaggagggttgaagataatataaaatagagaatgtgtgggagtaaacttgatggttataaacaaagatattttatttgacattctagccacccacaccttattccccagtccttatttctctgtcctggatagactagatacattcaggaatatttgtaaagcatgttgcatggtaatcttgatgcactctgcagttttacaatgctgctatctcagaataattacacaaaagcaattctctctgcagttctcagggcaattacagagcttctggcaaacacagacattaagtcacagaacactttgtagaccattcttgtctggaacagatttatgaggttacttggtagaccctctttaattagaaactgggaaatgaaaatagtcagacatgagtaaaacatttttttataaagcccccttattttccactcaagtaacacaaagtacagattgagtatcccttatccaaaatgcttgggactagaagtgtttcgattttggaatatttgcatatacataatatttcaggcacgggatccaagtctaaacatgaattcatatgtgtttcatatacaccttatacacatagcccgaaggtaattttatataatttttagatcattttgtgcataaaataatgtttgtgtacactgaaccatcatcagaaagtaaggtgtcactatctcagccacacatgtggatagtctgtggttgtttggcatcaccatcttcttgactgaatttatatgctaccaatacacagtcattttcttacattaattcacacaaagaattttacataaaaaaagacatatcattaatacagtaagaaagaatgtgtttagtgaactaaacagcaccgtagcatcactggaatatctgcgtcagctgttaaatgacagcaacacaaacaacagcaggctttcagtctccacctacgatgctgtgttttgattaaaaagttatgtacaaggtattttttatgtgagaatctgaggatagaaaacatatatcatatgtagaaacatacatcacagctgaagggggctgggaggttctttcttagggacgctgaataaactggtgttgtacacatgcattttgattgcaacttgtcacatgaggtcagaatggaatttttctgttggcccaaaaatgctttgaatcccggagcattttggattttggatttttggataatgatgctccacctgtaataataacatagcatcttctttggtttttagttctctcatgttgggtctctctcattaactagtgagctattttacaagtctgaacacagcaaagattggagacttgcaatttaggaggagccaatggaaaatgtttgtctatagtcaagcaccatggacaaatcttttatgagtttccaatctttcccagtgttagaaactagactgcatattatcaatatcactagatattaattgaccctatgaacaacattttaaaaatgtaaaaggaaagtaaaaaattccaattcaagtcccaaagaacaaaagcatcttttctgtatcacttggtttatgtactgaaagctacttatacactgttcaaaaatgattttccacaaaaggatatgtttactgatctgatggcagcagcggcccatctggagtggcctctgcgaagacgccagctgcaccagggaggtgtgaccaggactgtgtactccatggagatggtgggagccctgtccccttccgagtggcaggtcaggagccccaccctcccaggcacagctacagctgcccagctgtagctgcaacctaggcatccctgcagtttgggggcccaggaccccatggcccccactccccaacccctgcaccccactcctttcccctcacccctgcaagctcagaagtgcctgctcctactgcctgcctctccctgctcctggcacccactccagaacaaagttgtggccaagcctaggtgctgtgtgacctggttaggtgtggatgtgctcagggtggcaccaacatgccagccccctgctgctgggcctcctccagactttgggggccaatgagcatgggagggaggctgaagaggatgggctgagggttgcttagcatgggcctgtgggttcccctcagcacaaacagcccaggggcctggatgacacgcagatggcagcaggaagcagataggcccctgggcagaaaggggcagtccagtgaagcaccaccttgaagccagggagggcctgaagcctgggggccaacctatcagtccaggtggtgtccacagcccagagtgagaacttatggtgctttttctgggcccacccatgccgcccatggaccaatcagcatacacttcctcccttatgagcccataaaaacccaggatcagccagactgggacagatgtcaggatgacctgcctacggataggagctacccactctggtgtcctctctgctgagggctgcacacttgtcaggacaacctgcctgtgaatagaagcacccactccaggtttcctccctgctgagggctgcacacttgggattacctgcttgtggaaggagctacccactccaggtctgctctccactgagctgcacactcattgggacaatctgttgaagataggagctacccactgggggtctcctctccactgagggctgatcacttgttggacaacctgcctgtggaaaggagctacccactttgggtctcctgagagctgtactgttgtcaataaaggacttcttcaccttgctcaccctccagtcgtctacatatttcattcttccggatgtgggacaagaactcaggaccccctgaatggtgggactgaaagagctgtaacacaatagggctgaaacatgcccctaccaccccccctgcttgccatgttgccagcaatgagaagagagaagggcagcagagaagagcagaggcccttccaggagcccaaacctagaggctcccaagccagggctgtgccaccctctttggggcactgtggtttctggcttctccaagtttcggatgccagcacactccccttatccagacttgggtgtccataggagaagctgcttgtgggcatctgatccagcagtaggcttgcacagaactggcatctgtactggtgcctgcagctgccaccccaccagagcagctggcttgctgactctccacagtggctggaccccacactcactgcttatgcacctctcaccactctacacctggcttgaccttggaggcgtgggatctggtggttagcatgagccaagcacagcctgccaggccaagtgggcaaaacaagcccagcaggctgagtaaagctcaggcaaaggtgccaacagccacacaggcttctggctggaaaagtgacccctaaggatcttatgacagttccatatgctatcagtacttctttgaactaaatctatgttctcaagcaacttttgattaatcataactttctgtgtaggttttgtattgcttttgcagatatgtttggtagggttagaggacaggagagtttttaccatggcaaatagaaaggatccagagatgaagttgttttcctgaacataaaaccaaccaaagatgcaagcatattaaaaggacatttgtagtttttggtagcaatccaccaaaaggtctctggtaatttcccacaaaatgagcacttagtaagtaaagtccaataccactaacacaaccttctcttgtttttataatcttctaaagtcagaataaggtcaccatccctgcagcaaaaccaaacctgttgtcatccagagaaattcaggatctattcatggcccaataggcttgcagttcatttaagaaagttcactagggagtcttggaggcggtgaagggcaattaggaggaagagaagtgaaagtcaaagccaactggccctgataccctatatctattttgtatgtgaagagaagttctaggaagaaagagtaaggaattcatgaagacttgatggaatctctagttgcctctcccttttattctgcctcgctgccaacagcaacatgttagtatgttttaaagtaactccaacaactgcacatgtaatgggcttggcagtttttactgttcccttcacaaaaagtgattgtcaactgagaggaatccagacaagagtccactgagatttctgaggaaatgtgaggaaagagtttggaattgttttgtgaaatttactacaaatatgaaaaatacgtttaatatatagaattagaatcttgtaaaggtgcttctcaaacattcctcatgtgagtcaccctgcgatctgataaatttgcactctgattagtagtttggaggtgaggccggaattttggcatttcttacatactcccagatgatctaaggtgctgggccagggaccattctttgcatagcaaggttgtaaaaaggctgggatacttgatgatatctgcagaatgaagatataaaaatgtcaaggtttgcttagcaaagctgtgatcagacaggaagaaagatactgagtttccatgaccctttgctcattgtgctgtcatttagagccttaggctgtaggtacagagagacaaagaaaagagagactccaacaagtgctgaaggagaatgcagaggcaaagagaacagcttgtgagcagactccagggatgacttgaagccctgagggaagccttactagatactcaatgctgtttaattcatgcctcattgcctgcatatagcttgccactgtcagatggtatatgctgatttttttttttggaacgttcagtccattgtgtgtgctaaatgagagagctagcaatcgtatgctttcccatagggaataccaggagttacaagtcctcagcactagtcaggtaacaataaaaatcttgttttctattatctcatcttccctgattctagcttgaagaagccagcagtaagcattgggtaggtgagtaaggaaagactgggaaaagggaaaaaaacagatcacataccccttcccatggctggacttcatcttaacaggcctgaagtaaaagagggagagaaacttttaattgaaaagcgagattggaattggatggttacggcaaaaaaatcaaccgggctgttcagggatagggaggggagctcaggaatacacattgcagggcagcaatagagagacagaatttcttaatgaatctgagcaagttcagccattcaatataaactagtgttagatgcacaggtctgaacaaggaagaataagaataaacacagaaggtacagaatgagactagagttctattctcctctgcactgagagggggctggattgacctatgccaatgagttttcccacatttctaagacatttatttcatcttgtaatcagagccagcattctctctgtttttcaagagaagccaggattatatatttttatgtgagctttctgattttttaaattttaattttaattaattaatttatttttttgagacagagtctcctctgtcaccccggctggagtgcaatggcacgatctgggctcactgcaacctcctcctccgggttcaagcgattctcctgcctcagcctcccaagtagctgggattacaggcgtccgcatcaaacccagctaatttttgcatttttagtagacatggagttttgccatgttggccagctggtcttgagctcttctgatttttaactgttgactactaattcaaatttctagaacaccagagggtccagctattttggcaaaggatgcatatctgagggcctctggctatgacttcggactaggcatcacatccaattactcacatttatgtaggagggcactgaaagcttggactagtcatttctgtgtcctcagctccaggctagttctttagtaggtgtccatacatgtcgtaataggaatcaaaggcaactatgggctggaaattaaagacccttagacaataatttctgaaattcttctggtgctggaatgtgtcactactagctacctttcaccttttgtgatgaactgactgagaagcccagcataggaaaaggaagaggaacccttgctcaccatcgcgggtcaagcctggagcgtcctggatatctgaactccatcttcaagtgcatgctagtaaacctttatcagcgcttccaaccgatacaaaacagaatgggacatgtttaaattgcctccctttggaggcagagcagtctgccctgtatgtgctctgtaaagcctccttccctttactgagcacaggagatggagggccttgaactgttaagcactgtaatgtgtgtggaggtggggaaaacacgccaaaggcctgtgagactctgaggccccatgtaccagaatgtgtcggcacctccaagtggaggcccaagcgtgcataggcccagacacggtcttcctggggaactgctgccccctgcggcaatgaagggtgagacaacattctgttctaatcagcttagccaatcttctccacagcacccaacctctcatccataagccaggtgagttgggccttcctgttttgagcctcaggttcccagcttctcgcttcctccactatgcactgagggcaggagccaggtatccttgttcagtcggaatctgcaacccttaggagagtggcctatcacacaaagaactgctgaatgaaaatggttaaattctcgttagtgaagaagagctggatctttggcattaggctacttgagtttaatatcatcttcatggcttgagtctctatatcatcatctgaagaaacggaaaacacctctttgggtggttactgattcaacacgataatgaatgttaagtattaggattatatctgtcaatagcaagggttcaataaatagtaactattagtatttttttaaataggcttatcgaagttgacagatgaagattaaactgcacatatttaaattgtacattttgatgagttttcacattgtatatacctgtgaaaccatcactacagtgaagataacaaatatatttattccctccagtttccccatgcctctctgtcatccagcctcctctcctccccaaagaaaaatgtccccttccaggaaaccactaattttctgtgactgtagactaatttacaatttctatatttttataaaatgaaatgagacatgtactgtttttgtttgtcctctttctctcagaataattatttaagagtcattcatgttgctgtgtgcatcagaagatcattattcttttattgcagagtaaattccattgtatagatacaccacaatttgtttatccatttacctgttgatgggcatttggttgtttccagtttatggctattacaaataaaactgctatgatcatttgtggacaaacatttcatttctcttgagtaaatacttaagagtagaatagctgggccatatggtagatatattataatcttttatctaaagtgattgtaccattttacattcccatcagcgatgaaagagttcccagctgcttcacatccttgccaacactttttaattttagccatcctggtgggtagatagtgttatctcattgtggttttcatttgcattttcctaatgattaatggtgttgaactcttttcacatgtttattcatcatccatatatcttctttagtgaaatgtctgtccaaatttttgctcatttttgatcgggtttttagtttttaaggagcagaccaaatcattttataagttaaaaaaacttactgagatacaatctgcataccattcaattcaccatttaaagggaaaatggcattcagtatatttgcagagctgtgcaactatcattgcaattaattttagaacatttcatcatcctaacttcctcttcttccccatcctttagccatcaacccaccatcatcctaggcaactactaatctacttgctgtctgcagagatttgcctattctggacatttcatgaagtggaagggtcttttttgagtggctttttaaatttggcataatgttttcaagattcaccatgttgtagttagtatcagtgcttcatttttaaattatagaagaatattccattgtagaacatatcaaattttatttattcatgtcttcatcagttgatgaacatatggttgtttcactttttggctatattgagtgatgctcttatgaacattcatgtacaagtttttatgtaacatcagttcttatttctactgggtatatacttgaaagtgcagttgatgggtcatatgatactctatgtttacctttttgaggaacttccagacagactgttttccaaagtggccacacatttcacatttccagcagcagtgtgcaagggttcacatttctccacatcctcatcaacattgttattacctgtattttttattatagctatcctagtgggtatgaagtggtatctcatatggttataaaacgtcttttttttagaaaaaaaagttactttactttgaaggggtccaattgttgatattttttcttttataggttgtgctttttgtgttgtatttaaacaatctttgcaaaactcaaatttcttaagattttctccaatttttttccaggaactcctatatttttactttcaaatgtatgtgtatggtccattttgagttaatttttctatgacttaagggtctagttcattgtttcgcatatagctattcaagtgttctagcaccattgttaaaaagattatttttccccattgaattgtcatggaaccttggtaaaaatcaattgggggtctacttcccagattcagtattcttattcttattcagtattcttatttttaaaaggcagccttaacttaggctgatcttgctccaatactgagacaatagtcttatgaatcttttattgagtgccttctggttacaatgttttcccactctggctggttgtaacttaaaccattccaagttttgtgtgaccttggggatcttaccgtttgcaggtggttctttccactaaactatggtctagcatagttcttcacatgcaaactgttagttaaagacttgaaggaacccatctgcagctcgccacagctctctctctcttcagctctctctgctccagcattctgccctgcaactctgctgccttagagaattcctactgccagatgagaatgcttttttaattctcatttttctcctctatttaataaactgctggattttgcttggatttggcctccctaaactacagcctggaaaatctgtcaggcaattatctgaggcattgcagggatcatttcatttgtttttcttttctcaaggatgctctttcttttgcactatttgttgtccaatgtctgaaattatcgtttcatactttttcaacttagctgtttaaagtaggagagtaaaccaggtcattgttactctatctttgctggagcagaactgctattagtattgtttctgtctttatttcaccagtctggcttatgatataagtgaccatcccaaacacacatgttcatatatgcacacacacacacacaccactactacccctgttttctataaaactttctttttatagttgtgaaagttgtcaaaatcaaaatgaagcctttatattaaagtcctggcaaatggacccatggaaggccataaagggagtattctcaacatatgcctgaaattcagaactatcacaaaagactgccaaaaatgcagtcttgcacagaaatacttctgcaaggatgtctattcagcaactgtcagtccttggaccaatgccaccctgttattgatcctcgtagccaaggacaattgattcaaaacaacttatttattctttctcatttgcctttaaaaacttccccttgtcttaacttctttaaatatgcacatagtataatatgcacacttattcacattgcaaacctgaataaatatcattttcttatgtagagtctcctttctctctttattaagtttaacttggaaaaggtataggtcatccaccagtcactgtggctacaatggcccaaagcaggaagtaggagaaatcttcccctacctgagtgaaggaacctcgggttatattttcattcattcactcacggatgacaacctggatttagtttgcctgggttgattttgggctacatcactttttacttttgtgaaattgtgctaagccctctacatacagttctcacttaatcctcaagactaccttcatacacccattttacaagtgaagacgctgaggttagaaagggtaactatattgcccaatgtctgacacacagaaatgctgctcaatctgttctcgtttctcagtactcacttcacttaagctgtcattggcacttgcctgggctgatcattcctctttcatgaaatttctttcttcagttcatgtcaagtacaacacactcatttctccccaacctcattgtcttctcagcttttatatcttctgaatctctacgtgtgttctttgctcttatgcttactttataggggatctcctccagcctcatgtctttaaatactgtttctaactgattagtcacaaatcatatctctagcctggagcttgaatacatctatatatcctagtcctactcaacatctccatgtggatgtttttccaatcttctcctttttgttccaaatccttccctgtcctacctctgctctgctctgtcttgtggagggtggagtggtctgacctctgcggctcttgtgtcagccacctttagcctgcctaggatcctcagaagggacttgtggaagatgaaggaagaaggaagaaagaaggggaggtccagctatttctagctcctctctttcttgccatgagtagtgtctctgacagagactgttgctcaacttctggtctatggtgtgacactccttcatccaataatgccccagctctttccactgttgctaataatttctgtggtgccaccaaaccctgtttgtcttctcagcaatgtcattacctgtgtaaccatgtcctctgtttgcatgcctagagtggcttctatttcctgacatggcctgagttgacacaggtctctaaaaggatctcaaaaccaacacatctagaacaaactcctaatttccctctcaagttgttcttcctgtagtttgtccattcaaattcatggcaactccattagtgccatccttgatgctactgtcctctcatacctgtattcaatccaccagcaagtcctattggttcaactttataaacatactagagctgcctatttttctccactttcactgctatcaccatcctggtccaagtcattataactctcacttggactattgtggtagccttctgatatggtttggctgtgtccccacccaatcattatcttgaattgtagttcccataatgcccacatgttgtgggagggacccagtggagataattaaatcatggggggcagttttccccatacctttcttgtggtagtgactaggttcatgagatctgatgggtttataaggggaaacccctttcacttggttctcatatcctctatgtctgctgccatgtaagacgtgccttttgccttctgccatgattgtgaggcctccctgccacgtggaactgtgagtcaattaaacctctttcctttacaaattacctagttttgggatgtctttattagcagcataagaactgacacagtaaattggtaccagtagaatggggtgtattgtaaagatacccaaaaatgtggaagtggctttggaactgggtaacaggcagaggtggaacagtttggagggctcagaagaagtcaggaagacgtgggaaagtttggaacttcttgagaactgttgaatggctttgaccaaaatgctgataatgatatggacaatgaaatccagctgaggtggtctcagatggagatgagaaacttgttgtgaactgtagtaaaggtgactctgctatgttttagcaaagatactgggggcattttgtccctgccctagagatttgtgaaacttgaacttgagggagatgctttagggtatctgggggaagaaatttctaagcagtaaaacttgaaatggtgacttgggtgctgttaaaagaattcagttttaaaagggaaacaaaacataaagttcagaaaatttgcagtctgacaatacgatagaaaagaaaaacccattttctgagagaaattcaagctggctgcagaaatttgcataagtaatgaggagccaaatgttaattacaagacaatggggaaaatgtctgacagggcatgtcagagacctttgaggcagcccctccctcacaggcccagaggcctaggaggaaaaaatacttttgtgggctggctcaggtcctcccgctgtgtgcagcctagggacttgtgtcccagcctgtgtcccagtcactctagccatggcaaaaggggttaaagtacagctcaggccatggcttcacagggtacagtccctaagccttgcagtttccatgtggtgttgagcctgtgggtgcacagaagtcaagaattgaggtttgggacctccacctgtatttcagaggatgtgtggaaaagcctgaatgtccaggcagaagtttgcgcaggggtggggccctcaaggagagcctgggctaggtcagtgcagaagggaaatgtgggttggaggcctcacacagagtccccaatggggcactgcctagtgcagctgtgagaagagaccactgtcctccagaccccagaatggtagatccaccgatagcttgcactgtgcacctggaaagctacagacactcaacaccagcctgtgaaaggagccaggaggaagggtccccctgcaagccacaggggcagagctgcccaagaccatgggaacccacctcctgcatcagtgtgactggatgtgagacatggagtcaaaggagatcattttggagctttaagaaatgactgccttatggatctggacttgcatgcggcttttagctccttcattttggccagtttctcccatttaaacaggtgtatttatccaatgcctgtacccccattgtatctaagaagcaactaacttgttttgattttaccagctaataggtggaagggacttgccttgtctcaggtgagactttggctatggacttttgagttaatgctgaaatgagttaagactttgggggactactgggaaggatgattggttttgaaatgtgaggacatgagatttgggagtggccaagggcagaatgataggtttggctgtgtccccacccaaatctcatcttgaattatagctcctgtaattcccacagttgtgggagggacccggtgggagataactgaatcatgggggcagtctagcccatactgtcttgtggtggtaaataagtctcacaaggtctgatggttttataagaggaaaatcctttacttggttctttctctcacatgtgccgccatgtaagacaagccttttgccttctgccatattgtgaggcctccccagtcctgtgaaactgtgagtcagttaaacctttttccttcataattacccagtcttgggtatgtctttattagcagcatgagaacagactaatacaccttctattagtctccctgcttctgtagttcagaatgatctttctaaactagattatgctgccctctattgaaaatattacactggcttctcatcttactcagaagacacggtaagatcttgacagtggctcccaaggcaccagacttctaggacttcatgttctattactttctactatgtaattctgttttagcctcaaagacctcaccactctggctaggacccaccaggaatattcctccacagggcctttgtacctgctattttcacccagaatgtgctttctccagtatctaaggtgttaactacctccttgcctgtgctcaggtgtcacttcataagagtcctttcctgattacatatacatatcatcctccttatccctgtttttttttttttttttgggatggagtctcatctgttgtccatgctggagtgcagtggcatgatctccgctcactgcaacctccacctactggttcaagccattttcctgcctcagcctcccaaggagctgggattagaggcacacaccccacacccgctaattttgtatttttagtagagatggggtttcaccaagttggccaggctgtcctgaactcctgtcctcaggtgatccgccgtcctcagcttcccaaactgctgggattcaggcgtgagccactgtgcccagccccttgttgtttgttgttgttgttgtttgtttgttttgttgttatttatagcacttatcaccacctcatgtattatatagttattcatgatgtgctcttcccatcagaatatatacaagagaacaggaaccttgtttggttggtttctataccccactgtcttactaatgcctggcatttagtaggtgctcaataaaatctttgttttagaaatgattaataaataatatgtacatattgaatattgtttcctcttttaacaaatctttaaaataataaaaaatttaaagcagcaagattgctttgcatcaggcacaatgataagcgcttaaatggagcccatgattcactttcatttatagagcccacatgctctctgtcaggcgcagaggtgccagccctgcaggagcttcgggggcggagcagaaggccgcctaaaacagcctttctaagagagcatgcgtaggcgacgcgctggtagagctgtggacctgccagcctgcgaggggaggacgggctccatctcttagaaacgcctacggcgcatgctctatggggtcaactgggggctggcaagcggcagcgctggtctggggcggagtctccgaggcacttcccggtggctgctgctctgattggctgaacaaatagtccgagggtggtgggcatccgccctcccgacaagcagaccaggccccctgcaggtcccctatccgcaccccggcccctgagagctggcactggactcgagacagcggcccggcaggacagctccaggtgagagtgccggcgccgcggcgctccaggtgcgggtgcggcgtggaagctggtgccttcagcaaggggagggtcgcgccccgagctctgccggccggcaagaccctctgcgtttggacccagcgagtcttgcctggggtgccgcgggtgctttttctgcgggcgttggctcaaggcatctgccaatcaaccagggcaacttagagagcaacttcagagagaagcccactctcttccctgggcgctgtccactttcctggaaggcgcggtctccggtcagtgaagctgcccagtgctcctggaccgcgaggacagcagggtgtctgattcctctctctgcatcctcgtgctctccccttagctcctccaggcatcccatctacctctcttgttagccaacggcgtggtcgaaagcagacttgggcatcaatcctggttaagtcccagcgatactgctttttaaacagctgacactttgcttccagtacttcagctggtgaacctcagattcctgaaaaatggaattaatggtactgccatagggtcggtggaggagaattgacagtagatcagaagcgctgcctgcggtggctggcgcctcgcaagagcttaaatggagtcgtaataattgttgttattagaaagttaaatagcatgctgcgttggggccttttttctgccactgaactgttggactgctcttatcttttttcagaatctgtactatgcatctatatatacgtggcactttgcttggtcctgggggtacaaagctgagtcagattgttacaagtctaaataactgagataaaggtgttaatacagcccagaaaagcacacttaattcagccggaaggttttttttcccccctccttcgagattttcagagtatctccttcttagtaagaatgcttggcttagtatgttgagaaaaacatactaagtatgtagtgttgtgttggaaggaaacttaactgggtgagattttcagctgagtagctttagctgttactctcatggaccttccctgggcggttgatacaggttctgtaggaaaaccgctgaatgaaagcagctcctgcagatctattctgttttcaattgtggtaattcctttaattttttccctttcaatttactccttatctctagtaataatagacttttgggaggttgcatttatgataaaaaatagcctggggcttacaatccttcctatcatgaagaagtacaaagttgtaagtagaagcagtggccttgcttgccaatgcacactgaaggggataacgtttgctcctgttcagagttcacggccgggcgcgtggctcacgcctgtaatcctagcacttttggaggccgaggccggcggatcacgaggtcagagatcgagaccatcctggctaacacggtgaaaccctgtttctactaaaaatacaaaaaaaaattagccaggcgtggtggtgggcgcctgtagtcccagctacttgggaggctgaggcggagaatggcctgaacccaggaggtggagcttgcagtgagccaagatctcgccactgtatccagcctgggggacagagcaagactgtctcaaaaaaaaaaaagaaagaaaagaaaagaaaagaaaaagaaaaaagaaaaaagaaaagaatttcagagttcactacttcttggaaaaaataatcccaggaggaattccatcaacagaagggagtcagttcacttttgcaatctcctggaatcaatttcttaagacttgtggaatattcagtttaaacacaaaactaaaaacaaacactgtattggagtattattgacatacaatagcatggcatatttcaattgtacaattgtatagtttttgcatgtgtacacacctgtgaaaccatcagtacattcaatattatgaacctgtcatcacctccaaaatattatttgtgcatacccctttgtgatcctttcttactgcccctttctccaggaaaccactgatctgctttctgtgaatatagattagactgcattttgtggagtttatatgaatgggatcagacagtacttttttttttccttattttgatctggcttctttggcataattattttgagattaatctatatttttttgtgttccttcccttttatagctgatagtaggtatataccataatttatccaatcatccatttaaagcatttgggtttttccagttttgtctattacacccaaagctgttataaacatttatgtacaagtctttgtatgggcaacatgcctgcatctttttaagtgattctatttattttttaaaaatgtagaagttctgggtctagtcctaggtttttctctgaccacttgcgtgatcttaggagaggcatttaactttgcttcagcatcctcaaggtctttgctgtgattttgagtcatcactgccagaaaccaagatgtctttgttgatttgatggttagagaatttcagaaggagagagacgggtcaaatttttctttctgtttcttttgaaagctctattttctttcatttcacttttttcccatgaatgacaatttaaatgctgacgtataatttggggcaagaacagaagtggttagataagtaggaggagagctaatagtggttagataagtaggaggaagagctaatagtggctgaacttaaacatgctaaatcataggtggaaggcaagaggtgggaaataagcaagctcagaaattttgtgtcttttctttttctcaaactatcctcttctaagtcttgccttttgttatttctccatgaccatttgtttttaactttggggttaggaggtgaatgggtatgctggactccaaaggtcatattcaactggaggtggtgggtgggaggtttcttagttaaaagtaattcctttgggccgggccggtggctcacgcctgtcatcccagcactttgggaggccgaggcgtgatcacgaggttagagatcgagaccatcctggctaacacagtgaaaccccgtctctactaaaaaaaaaaaaaacaaaaaaatttgccgggcgtggtggcgggcgcctgtagtcccagctacctgggagtctaggcaggagaatggcctgaacctgggaggcggagcttgcagtgagccaagattgcgccatgcactccagcctgggcgacagagcgagactcagcctcaaaataaataaataaataaataataaataaataaataaataaataataataataataataataattcctttgggaggcggggcgggcaggtcacgaagtcatctgagaccagccttgccaatatagtgaaaccctgtcttactaaaaatacaaaaattagccgggcatggtggcctgcacctgtagtcccagctactcggaggctgaggcaggagaaccgcttgaacctgggaggcggaggttgtggtgagccgagatgtgccactgcactccagcctgggcaacagagcgagactccgaaaaaaaaaaaaaattctgggcaggcgcggtggctcacgcctgtaatcccagcactttgagaggccgaggtgggcgatcacgaagccaggagttcgagaccagcctagccaatatggtgaaagcccatcgctacaaaatacaaaaattagccaggcgtggtggtgcgtgcctgttgtcccagctacttgggaggtgaggcagaagaattgcttgaaccaggaggcagaggttgcagtgagctgagattgcaccctgcactccagcctgggtgacagagcaagactccatctcaacataaataaataaataaaaaataaataaataaataaaataaaaataaataaataaaatttaaaaattccttattctctttcagatatggctggagtcatttgtttcatattttcctttcaccttttacttgccctaatctggttcagaactttttgtgggagcattaagttaccagaatatttttgtgtagtaaattcaagcaaataataatagactgttttattatacagaatgaaaatgcggttcttggggtggtggtctgtttggttctctggaccctgcattctgaggggtctggagggaaactgacagtgtggatcctgaaacaaacatgaatgtggtaagtttctcaaagttatgtacttttaaaagcatctatttccccgatccagttatgtgagctacatgaagccatacccatacattcatcctttataactcctttgcttttcaatttctctgaatttttttttttttttttttttttttaggcagagtcttactctgtcacctgcccgcccaggctggagtgcagtggtgtgatctcgctcattgcgacctccgcctcaggggctcaagtgattctcgagcctcagcctcccaagtactgggactacaggcatgcaccaccatgcctggctaattttttttgtatttagtagatacgggtttcaccatgttgcccagggtggtcttgaactcctgagctcaggtgatctgtccactcagcctcccaaagtcctgggattacaggcgtgagccaccgtgcccagcccaatttctcgaatcttagattcaatttgctaggcttttctcaccaggtaatatgtagccaaca

SEQ ID NO: 5047 - DNA, 54985 bp, Homo sapiens
  misc_feature (48521)..(48725): n is a, c, g, or t
ttacagattgggaaggaataaataaagctttgtttgcagacgtcatgatcatctatgtaaactctaaaagtatcatcaacaacaacaacaaatgtcctggaattaataagcaattatacaaagttgcaggatacaaggttaataaacaaaagtcaatagctttcctatataccagcatgaacaagtaaaatttgaaattaaaaatgcaataccacttacgttagcacctcccaaaatgtaatacttaggcatgcatttaccaaaacctatatgaggaaaactatataactctgataaagaaataaatacagagctaaataaatggagaaatattccatgcttgtggataggaagctcaatattgtcaaatattagttcttccaaatctgatgtataaattcaacacaattccataacaattctggcaagttattttgtggatagcaaaaaactgattcctgggccaggcatgtggctcatgcctataatcccagcactctgtgaggccaaggcaggaggatcgcttgagccaggagtttgagaccaccctgggcaacatagtgagaccttgtctctataaataataaaaaaattagccaggcatggtgatgtacacctgtggtcccagctgctcaggaggctgaggcagaggatcagttgagtctgggaggtcaatgctgcaatgagctatgatcacatgccactgcatccaacttggacaacatagtgagatcttgtctcaaaaacaacaaacaaacaaacaaacaacaaacaaaaaacctgattctaaagtttatgtggagagcctaaagacccagaatagccaaaaaaaaaaaaatggaaagaaaagaacaaagttggaaggctactataaagctacagtaacaagatggtgtggtgttagtaaaagaatagaaaaatagatcaatggaacagaatagaggcccagactcatacaaatagagccaactgatatctgacaaaggaacaaaagcaataccatgagaaaagacagcctttctgacagaaggtgccaaaacaactgaacattcatatgcaaaaaagactagataaagcctcttatccctctcacaaaaattcattcaaaatagatcatagactaaatgtaagttgtaaactataaaattcctagaagattggccaggtgcagtgactcacagtgtaatcctagcactttgggaggccaaggtgggaggattgcttgaggtcaggagttcggaccagcctggccaacatggtgaaaccccgtctctactaaaaatacaaaacttagccagtgtggtagcaggcgcctgtaatcccagctactcaggaggctgaggcaggagggtcgcctacttgaactcaggaggcggaggttgcagtgagctgagattgccccactgcactccatccgggggacagagagagactccatctcaaaaataaaataaaataaaataaaatccctagaaataacacaggagaaagtatggatggtctggatatggcaatgattttttagacactatgcaaaggcatgatccacgaaaaaaaaaattgatgagctggactttattaaaaacttccgtttgcaaaatacactgtcaggagagtgaggagacaagccacagactgggagaaaatatttgaaaggacgtatctaataaaggactgttatccaaaatatacaaagaattcttaaaacccacaataagaaaagaaacaacccaattaaacaatgagcaaaagacctcaactgacatctcacaaagaagatatgcagttggcaagtatgcatatggacatatgctcaacatcatatgtcatggggaactgcaaattaaaatggcaatgagataccagtacacacctattagaaccggcaaatcccaaacactgacaacgctatgtgttggtgaggaggcggagccacagaaactctcatcactgctggtgggaatactcaatgaaacagcttctttggaagaagatagtggtttcatcaaaactaaatatattcttattacatgatccagaatcattgggtaaatccattgatgttacccaaaggcattaaaaacttgcatccacacagaaacctacatacagatatttacagcactttattccgagttgcccaaacttggaagcaactcagatgttcttcaggaggggaagggtgaacagtggtatatccagacaatggaatattattcagtgctaaaaggagatgagctataagccatgaaaagatatgaaggacataaatgcatattactaagtgaaagaagctagtctaagaggcgacctactgtatgatcccacttaagtgacattctgggaaaggtaaaactgtgagagagtgaaaatatcagtgattgccaggagttgtggggagggaaggatgaacaggcaggcacaggggtggtttagggcagtgagactgttctgtgtgctgtaaccctggatatgtgcattgtacatttgtcaaaacccatagcatgtggaataacgagagggaatcctaatgtcagatgggctttgggtttgtggtgtatcactttggatgatggtgtatcactgtaggttcatcgttgtaacaaaaggacggctctggtgaggaatgttggtagtggggaggctgcggtgttgggggcatggattatatgggaaatctctgcactttctgctcagttttgctgtgaacctaaactaccctaaaaaatactctagtaaaaaaaataaataaatagagacccagcatggtggccacacctgtaatctcagtgcttcaggaggtcaaggagggaagatcatttgaggctaggatttgaggcctgggcaatatagcaagaccctgtctctacaaaaaataaaaatacagaaactagctgagtatgatggtgtgagcctgtagttctagctacctgggagcattgcttgaagcaggagtttgaggctgcagtgagctatgatcgcaccacagcactacagcataggcaacaggtgagactctgcctctattaaaatatatatatttctagggaatcatcattaaaaaggtttcactgcagactctgtcttcataattcggtaataatgtttctatagtccatctatttccacaaacatatgaaatggtttacagtaaaagatgtatgtaatagtacaaataaaaagcattttaaaaaagtaaagctttatggaaaaaagagagggacagttaatcctaaacctgggctatgtgatttctggtattgaatagatttacttttgaatttcctgaaagtcaaggcaaaattaaaatatcaaacattaaagtttttattaaagtttgttgttgaaaaacaaaccagctacatttttaggaggctcaaactttttcctgatagtcatttttaaatatatgaagagaacatcatgcaatgacagtcttcaattccagttttatcggtggctggggccgggcagtgctcccgtggctctccagtctctgccgggggccgggggttgggagcaggatggaggcagggctggggaagatgcctcacggtgatccctcctgtcgtgcttcctccctcctctgaggctaaggatcctggggagagagtgcagcacggagaccgcacagccggccccatgcacaaagctgtgccggtgccttcctaaagagcgcgccgcctgcagaacgggaggcctcctccctgcttcgtctctgcgccccctcctgctctctggatcctctggctgctctgatcattttatcttggatggggttcaacctttgaattccctaagacagtattttaactgactccttacgataacttgttattatggtttgaaaccgcgcccacactgaaaggggaccagtgctggcagaacttcaggactggtgagaggtttgtaaagggataggagcatccaagccgagatgaaaaatacaccaaccttctgctgaccttccgccgccaacagcaccttctctcctaaggatgctccctggccgcagactttctgtgcagtgcgcagcctgtgttcactgacaggaaagagcgatttcagcgctgtcattctaaacaatgatttcttctccgtgtctatgaaaaaacaaggtttttttttcttcggataaacaaaacaaaaacccaaaaccaacagataatctaaccttaatcacaaaggtgtccgagttatttagtaggtacagagtagaaagatatggttaaggctgggcgcggtggccacgcctgtaatcccagctctttgggaggcccaggggggcggatcacctgagatcaggattcaagaccagcctggccaacatggtgaaaccccacctctactaaaaatacaaaaattaccgggcgtggtggtgcgcgcctgtaatctcagctactcaggaggctgaggcaggagaatacttgaacccagaaggcggaggttgcagtgagccgagatcgcgccattgcacttcagccgggcaacagagtgagactccgtctcaaaaaaaaaaaaaaaaaaaaaagatatggttaaattgcacagctacactctcaaataagaacatgatatgttaatttgtatatcgttttaaaaagcactggctctccgccaaacacataagagatgggattttctagctttgtagtcatctttgtactgtctctggtcagcatagtggctttatgcacgtctgtatctcggctttcacttccagacgggattccctgcaagtggcacctactcagtgaattcttctctgccggaagacccgcagggctcgtgcctgcccaggttggctcttccctcacctccaggcgttagctcagtaccctggccacagtcagagcatccttggccagcgcaggctcctgtgcaatgtggggggccttatccccagccccacactgagttccctgctcacacttcctctgggctccgcgggtgggcacacctggttcaggatctccctaggcagccgttgcctcaggagaatgctggaggacattttcccttttcctccctccactcggtgccccagggctgtgctgaggcgcccgaacccttaggtgtggctggtgccaactgagacctgctgtgagtacaagacaccctgcatttcaaatatgggtacacataaaggaatgtgaaatctcaatcattttcattttgattacacattgaaagatagtattttggatacattgggataaataaaagattattaaaactaattttacctgctcttttcaaagttttacatgtagctactagaaactttaacagtactcatgtggctggcagtcttgctgttggcagtgttgccgagagggacagcaggatggaggcagcccccccagaggagctcccaaagtccccatttccaggtcaccttccagctcccaagggtgaaggaggccagtggctcccccagcagtgcgcctccctgttcgccgcgatgctgacaggactgaaagcacaacagcaagtggggtgtacggctggctgagggttccacgtctcacaatgcatgtctttactctggttttctgccacagactctggatcccaggggtccaaagggaattgcaaaggggaaaattcagtcttccttttctcctctgtggcttcctgtggctgtgtttgcaactagactgtccagacagctccacaaaagacagcttcctccctggttgcttgctcacttatgtgcccaggcctgggcccggcagccacacttctgtctctgctgcatttgtacttgagtttcctgaacccctctaagtggccaacactagtaatgaatgcagaaacatgaaagaatattctctcaatcatttcagggtgggtactcatcagatgaacacattttcagttactaagttaatgacaacattgaagacattggaaatttttattcatctttgctttacaacagaaccaaaagcgtcaattaagaattcattttacctgctggtttccacaagctagttatgtgaaccatgttttacaacaataataatattacaacaataattatggagaagttaattggataatagagcttttcccaattcaagtagaaacacagaagaaactggataattttaagtcctctaactcaagacatctggtgcaagcctggcctgcgaggccccattgcctgcgtctcccgggggccttaggaaaactgacagttcgcgtgcctctggggaaatatctacgctacagaaaatctttaggtgttcgtagttctctagagattttaagtggtatcacaacagcccatccggagaacttatttctaataatttgaaaaacaaacaagaaaccattagggttttcatgcagagcagcctccagagcacattctctgagaggaagagtcgaccagagtgagctctccgcagggcctgctctgccctccctgccccgctctgcccttcgcagggcctgctgtgccctcccctgccctgctctgcccccgccgccctgcagacactctcccaggactatgggaacccaagctctctcctctgggccgacaaacaatgctcaggccatgcacctcctcagaaaagggggcatgggttgccacatctcagagagctctgagtaaactccctgggcccagggatgcaggggagcctggttgttgctgagagccagcctcatgttcccctaaacatcctttctaaactagagatttctagactaagaaaaatcaacatgcattcacactttatactctactccattttcaatcccttagatttaaatcagtgtggagaatctgtgataagcaccttccaaattcctccaggatcatctgctctgcaggcacttggagcagtgttctttctcggcctcttctccctgagcaagcaggcaggcgcagtggcctccaccacctcccaggagatgcatgaggaaggccgcctgtcagaaacagagcattaaaggccgctcaacagtgcaccatttctacctacagtactatttatattcaacagaaattgcttgtccatgctattttaaagaacatcatccactaaaatctaacgttgtcttcctatactggaaactattaggctgggcacagtggtctgtaatcccagcaccttgggaggccaggcaggaggatggtctgaagccaggagtttgagaccagcctgggcaacaaagtgagacctttttttttttttgatactgagtcctgctctgttgccaggctggagtgcaatggcacgactcggctcactgcaacctccaactccctggttcaagtgattctcctgcctcagcctcctagtagctgggatcacaggcatgcaccaccacacctggctaatttttgtatttttagtaggacagggttttgccatgttggccaggatggtctcgatctcctgacctcatgatctgccccctcggcctctcaaagtgttaggattacaggcgtgagccaccacacccggcggagacccgtcttaaaaaaaaaaaaaaagaaagaaaagaaaagaaagaaaggattaactggttttagagaataacacagaggacaagtaaatctgtccgtttttgacatgcctctcatggcgggttgaaatttcctcaaaattagattcactgacgaacccagaggatcccgggctacagtgtcagcacgtgggccaggcaggaaattgcagaagcaggactcttggctgaggcagggcacgggacaagccgagcagctttgctctgagtcctgtccacgctgggtgtctgcctgtcctcccccaggcccacgtgcagccagagaaggccaaggttctgaggactcgcctgtcaaaccttgggtcctgctgtcaggacagccttccccatcaatgccgcttggagctgtgaaagaggttctgaagacaagttgaaccgcatcacatagcgccagctattctccccactgagctcagggggaactgtggcttagctagatagcaacccaggtggcgctaagtcgaaaaattttcaggaaactttataaaacattaaaaagtgttggattataaaaataaagcaaaatgttggattaaagctctctataaagacaatacacgatgactttggttgaagaagaaaagatagggctgccctgggaaaagaagggctgctaacactgcaagacgaggctccaatgtacaggcccccaccggctccacagaacacacatcctgctgcaggcgatgacattttcacacatcacttcacagacatgcagccaggttttggtaaatttttactgataaagacctctgtgggtcagctgggtgcgtggcttacgcctgtaatctcagcagtttgggactcagaggtggatgaatcacagttcagagttcgagaccaatatggcgagaccccatctctacaaaaagtagaaaaatcagccggagtggtggtgcgtgcctgtagtcccagctactcaggaggctgaggtgggaggatcacctgacctggggaggttgaggctgcgtgagctgtgatcgcaccactgcactccagcctgagcactgagtgaaagccctggtctcaaaaaaaagacccctgtaggtcacaatcatgagtattttgatatctctctaaccaaataagcatgaatttggctttgcaaaatattaattaatgacactggtagtttatcatgatatgaccattacattgaactcgaagttttttttaaacaaatgatggaatctaatagatagtaaaactatgactcaactttgagaactactaggattacaattggcttcaaaactgataaatgcaaaattatccaactaatccggatccacaactgcttagaaggaaaacaatctggaccaagtacagctctttgctgccacttcccacgataaaggataggaggtacgcactgtctttgctgcgctgggtcgttgtggctctatattaacgcaaaggcgtgtcagaactctgctagccctgctggtgatcctggcagcagggctcttttgtctggtaaaaacgggagtaactcagacagtgaggatgagaagacaaagaggacaaaacaggtttctcagcggggcctctaaggaaacacagtggccacccaggattagcccatggagggaggaacacttccctctgcccccaaacacacgcccgcccctgcaggctcacacattctttccagtgataaattgtcgttaattctcctctcaaattaacctctgttccctctattagcagaggttgttcaaagtacctacctatcgtgactgaatcttggaagtcctgaaaatttcgttggtggaggtaatggctgccttccaaacctccagtctgcatgtagtttggcatgctcattagtgttttcgttctgggctttcttcataatttttgcaaccaatgcatttgcaaatagaagaacaataatttgggcctggtaatataaaatgcttcaataaaattaggttgtctcacaagtcataaaaactgacaaattctatttggaccttaaataattcttcgcgtatatttgcccatgacgagagtgtgtgtgtgtctgtgtgtgttgagtgtgaatgtgtgggtgagagcgtgtgttgacgtgagtgtgtgtatgagtgtgtgtggggtgtgtgtgtgttgagtgtgaatgtgtaaggtgtgtgtgtgttgagcgtgtatatgagtgtgtgtggggtgtgtgtgtgtcgagtgtgctgtgtgtgcatgagtgtatgtggggtttgggtatgtgtgtgtatatgtgtgagtgaatggaatgtgtgtgtgactgtgtgtgtttgaatgtgtgcgtttgagagtgtgtgtgtgtgtggacctgcagttttcatcaagtgctgctgttgtggagatgccatagtcctgctgctgacaagtggaggccgagtgtatgggtgtgagtcccaagcagagagagggtgttgctctccctttctacccgggagccagcaggctgcttctttgacttgttttgaagaaagcctgccttagcgattataaaactctagcttatggttctctttcagcatgtgaggctattatgctggttcttgggtgcagagaatgtacaagagagtagaattcgaaatctgcctgagagcaggcctgtgctgggagctgtcaggggagacctctcctgctgccttgtgggtggattttgtttcaagctttcctggcaatgtgatgctgagggggccggcatgtcccatctgtacccagcaagccccccttgccccctcatgccaaattcttgctcatgtgggccccaggggctgaccaagagctggactgccaatcactatggtttttggctttctctttccttcagccccccggggatttcccttgttctttccagctgagagatgcatcttcagggggatgcgttctgtttcatctgcaccttgggtgttttgaagcaggaggctttatagagtttctagtctacacgaatgccagagactaagggcagtgctatccctttcctctgagcctgcacattctgtgggctgtgcccagcatagctctgccttggggaagtgggctgagccacagttccatggcagccagtgaaggtgttttcaggacagaggagctgctgtgggtgcgattggaagtggttcctcgggggtgatgtcagtccatttcaactgtgcatctctgtcgtgttttgactgtgttttccacatccgagctgggggtgtggggtccaccttcccaggtctttcagtgcatgtctccagaatcaggtggactgtttcaagcccaaccctctgtgacagacagcctttgaaaagtataattcacaggaacccccaaagacctcaagcaaaccaaaacagaggtttgtaaggaaggtttgctcggctgttcccctatagggcctaagggttccctcactttctctttcctcctttccctcaacacaaaggaaaaagaaatagcaaagagaggtgaaactgcgacagcactgaaggggaaagtgggtcctcattatctttgggaaaagaaaaagcttttgtccaggccgtgatctgcagcttgctttgttagctctctccattggcttaggctggctgtccattctggtctctgatggggctgtgagccaggaggagctacccttggtcaaagcaccaggtgaatggatgtctggggacaagcgccacaggacttggaactgactgagactttgaggccaaactgtcccccacggccccacctagagcactgggctttgctcagggaggaagaggcgcggctgccctccgggagcttccaccctgttggggaccagcgtggatcagtggccacagagggacaaagccacgcagagggcaccctcactggtactcagggctgggctcaggggaagcaacatgctccaaaaggagccctcagcaaattgcccggttcacaaagctcagctgtatttgggaaattaattcagattgatgtaagtgtcctctagaaactctggaagaaaaaaataattatatttatctttttaaattacagcaaagttttttaaccacaaaagttactcaacatatttacctgtgttttttgttagtgagttagggagtgggcactaacctcatagcactcgcagtaattcttcaggcagcctgacctcctgcagttcaccctttgttgtgctggggcttgacattgcccaattggcccttcccaatttttggctgaaagcttctggatttctaccaagacatgcctagggtagaatgggaagctccatcaggatgattttatcatttaaaactcagctcaatgaagggcatctcatttgaatctgattgttgtaaagatgccacaataaacagagtctcttgacatggttcagaaggtgcagccccttcttgttgatttccatttgtttccatacacaaaaagatatattgtagctaaggtttcttcatgtttgttttctgagtttccaagtcttacatatttactgtaaaaaaataatagatggtaaagtgcaaagaaaatcattatttccgtgtggacacatttccatccagcatttctggggcccttttcctaagatggttgagaccgtggaccatactagcagctcacactgcctgatcacaaccaacacaccatgtgccaggcttctttccatgggatttatatatacatgccctctcatttatcctcagcaactaacgtatgattgttttatacccggagaaacccaggcaccgagaggtaaataactgctggtaagtggcgagatcctgattcaaagtccctgtgctgacttcaaagcggtctcaaccgctgggccatgcctttcccaagcaatacacacgatatgttatccaggtcatttgttgtccctttttaatctatctatacacacaaatacatacatatctttacatacaaacaattcaacgctctttgtaaaaattcaaatacagaggtcacagtggaagtctgtggctccgttccgcttcctggggttgacatttggaatcggtgctgtccagcagcacggcccctgcacagggccatcgctacagaatgtgctgctggacagccccagcctgcggtgcgcggcttaggcattttcacggatcactgaagtgtgacaggcagtggaggcacacatctgcagctgggcatgatgatcttgtgcatgtgtgcacacctgtgtacctgtgcacacctgtgtacctgtaccaaggtcaagttagaggacaggcggccccacaggttgccttgtgactcctcctcagggtgcacccccgcggggaatgctcttcagacatagagggctttaggtttgcctatgctgtgcctcaggtaagtggaatcccacagcttgtactcccgtgtcggctgcctccctcagatacaactaggaggtccgtccgcactgctgcgcttagctgtagctcctgcttttcatcaatcatcaattcatccattctaccacggatggacatttgggctgtttccagtgcctggctacctgaatgaagctgctgtgaacattcccgtacaaatctcccagtggacattggcgcttgctctattggctatatttgtaggaaggaaatggctggatcatagcatacacaaaggtttagtttggtagctattgtcaaacagtttcccgaagtggttgtgcccctttatatgcctatcacaatgtatgaaaattccaaccctttttgtttttacagttttaactgtagatagtattcttatccctaaataaaatgtactaaagtttacatgcgtgacaattttcttctgtcctatggtctggctatatcaaaattggttagatatttcaagtcatttatccataattcaagaggagattaaattattttagaaaacaatgcagagagcagccacacccttataattgtgttctattgcacaggacattctcaggtctacagtcaatggctctcaatttcccttcgtgaatgagtggcaccggaagtgtctccctggagtaggttgacagccttgagcctaactgtccctccttatccctgattatcttttgtgcctaaagaaagggataaaagctgcaagctcctgtgtttaccttcagcagagtggccatcgggggcatcaaagtaaccttttgcgtctctgggaaaaccagattcttctctttttctggaagctgaggggtgaaatttaaattgttaaattttacaatgaaaatgtaggctgcctgatcactttcccctagccttctcacgcagtggactgtctacactttgcggctacactgctccagctcatgcttatctgctatgtaagatgaccccaaatgttaaactccaagataaagtggacattcgcatgttcttgaatcagaaccttcctagactgcgcatctctgaagccttcccacataataaaagggaaaaggcctttctctgcctaccactttacaacagccgcttgtcgtggttcaatacccccaccggcaggaatcaagttgtattcaagtaaattcttcaaaactgtgggttttttccaatgaggaatctctgaaggtgattttatgacatctcaaacagtttgaaatgcttttaaaatgcatacatttaatggacatttattacctaatggctttaaaccgttcaatatcatgatgcaagttgttgcaacaattattacaattgagttgttgcaaaagtccccactggcaaagcagtcacagtacctgtgaaggaaaggacaggtgagtggcaggcacagacggcacagtgagtagtgaaaagaagagcacacacgtgtaagaaagagcgggcagtgtgctgcagtcagaacactgaacactttcatagacggctcagactcttttatatgagaactagatcaactaggataatgctcaccagtgactaacacagaaggggtaaaactagttaaaaccatttgtttcataatataggattttgcaaagcaaaacaatttctgtcaaatccattgcatcaatcaatcctccctggcccctaattgccctccgccattttccaggagcgcaataagtttggtgggcagaaacatcaagtaatgaagagctgtccccatcacttccccagtccatccaacatgactgaaggtgtgttcacttcttcaccagaccttgacttgagtgaaaactaatgggacccagaggtggaacctggcctaggccttaactcgctttcttctgtgagggggaagtgaatggcagaggaaaggaatggatgaggcggctgcagtcacactcttggttgtaatgcgagggttgttcgagaatcctgagtctagtgaagcccttggagtgacaccaccatgccctgtgactcctggggccacacaggtgggtggcagtgctgtggattgctctgagggcttcctgggagagccgccagtgctggcagccagtctccctcccaaggtctgtaagacgcctgctcctgcattgtaaggcagagaggtgtttacaggcacgcgctttaccttactgggatgggcaagggcgacgctctccttaactcatgtgaaaatgtagcatcaagcaaggactcctactgtgccacctatgacccgcgccccagagagccaccccatggcttcccctgtgaccagagaagacccctgtcactgtcttctgtgagcatggttcatcgaaaagagttccaactcgttttccacatcggctctgccgccttctccccatgtgccagtcagctttgaagctgtagagtgggaatcgtggtgctcagcctcccagtcccaaagcgctgctgagggaaccctgggcgtgtgaagcttcccatagtgctgcaggaacacggcgagggccgtgcaggaaccagaggtctgcagaaacctctctggggcagaattcccaaacacaattcttttcataatattattttcatattttaaaataatattttaatgtcaagtcaacaggaaagtaaagaggtcattagaggccaaaaagacaagaaattgtgaacccagagaggcgagttctgcagcagcaagtgctgccctggggcatctgccagtccctagggacccggagcttgggttccaatgtgagcagacaggagacaaagtctgggcatcagaccagagacccctcataaagtgtggatcctgaaaggcgagctccccaaggagtgaattattagagacaactccactccacaacagggggaggagagacacatcccctgcagggagaaaggggaactatagaggtctctcctgaacctcaagccacgcagatggaaagaagggaaaggggacagtgacagaagatttggacaccagaagcagaggggcgagagaactggcgtggcagactcaagaatgctgaacctgaagtcagcagaaagagctgggaaggagcttcggaaggctctggaatgggcagcaccaggttcctccaaggagagcaaagccaggtgagataagaagagaaccagggggattctctgcaggaaggcatagtccccagatgactcctccttcctaagcagctgggacccccctgccaccgtggcagagctaaaagtgactctcttggagcaaaaccattgggcgtgggatatgataatgaacaaatcaagaaaagtgattgttgagacccctaggtttcttctactcagcttctagcattctagcagagactagaaaagcctcctctgaggactctgaccagcccaggagaaaatatctagaattgacattgagctttcccaataaaatagctaagtgaccaccctgtggtgaagctacagtgacaagccctcagcagtgcacctgcaggcccagtcagcccacacctcagctacagcccccaacagcccactcctcagctacagccccccggtcagcccacccctcacctgcagcccccagcagcccacacctcattcttaagtatgagcagagtgacgcccagggatccacagacatgtaggaaatcttccagagtatgaaagacaggggcccagagaaacggaccatgcatggaaaaaaaactaggaggaaagtggtatcaacagccttagagagactaagaaaagttattgatcgtgaaacaggaaaataattcttattaaaaatctcaggatatgaaaaaagatattttaggagcaaaaaagtaatcacagtgatgaaagacctagaaggtatgaaaactagaactaatcagggagaaagcaacagtgggccagactagaaaatccaacatttatatagtaagaatttcagaatactgaatattaagaatgaaggggatacaataattccagaacatttcccagaactaaggccatgagtttctgaagggaaaggacctgccttgggctctgcacagtagctaggaaaggactggaaccaagacagcatgagcacattctgcagcactgggaataagagatgatcctcatggttctagaaagtataaaacagttttcatacagaggatcaagaaaaacaatgatgttaaattccactagcaacattggaagctagaagaaatgcagtaaggccttcaaaagtccaagaaaaaccatttccaacctgaagttatactcccaatctaaattatcatctaagcatgagatagactaagacatttttagacacgtaaggtctgaagaaattacatcccatgtactcttctcatggaagctactggagaaggcactgcaccaaaatgaggctgtgaatcccacaaggagatgcgggctccaggagtcaggagcccaaacatgacaaagaagctggtgaaccccttagatgatagtagaggggggtccaagacgagagctgcacacaggcctggaaaccagcccctcatggcaggccaggccaggcagctcaggaaaagccttcacgacaggactgacagtgccccacttctgggcatgttgagaagaccgttacacaaccagaggagaggttagtgttatgttatgttgtgtgcatagaagactaagtactgggtatgaacagaaagggaaaggtaaagaagtcaggaaaggataattcatgaaggctcagcagggaccagagttttcatcgtcataaaaattaaagactcaatgctaatctaaccaagtctatctcatgtctgggtgtgggaaatgtgtggttggtaggggttggtgtgtgagtgggagaggaaataaagctaaatccacatttcccacgtacaaaaacaatagatcacaccaaactgaaaagccgaggagtaattcagacctgttattagacttatggaagcaaatattagaagattcagttaaaagagttgaaagttcctgggggcagaaaataaggaacaattgtcagggtactactatgttttgtcatgagcctggtacaatatgtggctctctaaattatatgtgtatgtgatttggataaaaataataaactgagagtagacagaataaaagataaagaaattagtctagatgcagcacagaagacagattgcaaataacaagagaggttaagagaaacagtcaagagttagagaggctaacgtgtctgtctggtgacattacggaaggagagaggagagaaaatgggggagaggcatctttggagtgaggatatcgtgagttttccggaactgatgataactgtggatgctcagatttaggaaacctaatgaacctaagaaagacaaacaaaaagaaaaaccaaagacaaaaagaaaatctcaaatgcactaggtagaaagatacattacctagacttgcatctgactgcttgttagaaataatgggaaacacagactgttttcaaagcattggcagaaaaaacctgacaacctagaattgcatacccagtaaagtatgtttactcaccgaggtccaggctaggcacacttctttttttcaccgtacactttttgctgactgattttattaactcttgcccttttaatcttttgaagattttaaaatctttttcaccaaacctgctctctctcccacactccagaccctaaaatccttattgttttattcccaaacataatgaaagggtgggctgtccacatgtgctcttatcattcctcatctcccttcattctttaacctttgcgttcagatttcctcctcctgcccacagactctcaaaggcatcaaccagctcctggaaaacccagggctctcttcactgttcttgagagctttagaccctctgtgttccagaaccacatcccagcttccagtcagaaatctctatcttcaattcagcgttccaccccttcacccacggtcttcatctgcacccctcgtgctgctccagccactctctctcctgtgcttgctctccatccatggtgttaccatctgcccagtaacacagcccctgtgtggttctgacaattaccttgctctgtttccccacatccaagggttgccaaatctactgatctggctcagaaatgtcttttattaattttatttttgataaatgtaaatcatatttattgggaatttttaaaaatacaaataagtaaaaagaaacaaattacatccaatctgaatctcatccctagagatgatcatttgatgaatatatttcagactttttctgtaaaactatacatatgaaataagtatatgttgtttggttacagattatatgtaaacaaaaataagatcatatttacaaactgcttcagtgtgcttttattacttatcaatagaagtaataaagataacatcttcattactcatcagtatgttatgaatgtttcccatgtaaatagatttacataccattttattgctgtacataccccatactatagcagcaccttgatttatttaataattcactttatctgagcatgtagatgttttatatatcttggaaatataaacaatactatagtagtggtgtggtcttctttctgttcctagaaccatccaccctccctctcttgccacagggcctttgcactgctgtttcctctgcctacaacactcttagcatccaccttcaatctacttccacccaagaactccccctaatccaaacacacctcctcagggaagccttccccgactgccatgcttgtcaacacgtcccaccccctcagcccattactgctcctttgccacattttccatggttccctccgacctttaattacatgatgattcatatgggaatagtcactttagactgtgagtgcgggagggcagggaccgtaactctcttgctcactctgtcttccctgttcctgagatcatggcattcaaaaatatttatggaatgaatgaataaatgagtgaaaaaatgatacaatgcattgttggaaaagtctctggaatctgtgttttttccttcattgttaccacccctgcccgggtcaggtctgtgctgctgcagtggcctcctaattaacctcgctttcaacttcctccacttgccattagcactaattttccaaaacataaatcaggcaaaaataagcaagcgaaaaagcataatcagaaaatgcaaaataagatggtattgtatattcctagtgggggtataaaatggttggccactatggaaagatacggcagttcctcagaaagttactatatgatccagcaattcacttctgggtatgtacgcaaaaggagtgaaagcagggactcaaccagatacctgctacacagtgtccattgcagcatcagggtaaacaaaacgtgattcatccatacaatggaatatttgcagtcataagaagagaggacattctgacacatgctacaacatggatggcactttagaacactatgctaagtgaactaagccagatacaaagggacagatattgtatgagtccattttgtgaaggacttagaatagtcaaaagaaagaaagtaaaataggggttaccagagattgggaaaggggatgatggagagtttgatgggtatagaatttctgtttgggatgatgaaaaagtctggaaaaattcagtgatggtggttgcgcaacactgtgaatatatttcatgccactgattgtatattttaaaagtttaaaacagtaaattttatgttatgcatattttgccactatctaaaagacaaggcacagagcagaatgtatggaatgctgccatctgaatgggaaaaaggacctaaataaaacttaaaacttcaaaaaaaaaaagttgttacaaataagtccctatgtgtaataatcagacaaagaatgcaaatagattaaagaaagctattgaacatgggttattagattgcttttttgaaaaattcagctatatttaacctacagaagacacacctaaaacaaaacgccacacagaaagtgcaaaactaaaggaatgttataaagcataactcactaatactgcatagagaaagaaaacatggtgcagcaacattaccgtcggacagaaaaacaactgaaggcaaatgcgccaagatacagaggcatagtcattaacaactgatggaataattcaccaaaaagtgtagcaatcatgaatttgtatgaccttcatgctatagatctgaaatatataaagcaaatagaattataaggaaaaaggagacgaattcataatcttaagtgagggatctcaacacattttagcaaaaacataaaaatcacacaaaattgaataagcaattagcagatttaaacaacaaataagccagtgaatggatagataactgcccctaacaaatagagaatatacatgttttcaaattaatatagaatattttcaaaattgattgtattaagtcttcattaaaggaagtctcattaatttcaaagaattgacgtacagactacattatctaactacagagtaattaaatgaaagaattaactaaaatatcatttaaaaatatatacatatacatacacatatatgtataataatacaaatgtggacactatgaaatgtacatctaaataactcatgaggtaaagagaaattacaataaaaacgacaagctatttcaagcggatgatagtgaaagtactgcatatcaatcttgtaggatgcagtaaagtagtccataggggtaatttacagctttaagtgcatttccaaaaaaaaaaaaaaaaaaaatttaaagactgaaaataataaggtaagcagttaacacaaaagctagcaaaacaagagaaggaaataataaagacagcagtaaaaagcagaaattaatgacttcatgaaccacaaccaagaaaatcaataaaaccaaaagctggtgctctgagaaggcgacaaaatagacaacctctcctagaactgatcgagaaagtctagaaaaggtcaaaggcctaattatagatacagaggtcatctttaaatatagaatatatgaatacgaatatatgaataatttgaaagttttgaggattcaatactttttaagaaaaatataaaatatcaaaattgatcaagaaaaaacataaaaaagaaaacaaactacaaaagaaagtgaatgagtaacctatcccttcaccactccaactccaatagacatcagacccagacagtttttcagacaagtttttcaaacgttcaatgaacaaataaatcctaccttacccaaacttttttagaggctagagaaaagaagccagtggggtggggatggggaagcctaactaacgcattttattaggcaatacatattgataccaaaatgaaagaatatatgagaaagaaaaattacaggtctatctcacttggaacaaagattcaaaaatcctaaagagcgaaatcttacagtacataataatcaaattggcttaatccctggaatgcaaaggcagattaacattggaaagtttgttgtcatagatatatatgagattaaaagaggaaaacaatctgatcatttcaacaaatacataaaaaggcactcataaaattcaccagtcctttattataattccgataattataataatagcaaatcccttagaaactaggaatagaaggaagcatccttaacctgagaagggcacgtagcagagaagccagcagtcctgcaacagccacttccccttatcctacagtggcagcaattgtagtggagcataggttggctcacctcaagagtgcatttcccagcttcctatttagttggcccgaccacatgctaggctgtggccaaagggctatcagtggaagtgattatgacaatgccggtcttgccataaaggttaaggagtgtgcacttgccctcctgttttctcttccccagtgtctggaagatgacataagggtaggggctggtgcagccttcttagaccacaaaatgcaagccctccattgagatgtcagggcaactaagacagaaatctgagacaataacattgattagccaccatattatcctgaaatggttgtagttttgagtctttgttatagcatctgagtatgtattctacctataagggcatctctcaaaaacctacagcaactatcttatttagggcaaggcaagggaatttagaaatatttagaatttaggaggaattcaacagtgccccagaccagaacttccattcacactatgaggttctagccagtataataaggcaaggaaaagggaaaagagtacaaagatgggaaggtatcacggtccaatatctgtgataagatcattgtttaaatagaaagttgaaggaatccacagacaaatcattacaaataagaagcagaattcatgtctggagcgggattgagaccccaaatcagacccatgtgtaatcaaaccctgagagctgacggggctgcactgcagaatcgtggactatatctgtgttttgccatacatggtgctagacaattaattgtccgtatgaaaaaaataaaattgaatccctacctaatgccaatcacgaaaatcaattccaggtgattaaagctcaatgacaaaagcagaaatgtaaaacttttagtagaaattctaacatcacattatcccaccttgatctaggttgcagtgagcatcattccattaaagacgctgtcctggagggcagactgcctcaatgctggcacactggcaacactgcaacactttttgggtcatcctgcctgtggcttgctgagagggtgatgatactgttcaaggaaatactcatgataccctctgtagattcacttcccacaggcatattgaatcatgaaattttagtcttggtggttgaaaagactaaaatgacagttttttgttgttgttgttgttggaaacgggttctcactatgttgtccggctggtctcgaactcctcggttcaaacaatcctcctgcttcagcctcccaaagtgctggactacaggtgtgagctaccatgcccagctcaatgacatatattctaaactcattcttattcattggccatcctgacatattgcttgctataaaacacttaataacattgaattaaattttaaaaccttttagatggctacttgagctggtaaaaaattaaggaaacccaacagaggcaaaattcagagggccaagctaaaactgaagcctgaagtgacctctgaagcatctgctgtcccagcaaccaaaggcgctggttttaactgctgcgtggaggagaaagggggaactatgcaaccctaactgtggcaaacacttacaaggacatgtgtgatctgctgggctgtgctctagtgctttacgtatattaaccccagtcgaaggcacactcagggtagaaggtctgctgcagatccacacatggaccagaactgcggagggctctatctactctgggaacaaatgccctgaaacaaatggcaaggaaatgtgcgtgtgatcctggctggtgggaggggaggaggctcactcaggttgaaatctgaattcatactgtgcagcctaataaaaaaaaaattagccaaaaattttagtcatccaagttggaagtgccaccaagctccaagtggaagcaaacaaaccttctctaagagcacattctcaaaacaagcctcaaagaactcccacagggaaagccccagtgattaaattcgcagtttaaaaaaatcacaaaatatgtgaggttccaagccataaggagaaaaatcaagagatgaaacaaacacagaatgagacagagactttactatagttatgagctacagaaagataattatttcatatttttaaatttaaaataagaaatcaaaagtgtgagtaagcaaaagagactaccaaaaaaaatgaccatccagatttcaccttctactccacagaattctggggcaataattaatctagttaattagagacaaaaggccacgtgaagaaacaatatcacagctgtacaatctatgcctgaaattttagggtttgggctgggtgcagtggcttacacctgtatcccagcactttgggatgctgaggtgggaggattccttgagctcaggagtttgagaccgcctgggcaacataatgagaccctatttctaaaaaaaataaaaataaaaaagctggctttgatagcaggaggttgaggcaggaggattgctggaccccaggaggtcaaggctgcattggctatgatcataccacctttgcatatcaattcatccagcctgggtgacagagtgagatctgtctcaaaaaaaaaaaaaataatgaaatgaaactgagtctggattttcttaaagtcaacaatatatgaaagggctaattaaaactgtcctaaaaggctgagtgcagtggctcatgtcgtaatcccagcactttgggaggccaaggtgggcggatcacttgaggccaggagttcaagccagccttgccaacatggcgaaaacccatcctactaaaaatacaaaaattagctgggcaggtgatgcatgcctgtaatcccagctactcagggggctgaggcacgagaattgcttgaactgggaggtgaaggctgcagtgagccaagatcacaccactgtactccagcctgggcaacgagccagactttgtgtcaaaaacaaaaacaaaacaaaaaaacaaaaaaactgtcctaaaaatatctacactcatggtataaaaccaattcctgcttttctgagaggaagagacctctcccatcctagtggacagtgctccttctcactctatgaaataattgtccaaaaatgtataattaacacttataggcaaacctcattttattgcactttgttctattgggcttcacaggtatgcttttttaataaaacaaattgaaggtttgtgtcaactctgcatcaagcaagtctacgctccatttttccaacagtatgtgctcacttcatgtctctttatcatattcctgtaattctgtaatgtttcaaaccttttcattactgttatgtctgttatagtgatctgcaatcctcgtctttgatgtcactaagtgtaattgttttggagtaccacaagccacatccatataagagacgaacttaagtgcaattgttttggagtaccacgagccatgtccatgtaagaacatgaattaactgatgaatgctgagtgtgttctgacttctccaccaactggcggttccctgtctcctccctgtcctcaggcctccatattccctgagacacaacaatattgaaattaggccagtaacaactctacaatggcctctaagtgttcaagagaaaagaagagtcccacgtctctcacttaaatcaaaagattaagcttagtgaggaaggcatgtcgaaagccaagataggctgtgatcaaaggaaaagctttcggaggaaattaaaagtgttactccagtgaacacacaaattatagaaagcaaaacactgctgacatgaagcaagcctgagaggtctggagagaagatgaaacggacaaagcctaatccagagcaaggccctaatgcttgtcaattccgttaaggctgagagggtgaggaagctgtacatcaaaaattggaagctagcagaggctggttcatgaggttgaagaaagaagccatctccataacggaaaagtacaaggtgaagcagcaagttctgatggagagctgcagcaagttctccagaagatctagctgagatcactgataaaggtggctacactgacaacaggttttcagtgtagatgaagcagccttctactagaagaagatgccacctagaactttgcagctagagaagagaagtcaatgcctggcttcaacgcctcaaaggacaggctggcctcttattgggatatggtgcagttggtgaccttaagttgaagctaatgctcatttcccatctgcaaatcctagaccctttaagaatgttgctaaaactactctgccttgtgctttacaatggaacaacaaagcctgaatgacagcacatctgtttacagcatgatttactgaatatttaagtccaccgtgaagacctactactcagaaaaagattcctttcaaaatattactgctcttgaccaggtacctggccccccaagagctctgatggagctgtgcaaggagattaatattttctcatgcctgcaaacacaatatccatcctgtagcccatggatcaaggtgtcattttgctttcaagtctcattatttaagaaatacatttcataaatctatagctgctattgatagtattcttctgatggatctgggcaaagtcaattgaaaaccttctggaaattattccattcttgtgccattaagaatattcatgattcatgggaggaagtaaaaatatcaacattgaaaggggttagaagttgattctaaccagctgggcgtggtggctcacgcctgtaatcccagtacttgggaggctgaggcaggcggatcatgaggtcaggagattgagaccatcctggccaacatgtgaaaccctgtctctactaaaaatacaaaaattagctgggcgtggtggtgggcgcctgaatcccagctacttgggaggctgagccaggagaatggcttgaacctgggaggtggaggtacagtgagccaagatcatgccactgcactctagcctggtgacagaggaagactctgtctaaaaaaaaaaaaaaaagttgatttcaaccctcatggatggctttgtggggttcaagactcagtggaggaagtcactgcagatgtagaaatagcaagagaattagaattagaaatggaactgaagatgtgactgaattgtttcattaccatgataaaactgtaatgaatgaggaattgctcttacagatgagcagagaaagcagtttcttgagatggaatctgctcctggtgaagatctttgaacactgctgaaatgacaatacaggatctagaatattccataaactgagtggataagcagtgcagggcttgagaggattaactccaattttgaaagttctactgtgggtgaaagctatcaaacagcatcacacactatagagaaatctttcctgaaaggaagagtcagttgagtgccaaactgcattgttgtcttattttcagaaactgccaccgcaaccccagccttcagcctccaccaccctcaacagtcaatagccacgacattaaggcaagaccctccctccaccactagaagatgacaactcgctgaaggctcagatgattgttagcatttcctagaaacagtgttttaaattaaggtatgtactttttagatagaatgctattgcacactgattgtactacacatgtttataattatataaacataacttctacatgcattaggaaaccaaaaaccttgtggacttgctttattgtgatttgctctgttgtggctgtggagctgaagctgcagtacctccacgcaagcctgtatgttgttgcctataccaaaataggcctgttataaacgtttttatatttatattttacgttaaatttttaagttgtatattttacagttgctttaaaaaatgatgtgcaaatcaatgtttaacatatacaaaaatgattaagaaagacatttgtaacagtgctggaaggtagatgttaattactttaaaaatctggctgggcgcagtgactcatgcctgtaatccagcactttgggatgccatggcgggcagatcacctgaggtcaggagtttgagaccagccggccaacatggtgaaacctcgtctctattaaaaatgcaaaaattagctgggcatggtgggggcacctataatctcagctactcaggaggctgaagcagtagaactgctggaacctgggggtggaggttgcagtgagccgagatcacaccattgcactccagcctgggccgacaacagcagactttgtctcaaaaaaaaaaaaaaaaaatttaaaatccatcagtaagtttccaataaatagaaagcatttaactacctcttcagtttacatcaacaccattttaatcatccagataatttatcagttaaaaataattcccaactttttatggctactgaaacaatagcaacaaaggttggggtacattgtttcaagtttcaggggtaaggaactaagagaggaactaaaaaggtagttccagctctatgtggaggaggaagatgaacgagtaaaacgcttgtctaccacaggagagggcaggagacaatctttacaggtgtggaggttcccccaggaaacctgaaagcagagttgctaagagtggaagcttcttggagggagacagactatgggagaagtggagcagggtctatcactttccatggagccttgactgtggtaatcgatttttacccatgccatcgctaaaacaaatacaaaaaattagctgggcatgagggcgcatgcctgtaattccagctactttgaggctgagctgggaggatcacctgagcccagggggtcaaggctgcagtaagctacgattagccactgcacaccagcctgggtgacacagtgagaccctgtctgaaaaaagagttataaataaaaaaaaaaatactgtcatgtgtttttatctctattgatggcaattataataataaccctcatagcctgtatacagcagagactcccatgagagtaggactaactcacgctaagaaattacattccattgccttgcgctcatgacttagttgcggggaataaaaaggtaaaagaatggaaagctattgatggcgatgatgccacaagtgtgagtgaagcaagcaacggaggatcccagcttatgttccttcacctgaaccaagtgtctccacatgaggacaggtggcatgtaggagagacaccagcacgaggtcaggggtctgccaccaacagacctcactgcttgggtgatttacctattccttagcttttccaaaaacagaacacaaactttattagtatttccagagtaactggtttctcagtgatggattgattccagccaaatcacaatgcatgatcagaatgcatgcgtcaattcatgatggaaataacatccttttccagtgcccaaaatgttcacgttgttctccaaggcctctcatttctcagtatggagctactaggaagctaagtcaatggccagaagttgcatgttgagcacagaattcgaggtgtgtagacatcgagtagattgggagggctcaagtctcttgcccactgcacacagcacttcgtggagaaggcatctccgtgcccttacagcagtgctctgtcgcctgccagcactggacacactctgggcctcctttcctctgttccaagctgaccgagtgccctcgtgatggtacattctttcttacatgtgtcggtcaccaattaactaggaagctgcttctagacaagaagctgtttctttggccttccattctgacgtaattcagttaagcctttcttagagtcatctcgtttccaagtccttaggagttacctcattttgtcctagttacagtctacaccctgctttaggcttcatggtcatttgacctgcctggtcccccacccagccagcagctgagcagctcccatccccaggagcccaccaccctgcacagctcttcctctggatgccaccacctggtcctcctccacatctgacatctccatctgggaaggccgctctggcttgacagcgtcacagggtccaggctttctcccactgtgcttcctcctccttcccagagctgcgtctttagcttccccatcagtcatgtcatggcgtttccaatgttcagaaagtatatggcctcgtagactaaaccaatgagagctcaaacattttcagacagtcaacctagactgtctgcaattactttttaaaaatcaatttgtttttccactttggttgtgtgaataagtttcacggacttctggatttctacccactggtgcacccccacatcactgtcccatactggggctctcagtgacttcagcaggagctctgtaatggaaaaatcacgtgaagactgggttagggtcgttagacattgggactaggacatgttctcccttttcaacgtgtaacttaggctaggcagacataagagcagaaagtgagcagcccacagcaagagctgagggaggacaacagcacagacaccagatgccagctttggcagggtggccgaggaaactgatgcccctaggctgtcaagcatggcaatgaggtctgcctcctacttcagccacatcgtctacttccagccccgactccacgtgacaattggccctaccatcccttgaccacacctcctggctgggggaaactttctgagaaaatttcaatgtagaataaaccaattcataaaactttttaaaaatggatgtggaaatattacagttaacgctcaacaatgacatcgttagcacttgtctgaggggcagaggatgcaaaccaaaacccaagaaaaattacgccccttgaagtgtgagccaccagtacttgactaaattagttggccaagataataccaaaaattcgtaccagcttcatgcaaaagggctgcttctcgctgttttggttgacaacgagcattaggacaaggttgctgagaagtaatgtaacacgtgcagtgctagccgttccggtttctctagactatgctccacttactgactctaagtaaccttatttcatatttaataatgaaggatttgtgattacttacaatttcagaactgggatttggtacagttacatggctttttagactttgtgtcccatgaactaagagttctctataaagattaaaaaagaaaatgtattcagctggttactccttatatagagaattactaagcatctggtgtttttcaacacattgtgagaatctcaacaccagatcgttataggtttattgacagatgcctaatcatgaagtgggagtttccaatgtgatggaactagcaccacaaacacagccacacatgcccagggagccagtgtgcatgcggagcagggtcctaaggctctcacccttcccaagatgtcttcctggagttcttctccccctgacctatttaaatctctatttttgtgctcctctccccactgaacagctctttccccgccaaaatctgaatgctaatggaagtacaaattaaagaacaatagatgaagcgtcgttcatcttcagatataccagtgctaagcagtccacgctgtaatattactaacaatatcaaagcatgttagtaatcacttaagttgccatgtgatcattggggactttcctcattttaggaagggattattacaactccctccaactgcatttggcgattagctcagaagtcatcttcaggggcattagagaagaaacaaaccttcctctaacgtgtctctgggtgttgctaaatgtgagggcagctgcacattaaaccatgggagaagttcccaagcattgctcagaagagacactcaccaaggagctcagaacatttgaatggaagtggttcaataggctgtgatgacaaggaggggcacgtgtacaaaacaccatggacaaaaaccaaactagatgaattctaaacgaatatagcatttaatttagaattctgtgcagggctgtccctgtgcccagtgggggcatgcatctctgtcagtgtgctctttgaggtctgtacacaggcctcatctctgcaacgcactggccacttctgagcaaggctgcatcttagcttgggttttcccccagagctagaacagcacctggcacacagtccgtgcttgctgtcagctcgcgccatctcatggaacataggggttggtaactaatacaaacgccctaaagagaggaaagtcttcgccctgtcctctgtgctccgagcgcccgcacgctcagcagtcttggctggtgtcggggctgaggtcagttccaaatcctcccccacttggcctgccctcacctcactgcctggtcttccgcccctgctctcaccacctgtgcatctgtttagtgacccatcccactcccatgggaaacagctcatggcacctgacatgggggcaagctgctaactttgactgcttctgagagagctcccattttagaggtaaagacaatgttgctgaatgctgtattaattgagaatcatctagttttgtttttcctttagagacagaacagttacagctttttgccctcatggggcctagaggtggcaggtctagctatcctgccacctggcctgtccacctgtgggtcagactgggcctgttcagagggggggctctgacagctacttcactgctcttgccctcggccctccagacctgccctgagctggggcacagggtggcccggcacttcctgtccagaggaacgaaactgttctgttgaggaagtggtgtgggggcttgcggaggcagtccagtggggacccacttaactgtggagggagggtgacaggcccacgagtatctacagagtcaggaggaggccggcggcatttactataaatcactgtgtggccaggactgtggtcagtgcttcaggggacaccaggataactatctgtttaatatacagtgcctgtcctggaggagtccaccaagtcagcaggacatgagacataggcaatggaaacattagagcacagaagagaataatcaaccagcacacgtcctatacggactgtgcacatggtgccatattgactgtaaatgccacaggaactcagataatcaaccagcacactgtgctacaccgactgtaaacactgcaggaactcagaggcagctagttcggcacagatggaagaagtgaaaaccaaatgcttttgaaggaggtggaacttgaatcaacttttaaggcggcaaggtttcttcactattactcaacaggatgacccagttgaataacagcgccagtaaagacacccatcaggaatgagcacggagtgcaggggcagtgagggctctgactgcagtggacactaagtggaaactcacttccatggctccagatggactgctcctcagtgcccatctaaaaattaaagagttagaagagatgtggacaactctgcctcagaaagcattctaaacaaactacaccacaacaagataacctcatctttaggaaaaaaatttccgagaagcggactcttgaatattctttattatgatgttcattatgttactaaaaccagtacatcaacaatgtgtcagaattcacatttattaccagattggtaataggattattaaagcacagagtgtcaggacaaggatttgtattaaagagtttttattaatatgataagctagttataagttagccagttcaccccccaaccctaacaaatgaccatcgggtcagctcgcacaccagcctgctggcctccagcctaagctgaactgcttctatggcctctataggttagatatgctgaaccacactgggctgacagtcttggttgggaactcacacggaatgaaataaccagaaaacgttctctgactgctttcttaccaccaaaaataaattggtagagattccagtatacatcagtattgcagatgtcgagataaaaatcatcaggcccaattaagtggagaggcattgattaagtaattatgtgcataaaaaatacaaatacacatctcatgtttttcctggcacacgtttacaatagagaaatattttgtaacattcaaaataaagaaaaacatgtgactgattaaaataatctagtatagacacagaaggaggaaaaggagagaggaagaagagcagggggagagaacaaagaggaggaggaggggacgagaagaggaaggaggaggaggagaatgggaagcgggggagaggaaaagggggaaaaggagaaatagctgccctgaaaacgctgtcatgactctgctctgtgcaaatgcccatcggctgcaacacatagaagcctcagagggtgctgcaacgggagagcacgcaattaaagtatgagaagtatcaaatgtccttgaatgttctagacacatacagcacagaggcaatactattgaccagatgcccccagattacaagaaagatgagtatttcagaactgtagccttttagatcatcctgtgtaatgtatcagcagaatctggaagtagtgaagtcatttttgtttggtccagaaatgttaacagccatgatgagatgaccaattacatcatagcaactgcaccctcaccgatccatcacacccagagagtgaagcaagcagcatggccacagtcttattctgtccaactcagcaaaagttgtcaacagcctaggcacagaattacacagctgaaagagccactgcagaaactgaagcagcggtgcccaggagcaaccaacgccctcagcgaccatgagggctgatagcgttgatcggttccagtgtgtttccagattcacggctttcattccagccccaaaccactctcctcacacttaccaaggccatcacgaagccatgccgatggcagaactctgcaggagcctggaaagcactggaggctgcgggctgtatcctgtaggtgtttgactgctgtctctcaggcccagggtatgtgtttgccttagactgtgggcccaagaactcctgcaggcaggccgggcacgcctgtaatcccagcactttgggaggctgagatggcggatcatctgaggtcagtatttcaagaccagcctggccaacatggtaaaacccagttctactaaaaaatacaaaaattagcctggtatagtggtatgcgcctgtggtcccagctatcgggaggctgaggaaggagaattgcttgaacccaggaggcggaggttgcagtgagcaggatcatgccattgtattccagcctgggtgacagagcaagagtccgtctcaaaaaaacaaacaaacaaacaaacaaaaaacaagaaaaaacaaacaaacaaacaaacacctcttggaggaggaatatgctgatctccataatcaactacagggctcaacgaatggagagggttgcccaaccactgttaatacataaatgttaacctgataatttcaaccagctgattagtttaattacaacaattataaacacaagacaggcaagaaatagcaagattataaacacaagacaggcagaaatagcaagatgaggtcccagataagtgcagcctatgtccacctggagatgtgaagaagatcatgcattagcacctgccatagagctcgagccaactcagcatggaaggcagcgggggaggcagctggagggcactctgcagccccccgttcatgctgcatggctgccacaccatatttccacggacgacagcaaaaaagagaggccagtacagtttgaatcaacatggaatgagacaaagagctataaatggcaacaagcctcagaaacaccaacataggacagcggacaggggacagggacagatgcaggttatgggccagactttccagcagcctttgcagccccagtgaaccagacacagacagcaacaccgttagtggcattgctgatggtaaaaacatttctcagagtcatgaaggtgtgcagtgaagctcattttatagtatagaagaaaatcgtgaacgtatcaagagtctcttaaattattacattagagtgacaatgtattgcttctaatccttacccaccaaagttatttttggtggtcctggaagagttgatcccgaggggaaagcagacccgttgctaccgatggtaaggctccctcaagctgttcaaagtcaaaggcaaggatattttgaattgcaaggatttttaaagttccagtcagccagccccctagataaaaatgattctttttttcctaaaggtttacatcaccatccctttataaccatgtctggccttattaccacaaggaatcactgacattcggaaggtctagtgctgaggtgtgtcacaggcctgtctggaagtgtgcaagatgtctggaagtgtgcaaagatgcagggctggcctccacgggctggaggccgtccatgctgtcactcagctggccaggggtattgtcatggaactccttttcatttttatagactacaattatgaaataaatttaatgacaaatttccataaactagaaatgttcttatacagatttgacatttgaagtcttgttggcaaccatgatttttcatgtattcaaaaaaatattttgaaccagttttaacaaattcaaaagcaatgtcatcatctctgcattgtccatgttctttgtttcccaggtctcatctttctttatgttactcattagcatggcctgtggaggctgttcaagggaaaggaacaggcagcaaagccatcactggcctacttctcttctactcagtagcttaagaaattaacagtactaaatacaattaggttttcagattatttgcatatatcacaattaacctcatatccttgtcccttcctctgtccaaaaatggaaatgtatctttaaataaattatttttaaagctttaagaagtatagtcttagaaaaaaaatgcgtcttgtattcatcctcgcacttcctccattctgtgcccagtttaaactgtgtgtcatcaccatccattacggctgaagacactgagaaagcctcctgggtcccactgcctcatttacaatcagtcttaagtcccaggcttcttcccgggaaaccccttcctgctctcctcttgctcgtgcacagaagggagtgtcacaaggccctgagacaggtgtcccttttgccctcacctggacacctaattgttaggccctgtcttcaaatgtcagtctgaagagttttgcattcttttggagaaaggatgtcatagtctcaggattgaggcaattattcgcataaaccaggtaaaattactttttttccccctttcttatttagccccaaagtaaagcagagacatctcttatgtactccataggttgtaaatcagggcaactttatgctggaatccacgagtttcttcagcaatgtttggtcctcttggagtaaggaagtcaactcggaggcagggcttctcagactctgctgtgtgcacaagtcacctgggcctttatgaaaatgcaaatctgattcagggggtctgaatcccaggtttggggtggaactgaggttctgcacttcttaacaagctcccaggtgatcccaacagttctggtccatggacacactttgggtggtaacactccaaagaatatacagaactggggtctggcaaggaagcaacgattctcgagaagcagcaaatgcattgctaaaagaattgtccttgaggtccatgctggtaaggggccaaaatggggacgataataaacagtcaaggaaaggtgggggaaggtggggaacagcaagttgtggccaaatgggtgtttctcatggaagatcttagaggtgaaagagcaatacaatgtgtgccttctggactggtggctgaaacagcagagaaaggaaggccagcagcgggagggggccagacggtaggaggattctatgaggttccaacacagactgcatctgcgtgtcgccagatcccgacttacactcacctcctgcactgataacactctcttttatcttggcaatgtatcacttgagaagtatttactcactcattcaacaaatatctaattcaatttacatcacttcctttgagatctcatctattcatatggctttcaacgccatctatacactaggatcccaatctcatccctcctgcccagcccttcctcactctaaactcctacgcaacatctttgaggcatcccaaatttaatatatccaaacggaactcctggacgcctttgaaaaacttgaccatctcatctttgttgatggaaactccatctctccaatcatccaggctgaaaaccttggcgcatccttgactcctctctttctctcacatcccacatccaatccatcagcaaatccgttgactcaaccttcaaagtatccctagaagctatttcttgccacctccactgccaccactgatctgagcgatcatctctccccgagattattgccataacaggctcaccgttctcctgacccctcctccccaccagcccctctttagagtggaagccataatcctcccagtgccttacttcctccctgccctgctcccctagctcacactatcccaggcccagtggcctcctcgcgccaccacagcaggcatgaccctatccaaggcccgcctgggatgttccacagcttgcttacagagctcattccctcatctctttaaaggctttgctcaaatgtcaccttcacaacggaccatgatcaccttttttaaacctgcaactaggctttttccccatcaaatccccatcccccaatccgcttcctctgctctcctaacagatgatgtaattggcttcctattagatttgctattgtctatctcctgcagtaaaatgtaagctgcaggagggcggagttgtgtgttttgtttctgaggttcacttacctcacagatcagtgcctgcccttattgaagggtgagtgggtgcctacatgggccaggctttgtgctgattctcattttacagagatgaacgagacacatatgcctctgcccctatggagcctgcattcttgtgggtggatgcagacaaaccaaccaaccacaaacgcaagccagtgagagtgccatgcagagcaggagacagcactgtgactgtggctggcgtctacgctggggagttagggaaggctcttccggggaggtgacacttcataccaaaaccgggaaaaagagcgtatttgtcctctacttttatgtaatatacacatatcatggtgtaacataaaagcaaactttaaaaaagtatttccataacactgaggagggtgaggagcgttctgaccgaggaggtggaatatgctgttggtggggtcacagaggacaagttagcaagcgtggagaatgccggtctggaggctgcaggaaagggcaaaagggcttcatcaagttggtgaagataactgtgtccgagactgactccagcccacagtgtctgacacagtggggcagggactgacacttggtaagtatttcactttgacttttaaatggaaaataaattatatttcctgagtattccaaccataacaatcaaaattttaagagacaataatgcaaaattgtattttttaaataaaacaatgactcacttgttgtgtaatgagatttaattttgttgatgctggcaaaaatcccctactaaagcagtcattggtttagggacatctgtaaggaagataattaaaaattaatgtagcatctatcgttcctcttccacttacacgtggatgaaagtacaaaagtctgttatgacatgtcctgtgcaaagttatttcaacttatcttgatgctagttacgcattttattctcaaaacctttcaagtcagtattttacttaatatactcatttttcttttcttttttggggaatggtcataaagctacttgatctgagcttccagggttgctctactaggctaaaacaatgtgttagtgctctggttcccaaattgtgtgccaaggtgccctgcatagccacagcaaactactaggaaaaaaaatgtttgagatagggtctcgctatgttgcgaggctggcttcaaactccgggctcaagcaatcctcctgcctcagcctcctaagtagctgagcctataggcataccagcttcgctggatattttatgttttcttttttttttttctttttgcttttttgagatagatcttgctctgttgcccaggctggagtgcagtggcactaccacggttcactgcagccttacccccctaggctcaagtgatcctcctgcctcaccctcccacgtagctgagactacaggctgtgccaccatgcctggctaatgttttcattttttgtagagacaggatcttgccacatgaccagactggtcttcaactactgggctcgagcaatcctccggcctggcctcacaaagtctgagattacaggcgtgagccagcactccaggctggtattttatgattttaaagaaagccagggacatctattggataccacaggaactacttttttttttttttttttttttgagacgggtctcactttgtcacccaggctagagtgcagtagtgcgatgttggctcactgcagcccagcctcaaccttctggcctcaagcaattctctcacctcagccccccagtcaactgggaaacaggtgcacaccaccaagcccagctcatttttttttgtatttcttgtagagacagggttcgccatggtacccaggctggtcttgaactcctgagctcaagtgattcacctgcctcacctcccaaagtgctaggattataggcgtgagccacggcagccagcactactttcgattttgtgtatttttttttcaagtggttactaagttgtttggatataaatacttactaagctattagactaaactacttagtactggaactgataggtacttatttggtctacaagtgccataaaaacattcttgagacactaagggtgtgtaagcctctgtgctcatgagttcaagtagagcacctgaacactttttctcctccaggcctaggcatcctttgagtgaggaatctcagaccaggcagcaggatgcacgtactttattgtgatgtttaatatgtgcacagtgtaacaaagagatgcaggtggggggagtatgattatatgataaggaacttgaactggaaaacactataaaactctctcctcctgcagaccttaaggcactaggattttgtcatgtgccaggaggaagggagcaggaaagaccttctccctgcctgtagagatcagagatgcagcatgaacctatagagatgaggccaaagctccaacctcagcttcttcactgtgaaaagagtcaatgtcttgagatatttattctgtccctggacagggagacaatcaggatgcaatggggagacagggagtccgctttgtctttttgccctggacttcaaaggccagtgaaactacatctggatttgctatggtttcaagttataggcaaggtcagtgaatcacctgacagtgaatattctctcgttaaccaagatctagggtaatgtgattacgtgcagtccccatagagaggcctaattttcaagaatagcatctcacttttgttaaacacaatcctaaaatacgtcatttactctttctctaatctgcataaggaatttcagaacaatcaagtacttacaggtcatttcttattattgtgccagttaaaaaagtttcttagtcaggtaagaatgaatttcttagaatgaatgtcagacaaatctttgttatttcagaactcatggtgattaaagcagaatgatagttctcattgattacactaaatgtttacattaaaatgtaggtgtttacaccacacctgaagtcaacccatcaggtcatctgggaaaggctgatatttcaatctaggcacatcgaggcacctatttgtggaattcctccaatgcagtgtcggtctgagtcatcacctgttaggatcacaaagctctcagcagctagtgacatgagggacagctatccaagaatttgagacagtcagtacagggtacaaaaattagctatagatatacatttttatattcttagcttactaatatggactacgaggtttgccaaattcctatttaatatcctggttgccatttcactttatatacaaagccaaacatattcattaccaacttacatatatgacatagttttttttattaattaactttgtacctgactgtagaaattattttgatcttgatactgaggaaccaaatggagtgcttttagttctcttgttctaaattgtctatacatagcatttgtgtgccccctttcaattggcatatcacctaaaatgaaaagaacaatcaggtttcatttttgaaacataattccagtaataatgaacctaaataaactaaatctgagaaaatagctttaatccagaagttacattttaatggaagatagaaaactaagatctgttttcgatttcttactctacactaacatgctctttggagacaccaaagggcaaaaaaaaaaaaaaaaaaagaaaaacccagaaatgtttcctgagatgcgtccagtgtgtgacagaaaaaagttcctgtgcctggctttctccacaggtgtctgatttagttggggatcagtagccatgccccagagcttcctttgtcctgtcctcactccaccattgacatgagcagagagggtgctgctccgctaagccccagcccattcagccccagtgggcactgaggccctggggcatgtccctgagtccctgggcacgcacttaaaatcctctctaattttactccaactgcctttcctgccacacacatgtcattatttaacacatggggttttaaaaacacatctatttatttcctacaagtacagcttagaaaggttagtccaagaactataaagttctaagaagcacactgatctgcttgggcctgagcagcactgtcagaccccccttggatactgaccataataaatggtcgcaagccgggtgggtctgccagtccatcccatcagtcaagcaaaagcactagggaactgtgtgcccagccctgcttcaggctgtggcatgtggggatagaaaggcgagaatgctgtggcttctgcctggacacagcttccaattctgctggcagaaccacaactacacgagcagctgtgctttatacacttaagttgcttataatctagataagagaacccaaagaacataaaggaccaatgttatcaaagtaatacacattggacctactatggtcattggatcatattccacatcatcctgacatctgatgagaggccagcattcatgttcaattggagttgttttgtatttggaggataaagttatagctacacacacacacacacacacacaggaaaggccagagtgaactctgcagacctgcctctactgcacactcctgggccctatccacatgggaccttggctctgccctctggggaaatgtgctaacatcactctgcagtcttggggagtcgggagttctcatcctgctgacctgcttttagggtcctagaaaaactgctatcagaacccacgccccaaatagaaccaccgatggagaggctaatgttagtgtacaccacagctaaaccaactcatgacaggctcattttcaagtatttgcttgttaacgtctatgccttacagcaagggctcatttctaggaataaagaattgctgggggaaaggcaatgatcggttcttggactctggtgctttgctaagggaatgctgtgggcgacactctccccattcctagtccttgccacgtagatctggagtcccagatgcaccacttaattatgaagaccaatgtagatgatgtaacattctgtttcttacccataaagtggggataaaaagaatgcctatcctacagagttgttaggggattaaataaaggtgcaaaaatatgacataaaccacagctgtgactgattacgtacccatacaagcgttacctgttatcatgagagattgggacacgaaggaagcaggctctgccctaagccacaggaccgtgccccacaccaatatgccaaaccatgaggctcagctgcagtcccgaccccagcactgcactaactgatgtgatttgtgcttgctctccttaatgaatacagcatgtcctcatctttgttcaatttgctaagatggagtagaaatgagaatcttagaggtgagtgtgaaaggctcatgtccctgttttgctaatgagacaaccaaaaatcctgatacaatactacgtgaaatgaaaaacgagtgaaatgatcagtcgacttagtaatgatggggtccagcattagtataatgttagtcctacacatcttctttagcataattaccattgggttggaatcttcttaagagaacagcaggaggcatcctctagttcctgggacgatgggaacttgcaacagattcctgagcaagaagattctgcaaagttgcttcttccggattattacttgtagtagtacacctgcttccttgatttcaacctagaaaaaagcaataattattttagagaacacatggggacactggctcttgcagttgcataatttagaaaattgaaatctcagtgataagtagaattatggtgaaaccctgtctctactaggcatggtggcacactcccagctaccggagaggtgaggcaggagaactgcttgaacctgggaggcggaggttgctgtgagctgagacagtgccttgcattccagcccagccccatcacacattcttccagcatgctcagtagtttgaattagtgttctagtcaattgttttttcctcaaaaagccccaaatccttggtaacgttttaatatatttatgatgtgtttataggaagatttgtaattaggtagtagccctttcctgccttaatgtaggacaacaaacatgaaatggtggagagtagggagtggctgccagctttgtgttcaactgtcttctgtaacaactgtcaacccgatgacaaaattaccaaagatatggagaaatacgggataatactgaaaatcaatagaatttttaaaagtaagaatcctcgtggttaaaaaaaattacaatcaggattgtttcaacattgggatgctgctttttacaatctgtaggaatgtgggaggactgggaaacccacgctttgcatcctcccctcccctcctcctccacctacacttcccgagctgcctggaccagaggacagtggggctccccaaaggccaggaggcaggccacaagcccttccaaaaagatggtggctctaaggtaacatactgaagacctcaaataaaaatccagagcaggtatctttcaaaatgcagatagtgactcaaattggagcttgtccagcccaaaaaatcagaggcccaaacaaatcatatttcccatgtatgggcaaatcactcagcacagcgactagcatctaggtataaatcttaaaagagataaagtttagctatattttaagtagcttatttagaaattttaaatttcatataaatacacataaaattttcttctacttgctgcttgggggatgtgctatgcacgtcatcccagtttagatttaacttatctccctgtaatcaacaatactactataataaatatatcatttcctcagacctatgcaactaatatctgaactactatactaaaattccatttctgacctttcaaaacaaaggtcaacatgtgggaatgaattttagaagaaggaaattagcaactgatcctgaatatttactgaaaataattccattctgttaaacgataaacatgtctgtgctgtatctggtccattttattaatgaatcagaaagcagtaataaaaatttaaaaagcaaagtctctcctttagtttgtcagaccagcaatctcttaaattggattaaagagaattttactatctttaacatcagagaattctcttgtgtgtgttttgttgttttttaagacagggtctcactctgtcgctcaggctggagtgcagtggtgcaatctggctcactgcagccttcgcctcccaggttcaagcaattctcctgcctcagcctcccgagagctgggattacaggtgtgcgccaccacacccggttaatttttgtattatcttccctgtctgattaatgctttctgactccactctgtgaggaaatgagccgagctaggacctacgggaggaggcgctggacaccaatccggctgggcagcaaaatgcagttcttaacatttcaagcctctgagaaaggctgtgagaaagacctctgtcctgggaaacggctgggggaactggtgactctatggctcctctgaggacaaacagaggtcagtggaggccccagcctctgcccatcctttcctgtacactaaggactggcaattaccataacagaaaaccggaagagcagaaatccagctcctgctgctctggcttatgatacagggtcaggctccagccatctcaatactgactaagcattgtgtcccacaaacgcttcatctacaacttactaaaatgacctcatggatgagggtctcgttttctgagctgggtcctttttgaggggtcgagaacacattttcctgggacctttgtttcctttgaaaactcattagttttggcaagaacaaagcggaaaattatcagcggcatctacagctagagagggcagtcggctgagagctggcaagcatttctttaggctctgattacattgcatatgcttgaagagctattactcattagcaaagggaagatctcacatcttacttcaaggcccggaaaatccaagtattaactctgagtccttgctgtggattccaagccggtaaagttaaaggaaaaaaaaaatgcaagatgcaaacacgccaaccctccaccacattcgtttgttttcacagacaatagttaccagcagacagcgggcctctctccttaagccaagatagcaacagggcccaagggaacctacgtcctagctttccccctttttttgttgtccgcgtctgcatggttaggtcagctttggacgactggtgcagggcagaattccctccaggggaagggcttggctgggccgatgcatgttggattaggaagacgacaaagagtatacgctctacgagaatcagtgactccggtgggctgtgtgtggtgtcaccagggaaaatgcttgtagaggaaatcctggggtacactagcagcctcagatgggttggggaagggatggagggggagcttgcccattccccaggcggttcttactgggatcatgcggacgcccgggtgggaggctcctccaggacccaggcgcccaggggcaacaccgccgggctgcggtgcgcgggtagcagcgagacaggaagtgcacgttgcaggcgggcggctgcggggcctgcaggagcgcgacgtcctccgcgcgctgagctctgggatcccggggtactccccgaggagctccccgccgtcgctgtcgcccccgcgagcttcgccttgacctggcccttgcagtcggcgcccagcgcggggttgaaccgtgcaggacgggttccttggggtccgccgggcccaggtacgcttctttgaagacgtggactcgtcctcctcgtacttcacgggggccttcaggccgatgttctccgaagcgaacggacctcggggcttaagagctccgtcaccatcgcatcctcggggctgggcagcccgcccggcgagggccctcctccatggcgcagggcggcggggcgggatggcgggggccgcgcacctgcacacgcggccaggtgagaggcagccagaggagaggacgaggggaggggcggccagaaagggacagccaagggaggggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtcatcctcctcggaggacgcacctggggccgccggggctgccgcatcgtggatcgagcgggatgggcgtgggccgggcctcatgcgcatgcggccgttggcggttggagaagggggaagggtagggacaggaacctggggggaggggaagaggcgcccgggcagtgggcggggcctgggcgggggcggagtcgaggtcggggcggggaggtaaaggcggggccagggaggtgtggtgggctggtctggggcgggaggagacagagtcgcgaggggcggggcctggactgccgctgttgcagagcgggtcaggggaggcactcccaggttcagccgatccaggctcaggtggggaaactaggtccccatcaactcgggcagcgctaagtgggactgcctagcttggcttctgaccttggcttcagttatatttttctggccaggcgtggttgctcacgcctgtagtcccagcactttggaggccgaggcaggcggattacttgaggtcaggagttcaaaaccagcctgggcaacatgtgaaaccccgtctctactaaaaatacaaaaattagctggccgtggtggcacgcgcctgaatcccagctacttggaaggctgaggcaggagaatcgcttgagcccgggaggtggaggtgcagtgagccgagatcccgccactgcactccagcctgtgccacagagctagactccgtccaaaaaaataaataaaataaaataaaacatttttctacactcgagctctcaagacagatccggcctgggacgctgcgggtggacagagggcaggggcttgcaccgcacgttcccagcctgcacccactcccggtccttggtgacgcagcttacaggtgcaactgatggagttggtccgaaatagaagtaacaaatacggctgggcgtggtggctcacgtctgtaatcccagcacttgggaggccgaggcgggtggatcacctgaggtcaggagttcgagaccagcctggccaacaatagtgaaactccgtctctactaaaaaatacaaaaactagctgggcgtagtggcgcacgctgtagtcccagctacatagaaggctgaggcttgaacctgggagatgggggttgcagtggctgagattgtgtcactgtactccagcctgaccaacagagaaaggctccctctcagaaaaaaaaaaaaaactcacaaatacaatgaaagtctcaaattttgggtggggaatgagctattcatctttaaggagtcaatagatatcactgtttaatcaagaggaggtgaaagtttaattaagtgatggcgaaaactgcaaagggtgtagagggactggtgggagtgggtgctggggagcagcctcaggtactgtctactcaggtactgttttggtaaaaataaagaatgtaaaacatagctttctaatctcacttttaaaaattaaatacttttctaaatttttaaagggtagtaccaaggcacagcaacaccgtgtactatttagttgtacatttaacattcaaaaatcaagaaattttgcctggggctgggcgtggtggctcatgcctgtaatcccagcactctgggaggccaggtggtcagatcacttgaagtcaggagttcaagaccagcctgactaacatggtgaaacctgtctctactaaaaatacaaaattagctaggcatggtggtgcacacctgcaatcccagtatttgtgaggctgaggcaggagaattgcttgaacctgggaggcggaggttgcagtgagtgagattgcaccattgtactttagcctgggcaaaaagattgaaactccatctcaaaaataaacaaacaaaaacaacaacaacaaaaaacactcacagaagcagaaaaaataataaaaaaataaatcgaagagcccaagaattatgcatagcttgagtggcccaagcgagagagtaaccacaaggttgcaccgttcattcgtttactaatcagaatcagacgtctactgagtagcatatgccaggcatacacagccacctgtgggggtcacccacgggttgcaatcaagcctggagctctgcacctgctgctcctagatgcttgctgccctgctgcactggccgggctggctccgcgagtctctcaggtctcagctcaacccactctaagtgggtcaacctccctgccagctacaccccctcccaatgatcctcttagttgcctcagaacacttaaaatccttcaactggttgcttgttctctttttcctctgtgatatggtttggctctgtgtccccacccaaatctcatctgaattgtaatccctctgtgtcaagggaggggcctggtgggaggtgattggatcaaggagcggttcccctacgctgttcttgcaataagaagtgagttctcacaagatctgatggcttaaagtgttcggcaattccccctcactctctctcctctgctgccatgtaacaggtttcttcttccccttcaccttctgccatgattataagtttcctgaggcctccccagccatgctgactgtgagtcaattgactgtctttcctttatacttacccagtctcaagaagttctttacacaatgtaaaaatggactaatgagacagccagaacctggtggggtcactgctgtctccccgtgcctagaacaggcgctgatatggtttggatgtgtgtccccacccaaatctcaggttcgtggtaatccctaatgttggaggtggggcctgatgggaagtgactggatcatgggcgtgatttctcatgaacagcaccatccctcttgctactgtcctcaccatagagtgcgtgagttctgtgagatctggttgttcgcaagtgtgtaagagagcacctcctctctctctctcagattggttgtttgcaaatgtgtaagagagcacctcctctctttctctctctgtctcctttcacatgtagaatgcctgctccccctttgccttccaccatgagtaaaaagctgtttgaggccccccagaagcagatgcctccatgcttcctgtatagcctgcagaactgagagccaattaacctcttataaattacccagtctcagctatttctttacagcaatgtgagaatggcctaatcaggtgctcaagaaaaacagaaaaatggaattcatgcattacttttaacatatttattggcatcttttatgtgtcaggcactgttctcagcattgaggcaatggaatggatgaataaagcacagcaagtgaaaatcaacaggcttttctttccagcccagcacatgaacttggtgattccatggtctcctccaaggccttgtttccatatgctgagactttccactttgtctcaagatctgaacttggtccttgacttataatccccttaatataacaaaagagacagaaacaaacttgtagtagactggggttaatgttttattaatgataacctacattcacactgcatttcaagatttacatccaaagagcatactgtatttacatgcaccggtcagcccaagataacaattcaaaccatggctgcgttaagacaatggtttgttccaattaaattaaacagataataccttatcaccccccttggacatgtacaataagacccctctttctcccctcaaggaatataaattgcattgataactgcactgatgagcaacaattacatttgaaacatttaaaacctgaagagaaacccaaatatgtttaagcactcacgtctacactcaaaatgccctgtgaactctgtgtaacacagattgctcagtggtcaacagtgcatgatctagctggctctgatagggacgacgccggctgctggcttttaacgggaagtgctattcttgcccagggcagagagagctaatccccgctgcctgcttgacggacagtcaggggcttttgttgttggtttgtttttgctttttttttagacggagtctcgctctgtcgcccaggctggagtgcagtggagcgatctcggtcactgcaagctccgcctcccgggttcacgccattctcctgcctcagcctcctgagtagtgggactacaggcgcccgccaccacgcccggctcattttttgaatttttagtagagacgggtttcaccgtgttagccaggatggtctccatctcctgacctcgtgatccgcccgccttgcctcccaaagtgctgggattacacgcatgagccaccgcgcctggacgctttttttttttttttgtcttttgttttcattttttcttgctttcaggagaaaaaaaatctttggcccataaggtgggatttttacatcatgaagtatacatacataaaacatgcatgtgggccgcgcaggtggctcatgcctgtaatcccagcactttgggaggctgaggcaggtggatcacctgagtcaggagttcgagaccagcctgaccaatatgatgaaaccccgtctctactaaaaatacaaaattagcagggcatggtgttgggcgtgtaatcccagctacttgggaggctgagacagggaatcgcttgaacctgcaaggcagatgctgcagtgagccgagattgcaccactgcactcagcctgggcaacaagagtgaaactccatctcaaaaaaaaaaaaaaaaaaaaaaggcacggttctccggcaagcaccttccatcgactccaacagttcagccatcgctgttgtactatcgggtgcagcactctgaaggagtcaggcccaactagaaccaagtggtcaaaaaaataaatcacaatttaaaacaatggacagctaagcttgtcatgacagacagtgggaatttcattcctgatgcttcatttttgcattaaatactgaagatgactcagtgcataattgctttgtggtcatgagacgctttcgtgaaggcactcctatctgaaggacaggctgggtgaacacctagcctgtcacttgagacatcttggctggtcaccaaggtgagccggcatactgtctccatcacctctggtgagtctttcccctcaccgggtgggaggagaaggccatcccttggggtcgtgggccactctctcctcaccacggtgggctgccctccccttcctcacttgctagtccccgctggtggccgatgccctgccctccttgctgtcactttgggaaagagatcctcctgaggcactgtcatgttttattcttgagtgaattatctgaccatcacggcccttgctccccttttatacatgtgcctgttatttcttttgttgcttatgatgacaagaaggcagtcccgggagggggtctggcacagctgcccttgggaaggaactggtgtttctgagggggagggggctggtgggtgtagcaaatgcttatgtacggttatccatactcagtcaattgtgaagggaacagtatcccacaattccacccaaagactctacaaaataaatctttctctccatctcccttacattagggcctttcatttttaaggcactgggttgtgaagacttgaagacatacaaggtcagtaaactgaagaccttgcatcctgcttgcttcaaatgtggagaggcaaacacaggctactggccagacgggaacggttacccacggtgacaaaagcaggtctccaaagcacagcattttggtagtgcattccagatgtgttagctacaactggggacaccaacttgaataacacatttttttttaacaaaacaaaagtttaccctgcttggatgatgctaaatgcccttaagcactaggcttcggttgccactgagaaagcacaccatttccattccactgtgtgtgaagccacaacctactaattccttcattaactcaacaagatttgcatcccttaataaatccaagccgatgcgagacatcaggggagactttatcagatgtcccccaagggagggcaagtctggaagtagtgggttatgcttcacaggggagagatactgttctaggaaaaaaaaacacccacattttctgaaggaaaactgagtttttttaagagcagtgtttcatcccgagctaaggtcaggattaagcctatttttcatttggtttgcatcagaagagctcgttttccttcccagcagctccagtgaattactttttggaattagaactgagaccaaacaaagtgatgatgtcagtcattgctttttcaggtgccttccaaagcgatgagaatcctttcatgtaaaaacaaaaaccaaaa

SEQ ID NO: 5048 - DNA, 100000 bp, Homo sapiens
gcctgaatgtcaactccttcatctgcagtgaaaaaataagactgctctgtggaccagacacttagttttatttttcactgcagattatttttcactactcatgtgggcctgcccagggattctttcccaggaggcaagttatgtggcaagcaaaatgatcaggagagtcaaacaaacgctgcagaaacggatggacgatgactgtcagaaggaggagagaagtggagggtgacagcgaggtgagtgcctggctcattcatcctcactccctctcttgaatccatgttaatcacaattacatgaatgcagtgctttaaaattaaggtatatagagaaaccccatctctactaaaatacaaaattagccgggtgtggtggcgcatgcctgtaatcccagctactcgggaggctgagcaggagaattgcttgaacccgggaggtggaggttgcagtgagccaagatcttgccattcactccagcctgagcaacaagaacaaaactgcaactcaaaaaaaaaaggtaaggtaaggttatgcttataatcccaacactttgggaggccaggccaggaggatggcttgatcctagggttcaagaccagcctgggcaacacagtgagaccacagctgtcccccatctctataaaaatttagaaaaattttttaaagtgctaaaattacaggcttttttaaagtggtaggattatagccggggggtggctcatacctataatcctagcactttggcaggctgaggaaggtagattcttaagccctggagttcaagaccagcctgggcaatatagtgaaaccccatccttcaaaatattagctgggtgtactggcacatacctgtagtcccagctacttgggagactgaagtgtaggatcacctaagcccagggaggttgaggctgcagtgagccaagagtgcaccactgcacccagcctgggcaacagagtgaaaccttgtctcaaaagaaaaaattatccaggtgcggtgtgcatgcctgtagttccagctacttgggaggctgtggtaggaggatcacttgagcctggaggttaaggctgtagtgagccgtaatcacaccactgcactccagcctgggtgagacagcagacattatcttaaaataaatgaaaaataaaagtaaggtagaaagagtatttttaaaagcttattggaggttcacatcagcactgagagataagaaatagagcagatatcatgattccactttttgaatgcagaaactgaggcccagagaggtgaatccagcctgtgtccttcacacccagctggctcatagaaaccatggcctgttaccaaccaagccctccagagcccagcacttaggccgatggcggccttccctggcctgctcctggggcaggttgctgagaagcattgccgttttggggagaggcctgcggcagcctgaggaatgagcctggcagtgggcactctcactgggcctcctccggcgctgccctcaggaagattctgtggctcccaaagccccaggggcgctctgaccacagcagtcagtcctgccgggttggggggggctcttgtgcccagcgtaacttacagagccagcacgttccagcctgggagggaaaccaaaaggcactttgcccaagtgtcacgggctgaaacgacatcctcatgggcccctgtccccggaagcaatgagattggacaggtctgagcccctgttacttcattgggatggacttgcatctaaggaacgaactgagagtgaaatttccaaatttgaggcctaagaaaagtttgttggcctgatgagctgtgacaggcaacctctggggaagtggaagctcagcacatcctccggttacttattacgttactgaagggtctaaaatgactgtccttggggtgctggaatcctgcagaataaaatagtgctgaattttaatcattctttgcaaatgaatgttctcaaggctccggttggagtcaggcaccctgggaccttcagtagtgtgctttgggtcccaggccacagcacagcccctttctttttttttttctttttgagatggagtcttgctctgtcgcccaggctggagtgtagtggcgtgatatcggctcatgcaacctctgcctcccgggttcaagtgattctcccgcctcagcctcccgagtagttgggttacaggcgcccgccaccaagcccaactaatcagctaatttttttttttttttttttttttgagacggagtctaactctgtcgcccaggctggatggagtgcagtggcgcaatctcggtcactgcaagctccgcctcccaggttcacgccattctcctgcctcagcctcccaagtagtgggactacaggtgcccgccaccacgcccggctaattttttgtattttaagtagagatgagtttcaccatgttagccaggatggtctcgatctcctgacctcgtgatccacccacctcgcctcccaaagtgctgggattacaggcatgagccacctcatctggccttttttttctttttttagagacggagtcttgctctgtcgcccaagctggagcatagtggctcaatctcggccactgcaacctctgcctcctgggttctagcaactctcctgcctcagcctcccgagtagcgggattacaggcacatgctgccatgcccagctaattttttgtatttttagtagaaacggggttttaccatgttgcctaggctggtcttgaactcctgacctcgtgatccaccctcctcgcctcccaaagtgctgggattataggtgtgagtcaccgcatccagcccatagtccctttctctctgggagtctctggtggccccttcataatgcttttttttttttttttttaattctggtacattttctatgtaatcatttcaataactgactgtccagtagagtctttagttttttgtatcccttcccaaatttagaaacctgacttgaactttgggccagttgtaatgtgtccctatgacaggccatcctgggcccccttccctttgttcctgtggccggagccctgagcagccccatccacttgagtccaagaggccctctctcctggctgctaccattgtacccacctgtggccaggcccccacaggggcctctttcctcctgacagtctcatccccactcagcagccgagtgccttctttataaatgtagatcagatcctttcactgtatttgttcatccaacacaatttactgagcacctactgtgtgctaggccctggtacgggcacaggaaacacatcagggataaaactacactctctgctctcctggagcttccatgctagtggagagaagaaagatactaaacatgtaatgagtcaggtggtgatgagtacaaaggagaaaagtaaagcagagaaatgagtagaaagtgctggcaatagtgggtggtggtggtggggggtgtggtttgcaattttcacaggggtcctcaggcctgactgaggagctgaagaggtaagagagtgagccacgaggctagtggggtgaaagagttggagcagaaaaggtgggaggatcaccaggcatgatggccccttctgtagtcctaactactagagacaggctcatgcctgtcatcccagcactttgggaggcgaggcaggtggatcatctgaggccaggagttcaagaccagccagaccaacatggtgaaacctgtctctactaaaaatacaaaaataagctgggcgtggtggcacatgcctgtaatcccgctacttgggaggctgaggcaggagaattgcttgagcctgggaggcagaggttgtggtggccaagattgccccactgcactccagcctgggcaacagagtgagatcccatctcaaaacaaacaacaaaagctaactacttgagaggctgaggtgggaggattgcttgagcccaggagttgaggttgcaatgagctacgatcacaccactacactccagcctgggccacagagtgagccctgtctcaaaaaaaaaaaaaaaaaaaagagtcccagcagagaacagcaagcacaaagccctgaggcaggagtgcacctggtgtgtttgagaacccacagagacaccactgtggctgagcagggtgagatgtgggaagggagtggctaaggaagctgagaggtcaaggaagaagtgggttggagcaggccctgcaggtgccgaaggcttttgcttctttcctgagatggcagccccacgagccctggagcttccctggctgccatgagatcaggtggaagggggtcgaggctgcagtggggacgcatgagtgggtgacaggtggcagtagtagaagtgtaagaagagctgggatctgggtctcttctatcttgaaaatagaaccccaggctgtgctggtagagctggatgcaggtggaagaagggaaaatatttttgctgcttaaatcctagcctggcttcccattgctcgggggtgcattctcgattcctcttccccgcctgaggtctgacatgtgctggccctggctgcctctcctgtaccttctaccaccagctccagctcatggcctgatgtggttcctcccccgatccagcgaccaggctgccctctgccccagcgcctcctccgtggatgtctgctcttcctaactgccctcccaccggacggctgctccttggtagcagctcaagtgtccttccttccctagccagtttccccaaacactgcagcacaacgcccttcatttctcatggcattcttcatgcctgtcaatggggcttttgttgttttaattttccgtcttcttgtttttgttggtcttccagaatataaaccccatgagggcagaggcgttcagcctgactccagcctggcaaagctgtacaaatctggaggaacacacacgttcacgggcactcagttctgtgaggtactgcaagcctctctgaacctgcaaggtggccattgctgtccccactttacaaaggaggaaagagtgcgggagaggttctacttagacccgccaagggcacagtcgttctagaaagtagcagactggggttccaacttgggcttgctggttccggagccccttctgtgccccttccaggctgtgcctggtgagattcttctcctaccagcacgtcttcttcctggagggttcagtggctgagctgaaccggtgggcaagaggccctggcgggcttgttgaaggactcaaaggtggcgtctgggagctggcgggactttctccctgtcagcctagaggcacttttagaggagtgtgtctgtttcgagtcttcgtgtctcataattcataactaaggtagagggtacacatttagtttacagtaaacctcaaacccacctccactcccagccggccacttctctccctgttcccttctctgcccccacaggtgagaacaagtgtccggggccgccccgtggggccccaggctgcccgccctgaactgcctcgctgtgtgcccttgggcaaccccgccctgctccgtgcctcagtttccccaccatagaggctccacaggtgacacacctggctccgggccccgatcggccgccgggccccgggggcggaaaccccgcgccaagcctcccggaggcacctccagggcagggcggggagcgcgggaggggccgcggggacctgcgccgctggggccgcctggccgccggccggctccgggggcgcccgcgggagggcgcggccggtgcggggggcgcgggtggcggcggcggggggcggaaagcggcgcggcttccgctcccgcgcgcccagctccctcctccccgtcgtcctggtccgggcgcccgaggggggaggcggaggcgccgggagccgcgcgaggagccgccgccgccgcgcatggagcccgagtgagcgcggcgcgggcccgtccggccgccggacaacatggaggcaggccgcccgggccgccgtggccgctgctgctgctgctgctgctgctgctggcgctgtgcgctgcccggcccccgccgcgggtaggtgggcgcaggccggccgggggccgcgggttgctcgacaatggcccgggcggccccgcggccaagtgcgcgggcgccgccgccgtctcggaagcacttggcgagttgggagcgagttggggcgcgcgcccgggatccccctgccgtccccggctccccgccacgcgcgggccctttgtctccccacccgggccctccccggggacgctgcgtccgggctggcgaggagggcgcccgctccgccaggtgcggcgcgggcgggtcctcacctgccgagcccgcgggaagccgggagccgagccgagcccgcgctgggcccgtgtggcccgggcgggcaccgagcggggacttggggcgcggaggcgggcctggcccggggagccggttcgcagcctgtttccagcggccgcgcggccgccccgcgtgctccgaggacgggctgaagttgcgcgagaaagttctgagcccgggcgcggggcggcctggccggtggcgctgctcctgtgagcgcgtggctgtgggtttccaagcggactgacacctgccaggtgcccgggcgacccgaatccccgtgtggccgccgggtccccagatagtgtccatccccgggtcggctacgcggaggtacgtggtcccagatcgcggggcagtgggggaggcaggcttgtgcctcagttgtacactccgtggggagaggtagggcgggggaactttctctccaacttttggtgtttcccagggggtgagttgaggtcaggaggactcaggaaacttaagcagtcgtgaaacgctacacatgttctttaatttggagattgccatgtggtttttcaagcaagcctcttgctacctaaatcattctttcggatgtgcgtgttttgtttttctggagtatggctggccaagtggcacggccgcaaggcctgtgcacgccgcggctcctgttctgtttgtggcagtttagcggggaggacctcgggccctttgtctgggcctccttaaggcaaacagctgtctccctgaatatttccagtgtgaaggtgcagcggggtggccctgtagtcagatcccccaggctgcagcctctgcttggaggtggggggacagcggggaacaggaggagcttggagtttgtttcacgtcctcctgcctctgaccaagcctagagattctatggacagtttcaccccaaatctgcctctttcaggagcgtgttacattgtggggccttgtctggagctagcaaaacaaggtgaagacaaaacagcgacagtactggggagtacaggccagcgccgctcctttttccggaaatgcctgggtcaaggaggcaaaggggttttggggaaactgtttgttttaaagggggggtttctaggccgaccgcgttgccttcacctcattgcagttttgggttttgtgcacgttttggggtgatgttgctggagtcaatgcctgtcgtccatgtggttcgagcccctgaggagaaagaattatagctgtagagttcattgtgtgtgaggcaaaaatagagttgattattttaacattaggcagcaaggcctgggagcccagtgaatgtggtgatccaggcctaaaatggaaggaaagggaggaatctttctgcagacggttttgatgttatatccctggttttactgtgtgaaatacatgcctcggacctcagcaagccagtaagtgggccgctaattatttttcctgattgcttcctgttgcaattggaagcgtgaacgcacggaaatggctttgttctagtggtcccagtgctgagaacttccccagctccaagccctagtcctctctcctcggggcccaagtgcttgttccagggccggcctgtccagcaccccctctccccctggaggttcctcctgtagatgcccaaggccaaggccgggccctcgggagagcccagaagggctgagtggggttaaccaagtgctgtgtggagcaccctgagaggtcccctccaaagcagggccccgtgtgtttagctcccctcttcagttccaagaaattcgcggtgaacccgatccagcatttgttcagcactttcctggggagattcacctcgtgcttctgtcgtttttggaacccgtttaatttcagccgtgctgtgtcactgctcaggcatttagtgaactcacacacacgggtgggggatgtaggcaggtgaggcctctgagttgctttctccctgcagcgacgggttgcagggctgatgggggtggaggggtttggggtcagacccacctggtttacatgctcagtggctgtttgacttcgggcaccatacctagtttctgttatctcacccgttcctctcccaggctatggggagccctaactgccctgtgtgagacctttagccccatcctggcagagctgcagtgagcgcagttgtgtgtcagcgtcctcgatctttctggccccaccggtctagaggctgttattacaatagtctggatttttcctgtatgaccttggacatccgtccactgacaaactcactcactcaccgctgcagccctcgggggcaggagtagttagttgcactgtggacagagcccctgcgcccagggtctgattccagcctggccgcttcctgtgcgggaggcttaggaagctgatgctacctttgtgtgcctcagttttctcacctgtaaaatggaatagaatccttcctaccatgaattcagtgagttaacgtgcacctggcccggtataatctgttgctgttttgctttggtgtctgctaccgagtgaagtgctagggttgagtgcgataaatggcagataaggccccgcccctgcgggcagagcttcccatgtagaggggaggacaggaaagaagctttgcagctatgcagaggtgggcccacgggtgctccttcaccctcggggtgcctgcgagaggcccttagaggccagatcatgctgtggagtctggttgtgatccacaaggagcggaagcttctggaaggctttaggcaggagttacaggaaatgcaagctaaagccagactttcctaggtgaaaggtgtcgagttgttttttttttaaattgaggtgaaacttatatatataaaatattaaagtatagaaggcaggcatttggtacattcacagtgtttacaacccttcttctatcaagttataagagatttccatcaccccaaaataaaacccatacccattacaggtgacttcccgttccctctccccggatcccctggtgaacaccagtcgactttctgccttgtggttctgcctgttctgggcattttgcatgaagggaatcttacaatgcgtcttcgtgctgacttccttggttactgtaacgttttcaggagtcatccaagtagtaccacgtatggggtttcagccttttattttttttttgaaatggagtcttgctctgttgcccaggttggagtcggtggtgcgatcttggctcactgcaacttctgcctcctgggtttaagtgattctcctgctcaggctcccaagtagcttgcattacaggtgcccgccaccacgcccagctaatttttgatttttagtagagacgggatttcaccatgttggccaggctggtcttgaactcctgacctaagtgagctgccggcctcggcctcccaaagtgctgggattacaggtgtgagccatcacgccggcctatttcagccctttttgtggctgaataatattccattgtgtggagggaccacatatatttgtcagttcatccgctgattggattgatcttggttggttgcatctcccagccgcacgagcaggtctcatgcctcctgcatcctggtggaggtggctggtgggaggatctggctgagactctcctgccgaggttcaggaacgagccaggtgatggggacaagttggggagtcgtgctggcatctcagaggaggggcctgggccctgagaggagtgctgggagggcagagtggggccaagttcaggttacagaagccgtgagacagccggacatctgtggtttgtgaggcttggaaacacttaatgcgctctccaaatggggagtctgttggggaggccctggcgggagcggggctacatccaggtcctcggcttggtggccttgttcacttatttgttcaggaagcagagggtgtgggctctgtgccaggccgccctggagggctgtcctggggccagtgaggtccagtgtgatgggcggaggcagctgtggcttgctacgagccggcctcagggacccaccggctgctccggctgctctctgcattctcttcagctctggagagccgtgtgccagccctcagcccagtttcctcatctgcaaaatcgggacgatggtgtccaccttgcccatgctggtggggtccaagagctggtgtctggggtgagggagctgggggccaaaagctcctgccctggggcatcagctgtcctttgaagagtaccccgagggtgtgactgagagccagtccccagcaccctttccagatggggaccaggaggtgggtgaagatatttggggtctgagctctgtgctggttgccccgagggggcctggagccctgagttaggagcagaacggggtgctggtcctatccgttcctacctgggtagtgggggctgccttcctgggttgggggtggggggagctccctgtgtcctaagccatgcagaggcatgcgcatacgcgctgctcttaggcatgtgggtggcgctctgggtccctgcccattccccagccccatgtggtggtccctgtgctccaggtccagcctctgtttccagtttgtcctagtttgtcaccttgtagggggcagttgacactttgctggcctgatcgtggtgtgccagagcccgtggctgctgggcgactgtgcctctttctctcagtggcaaagccttattttctaatagagcctgatgggccagaggttccgccacagggacactgttcttgtctctcgtgcttggggtctcttgctgtggaccccctgggaggttgtcctgggggtgcgggattgtgttttctgggtattttcttatttgctctattggagtgtatttaatttaataatatattttaaacatcttttagtttgccttaatgtaattttttttgagatttaattttttttttttgagatggagtcttgctctgtcgcccaggctggagtgcagcggtgtgatctcactcactgcaagctccacctcccagggtcacgcctttctcctgcctcagcctcctgagtactggaactacaggcacccgccaccacgcccggctaattttttgcatttttagtagagacgggtttcaccgtgttagccaggatggtctccatctcctgatcctcccgctcggcctcccaggtgctgggattacaggcgtgagccaccacacccggcctgcttttttttttttttttggtcttgctctgttgctgaggctggagtgcagtgattcagtcaccgcttactgcagcctcacctcctgggctgaagcaatcctctcacctcagcccgcaagtagttgggacctcaggtggcaccaccacgcccagctgattttgttgttttttgtagagacagggtttcactatgttgccaggctggtcttgaactcctgggctcaagcgatccacccacctcagcctcccaaagtgtgggattacagacatgagccactgcgctgggccttaatgtagtttttcttgtggttaaatgaggtgaaggttcactcaaggaggaaagtggtttttagccttttgaggggctcaaggacccttcaaggatatgacaacggctcctctcctgagaaggtgcctggtgggggcggcacagctccactccaccccattgcaagaatccagggccctgcagggctcagagccctctccctcctccctgtggggcattgagaggcactcaccttctgagggcctcagtttcctttttttgaaaatagaaccagctgattccaatctctatggtctcttctagcacggagcttcacgtttttctcccttcaggatcctgaggcctctggatcgctagagattgggggtgcccccagaagggcgctgcttctgtgccctccctcaccccaccgtgcctggctccttgtttttttttttttttttttttgagacaggagtctcactcacgcccaggatggagtgcggtggcacgatctcgctcactgtaacttctgccaccctggttcaagcgattcttgtgcctcagtagctgggacacaggcatctgccaccatgcccagctaatttttgtatttttagtagagacagggttttgcacgttggccaggctggtctcgaactcctgacctcaagtgatctgcctgcctcggcctccaaagtgctgggattacaggcgtgagccaccatgcccagcctgcctggctgattttttaaatttgtcgttgagatgggtgtcttgctttgctgcccaggctggccttgaactcctgggtcaagcgatcctcccacctcagcctcccaaagtgttgggattacaggcatgagccgctggcccagcctattttattattattattatttaattttattttttctcactattgcccagccctggcctccaactcctgggctcaaaggatcttcctgcctcagcctcctgagtagctggactgcaggcatgtgccatcacaccctactttgtacttttgcttttctgtctttgctcttttaaaagccaagtgccatttcatagtacacaggtgcacttgacagcatttacctgattgggagtttttccagccttcattgctattacaaagcatgcttgctcgtgtgtctctgcatggtataagtgtttttataggatacattcctagtcaaagagtgtgtccatttctgtttttaagatattgaggccgggcacagtggctcatccaggtaatcccagcactttgggaggttgagcaggaggatcacttgagtccaggagttcgagaccagcctgggcaaaattgggagacccccatgtctacaaaaaatttaaaaaattagctgagtatgattgcacactcctgtagtctcgctacttgaaaggctgaggtgggaaaatctattgagctcaggaggtcaaggctgcagtagccatgatcacagcactgcaacagatctagcctgggcaacagagcgagaccctgtctcaatacatacatacaagcatacatacatacataactcctaaaaggctgtagcagttcatactgcaagcatctacgagaacacacactttcctatatcctctctgatgctggcaattacaaattttggtttttggtgttttctttggtccagtttggttaaaaattataacaccttttgattgcacaaccctcatttctggtttattggtatttacttttctgcaaattgcctacactttccttggcccatttttctgttgtctttttcttttcttttttcttcttcttctttttttttttttttgagacagagtctcgctgtgtcctccaggctggagtgcagtggcgcgattgcctcttggttcactgcaacctctgcctcccgggttccagctgttctcctggctcagcctccaagtagctgggactacaggcatgcgccaccacgcctggctaatttttgtatttttggtaagacagggtttcaccatgttggccaggctggtctcgaactcctgacctcaagtgacctaccatctccgcctcccaaagtgctgggattacagacataagccacggtgccagcctgttttctttttcttatagatttgtgggaggtctttatttggtatggactttaattctttgttcgtttgtttcaggtttcactgctggtctgtagctagtccttcatccttgtttctggtggtcattatcataaagatattaagaagcttcatataatcataactctactttttccctatggttttttcctatcccttgttactccatctccagattataaatatatcctccattattttctccaggactgttactgttttatgttttacattcagacattattctgtctgggtttttttttttttttttttttgtatatggtatgaggtaggggtctggccagtgaatagggagttgtcaacaccttggtgggatggtccatcctatccattcattgtaaatgctgctcttttatgttagtgtccacagacacctgggtcctgattccagacccttcactgtgctccactgcctgtagtgtctttgtgtaccggaatgctgctgtctccatctctgaagcatcagaacatattttagatcagttatgtaaattcccacctcattgtccttttcaaaagacgtattggctctgctgcacgtttatgcttttgtggtgaacttcagagccgtcctatcaggttccaccctttgattcttgatctggggacggtaaatggtgatatccagcaggtgtcagagggctggattttaatggcctccgatgagctggcggtctcaggctgtggaagtgaattcatctgctgggtgcagggagccggccttgacatttgtgggttttgctgacatttgtggaaggctctggaggtgcctttgtgccgacttgcccgagccactcctgctgcccaactcactccggtgtctgctcaggaagaaattctaatgcacactaattttagcattagcccgatggcaaatataattactgagtaattatcactcccctccctagttaatcccagagcaaaatgtgggcacctttcatttctccttgggatgtacccctgtattagttcagatggggaggcggtacctgcctggcaaagcttcaggaaattgctcaacggggcattaatagctatctgagcgtgtggcctgggctggaaccaccagcctgggtgctgggtgccttccaggctctggccaccttgggttctgccccaggaggagcagactgtctcctctaggggacctgaagcttaacgtcctcactgtacgagatagtttggagcaagatatgttctggggcttgcttctgcgggtaaaggccatttctccaaacttcccccagagcgaacttgcttcccaaaaggagtctggatccgggcgtggccgtgctgcccggccgcctcctcacttcagctggagcctccgagctgacgtccatgcctattcctcctgacactgtagacacaggccccagctctgtcccctgccctctcctccactcagactccctggctctgaggctttacctacaggccctgcggtgcatattcagtgaaagcctagattcagagcaatgacatcagcttttacttggtctccttgctttctggaacctcccctttgcccattttcttatgctctggccagattaatttttctccaagtagttttcatcacatccttcccttttcagacagtcgtgcccattctccagcatctgaagttggaactttttggcctggcaggcctgccgccctgagcagacctgcccatcttctgcccctggtgtgggcacttctcttgccagtctgtctggaaccttccatggtccacccaacctgggagggccttgaggacaggggctgtttcgtctgcgcccctctgcctctagtgtgatgtctggtagatgatcagtaactgttctgggccaaggcctcatctgtccagggagcagatcttacccatcttttacctcctctggctcaattctgctggagcatgagctccctctagcctaggttgtagaacacctgtctggctatggacagcttctgggccaagtgtgaggacccccatggtcctgcagtaagagcccatatttcggggtgtgggaaacccagtgtaccccaaagggacttgactgtgaagtcccgggtccacgggtacccaccagcctcctagggcccagactccgtgagatgccacggtgggggcttgggctttgcagccttcacttggcattcttaccattttcaggaaactttatataaacatttttatcatgcaaaaaaggaattatggaataataaatgtttatattaaaaagtcttggtggtttgattgatttatttattttttgagatggagtctcgttctgtctcccaggcttgagtgcagagcacagtcttggctcactgcaacctctgcctcctgggttcaagcagttctcctgcctcgcttcctgagtagctgggattacaggcacccgccaccacgcctgggtaatttttgtattttagtggagatggagtttcaccatgttggctgggctggtctcgaacttctgactcaggtatccacttgcctcagcctccctgagtgctgggattacaggtgtgagccaccaagcctggttggtgctttttaaatttattttgagatagagtctgactctgttacccaggctggagtgagtggtgccatcacagcctactgcagcctctacctcccctgggttcatgtggttctccccctcagcctcctgagtagctgggactacaggcacacaccaccaggcccaggtaatttttaaaacactttttttgtagaaatggggtccctccatgttgcccaggttcatttggaactctgggcttaagtgatcctcttgcctcagcttcccaaagtactgggattataggcgtgagcaccgcgcctggctactttggtacttttgagttaaaactatagagtaggtgactgagtgaatttttaatgcgttctcaagaatttgaacacgaagagagtgtcaccctcccaggttatgccccgggagttcatgcacttgccacctggtcgctgctcagggggcccagggagtttgctcagtgccggaggactcctgggtcccggctgtgcctccccgcagccgcctgctcccttggacactcattcatttgctgtggccactgccgcccacagtccttgcctcgtagactccactcagctctggttacaaagagcgagtggtcagggactcctgacctgccatgcagggccccggggcttgtggtggctttggtgccgtccgctgcgtctgcctcttagagcatggagttctcttctcaggagggctgagctgctggagctctagtcctgccgcagagcagcccccaagtgcgcgttgcctgtccctgtggagcaggtgactacctggctgcgggcggaacagcaggccatgctctggtagtggtctgtgacagcatatcaccctgtgggacagatccccgggacctagtgggtgggatagtgagagctgcgtccacaggggaggctcagagacttgtgtgcccagtgtgccctgtgtgctgacccagctgggctctgccctgtgtggcccccagggtgcccggcgtggccctgatggcctggggcagagctccagagagccacggctggccgagggctcacggatttcacccgcccccagtgcctcaggagacacctgggcagcgaacagcttgaggtgtgcagagatgggtcacgatgggagggaggcacaaggggtgctttccatctctttggccaccagtttaattaaaaaaaaatttccatctgttttgaaaggttttatcctcttaaggaaatgacgttattaagcaacagccccttctgctcatcgtccagctgtgcccactggcagagcagaggcggtgggattccgcctgctccacaccaggaggtgccacttggcttcccagtgtcgaaggcttcttggactcagcacaccttcacggccccgtgggctgtgggtccctgggttgggcatgctgacttggagggtgatgagagatctccaggatccaggcaggtctggcacgccactggggctaggcgctgggctctgggcggcctccttgctgtgcttttctctgagggttgagggagcctgctcagagaccaccaggtgagctctgggggtccctctgggctcctgtgccctgcacgcccggttctgaccacagacctcctccatcagggtggactatagcccagagcgggatacaccacgcccatcaccccccacccctggagcccctgaccaaggcccttctgggtacttaacagtgatctgatctcaccacagtcagggattagggcctctcccggagggctggggtccatggtatgatgtgtttcaggtgagaaacaggttcagggatgtccccagcctcactggctgtgttggcagagcaggatgaaaggcagacgggaatgcagaattgggatcttgccctgaccctgtgatccgtgaggcccttgagctagagggatgcactcagtcgaagtgcccgcctcttctttgtgttagtgtgaagaggaggggtgggccctgttctattcttggctgcccacagcactaaggccagcttggtcaccaaggcatgctggaaggtcaccacaggtggcacaggtggctggggtgtgctgggcagcaaccattatgcagcagtggcctccaagcagaagctgctgttcggacacccgaggtattcccagcctccttcccctaccccgaggtttgctggagtcactggggggcagtagcgagctgcaggtgcagggtcggggtcctgggggttgcgtgtatgcgcacctccagagaagcccatgcaggcccccctcacccgttcctgcctgacctgctgttgtgtctgctcctagctctgcggtctgggacaagcacgttaactgcttcagagctcagtttcccatccgtgatagggaatgatctttatgctcccacaggctcgtcctgaggctgcagagaggagcgttgaaaagtacctagctcagggcctggctcagtgacggttagctgttagggttacatcgcatcgcaattgttactccatagtgacgaccccccggggactctggacttgttcagtcagctgagaggctgcttggccgaaaccatctcagctctgcatagtgtggcctggtggctgtgggttgcgctcatgacaacgtggagcctattcagtcggtaccgagtgtgcgtccttcctagctggcctcggcatttattttgtagctggagccctggtgggatggggtcaggtggctctaggagtctgggggacaggtgcaggtaccttcgggtgcgcctcccctgggggcctcgctttgtcagaagtatggcagggggctgagggctgactatctatttgtaggtgtcaccaagcagtccccgcctctccttttcagaggacattgttgaggggaccctgccatctgcgtcgggctggctgcttcctctgtggggggctcctcccggctgaccagcagccctttctggcccctgcatcagcgcctccccactcagcttcactgctgaaggcagggccagcctgggcaccggttcttccccctctgcccaaggtccctgcccacccgtcttccctcgccctggccgtgaggtcagtgcctttgccccgctctgacgaccaggccctgtgcgcagttggcgctccgtggtgctgagagatgtgctctccagtctgtgggccagatggggcctctgaagtggagggggccaccctctctcctgcagcctgctgtggctccccatcgcctctgggatgagagcagacccgcgaagccttgagctcctggccctccagctgtgagcccaggtgggaccacccagttacagagcgttaggcctggctgtgtaggagacgtgtgtctccacaccagagtccttgcggcactgggaagccttcatggtcctcatggtggggaggggtccccggggaggcatggagtctcgtcctaggttgctgtgtggcttcagcgctctgtacctccatgcccctgtcctgcagatgtaacacccagttgaggagaacgtggactttgcccagtgttgtgcagggatggtggggccagctggagcccacgtgtcctgccttcgccctggccaaggtgggggttatctgccctggccagctgtgccgcccgtccctgcccgccccagcaggtgggggcctgcggtgggatcccaccatgagcagtagaggcttgttgacttactggcctcccaggctccccctccaaagccaagtctccaggacggttcttgcccctgagaaggggcagtgtgggtgctgggctgcagcgagccctcttcgttccatttcctcacagtcttggggacggagggcttgtcctggagcacaggacgggattgtgctgaggtcctgggaggccacggtcatgaggggacccagtgaaggccaggagggacaagcatccctccaggtatggggagggtcaccccagcgcctctgcggatctgaccactggctgcggctcctgtgcttgacccttttggcaaagatatgcagtggtctttcagttcccccccttaggcagcatgaaaacaatttaactcttgcagaaagaacctgggaattgattcccctgtcactgatcccacaagtgtgactttgcattggtttcttggtccccttgtgccagtctccccatctgtaaaatggggtgacagtagttccacctcctatgaggactgagtgagtcaggaaccagaagcagctcccacatgagactcagaaagtgtgacaggcgtggagggtgggacccatgaagctaggcccggcaccttaggaagaagagggagctttcctgcaggtttccccggacggaatgtgtttcgtcctgtgcacctgcctgcagagcccctcgcacgctgtcgtccacaatgaatgcttggtggaagagttcacccagggcctgcaacaccatagtgctcacttctccaaattcttcttaacttccagactcgacacgtaaacttgattccaaggaaatcaagctgatcgtcaacactggactttgcaggcagctcccaaacccacatgcatatttacactaagaaatgccagttcctcaaagaatgttagcctctgagatgcatcaggagaccaggagcaaggggttaaaggcaaaccgtggcattccccaaatctgtccagttccctggcatggtcagtgtcgcggagcccgaggtggcatcttttgtttggctgctgatggcggccttcgggcttggcatccacgttgctgcaattttccaggaacagtaatcatttgaaagtagagctgcccgttttgctcaataaagggattttgtagagcgatgataaatttggcatgtctttattatattattttttcaacacttaaagaaaataaaagctggtacaaaggtatgtttgtttctgaatgtgtttccttccccagatgttcttttctgccagttctaaaatgcgttctgagctcggcctccagtttcctccctgtgaggaagaacaatgagacctttgtaaccacacaggggaaaggccgcttccctctgcagtgggcatgggggaggggctgggacgtcccacctcctcccactcgatggaaaccacgagtctgtgccagcccagccgactgtcggggggtttggcagcctctttcccatggtggtaatttgcagggtcatggctcaggggcaccgcagtctgcacctccgccctggatccgtgcgtttgctgtgtggcctcgcagtaaatgcttccatctgcgtggcattatggaccctggggcttggtactgtctgtgttatctggagtcgaacttgcccttttcctttctgtctgcctttcttgcatcaaatgctggtccccacccaaagggtagcccagtctgcggacacggcgcagaggtagagttggtggcttcacgagggtccagtggggcacagaccttctcggctgctctgtcgctttgtgacttgagactgcgtgggtggggtacctgagggatcctgagcccgcccttcccacacgtgtgcatgcacacacacatgtgcacagtgcttcagaagaccaccttagttggatttgaaggacagccaagagacctgtataaagcttgtagttagagcgtttcgatactggcctgaattaagagcagtctccatggggttgctgtctgtggggtactgtttaatgaaaatccttgtttttaaataaatgtatcctgctttagaacacccaagataaaaatctagacttcatagacaaaaatagctaacatttgttgtgtatcacagtgtgccagtgggctctaagagatgtttgatttctttaatccttccagctgccctgtgggctgggggcatccctaccctcattttacagacgaagaaactgaggctgggagaggtcaattaacttgccaaatttggtataggcaaaactaggaattggcagacggtggttccagtgcctgccttttattggtacttgaattatacgagtgttttcttccatcaataaaagaaatcggcgaacagctcccatgggtttcagtaagtgcaagccctccttgtcatcccagacctcagcctgcccattaatggatgaagacactgaggcctggagggaacagtgacttcggagccactctcctggatctgccactcctctcgcctcccatatgaacctgagtggccacatgaccctgggggagagtactcaactgtcccaaggagagggtgatgactgctggcctcccaccggccatcagcgcccactgactgacacccctgagtcagtctccaccctggaactgtttctctcactatttgcctggccttgggccgcttccgggggcttggcaaggcaggaggcgtggaaccaagatggtattaatcagaatgctatattttgttgaaaataagaatgttagtaatgggctggtttctggcggtcaaactgggactctgaaatacatatttttctctgctctgccctaaaccttctaattgtgaaaacgcacatttgcagacatcaatcaaatgtcatattccctagcagcttgtcctggatcactgagctggtcacattccacagttgctaactcagggcttgcagagtatgtgtgccgtgtgtgtgcatgcgtgtgtttgtgagagagatacatgccttctggggagccctggtgcctgtttccttccctcccaggcccctgagcttctgctccccaccccgcccccagcccctgtcagcacatgcgcggccactgcaatgagatacagacgttcgcccaattaaaacacagtagtggaggacacatggctttcagggaaaactgctttctctcaggaagatctctgctgtgagtattccatagctagaccccagctccactcaacagtggactccattaatagcctgggtttggaagaggcgatttgcttctggtaactggctccggtgcatggatgttccctcctcttctggaatctctgcccgacccagacagtgcttgtgaaccagccctggtgggctccatgggttctgggtctgggaggcaaggacttgcctggggtcattctcattctgcacggcactagcatgctggctgcatgaagccgtatcacagagacctgtgggtcctttacatctgatcatccgtcatttgtatctgtatctggggtggttagttgcaaacaattccacagtagccaaatcagaaagtcactggctctcgcaggagcgcgattggtgtggggcgagcctgggggtgtagccaggcaagcccttcaccctgatgcgcattagccttcttatccaggaaatggggggaggcgtctgggcccagggaggggagcatgccaagctggggatctccaccggtccaggattcaggcgcctctgaccgttctctgcccagtgcctcctgttcagttttacttttgtgttttccattcacttctgcctctaggccagtgtttttcaaaatatgtttcctgagtggaaatgaaaaatgttctgtgatcaggcgcagttgggaaatcctaggggagagaaagtgaactaggcttcccaccgcaggacttctcagagcctttaaaatggtaattatgctccaggccttgtgccccttacctaggcatcctttactggttgggaagagacggcaggttacgggtgagtccgggtaatggagttgtgcctaagctgataacctgacgtcaccaacactgttctgtcaccttgctttgtgtggcttcttcacagttgtcacatctgggccgtttggagtgacctagcaagtcctttcttgtctcccaggactttccggagtagccaagcagagccttcggccagttcccttgtgggccaggccctgcccgggagcacaggcaggagaacagctgcctccccgcctgccccagggcttggtgtcagggccatagcccccagctctgcggtggagcagcagggacctgcctggccatctccctgttgagggaagacccggaggcgcctgtcctgttctgtgtgctccgaggtgttgaaaccagctacctcattttctttttatcttttgcaagtgatttcttatttcctgctcacccccaaacgtgccccctgtatgtttcctgttcgcctgcttccctgacctttgaaatgggtccctgctcgggaaacttgcctggacctcagtcaattatggttttcctctgggctgttgtgtgtgtgtgtgtgtgtgtgtttgagtgtgcaagtgtgtgcattaggattagagagattcgatggggggccaggggccaacaggaatgggggtggctgagctgagaggccaagggcggttccaggttgcattgagagccgaagctggtgagtgtgaggcgggcagatgtgaggtggtgtggggagtggggtgctgtctgggtgactgggctgggagagggcaggtgggggccaactggaagaggtggtgttattctgtagcacctgatgtacacagaccttgggggtgcagctcaggctttctctctccccacccgcccctgaaggccccactctcccgccttctgcagccaccttccttttgtctgcccctgagctcctccgctcttgtggtcgttaagaaaagcttttttaatccaagttggtttgggaagaggcaaactgtcctttcccaacagtcatatgccaacctggccacatctattctggatttgaagcaaaatatggtatttattcattattgtcatgcaatgtcagcagctcgctcattcttgatggagacagcacctggaatgggagggatgggtcccggccagcattggaggtgctcggccccagcacccgggccttgctctgcaggcagccctgtctgcaccgggccctgctctgcaccaggttccactgggtggcatcagccatgcctgcccgaggaggtgaagtgcgggctctctccagtgaaggtgcagaggcagggtgagctggcgggttacggaggacgtgggcttcacctgggtccaggaggccaggtcacattcagccaagtatcatcagctgggtgtagagaccagggagggtttttaggggtgggaatggctggaggcatgaggtggtcagggtggagtctacgggagacttggtctactctggtgcggtgggattcatgagagagagcccttgtgggctgaggccaggctgtggggtagatgggagagacctcctggctagcaggtccttgggtggatggatggacggatggagggatgttgggggaattggtgggaatagatggttcagccaaggtggaaatgggggagtagagctattcctggggtgcttgaagtgtcagcaagtatcccactccagcttgagtttgcagagctttctctaaaaggcagaacagtgcttggttaaaggaaacccaagattttattattgttgtaaatgtcaagtccctcatttgaatctttagacaactgcagaattgtgtcactgacttgggtaaaagcccaaggaaaaaatgaaattatgttgccaaaattgcggtcatcgtagctgcatgagggtttgagtggccacgccaccccagtaggagagacgcgtagatgttgaatacactgtgagctgcgtgcaggtaatgaaacgtggatgtggggaaggtccctggcttcatggaactgtctacataaaagcgagctgggtgtttcctgtttcttctaccttaagaaatttccacgagaagctaaggtatggtttgccaagaatgttgttaatggcccagcaatgaatattttcagccacttgtagacacctgacttcattcttggcaaacaggtgtatgattcttggacttggagagactgaactttgctgtctcagaatggaggagaccagctcacttgtactttgatttctccctggtccctgtcatttagcctgatcagtgctttttcaagcatttccccttgaaggggagataggactttctggctagggatggggaggcttccaggcagccttaaacattgtccctgccccaccctaagtatcttgaagtttcatgttttatcataaagtctgtgagaatgttgcagactccgttatagtcatctagttttatttttttaaatgtggtttgaattttatataaagtatatggattatatctggaactaatatgcaaggcctgtatgcaaaacataatacaactttacagaaggacattggaaggactgcagtagatgttcacggataggaagacaggagatggagatggcagttgcccccgattgatcagtggattcagtgcaggggccggcagtgcgctctcctccctgttctttcctccaccccattgcacaaatgttggtgcctggcatttaaagaagcagaccaggcgcggtggtcacacctgtaatcccagcactttgagaggccaaggtggatcacttgaggtcaggagttgagaccagcctggccaacatggtgaaaccccatctctactaaaaatacaaaaattagctggcgtggtggtgggcacctgtaatcccagctatttgagaagctgaggcaggagaatcactgaacccaggaggcggacgttgcagtgagcctggatcgtgccactgcactccagcctggcaacagagtaagactccatctcaaacaaataaataagaaataaagaagcagcatgtcgaggtggtgctatgtagaggtgtcgggggtgattggcatccagcatccggaagcaaggtgggtagggtgcagaggtgactgacagcagaggctactggagcagatgggaagctggttatgagctaataagtaaattgattgagcaaataagtaaacatatggatagtaacacaagccagctttgcactttggagaaggtgcttacaaacttggacgagacagtacccagacacatagcgaaactgtaggtactgccacgcacacatgcacagaaatagagaaatagtcatagatgcagtgtgtataaaagtgtatgtaggctaggcacggcagctcatgcctgtaattccagcacttgggaggctgaggtgggtggatcacttgaggttaggagtttgagaccagcgtggccaattggcgaaactccgtctctactaaaaatacagaaattagccggttgtgggggcacacctgaatcccagctacttgggaggctgagaatcacttgaacctgggaggcggaggttgcagtggtcgagatcacgccattttactccagcctgggtgacagagtgagactctgtctcaaaaataaaataaaataaaataaaagtgtgagtatacatacacacgtacagttggttcttgttatcttgaaagttatgctccataaagtcactgggaaccctgaattattgaatactgaaccatgctcctaggggaaacatcgggctaggttcctgtgagcctcaggtcacaacgtttttgcaactgttcgatacctgacctggcttttttttttttttttttaagacagcgtcttgctgttcaccccaggctggaatgcagtggtacaatcatgggtcactgcagccttgacctcctggctcaggccattttcctgcctcagcctctccagtagctgggactataggcatgcaccacccacctgtctgatttaaaaaaatatacagatgaggtcttgccatgttgcccaggctagtccaaacttctggcctcaagtgaacctcccaccttggcctcccaaagtgttgggattacagcatgagccaccgcactcagcccataaccttgtcttatgtgtgtttctaagacaccttattaggctgagtgcagtagctcacgcctgtaatcccaacagtttgggaggctgaggtgggagatcacttgagcccaggaggttgaggcggcagtgagccaaggtcacaccactggactctaagcctgggtgacagagtgagaccctgtctctaaaaagcaccttatttactgtatattgtgattcattaacattgaattcatggccaactacgctataactcatacctgaataaagccctcatgcatattctctctgtaaggcgtggggcagcctcatgcacctaggagcactacacgcagcatatgtgcaggggacattttatacagcaaaattgcccacaaaaagcacagtgattggaaagcatggcactagctagaccgagagaaggacacttgcttacatctcgacagccgagcaagaagatggggcgttgtggcctcagttgacctcagtttggaacgtgtgatggtgatcagttttttcacactctgcaagtcagtgagtgattgcagaagtgctgtgaggtttaattgggggatataaataaatgttagcaagtaggcgagctcaagtacggaatctgggaagaggaagactgtacgtgtatatcctacctccatcagcagagaggcctagaagcaatgaccccagtagcagtgagcacaccagagcccaggtctgggtttctgaataccattctccacccaaggagtcagagcttgtccacgaagaagctggttctagggctggggcaaggaaaggtacaaccgagcatggggcatcttattgtgtaagaaagcaaagaagttctggaggactggtggggcctctgggacagaagagccagcttagaggggtgctcactgtccaaatctaggaatatttaacgtcaaaatgttgtgtacatgccttagcgaccaacccacatttaaaacaaattcctgatgagggctgtaactgtagtcccaagtcattcttttttgtagctcataatagcccataaattactataccatatgtttgcatttacctatttttattttattttatttttttgagacaagttttgcttttgtcacccaggctggagtgcaatggtacaatctcagctcatggcaaccctgcctcccggtttcaagctattttcctgcctcagcctcctgagaagctgggattacagcatgcaccaccacatctggctaatttttgtatttttaatagagacagagtttcaccgtgtggcgagactggtctcgaacccctgacctcaggtgatctgcctgccttggcctcccaaatgctgagattacagtcgtgagccaccgtgcccggcctgcatttacctgtttttaattgtgtaaaatacatataacacttatcgtcgtaaccatttgtaagtgtgaagttcagtggcataagaacattcatgttgctggtaaccactgccaccatccatctcccaccacaatttaataatcattgaaaacagactttcttgaccacaaacaatggtgcagcagaagcatcatagatcctgtctgtcctgctggctgagctgtggcatccttccttttttatattgtaaaaactgtaataaaatgccataaaaacgccagcgttgatctttgtggaacttgcggagctgactgtagatgtgttgggggtataacaggaccagggcagcccaggtgtttctgaaggagacgaatcggagggactcgctccgccaggcatcagggcagattgcaaagccttgtttttgcacatcatccgatgcggggtggacagttagaccaagaggagcccggaagcagacccaggctttggcacaggagctttggcatctggcagaactcctgtccctggggttggggtgtgaggaggtgtgagggtagtagcgtgaataactgctttgaggagctgaagctagaaggtgcccagagctgtttaggtgtcagagaagttgtttgtgaggcattgtgagtagaattaagtaacttgagtgctaattgcctctggggatcaggcctgggcatgctcaacattcaccaagtcatgtttgttttcaatgctccagctcttcctcctccaggaagcctgcccagtctacccacagccaggtctcccacagtcagcccttcctcttcttagaagcctgcccactctaaccgcagccagatcttctctgtctaggaagcctgcctggttcacccacagccgtgtcttcttcctctaggaagccgcctggtccacccatagtcaggtctacctcctccaagaagcctgcctgatccacccacaccagatcttcctcctccaagaagcctgcctggtccaccaacagccaggtgtacccatagcagctcttcctcctctcggaaacctgccaactccacccacagccagatcttccccatctgaaagcctgcctaccccacctacagccaggtcttcttcctccaggaagcctgcctgggcacctgcagtcagcttatccatccccaggctccaggcattacctgtccatgcattcatccaccttttcttcttgggtggttttgtgtgtgcgtgtgtgtgtgtatgtgtgtatatcctgccaactaacctgcaggctccttgactctggagccctgatgtcttctgtttctctgtctctccatcatgctggcactggacgcaggatcattcctgactgattaatctctagcttgtgtcaggctgcagcttgctccgatgagcagttggaggcctagtgtaatgcttggtgaatataataaggcatggactgaaaatgttgcttattttggtatagtagcaaaggattgggttacctgaattgagtcttgtttggtgtaaccatgtaaataaacagtgtaaaatataggctattgaatggaagcccagacatctgttatgaattctatatataaatattggatatgcttacatggttaaaatgagattgttggcacttgggttttcaaactcctgattctgctccgggtaggatgatcacgggtcctgggactcaaggcaggaggggccacgagctggcctttctctgacacgacttgccagaagtgggcgttcctgggagtggcagacatgcacccactagagatagatcgaatcaccccctcacattctcctaatagtgccaagaacccacagcagagtgcggggtgtctgagtttgtgctgagcaggggtgcctgaatcccggattgaagaaagtgttctacgcccattaaaccaactgggaatccaggcaaaagaagacgttcccaggggaagccagcctgcccgtgtgcatggtgccttttaaacaaattatctgcattcccattgggatgaagttcacttgcaacattactcattggtttttttgcttttgtttagttttttttttttttttttttttttgagacagaatctcactctgtcacccaggctggagtataatggtgcaatgtcggctcactcaacctccgcttcctgggttcaagcgattctcctgcctcagcctcccgagtagctgggatacaggcatgtgccaccacacctggctaatttctgtatttttagtagagatggggtttcccgtgttgcccaggctgctctcaaactcctgacctcagatgatctgcctgccttggcttccaaagtgttggcattacaggtgtaagacaccgcgtcgggccttttttgtttttgttttttgagacagagtctccttctgtcacacaggctggagcgcagtggcacaatctcagctcacgcaacctccacctcccgggttcaagtggttctcctgcctcagtatcccaagtagagctggattacagggacccacccgccaccacacctggctaattttttcttttttttccgaaacgaattttggtctgtcgcccaggctggagtgcagtggtgcaatctcagctcactgcaaccctgtttcccaggttcaagggattctcttgcctcagcctccggagtagctggtattacagcgccctccaccatgcccagctaatttgtgtatttttagtagagatggggtttcaccgtgtggccaggctggtctcgaactccttacctcgtgatccgcccgcctcagcctcccaaagtctgggattacaggcgtgagccaccatacctggccataatattcgtttttatgcatcattctttttatggcccctctcacctccgtcaggtggtgaatagactacgtttcatttatccgtcatcggttatggacatttgagctgtttccatgttttggctttgtgaacactgctgttacatgcgtgtacctgtatgtgtacatacatgagtagaggggttcagttcttttgggtataatgtaggagtggaattactggtcataggatcattctatgtgtaactttttgaggcactacaggctgttttccacagcagccagaggtgtctttaaaagcagttgtcaactgggcttggggctcacacctgtaatcccagcactttgggatgccaaggcgggcggatcacctgaggtcggagttcgagaccagcctgaccaacatggcaaaaccccgtctctactaaaaatacaaaatagctgggcgtggtggcgtgtgcctgtaatcccagctactcaggagactgaggtgggagatcgcttgaaactgggaggccgaggttgcagtgagctgagattgcgccatcatactccacctgggcaactagagtgaaactccgtctcaaaataaaaataaaaataaaaataaaaggatgatcacttcctgtttcatgaatgaggaaactgaggctctgggagatgggaaatcctgccggaatctcacagctggaggccaggccgggctttgaatccaggcaactgagtctgagtgatggtgtgtgctttgtgttggagctggcccagggctggatgaaggcaacatttaattaagaaaaccactaccccctcccggctgttacctcttgagcgcttttctatgaagcatcctgttaagcctcgcactctgtgatgtggaggtgcagtaattatccccatttcacagacaggagttgaggtcagaggggttgagtgattgtcatgggccaggtctcagccaggcttgctaacctggagtctgccgtctgctctgaagtggtcactctcagctggagagctgacctggccctttgcctttgtgatgtacggtcctgaaaaaaatatttgcagaaatagcttcataggaacaatatggaatttggaattaaaaaatatattaaaaactatatatttaccagtattacaataattacccagagacttgtctccctaatgaggccacctttactttttcaatctttgtctccctggtgctttctcataactgccattcattctagtagaaatcatggttcacggttatgctggtgtgtggtttttggtgttgacatgtcgaacgttttgttgttaccgcagtcattttgtactagttaattggtgctacctttccacggagacaatagtctagttacccctgccgctgggattgttcttttttttttttttttttttttttttttttttgctattacaaataaggcctagcaaatattgtgactcagacgttttccttctttctggtgtttcttgggacagactcctcaggggtgatccctggggagagggcgtaattattttatgttcatgatgcggcagtcaccccgtgtttctgaaaggtttgttctgcactctgggctgccagttgacattcggtttttcaggtgatctggtgggtcctggggtgtgatggtggccgggcccagctgcttcagccctcagctgtccatcccccacccacacccagaactgaggctccaaggtgcagcctcaggtgtctgcaccctgtgcatccctcatcgccccaggtctgttgccctcccttctcctccttctcaaatacgctgcccagaggtcaggctagaggtcagcaggtccatcactggatggaatgacctgggcaggccaaggtatctgggggctgtgtagctgtgacccctgagcttcagggggctgtgaacgagagaccttgggcacatgggcacatgacgtggtgggaaggcgcccagaggaccagacccgccatgctacccccacactctgctccagtgtgctcccaccccaggacctttgcccggcctgccggctccttctttcccagcaaggcctgctctgtctcaggtagcatgcagcccccgacccacttctcatgtagcatgcagccccccgacccacttcaccctgcaccatttcctgatctgcagcgtttatgatgtaacattactaaggtgtccttattggctatgtgtattgttgtttattaccacccacgtgaatacggagccattcaggccgtgtcctgggtgtctggggggccagctggtgctgggcactcgcctgctggaggagtgagtgcccatggccagcccctctggtgcctgggctgcgtctcctccttagtgtgctgcctctacaggcttttctcctgaatgtcctctttgcttttttttttttttttaagctttaaaagaagtttttgtagagatgcgtcttgctgtgttgcccaggctggtcttgaactcctggcctgagatgatcctctctcctcgaaagtgctgggattataggtgtgagctacggagccggcccttcccttctactctgctatctgctgttctctctccctcccgtcgggttctgctcctgccacgttctcccctctccccccaaaggctgggttttctttgtcagggctcctttcccctttggagaagagggggctgtaggccttggtgcgaggccctccagtgacaggatcccccatcacccagagttccacaggcctggtagggaggagggggagcagaagaggaggtgccatctttgcctgctggggaagggcagggccacccacacagagctctcccatttgctgtggaccctggggccactgccagttcctccaaaggaaagccagctccccaggtggtgggagagtgatgtggcttcctcttaaacttagaattgagtgtgtggttgcttctaagtgccttagaagccggagcggctcctggaaagagctgcctgccacagcgggccttaccctggctgtgcccacagatgtccctggggcctgccgtcctgcccggctctcctggcctcccccggtgtgggttgggaaaagcacagcaaattaaaaacacctccatctctggcctttgaagaatgcatctgaacagccgagagtgtaaaccgtgtgaaatgtggtctttccagtttggggagaagcagggcagagctggggcttttgtacccaggtttccaagagctcctgcctccctcggctgggctggccagggccccccgctgggacctcagctgtaatagggaaggttttactgggttgctggccactgtggactgcccctaagggcggtatgcctgcctttacccgggttcccctcctgcctggaagatacagcccatgggaggctgttgtctgtgggatcctccagcatcagagacactggggccagcgtctgcctggtgagggcaggcctggcaggcccggtcccccacctgcttgagcacccacggtggtgggggctcgcgcctcccgagacaatctatgtcattgttgtccaaggaagctaatttagagtagaaagttcgtgtccagtcccactctgtgcgtgtgttagcaggggactctcgggccggagctgggtcaccctggtagggggacttcatggggcctgggcgacagcactgtgtatttgtgtgtgtgttgtttgtgtgtgtgtgtgtctgaggaggtggaccagtttctcaaaaggcctgtgaccccagaaccaaggaatttcagcctgggtggatcacaccttcactggtgagtgggacaagctggggccctcgccacaggagcagccagggcatggggcacagttggcctcattcacaaaatggagtataagtgatccctgctctggcggccaggacgatgagtgggaacacaccgtgtggggctgcctggcctgggtgtgccgcgggtgtccttgttggtgatggttccacctgcttgtgcaccagtgccctctgggtctcacacacaactctcttcccagcgaaggcccctcctgccccaggcctcagtgctgcttccgtctcggaaggccccaggagctcctgcatcctgggcgtgttcctgtgtgcctgcagaccccctcgcggctgccatctcatcctttggtgcacctgttgccagacctcctggtagcgggtgctgcactcccctgaatgtgccggggcctgggggcaggacctgggctcctccctcactgagtggagggaactcagtgtcttggagttggggtgcctgaggctgggtggtgcaggtgaaatgcagacctctcagctggtgttccagagcagctgcctcccccgcccgagggacttcacccgcagcccagtcaggggtggcgcctgggtgcatcgccgcaggctgggtaggggtggagcctgggtggccctgcctgtgagctgcatagttgtcgccttgaccctgagttttcttcgttatctgtttggacctgtttggggcaggcaggggatgagtctgaagataaatgccttagctgtgaccatctccttttgtgagaggtcaatgtccagttcgctgcagttataacatcccattttttgatttctttttattttttcctttttctttttggatggagtctcgctctgtcacccaggctggagtgcaatggggtgacctcagctcactgcacctccacttctcgggttcaagtgattctcctgcctcagcctcctgactagcaggggttcaggcgtgagccaccacgcccagctaatttttgtatttttagtagaggcaaggtttcgtatgttggccaggctggtctcaaactcctggccttaagtgatctgcccgcctcggcctccaaagtgctgagatgacaggtgtgagccaccgtgcccggcccagaactctttaattcccactgaaacttgccgccttaagcaggtccccagtctccctcccctagtccctggtcccaccttctgctttctgtctcaatgaatttgcctaccgtaagtacctcatataaattgaatcataagtatttgtctttttatatctggcttatttcacttagcataacattcttaagtttcatcatgttgtagcatgtgtcagaatctctctctttttttttttttttttttttttttttttcagacagagtctcgctctgtcatctagactggagttcagtggcacgatctcggttcactcaacatctgcctcctgggtccaagcaattctcctgcctcagcctccttagcagctggaatacaggcgcgtgccaccatgccttgctaatttttgtattttttgtggaggcagggtttcccatcttggccaggctggtcttgaattcctgacttcaggtgatccacccgcctcagcctcccaagtgctgggattacaggcatgagccaccgtgcctgaccagaatctttttccttttgagactgaatagtactccattgtgtggatggagcagattttgccccgctattcatccctagtagagggacgcttgggttgcttccatgtttgtttgtttttttgtttttgttttgctgtttttgagacagagtctcgctgtgtcacccaggctggaatgcagtggcgcaatcttggccactgcaacctccacctccagggttcaagtgattctcctgcctcagacttgtgagtagcgggattacaggtgcccgtcactacgcccagctaatttttgtattttagtagagacggggttcaccatgttggccaggctggtctcgaactcctgacctcaggtgatccacccgcctcacctcccaaagtgctgggattacaggcgtgagccaccatgcctggctgcctccatgttttgctgttgggaaggatgctgctgtgatccaaggtgtatgcatatctgattgtgtccctgtttcagttcttttgggtatataacccaaagcgaaattgctgggtcatatggtaattctgttttaagtttttggggaactgccatgctgttttccatagtagctgcaccatttcacattttgccagtggtgcacaagggttccagttgctccagatcctcaccaacacttgctattttgttttttgatagtagccgtcctaattggtgcaagatggtatcttattgtagttttgatttcatttccctgatgattagggatatattaagcctgttttgatgtgtttattggccatttaatgtcatctttggagaaatgtctgttcaagttgtttgcccatttttgagttggcttagtgttttctcattgttgagttttaggagttctctgtatttcatggatattaatctcttagtgatctatgatttggaaatattttctctcattctgtgggttgcctttttactctctcgatgtgtcttttgatgcacaaaatctttagcttcccatgaagtcccgtttgtctttatttgtgcctatgccttcctgttgtttgactttcacagtgtccctcgttgccacaaagaactgtaacctaagatgatgacagcacgggtggggcggcggaggcgccgctgtcattttcctggcccaggtcctctgtgtgtcctcccatcctgtggagcatgtctcctgggaatgggaggggccggatttgagccagtgcttgtcttggcagggaggcctgtgctcggaaccatctaccccacgcgctggggtctcctgggccatgctctggccctttgtgttcccagctaccctcatagagctgcaaatctttcccctgctgaaatgaaaccaactgaactaactacaggattcagttcttgattgtcattggctgagttgagtttgttttggctttctctttcttggtgaaggtgggatgtggggttggctgggctcccccatctgcgcaggaggacccaggggtctgcagttttcagaggaatgtcagctgtttcaagccaaggcttcagatgttttttgggggtgtttgtggccgcccagcctagccctgctgacagcagacacggactgatggagctccctggaggcccttacctcctcctgtccacatcttgtgttcactcctcatgtggcttcttagtccctctgagtcgtgttgggggttgctggaccctcctggtccgacgtctgaggtgtctggtggggtgatggctgaaggcctctcctgatttctcattgagcccgttgtgggaatgagaccgttgtctgtggatgaggcttcttgcacaggcagaaggggctgagggctgcggtgcagagggaggtgaggagccagcctggccgcaggcagatcaggaatgcttggggtggggtggtggagagaagtgtggtgaggccagaggccaaggccttggaggccaggctagggggtctgaccttgttctgcaggcactggcacagggagctgtggaaggtgtctgagccaaggggtggcattccagagtgacctttaaatgtaggaatgtccagaagcagggtgggagaaacatggaatacaggggtggagggaagctgatgccacggccaaggaaacgggcctgagcttggacagtggtcaaagactttaagggaatcttgaggctctgtctggcctgggctctgaacccctcaaaaaatgtggcccgtggctgggtctgtagcgagcagcatggccagtgctgtgcctgcatgtccccgtccccttgtcaggccaacaaaggggatgtggcttctctgcagaacaggacagggcccctgtagccctggaggacgatgtgggaggttttgggcatggcaggaagggtcacccatatctgggggacagacgtaacagttggtaaacaaacaggtgctgtcaccgaatgtgggaagaaggctgttgctgcgctgcaggagcctctgaatgatgcgggccggggctgcccaggcaacttcctgacacgccttaggggtgggaggaaggaactggaggtcttgggcatgggcagggcagtaccagagtgctctgggcatagtgctccatcccagggctgtgtatcttgctggcttagccagtggcctcacggtttgcttctgccccacagcctcgccgctcctgctatttgccaaccgccgggcgtacggctggtggacgccggcggagtcaagctggagtccaccatcgtggtcagcggccggaggatgcggccgcagtggacttccagttttccaagggagccgtgtactggacagacggagcgaggaggccatcaagcagacctacctgaaccagacgggggccgccgtgcagaacgggtcatctccggcctggtctctcccgacggcctcgcctgcgactgggtgggcaagaagcgtactggacggactcagagaccaaccgcatcgaggtggccaacctcaatggcacatcccgaaggtgctcttctggcaggaccttgaccagccgagggccatcgccttggaccccgctccgggtaaaccctgctgcgactccacctgggtccagggggcggggagtgtcaccatctcttctcgaatttgcatgagcccaagttgtttttcagaaaaagggtgtgactctgaaaatgacccgtgggggggttggctcaggcctgtaaccccagcactcggtgtgactctgaaaatgacccgtgggggtgttggctcaggcctgtaaccccagcactcggtgtcactcttaaaatgacccgtgggggggttggctcaggcctgtaaccccagcactcggtgcgactctgaaaatgactcgtgggggggttggttcaggcctgtaaccccagcactcggtgtcactcttaaaatgacccgtgggggggttggctcaggcctgtaaccccagcactcggtgcgactctgaaaatgacccgtgggggtgttggctcaggcctgtaatcccagcactctgggaggccaaggcgggcaatcacctgagtccaggaattcaagaccacactgggcaacatggtgagaccccatttctaaaagtatacaaaaatgaatcgggtgtgatggtatgcacctgtaatcccagcttcttgggggctgaggtaggaggatcatttgagcctgggagatcgaggctgcagtgagctgtgatccaccactgcactccagcctgggcgacaaagtgaggagatcctgtctcaaaaaaaaaaaaggctcagctttcaagatttgttattgttgaaggaattacttccccttgagattccatagtatgttccttttttttttttttttttttaattgagatggagtctcccttgttgcccaggcggagtgcagtggcacaatctcggctcactgcaaccttcgcctcccgggttcaagtgatttcctgcctcagcttcccaagtagctgggattacaggcgcccaccaccacgcccagctaattttgtagttttggtacagatggggtttcaccatggtgtctaggctggtctcgaactccgacctcaggtgatccacccacctcggcctcccaaagtgctgggattacagacgtgaaccccgtgcctggcccatagttatgttcctttttaaaacttgcatgtctgaggcaaccgatgggttggccatgggtttgaatggttaaacacatctttgctgtgtgtatggtgggcggcctggaagtgcggacgctcaggcaggtggaatttgcaccttctcctggctttctaattgcatggctgaaaaagtgcagctccttgtctggaagcagaacctgctgggagtggttctcgggtcgttctggaagctgccctgtgtcctcctcagctcctagtctggctgagttcacctgggccttgaaggctcagggcctggccgtgatcccaggtggggagagcgtgggtggcaggaaagtttggagtcgaagtccggggtggagagtttaaggggaggtggcccagctccactggccactaggccaggtcaccccagactcccgagcagagggaacagtttgcttggccaccccttgccctcctttgtcccttttcttgcagcctgggagtgactctgggggccgtacacacaccctacctgggctgtgctaagccctggcccttgctgacctgtcaggttctgtgctgggtcaggtcagaactggttggcagaggtcttgactagaacacaagagccatttcccaccacccccggctcagttggaagccctttgcctgttagttcattcagtgtcaccacagtctctcagcatcccagcctggacctcaccggttgaggggccggcctagatcttctttgcgcaatggcacatctcagctcactgcaacctccacctcccgagttcaagtgattctcctgcctcagcctctgagtagctgtgattacaggcgtgcactaccacacctggctaggttttgtatttttagtgacacagggtttcgccatgttggccaggctggtctcaaactcctaacctcaagtgatccccctcctcggcctcccaaagtgttgggattgcaggcgtgagccactgcacccagcctgactagatcttctaggttagaaagtcccaggagtgggcggccatgcatccaggcctgccacggagcccgcctgccctcctccctgaagtcagggctctggaagcccttcccttggccatgcctgtgggacagtgtccaagctctggagtaggactgaagacccctgggctctagtcctgggccaccaacttgctgttgccctttgcagtgacctccccctgactcccatggtgccggcgcaggagccgggcgggaggggctggttgccagatcctgcagatgcccctcctctgggccgcccagggtagtgggaatgagggtgtggggtgagggtctgtcctcaccaaggctggtgttgggagctcaggaagcagagtgccatgtggccaagttcacctctttgatctgtgtggtgcttaggaagccattgactggcttctgacgagcatgggaagggctggagcctttcagagccaacaggtttgtgtgagagccaggcgtgtgtgtgtctgagcaactgagtgtgggagtggaggatgtgagcgtgtgtgtgtgtgtgtgcgtgtgcacgcatatgcgtgcatacgtgtgacctgtgtgtgtccgtgtgtgtgcatgcatgcgtgtgagtggatatttgtgtgtgtatgatgtgcgcatgtgactgtgtgtgcacgtgtatgtgcccgtgtgagcgagtatgtgcgcgaagtgtctgcatctgaaccagtctgtgtgtaagtatggggtaccagcaggggtgggacacgtggaatttatcgccaaagtattttgagtccctgaggtcaggccagagcagcctcgtgccccactacctgagaagtgcccccggcctcccaggggtgctgtgctgggcaaccactcatcctggagcccctcgtatgccctcgctgccctccgagtgggctagccacccctgcagctgcggggagccagctgacctccggggcagcctctgttccgcttggtgaactgttgccctctagccctctccccctgcactgtggctccaggagtcgcggggttactgaccttctttttggagggtcggctggtgtagcagtgtctctggctaggagggggcatctgcagtagtcggagagctgaagatagcagcttgctagaagccctctcccagggccggcctgcggttgctcaccacggctgccatggccatcgtgtcgccaggacctgcgctcctcctgtcattgcgttccctccagcgtgggtcgctgcagctccctcacctcccaaccaggcatccactgcatttgtgagccttgcgcctggtcctgctccccacgcagcgggtatagcccagtctctggccctttcagtagtgggaggagatggtaaatgaatagtatttgaaagggacgtgtgcgtagggggataaacagtgcttgggtgctgtggcgaggggcttccgtcggagctcaggtgctgggaaggcctctggtgacttttgagtcgagactggaagcagatgaggctgagaaccgtgtggctgtctggggcagcgcggtccaggcagagggatcagccagtgcaaaggccctgggctggtttggggcgggcctgtttgaggggctgtagcagaatgtagggaaacagggcccaaggtgtgaggagagacacatgaggtctcgagcagaggaggtgccagctctgactcgtgctggaaggcatccctggtggctggagcgagagtgagctgtggggtgggtggcgtgggggcaggagccctctcccggttattaccgggatcctggcgacagaaagcagcagcggggacacctcacttgtggggtaaggagtggcgagatttgggatctgttctgaagagaaaagacagctggatttgctggcctctgcatgtaggttcgataaaaagatgagacaaggttggcacggtgccactctgtgcccagtatccttgtctgtacagaggcgtgaccatgctgcatgtcatgaggaaaacaccaagacagtttgtgagttcaacaaatgttagctgtcgttataataaaaatgccctttcctcgcaccagaagtccagtctccatgcctacgtggttttgtctttttacttctttatggcttttctatgttggttgggaagtgctcagtgctaggttgggaggtgatcagtcgggaggtgctagtgatttgttgggaggtgcatgatgctcagttgggaggtgctaggtgctcggttggaagtgattggtactttgttaggaggtgcttggcgcttggttgggagttgttggtgtccagttagaggtgctaggtgcttggttgggaggtatttgattgggaggtgcttggcacttggttggaggtgctctgcacttggttgggaggtgctcggtgctaggttgggaggtgatcagttggaggtgctagatgctctgttgggaggtgcatgatgctcagttgggaggtgctaggcgcttgttgggaggtaattggtacttggttgggaggtgcttggcacttggttgggaggtacttgtgcctggttgggagtagttggtgtccagttgagaggtgctaggtgcttggttgggaggttttgattgggaggtgcttggcatttggttgggaggtacttggtgcttggttgggagatgtgggcccttggttgggagtagtctttcccatgctcagatctgagctggctttgcctgcacatctctgcgagccaactgtccctgtttggctctggcttttcttaactatttgaaatggtcctttacatgcttgcctctgaattctctcccagaagccctccccaggatcacacctgtgctgttcactcccacccctgcccctggggcaaagttgaccttagtgttgattcctgggctctccccacaccttccctttgctccagtcatttgaatgagagagtgaaaacagtgagatccggctcccactcatcagatccagtgatgctgatgacgccagccatggtcctaccctgagtgctgactctgtccctgtaggctccatgtctccggagagggagagggagagggagaggttccagcctgtcacagcgcccgcggcagcaacccctgctcgccaaatactgacttgaatgtggtcctcaggcataagtgtgggcgctgagtcctggggcaggactgctgtcctgagagggggacagtggagggtgggtttgtcctctgtcctggccacaggcacacggttgcgaggacatcttggccttcctcccggccctgctagagcccccgtcatctcctgtgccctcctgcatgctgtcccccaccagggtccttcctcagaggagggggttcctgccccggccatcatcagaagggggtctctgggtccgagcgtccacctcagtgtgcacgtggccaaaaggatcaaggccctgcagccaggggggcccctcctgagactcgacttcgttgcagtttcagcaatgcagtggccccgtgcggacatccaggcagggttgagggaaggcacatccctcccaggcccaggtacccatgtgggtggcagagcgggctctggggatgaccctctggcccctgaggatctgggccagaaagacactggcttagcatgggaggagtccccggcctgtaccagcctgacaagggctgcagtggcccccgggtctcaaattaaagccagggtgaaacccaaccccctctttaaatgcaaaatggcccttccctaaaataacacacaaccacaaccgcagctggctctgcacaaggccatgctgcagctcttttcttcggaagtcgattttcctccgtggaatttggctggcttgtggtagcgtttgagactctgcaagagcacgtccacgccaaccagtctctggtcacgactggctcgcaaattccccatttaaggaaaccagcaggcctctgttatgaaactcgggaaggaatgtgaattatgctccatgcggaggctcctgctcctgcacgttttccagcctttccatgggccacggtggagcatttggggaaggcctgtgtggattcccccccaagtccagatgatgcccctgataccttctcaggaggtggcggagggtctgggctctgtccaggctcctggggtggggacgtgcaggtaaagcaaggcgtctgccgcaggcacgcgggagccttccctggctggctgccagcaccttggagtcccaggctgccaggaaaagttcacccacacccgggtttgctggcgaagggtgagtcatatgatggccgggctcgggccctcagcagacaccaaggtgttcccagagcagccgctcagcgcctgtaacctggaacaggccagcctttcggggcccagttttctcatctgcctaatgggaatagcaattcccaccttccctttgttggttgggtctcactagatgcacaggagacagcagcttgagagggactgtttggagagctgttccatggacacccctcttaccctgtccccacggggccggaggagcaggggcttggtgatagcagcgggcgcagtcagcctctgcagggaagagggcatgtttggttcgaggctcctatgccctcttcttgttgatcttgtcacagcccctctggaaggtggagatggtactcgctcaggaacgtaccactcaaggaagcatggccccctggatggggtggcccttggtgcacctgaggctccgaggctgcagagcaccatggtgggggaggaggcggctgtgtgtctgtcatttgcctctttgctgaatggagacccccagagggcaaagcggggcttgttctccctgtgtcccgggatcctctcatgcctggcttgggcgagctgcctgtttctaaatcacttgctaaggctgaggggatggggtttgccgcccaccccaggaagaagggagcaagggagtcagcaccattttacaagaccaagagtgggaggaggctcctcagaggacattctgggcactgtcccctttctctgcgtgaagggtggacaaaacacaataggtctgccagcccttgtgtcctgtggctcatcccactggctgggatgggaactgagtcctccaagctggtgtggttcccctctggtctccgctggagtcacgcccagcctctgggcacacaccctgtggtcacctccaaacagggcacactggcactggtgggggtgggacctgccatcccagacctggtgtctgctcactttgtcttggttattggccagagatcacgtaagggcgccctgaggatgtgcttgtttctcatggatgggtgtgcttgtctcttgggaacatggagaagcaaagccacgtcgcccacagacctacccaggacagctgcagctgcaggttcagggtccatcccagccatgggttttattcttttttttttggacggagtgttgctgtctcccaggctgagagtgcagtggtgtgatcttggctcactgcagctccgcctcccgggttcacgccattctcctgcctcagcctcccgagtagctgtgactaaggtgtccgccaccatgcccggctaatttttttttttgtacttttagtagagacggggttcaccgtgttagccaggatggtctcgatctcctgacctcgtgatccgcccatctcggcccccaaagcgctggaattacaggcatgagccaccgcacccagccttttttttttttttttaggcagggtctcactctgtcatccaggctggagtgcagtggtacagtcacagctcactgagcctcgacctcccagggctgaagggatcctcccacgtcagcctcccaagtagctgggatacaagagtgtgccaccatgcccagctaacttttttttaatttttattttttgtagagggggattttgccatgttgcccagggtggctcaagtgacccacccacctcagcctcccgaatactggaattacaggtgcaagccatcgtgcctggccatgttttgttgtttttaaatagattaattttttcaaacagttgtaggttcacagcaaaattgatgagcagcaggtactgagtcctatacatccctgtcctcacacccacacagccttcccaactgtcagcatcctgtgcaggtggtacatttgttacaactgatgaaagctggctgacgcaccatcacccaaaatccacgttacacgagggttcgcccttgatttgtacattcttggtttagacagatgagtaaggacagcacccaccattccatgtcatacaggatagttccactgccctgattttctgtgctccaccattcatccctctcctctccaactcctggcaaccactgatgctttactgtctctgtgtattgctttttccagagtgtttagaactggactcatacagattggctctttcacctactaaatgcatttaagtttcctccatgtcttttcatggcttgatagatcatttcttttcttttctttttttttttttgagatggagtctcgctctgtcgcccaggatggagtgcaatggtgcgtttctgctcactgcaacctccccctcccgggttcaaatgattctcctgcctcagcctccaagtagctgggactacaggtgctcactaccacgcctggctaatgttttgtatttttagtgggacggggtttcactgtgttagccaggatggtcttgatctcccgacctcgtgatccaccgccttggcctcccaaagtgctgggattagaggtgtgagccactgggcccagccgatagtcatttctttataccactaaataatattccatcctgagtgttttgaattgccttttagagttcatttacagcattttcatggtagcaaaaaaatcagaaataacctgaagttctttaaaaacttacagcagagtacactaggcaatcatcaaaagaacaaggaatctttctatccacagaagggaaggtgcccagaatttactgttaactgagaacaagttggaaatagtatatttgattgcccagcttaaggcaggaatacctgaaaccatacctgttggttatttccgatggggagattttagggcaagttcactgtctgttgtttcatgtctgcatctatgcagacaaaaaaaaaaacagatctgtgttagctgcttctcttgccctgcccccgtcacaggtacatgtacggacagactggggtgagacgccccggattgagcgggcagggatggatggcagcacccggagatcattgtggactcggacatttactggcccaatggactgaccatcgacctggaggagagaagctctactgggctgacgccaagctcagcttcatccaccgtgccaacctggacggccgttccggtaggtacccacgcagtcctggggcacccctttcccctttgtccccagggctttgaaggcgttccttcttaactcaggcctacagactcttctctgaaactctggggccctaggaatgcaggacttctcagaacttggaacagcgtcagggtctgtgtggcatttgccacagcccttgaatatttctatagcaaatgtggcacgttcattctaagtagggcagaaaagatatctgtagcccacacccatgcacagtttttttttttttaactttgtttttttgagacaagtctcactctttcacccaggctggagtgcaatgtcataatctcagctcactgcagccccacctcccaggctcaagcgatcctcccgcctcagcctcccgagtagctgggactacagggtgcgccaccacacctggctaatttttgtatttttggtagagacggggtctcacatgttctcaggctggtctcaaactcctaagctcaagggatccttcccctcggctcccagagtgcgggattacaggcgtgagccaccgcacccggcccatgcaccaaatgaggttttgtcaccaatgagcaacaaaagctttccatcttcagagcgttttggattttggaattgttggggaggcttatggcccggcagggttgtgaacagtaaccctgtcacacgcaccacccccaccctggcctatcccagctcaggcatcctgagggcaacagccggaagctgtctcagttattggtgcttccccagtctcaccagggggccttccacatggtcagtgctcaataaaatgggccgagatgagtaggaagggttttcccctcgttggttaattgcttttagagccttctggtcagcatgcttcccagctctgtacttaattaccccttatagaaacatcccttctgtgtacaggtgagggcagtttattcactaaccaagtgctgcctgctgctagccctgtgctaggtgtcagggtcctcctgggacggcagaccccattcctgcactagtggagctcctggcccaggcagggagtggcaggtgtctgtgcagagggcagtagtgactgcatgggaggactcagtggctggattctgcaaacacaggccaacacccacatgaacagacttgagggcttgggcagctttgctcacacttgccaggcctcgtgtgttagttatccattgctgtgtaacaaaacagcccacaactaacagcctgaaacagcaaacaggttttttatggggagggagtcagtgatgaggagtggttagctgggtgcttctggctcagggtatgacctgagggtacactcaagctcctggctggcctcagtcatctgaaggtttgagtgaggccgggacatccacttccaagctcattctcaggcaagaggcctcagtttctcctgttcctcttatgctgagccacacatctcttttgggctgtttgaaaatatcctgttgtccctggaagtgcagaccagcgggtctggtttgagatttgaaatgtggttaccctgtagactgtggttcttgggagctgagtgatcttacagttatgaaggtggacaagaggatagaaaggctgcagctgggagtgccctggtcaaaggatggtgacagggacagtgagggtgatggaggttgaaacatgctaatggtggtggcggtggcggcagcgatccttccatagcacttactgttttccagggacgtttatcagttcatttaatgctcatacacctctatgaaacgtttgctattatgttttatttttatttatatttttattgttttgagcagggtctcactttgtcacccaggctggagtgcattggcacaatcatggttcactgcaccttgacctctttttttgtttgtttgtttgttttttttttttttgggatggagtcttgcctgtccccctggctggagtgcagcggcaccatcttggctaactacaacctccacctcccggttctagcgattctcctgcctcagcctcccaagtagctgggattacaggtgcccgccacacgcctggcaaattgttgtatttttttagtagggacggggtttcaccatgttggccagctggtcttgaactcctgatcacaagtgatccacccacctgagcctctcaaagtgctgggttacaggcgtgagccaccacacgcggccacagccttgacttcttgggctcaagtgttcccccgcctcagccttccaagtagctgagaccacaggcacgtaccaccacgcctggctaattatttggtattttttttgtagagacgaggtttcaccatgttgcccaggctggtctcaaatcctgagcttaagccatgtgtccacctcggcctctcaaagcactgggattataggtgtgaccactgtgcctagcctgtgtttgctattttgatcccctgtgcacagagaagcatgtgatttgcccagagccacacagctagtcccagccagggttggaacatagggtctgtagctccgggtctggtctgttctcagcctctctcccacctgcttccccgcgggattcttctgcctcgcagcggccatcgctcttcatgatgcacctggggctattcacatggaagcgtcgtgtgtgggtgacgagctctggagccacacagacctgtgcaggcccctttatctgtgactgtggcggggcaagggccgaggctgaccttccctcagtgcttctggctgaggcagagcatggcccgggagcaaccgagagtgatgggcctctggcttctctcactgaaaaatggccacatgggcgggcgccatggcttacgcgtgtaatcccagcactttgggaggccgaggcgggcggattagaggtcaggagatcgagaccatcctggctaacacggtgaaacctcgtctctactaaaaaacaaaacattagccaggtgtggtggtgggtgcctgtagtcccagctactcgggaggctgggcaggagaatggcgtgaacctgggaggcggagcttgcagtgagctgagatcccgccacgcactccagcctgggcgacagagcaagactctatctcaaaaaaaaaaaaaaaaaaaaaaaaaggctgggcgcggtggctcacgcctgtaatcccagcactttgggaggctgagacgggggatcacgaggtcaggagattgagatcatcctggctaacacagtgaaaccctgtctctataaaaatacaaaaaattagccgggcatcgtggtgggcacctgtagtcccagctactcggaggctgaggcaggagaatggcgtgaacctgggaggtggagcttgcagtgagctgagatccgccactgcactccagcctgggctacagagcgagactctgtctcaaaaaaaaaaataataaataaaataataaaattaaaaaattaaaagtaaggccgggcgtggtggctcacgcctgaatcccagaactttgggaggccaaggcaggtggatcatgaagttaggagatcgagaccacctgggtaacacggtgaaaccccatctctactaaaaatacaaaaaaattagccaggcgtgtggccggtgactatagtcccagccactcgggaggctgaggcaggagaatggtgtgaaccgggaggcagagcttgcagtgagctgagatggcaccactgcactccagcctgggcgacaagcgagactctgtctcaaaaaaacaaaaacaaaaaaaaataaaattagaaaattagctgccatggtggtacatacctgtgttcccagctactcaggaggctgaggcaggaggatggatgagcttaggagattgaggctgcagtgagccatgatcacaccaccgcactccagcctggggacagagcaagaccctgtctcagaaaacaaacaaaaaagacaacattgtggaaaacagttgttgattccttgagacgtaaacattgatttacgtatgacccagcaattccgctcctagtgtatactcttaagaatcgaaaacaggtcttcacacaaaatgtgaatggacagtaatgtcgtagcagcactgtgcacaacagccgagggtggaaatgacacaaaggtcccccagtggggaatggatgcacagattgggttctgtctgcacactggaatatggttcacccctaaaacggatgaagcactgacatgctacagcctggatgaacctcgaaaacatggtgccaagtcaaaaagacagacatcagaggctgtatattgtgattccgtttatatgagatgttgagaatgtggtagttaagtccatcaaaagtgtttgccggggctgggggcggggactggggagtgactgtgccgggtgtggggtttgcctgtggggcaatggaagtgctttggaactagacagaagtgaggctgcaccgccttgcgaatgcactaggtaacactattcactttaaagtggtaaatttggctgggtgcagtggcttatgcctgtaatcccagcactttgagaggccaaggcgggtggtcgcctgagctcagggcttcaagaccagccttgggcaacatggcgaaaccctgtctctacaaaaagataccccccaaaaattagctgggtgtggtggtgcacgcctgtggtcccagctctctggaggcggaggtgggagaatcgcttgaacctgggaggcagaggttgcagtgagctagatcacaccactgcactccaacctgggtgacagagtgagaccccatctccaaaaaaaaaaaaaaagtaaacgtatgtcctgtgaattttacttcaataattttcttaaaaaacagcacaacaaaaatgaacagaagaggtggtggatctgcagagcccacagctcccatcttcccttgccacttcatgagtgtcaccctctcctggcaactgtgctgagggctggggacgtggcgggaccctctgcccccaggcccaccctcagggagcctgtcacggggcgagggtcattaagaaataaaactgcacattaccgaccacgtcacattatgatcctgtttccagtgtccataactcattacacccgagtcctcatttgctgggcactgtaagcatctagaaaagaatagctgttctcgggttgatgccaagtttcatttactctgaaagtataaattatgagcattgtaagaggagcgagtgcacatggcctgatttgtatacagaggttaaagcgttgggcaggagagggtgctttttgccaggcatggcttcctcctttcttccctgggggagactttgccacttgactgggggagcccgtgtgtcaccatcacaggctgtgtttgggaggtgccctgtgcacgccggagaaatgtacgagggcgccagctcctggggctcttgacctggcctcacttgtctggtgaaagcaaatgggaagcctggcatggtggcgcacgcctgtaatcccagcgctttgagagctgaggtgggtggatcacctgaggtcaggagttcgagaccagccttgccaacatgatgaaccctgtctctactaaaaatacaaaaatcatctgggcgtagtggtgggcatcagtgatccagctactcgggaggctgaggcaggataattgcttgaacccgggaggcggaggttgcaggagctgagattacatcactgcactccagcctgggcgacagaccgagactccatctcaaaaaaaaaaaagaaattaattgggtcagcagcaatgactgtcgggggaccctcctgatggccctccaccccgcttccctgactgcaggcagaaggtggtggagggcagcctgacgcacccttcgccctgacgctctccggggacactctgtactggacagactggcagacccgctccatcatgcctgcaacaagcgcactggggggaagaggaaggagatcctgagtgccctctactccccatggacatccaggtgctgagccaggagcggcagcctttctgtgagtgccggctgggcgcgggggcgagggtgcgggggctggggggagcgggggcgcggggcaggggagtgggagatgcgggggcgtgggggtgcgcgggcgtgggtggggtgggggggcaggtgacccctcccgcagaagcccatgctctggggggccccctctctaaaggggtacctgctgcaatggagggggtatgtggctggctgggggacacgggcctgcagaggacccctctgcagagctcatggggctatttcaggctcagcagtggcaaggggatttccaaggaaggttgcctcgttttcaagcccagaagaagttgtctgtgtgtgtgtgtatatgtatttatatacacatacacgtatgttgtatatatatatatggttatttatatatacatatatatgtgtgtgtgtgtgtgtgtgttgtgtgtgtgtgtgtgtgtatgtatttttaatagagatgagagattttgccacgttgccaggcttgtctcaaactcctgggctccagtgatcctcacaccttgacttcccaaagtgctgggtcacaggtatgagccaccatgcttggccctgcaagtcgcgtatttatcaatgaatatctgcccagaatcagcagttctcagcctgggggccacgctgggttgtgacagaggtcccgatggggaaatgcaccagcttctgtgacagtggggctgcggctctggggacagtggcccctcccacagggaccagggatggagatttctggccaggccattatggaaggtttggacttgaattgaaatgtggggcctaggggtgccagctgttcccagagcaggacacaggagggtgggctctctggagctgtttcctggtgagaaagtcgtggtcacaaaacccatctacacttgggcagcatgagggagggagaggttcattttgatgagtttgttgttccagttatatccgtttttggggctgctacacccagctttcccctggtttgaatgaggtgctggaagcatttatgagttccgttcaattgctgttggtcatagaagggcttgggagagtgacaagcttggccacccagcaagagggacagtgttcctatggaagctgctgggtccacacatagcacaaagacagacaagccttttgcccaggagcccattgtctctggggttcccgtcactaccacacaggaggtcctgaccccggccattggagcgtggggggcagcctttgcagaggggtgtcctttggggctccgaggagctggggagggtgttctagtcataggagcttggtgggaggaagcagaggggaggatgtcactccatgggcaggtcacatctgggtgtgagggtggccaggaaggtccggctggttttggggaaattgcaggccgtctggccaggctgagggccccatgtggacgggccagcgatgaggcaggtggaatggtgcccgcggggaggtccctgatgccacttgaggcgatgtttgggcagagggacacactggaggctgtcacgggggacgaggcaggatgtgactattcagaaacaagtgacggtcctcttctggaaccttctctcactctgtcctggttttccagtccacactcgctgtgaggaggacaatggcggctgctcccacctgtgcctgctgtcccaagcgagcctttctacacatgcgcctgccccacgggtgtgcagctgcaggacaacggcagacgtgtaaggcaggtgaggcggtgggacgggacggggcgggcgggcggggcggggcctgcgggaatgggttgcggccgccgggggtgccccagaaggaacctcggcaaacccgttcgaatgatccacttggcgggtgtggtgattcaagtctgtggtcccagctactcgggaagctagttgggaggattgcttgagcccaggaggtcaatcctgttttgttttgttttatttttgcccagatattttccacttttttactctccgccttggtcctcaggcacttggtgcttcctggactgtgttgcagtgaggcatggctcttctcctctggggcaccggctgaggatctttcttccaggtgtcggttcggggcgggcccttcgggaaatcacacacgttcaggatgcagctgccttcggggatgctcccgggcctgggatagccagtctggcctctggggctgaccctgggcctggcaagcgagggggtaacgagaggtgtcaggaaagcgccatccctgggaccagtctccccgtttctgtagcgtgatggggcccagcttgcagaaggtggtgggggacagggcctcttcctgtgccggtgtcccactcgggagggcagggggcttccaagtgggctggcttccaactcaggaacagtcctaagggcagagtctcggtgtggggccccctagaaggactctcctgcatccggtggatggagaagtgtccttgctctcactgctgtctgagcacatgggggtccgactttaggaacagtttcctggtccccctgttcttgctggctagggtctgtgtttgtgtcagcggctggggtgtgtgtgtggtcgtggcgcccgtggcgtgtgggtcttttctctgctcctggcaggggtcctgcgtttggtgaggattttccaggtttgtatttgtctttctcttttgagagcagggcatctttaatgaagacatggctgttacatcaaagggtctgtccgctgtccggctgctgcaggggatggttggagagcctccccgaccaagcatcttgtttcccaagtgggagaaggagaatttgagaaatggggacttgggcggcctagtcctcacggctctggacgcaccccattcattcatctgcttgctcattcattcgttcatccatccatttgctcattcgcaggcatttgtcgaacacttgccgggtgctggcattgctccgaggcactggggacccccggtgcagacagaatcccgggcctctggcgctcgcactctgggctctggggctgggtggtgggggagacggcacaagtgagtccacgagggagtcagtgcattagaaagggtgagtgtttggacacccgctcctccatcacctctggggcccttcgctgttgaccgttcacctcggctcaaaggcaatgttgagagagaaactggacccagggaaggagtccagatgagctgcctctgagtgacctggcgacaccaggggtttggaccaagcaggttaagggaggattatagaccttgaaggggaggagtggtttgaccaggttggatgagccctttgtttacagaggaggccaggcaagtcaccagcctggggttgcccacagcaggtggcatagtaggttctagcaggtgggtctggctcccagagccatgagtttgctgctgccccatacctgggccctggtggagcaagccctggtctccctcgcagactgccccaggacgctgcctgctccctggaggagggggtgctcggctgcacaagcctcagcggagaaggatgcttggcttgctggctgcccgggaacctggccttctcagagtttgttttctttcctgcctgtctgttggtgagaagaggctgaactcgtgctggagctggaccctgcgctctgcagtgttggttgaagtcctggcggaaagggaaaagtgaggacatacgggctcatgacggcagggagtggccaccacagtcagggccgggggaggaggggagagagaatcaccggaatatggcaaaggtgtaaaacaggcagctcgggccggcgcagtggctcacgcctgtaatcccaacaatttgggagtccaaggcaggtggatcatttaggtcaggagttcaagaccagcctggccaacatggtgaaactccatctctactaaaaattaaaaattagctgggcagtagtggcacgggcctgtaatcccagctacttgggagactgagcaggagaattgcttgagcctaggaggcggaggttgcactgagccaagatcatgccgcttactccagcctgggcaacagagtgagaccctgtctcaaaaaaaaaaaaaaaaaaatgcactcgtcctggctagtctgaaaaaggtggagcatatatgttgcccaatatccacaaatatccagaaaatatctgagaagaaagcagttaatgagacgggcctgttcccctgccccgaggacacgtgtggtgggggccatgtcaggaagcaagccggcacacagatggacataggacagcctggatcgggtacggaacacagcaggggctgagccggagactcctgtactgggggtgtgccgcctgagccggcaggtcagaggtctctctcaggaggcctgagatctgaaggactaaagagggaaaggcgagaaggaacagcacgtgcagcggctttgaggcaggagcatgctggtttgggaccgacttcacgggctgtgtgacctgtgtagtcatatgaggtgagctctgttgtgacctgaaattcctaccttttgagtaaggggctgtctgcacttccattttgcagcggtcccgcaaattctgtaacgggcccggctcgtgtgtttgagaagctgaagggaggtctggagtggtctcttactctcttggtgtgtctgtctccacattttatcttctgtttttttgttcccagccctccctgcgtttttcctgtatgtgactgtgtgtctgtgtgggtgatcgaaccgtaggcttcctgctatttatttcactttatgcactgcagaagcatttgcgattgcaggaggaaatatgtatcaaagacatgagttttagtgaaggatatctttttttttttttttttttggacagagtcttgctctgttgtccaggttggagtacagtggctcacagcagcttccacctccaggttcaagcaattctcctgcctcagcctcccaagcagctgggattacaggcgcccgtactatgtctggctaatttttgtatgtttagtagagatggggtttcaccatgttggctagctggtcttgaactcctaacctcaggtgatccacctacctcagcctcctaaagttctagatcacaggcatgagccactgtgcctggcctatgcctgaacaatatcttatcaagacatgcttttagtcatcctcccgctatggggcgtttctgttctctttgtgtttttgccatttctagtcttgctgctgtgggttgggagtgggcaggtgagagctggcttggggcctggccactgagttagagggagcagggcctggtgtctgttgccaccatcgattggtgatgtctgcctaacactgtgttgcatctgctggggatgtctgccttgggagagcaatgggcatgtaggaagaggtgtcaccatctctgttcttggggtgtcaaagcaaggctgggtgtggacatttgtcgaggagtggggaatggacacagcccccaacaagcagatcgtgcagtcgtgcctgtcaggtccttgccctaacagtggaaggatcatttgaggtcaggggttcaagaccagcctggccaaatggtgaaaccctgtctctactaaaaatacaaaaattagccgggcggtagtcgtgcgccgtaatcccagctatttgggagactgaggcaagagaacatgttgccctgggagcttttgtaagggtccctgtgtggctccctcacgtatcagagttccaggaacgggtgtgggccctgaaaaatcccagactcatggctcagtgaagtcgcacagctggacaagcttggagacccccaataacttgcccaggctaccctggcttgcaaagggccactgctcatccaggggtgacggaccgtgctgggtgcctggcatccagtgggtgcccagtgtccagctgccatgtccactgtcatgcccttatcaccttcatgttgtcaccatgaccggcgccttaggtgctgtggctggtgcaggcccgtgagagctggggcaggttcactcagggtccaggtttgcctgcatcgtcccaaatcctcccatacctgggggagtgggctgtcagtgggagccagtaaaggggcgttgattctttcccaaccagaagaggcaggggctatagacttaggtggagcccctggctctttgctgctcccagggttctaacagctgggccttctgagccctggggactggctgctcgtggctggcccttcaagggcattgcgctccttctgcaaatgtaattcccagtctccatgtccaggccagagcagccctggggagtcctcagggctcattttcctgcaagcgggggagagggggggcaggccctgtggtgattagaggaggctgcctgcgctcacagggggtggttaggctacccgaggaggaggcccctgcaggctggcagggggcctggtggctctggccccagccctgggcctgtggcatggagctgacaccacagacacctgtggggttggaccgctggactagcagcggccctgcccttccagttggatagcttttccattccagagccgtcagggccgcagggctggcacgcagctccacgctccctagagactcagccgtcaggggtcacctttctctagtctttgggaactgtttttgccctcagccgtgagaggcacttttacacataactcagttggagctgactggcacgcaggagaaaaacattttgtgtcatttataggccctgcttgggcgagacctgggccgggaacgtccacatgcagccagtgtggggactgttttactctgagcctgaattttctgctttggttccagatgccgtgtgtagggtgttctgtcaaagggaggaaaaagctctcaatgagacagaaagatgcaactgggagtctggttttgcatgaggacgtgagcgtttagttcacttttttttgtaagcatggttccccagtctgacctcagagctgcctggagatggccccacccgcttcccgttaattaacaggctggtgctcggtgtggatgctggctcctcctctccctgccctgggcccttttgaagctgaagtgttccaggggcagctggtgtggaaatgagttttctagaggttttagagttgagaagaaacctaaactcttcttagaagcatttcagggtttgtcaccaggatggctctctgcaaatttgaggtggttctagaagatcttcccattttcttaatccagagggagatggggatgggcgagaaacggctttgtccttaaggaagtctgttctggttggaggacaggcacggcctagcattgaagctggtgagtcagagccggaccgtgagcggggccagaatggggcgcgggcttcagacttcacaaagcagaccacgcggcagctggggctttagtatccaaatgtcctgccctccaggtttcattccttgccgtaaaatatacgttaaaggaaaatgttttgttaaaagaccacagtcctgtcacctgagcacagtcgctttctcggttcctctgtggctttccaggctgcaggtgcccattggtattgcggccgtgcgccggcgggcatgaattagctgtgccgcctggctgctgacgggacgcctcgcctcgactgaaactacctggagctgctcacccaggggcaacgtgaagaaaacgtgaaattctgtcgctgttgcagctgacagcacggctgtgaggtcccagtgggcagaggcctcgtgcagggcacccaccagccgggatgtcagagctggccagaaggagcggtgcccatggagggctgccagtgccagagagccttccgaggtgtcacgttgggcagtgaaattcagagtcgggcagaggaggcctggggtcacacagggatctcctccaggctatgggttggtgaggtccagtgtccggggtgaaggatagaggctctgtggtgagggctctggagctggccctgggctagcggaaacgcggtaacgaaggaggctgtgctggtgggacttgtgcctgttcccgagggaggcattgtgatgatgtttaggccaagaggattcaggatggaagacatggcttggtttgtagttgggagcggccaaggagtggtgttgagaaagtgcagtgtcaggcagacccgggaccgtggcggtgagaggtgcagtgtcaggcagacccgggaccgtggtgatgaggaaatgcagtgtcaggcagcccgggactgtggtgatgaggaaatgcagtgtcaggcagacccgggactgtggtggtgggaggaggtgcagtgtcaggcagacccgggaccgtggtggtgttgaggaggtgcagtgtcggcagacccgggaccgtggcggcgaggaggtgcagtgtcaggcggacccgggaccgtggggcgaggaggtgcagtgtcaggcggacccgggaccgtggcggcgaggaggtgcagtgtcggcggacccgggaccgtggcggcgaggaggtgcagtgtcaggcggacccgggaccgtggggcgaggaggtgcagtgtcaggcggacccgggaccgtggcggcgaggaggtgcagtgtcggcggtcccgggaccgtggcggcgaggaggtgcagtgtcaggcagaccggggacttggacacctagttccacttgcgggctgaccttctattttttgtcatcgtgttgggagcttaggaagtgacttaacctctctgtgcttcagtttgtccgttggtagaaagggggtgattatacccccgctccatggggtttggaggaaggctgtgtgggttgtgctgagcagcgtgatggtgaggctgtctgggtcagtgccgagggagcgagtcttccttcggcggttgtaatcagaagtgcttccaaggctgggtgctgccaggaggagctggggtgggtgaaggggcagtggggagccggctcacacggccagcgggtgacctggggaggacggaggggggtgtgctgggcgcttcggcgtgtggctccctttcctgtggggcgaaggtcaggaggggggcagggcctggctgtgcagaatcactcagactcttaagacacatccagagtccccagccccaccccaacccaacgacccactccaccagaagaaacggggcaggtgggggccaaatctgtgagttcccaagggagactgtgtggggcaggttgtggggggcggcgctagcatggctggaaacatctcgaggttgaagccagagcctcaggtgagactcaagggtccctgggactccctcctgggtgtctgacgtttatctttcatggagttacaggcgaagacatttctgtgatgtcttgaattctgcttttcctgattttgagcaaatgaaagccagctgggtgtagggagtcaggtgccttccccaagaaggggctgagagggtggtcacaccaggaccccaagggacagggagcagcgttcccagggcacacaggcggcctcctagaggtagggatgcgttggtggcggggggggccccgcactgtgtgtgccttcaaggtggcactatttacgtggcccctgagctgcagggtgaccgctagcctgggctgtgtcctggctcccccgcccctcctgaagtgacccccatgagacagggcaggatatcccacgagcctctgccgcccagcgtggccggggctcagtgggaccatggcggctggatgctgctctctgcagctcagagtcactctcatccccagcagtcgagtgcagagcctggcctccggcctccccaccccctccacacagccccaggaccaaggcagcagctggcttcgtttctgccatgtttttccaattatgtggaatgagctaaaaacagcaggagtgaggcctttttgggagttgccaccgccatcctcggaagctgctgttcctcactgccacccctccagcccatcctctgtggaacgtgcccctgttcttttgacttttgtctcctgcacatccctcctcttgggggcctttgggcagtgggcttagcggcgtgcaccatgccactcgggccacacatccctggccggtggctctcagagctatgtccagagggtggccaggcagtgctcccggcaggcccagatgaggctggggtgcggcttggggatttgtgggccgctggccacagctcacccgacagagttttaacagatgttcgtctgtcagggacaggaaacaaaaagaagtcggggatgagtgggggcagcgggaggaacagagggggccactgtcgagtctgacgggcagactgacgctggagccgacggcaaagcccctcacgtccctccgtctgtccgggcggattagctcagaagcagggcccgctcagctcggggccgaataacgggcgtttgttcccagagtctggctgcttgtcacttatcagggaagtaggtcaaagggaaaaaagaaaggaggtcctgtggggccagtctgccgcggccgggcagtgattggcgttgactttgcaaacagaaggcagctgctgtctcagccatggaccgtgaatttttaatagcaagaaaatcagctcacacggttcaggaagtgtggaagaagcctgagtgctaactttatttttttaattgaggtataacttgcaggcaaaaaacgcacacattttaacgtgtacatttggattaactttgacagctgcatatgtctgctaactaccacacggtccagacagagaacatttctaccactgggaaagttcccggtgccctttgccatcctcaacccccgccccctccaccactctcctgacttctatcaccttggattgcgttgcctgttccagaactacatggaaatggaaccacgcagctgtgctcttctgcttttggcctgaatactcactgtcagggctgatgcaagaggagaggggcgcatcatattcctgagaacgctgtcaccgtggagcgggggcacagggggaatggcatctctgggatgggtgaagctgtgggcgcctttccacaggctcagagttagactgtggtcactggttttgtcccctgagcctcttccatgtcccccttgtgactgcagcataagcccagctccatgcggaccccagccagctccgcagctccaacagcttccctttatcttcagtggcgagctttgcgcttgcaggtgcggggcctggtgggacgcccacgttgcccagacagaacccttgtgcggctgcgggcctccttgccctttccgcatttggtgatgactccttgtttcgtttcactgaccgtgcccttgcctctgctctccctccccagttccgtgtgccctggggtcagtgatagaagacacggccctggaccccaagtctgctgagctgacacctcgggctgccgctcacctgcagagagacatagaaggctccgactcccttcctggcccccactctgtttttctaccttttaccgcctatccaatggaaatgcacgatttgtttctccctgtgcacatctgagtgtggacctccctgccctgctcgtgctgtgcccaccacctggagcacccttcccctgccccctgcccccggccacgcgcccctccatccagaccccactcctgcacacggctcctccgcccgtgcgcagccctcgagagtgtggcaggtgcaccaggctctgctctagggagcttcttcctcttcctgtgtccacgggaccaacatcgggacccaggaaacaggctgggagagttcggtaacaccttcaagaggtttgagagctgaggttctttggtcttcagtggagctggcagtgactttcttgacttttcaagagaagccccccgtctctgtgccacctctggggatgtgattgaacggaaatcagacatccgagttccagcctcagccctctgctgtgtggctgtgaaatgtaggccctgtgtgcttgctgacctgggagggtcgaaaggacggtgtctggggaaggatgcataagttgtagaggccctgcacttgtgataggtggggccgcgtgaactgctgatagccatcttctgtcagttgggcagtggcattgtcacatggttccattctaatccgttattttggctactgccactgagcggggtgggtgacaaaagtaacgtttcttgggggccactgcagcggtcatggtcctgaccctatacccaggcacgcgtcctgggagctgtgtgaggggtcgtccgtggctggccctgttctttttttttttttttttttttttaattgagacagagtctctctctgtcacctaggcggagtgcaatggcgcgatctccgctaactgcaacctctgcctgctgagctcaagcgatttcctgcctcagcctcccgagtagcttggactataggcacccgccaccacactcggcttatttttgtatttttagtagagatggggtttcaccgtgttagccaggatggtctcgatctctgaccatctcgtgatccacccaccttggcctcccaaagtgctgggattacaggcatgagcaccatgcctggccggccctacttcttaaatgggcctgaggcacatggtgccgagagctgctgaggtctatggaggaagggcgcagatgggatctgggcctggcgtcctggccggccccaaggccttctccacagagtttccatgtataccggggtggccttgcggaggggcgcagcatgcgtcaggctggagccagctgcagaggccacagacagggtgtcatgagcagtacaagaaccgctgctgtccattgaacacctactgtgtgcctgggttcagaaaggcaccctgtgcggcttttaaagaattaggccgcctgcctaaaggggggagtgtggccttctttttcatttagtcaccaactgttttatacatccacgcccctaaattcttcagttttaggcaaagatgaagggctgcccaggcgtcatttgctcaacaaaaccacacttcacttgtgaggctgtgttcctcaccagggtccccagcaagggggtgtgagtgtttagtaccacagggagggctggcgcgtggctcacgcctgtaatcccagcactttaggaactcctcacctgaggtcaggagttcggaccagcctggccaacatggtgaaatcccatccccactgcctgcctggggagtggccatcagccatgggcctgaggttgtggtggggcatgggggcagaggcaggcagtggggggccaaggaggggctggctggcaccgagggatgggagaggaagggacccgcctgcaggtcccttctgaggccggcactgacttggtcactctctggctgccctgaccccaggcagagcagcgatttcctgttttagagctgagcagacagagcccctgactgcaggccaaggtgcctgccagtgctcctggagggccatagcctctctgtgcttgctggaaggtcccaggcaccgtgcagggacagtggccggcctcaggttccagcagagccagcatcgggcccagccacttcccttgtctttgtgaccctatggtcacttggcacaggatcccgggtcaaatgctgcggttgcggcattgccccaccacttacccctgggggcagcggagaaacttaatcaattgctaaacaacaaaataatctggccgcctgccagctgggaagccactgtggccaggctgtttatggccttggatctgcgcagtggacagtggcctgcaccgtgaccccgttcatcctgcgtgccccaggccaggaggtggctcaagccctctgcctcctgtaagggcacctgagaaggaggccctggagcgggagcagagctgggggtgggcgtccgggcagcagaggccgattctcagctttccctggtctcagctttccccggatctcagctttctgctacccgtgtgaaaagaagccaggagaaccagctatcctgggttggtgccggctgtggtgggaggcctgcggtgggagcctccgggggcactggacctttcctgggtggcctgtggcctgggagctgcacttggttcggtgcagggagttgtgacatccactctgtctgcagggatggccggggccctgcggctgggtgatgaggtggatggaggtgtccggggctgccctgcctccttttgccaaaataacaaaaattatcttgttgttgtgaaaaaacctgttttcccacattggggcatggagggtattaactgtgatgacttctgagttcctgcacactggtgacccattggcagggtctcctcctggctctggcagggtggctcaggccgctgggtgacggtgtgctggccagatagttcctggggctgcaggtggctctttcgccccatccctcccatcccctttcattcttcctgtcaacacatctcagaccctgacaccgaatgagccgtcggtacccacaccccagggcaattcagtggaggggtaggtggtcgttcccccacgttgccccaggaagaggaccctgtccccggcatcctgacccacctccttagagaccgagagcctctaaggataaacccattcacccgtgtttcagaggctttttttcctcttataaaataacatttatacgttcgctgtagcaaggaaaacattataaaaaataggaagaaaatagaaattacccataattttgccacacagacttagttgtgtccatgtatctgtgcaccttttttctgtttacggatcaaaatcgacttttagggtcaggcgcggtggctccacctgtaatcccaacactttgggaggctggagttggggttggggggtggatcactgaaatcaggagtttgagaccagcctggccaacatggcgaaactccatctctactaaaaataaagattagccaggcgtggtggtgggtgcctctaatcccagctactccggaggctgaggcagagaatcgcttgaacccaggagacagaggttgcagtgagccaggatcacgccactgcacccagcctggcaacagagcgagactctgtctcaaaaaaaaaaataaaaataaaataaataatacataaattgacttttaggagattggttcaaacaatgtgtgtaatgttgtgtctgaggtttttcatttatcgttcatgcaaattccgacatcattcactcttctccagagtgtgctttttcctgcctgtgtcatcacccgtcaccttgaatgccctcgtttaggtaaaataagtaattttattcaaaaatatttgaggacatttgggttgtctccaggttcttggtcttgagtttgctgttcttgtggagccatggtggtgtctggttgcaggaacctccatgcgttccagctctgcttctgcctgtgttcttagagaggaaatgctggggtccgcggttcccgggctgctgccaggaagcctgcggtgctttacggcccttccagaagcgggagatgcccccacttaagttcagacaggcctttccacctcactggcagctctgagcggctcccttctatttgcagatgctgagaagttaccaatttccacgtttactgactgctgtttctcctgttaatttgtattttagtcttcgctaatttattgctagggttttggtgttgtccctattgacttgtatgcctttaattttttaaacaacattaatagacttcatttttttagagcagttttaagtttacaggaaattaagggacaagtacagagagttccttccacctgctgtcctcctctcctcctccccccttccctccttcccctattgtaactttctttctgatattataaaagtcactcatggctggcgtggtggctcacgcctgtaatcccagcacgttgggaggcagaggcaggcagatcactgaggtcaggagttccagaccagcctggccaacatggtgaaaccccgtctctactaaaacacaaaaagttagccaggcgtggtggcgggcacctgtaatcccagctactcaggaggctaggcaggagaatggcgtgaacctgggaggcagaggttacagtgagtcgagatcgcgccatgcactccagcctgggcaataagagtgaagcttcgtctcaaaaacaaagtcacacacgctcttgtacgagggtcatttggccgaggggccagatggctcaccatctagttgggacaggcatgagctcggaatgctttttacatatttacatggttgagaagaaaatcaggagaataagttttgggacatgggaaaatgacatggaatttgcattttagtgtccataaatgaagtttgtttgctcccagctgtgttgactgaggcaggctggcttcctacagctgcggcagagctgggaggcgggaaggagaccgtgcaggccgcagcaccgaaaatatttgctctctggcccttccagagtgcttgccgacctctgtccgacagctagaaggaaggataggacccgtccgacgtaaccactgttgacatttgagcgcgtttccttcccggcttttgtgtgagagtggcagtcgtttgcttttgtggtcgggatctgctgcacgcacggcgggctgtttgcatgaggcttccggaggatagggctgggctcggagctgcacgcagtggggcgtgtcctgcatgcagtggggctcagaagagagctgtggtgggcggggcagtgccaacgctggtgggtgccaggcctccagctcagatcagccccggcgacaggtttgggccaccctctctctggcctctgtgcagtggccaggccgtctgctctgcctggcacacttgcctctgtccttccactgaagcgctcctctaccctctgctcccggctgggtacgttgaattgtgtccctcaaggagatatgctaaaggttaaccccaggaacctgtgtatgtgatctaatttggaaacagggtcttggctgatgtaataagcgaggatgaggtcaccctagagtagggggcctatatccacggtgctggtgtcctcagagagcaggtgagcagacactgacactcaggggtgaaggctgcatggagtcagaacaggcttagtgcgatggcggccacaagccaaggaactccaagtatttcctgcaacaccagaagtggaagatgccaggaaggatcctgccctggagccttcggagggagtctgtccctgcagagtcttgacttttgattgcagggatgcatgtcttagggtgtgtgggggggtgcatttctgtgttagaagccacctggttggtggcgatgtgtcacgggagccctctgcaggttctgcgttccatgtggtcggggacagaggtgggcagggacggacggtgtcgagctggacatgtccagacgtcggccatcccttgggatggcttttttgttttgaggataaggctgcctgccaggagctgtgccctgcctggcccttgccccaagcccctggcctgtgcttggcctcgcggaaggatgtcgcccttctctcctgcatgcgtgcagggaggaaggggagaggtcagcagcccgccggaggaggctcgggcgaggggaaggtttcactttcaggcaatgttgtggggctgtttaacaaccccaaagaaaaccatttggccaaactgttagtttccaaacattttacttccttgggtttaaataaattcctaccaagactctgtagctggtcccagggaaggagttggcctctctctttatagcccggcacagtcagtcccctgcacctgcccctcccaaccccaggcctgctccccgtggccatggctgctgcccggacctctctacacacagaacctcctggaggccagcgtgggcaccagccttggcagggctgtggcggagcccaggctgctggtactctctctgcactgctccctgctggcctggctggacagagtccccaccaccactggggtcacctctgtgcggtcacagctcactcagaccttcaggcaaatgggttggatcctgcctctctcccaggtgctcagtctctgcaaaactcaaaaacctcagaggccttgcagcctgaggggtgtcagagaacctccttcgaatcagtaaacacctacagattcaccccagcagtgaaaggactgcttcgcacagaggtttgatttactcctaagtaattggaagggatgccgagaataggttcctcatgtgggactagaggccctctgctgacctagttaacagagggctagggctgggtgtgctcacccctgaaggttctaggcccatttgggacaccccgccagaacctgccacaacctgccattggtgacagctacctaaatcccagaggctcttgagctggagagcagacctctcaatctcgcaggccccccacacagaccccataaccctagtctgccttcacagtacagttcgtggcttgtgttcacggatggtgttgttcacctaaggtctctgccctgtgaccccaagggcgtccgagggcagattccaagtctgtttcgtccacccctccttccctagcagcgggtccagggctggcctgaactagcttcccacagagatactggtgggatgatgaaggcagccaggcggcagtgaaaaacgcacttcctgcatgtgctggctcctgggattgaagtgtttgaggaagcaagtgaagtgagctttcctcttgcggctgtgtgtccttgggccgggagcctaccctctctggcgttggggtccttgtcagtagaatggggcatcctcatagctcaaggggtggtgtgtgaaattgtgctattgtgttactttaatgattttttttttttcgagacaaagtctcaccccacgcgcaggctggagtgcagtggcgcgatctcagctcattgcaacctctgcctcctgggtcaagtgattctcctgcctcagcctcccaagtagctggaattacaggagtgcgccaccagcccggcatatttttctatttttagtagagagggggttttaccatgttggctaggctggtttgaactcctgacctcaggtgatccacctgcctcggcctcccaaagtgctgggattacagcatgagccaccgcgcccggcctactttagtgatttcttaggaggacagagggaacgggtggcaagacaggcttggaatgtgttttgggatcaagtgccggtttctgtctggcactgggttctctgtggggccatgatggacacactgctgaggtcaagcgtgattcgtcttgcgcttgcctggcagtctcattggaaagttctgtagacatcgtgtggatggggctcttcccggcaagcccttggggaccttccaggactgtgatctccccacagtggctgttaagcagggaccttcgtgaagtggagtctctggtcccctccaagtcatagctagacagggactcgggcatcccaagcctggctgattattcactggatgaggagacaggcccagagaggggcaggaacctcccgaggtcacccagcaggccccagaggtttcggtctcggattctccctgctcatccctgatgtagtgctgctgtggatgtggttctgtgctgggggctgtggagagcagggggcttggccaggaccccagtgagggtggcgccctcgccatgaggccgactgttggtatggggcggcatccactggggtgtggggaggaacagctttcctgaggaggaggtggcgggaggaacagttccctgaggaggaggtggcggtgctgtgtgacctgggccttgaaggacaggtccattgcaacagaacattttgggagtggagcctagagggagaaaatttgttgaaattcagattccctccccctaccaatacacaccaaatcagatgcccctgaccagatctaaatttggctctcgagatttccattgtagctgggcacttggggaaccttctaagtgctgcctctgcctctcccagcctgcctgcctcagtttccccagccctgggcccgtgtcgctgttgccatcacgtggcgccctctagtggaggaatcagattatgcactccggggcttggagcaggagtcaggagggctcctgtctttccttgaaacgttggatgccgggatcctggaacagtctctgcattcctctggcgagaaccagagcctgggcacaggggaccatctgttgtttgaaggctgcagcctgcagggcactcaggagatctggcagttggctgcagggccaggtctaggggccagggcatcgggaggctctgggctggttcagccccgggcccctttgcagattgtgacctgggcccctggcaggggcatggccacaggatgctgggaggggtctctgaccctgaccttcttggctctggcatccttgagaccagaaaggtctggaacaaatgagtagacgatgccctaacctggggaggagccacatcctgatcccagcaacctcgggaaggatctgtcaggattatggggcacccgggggccccaagtctgcatgggtctccacttgcaatttctgtaggaagctctgataaatcaaactgggggtcctaggacacagtcagaaatgctgataccgttgtgtgtggagcctcggccctgggggtcaggagcatgtggagggtgggccacgggggttcagaagagaatcctgtaccccccaccccccaaactgaagcccacttgagggccatggctgaaaggttggggggtcccgtgcgtcctgtggagtgggtggtgaggagtccttgggtttgcacgcctctgggcctggcggcgggaccccgtccacagcggatccctgggccctgttgctcagatgctctcagagtttgctgtggccacggagggagcctgagttaagcttctcttgtgccggttgtacgctgtcggtcacactggtgagttaggcagggcacagatgcccagagcagagggaactttccttgggattcaacacgtgcaagtcttaggggctggcaaatcctgccctcagctagagagggggctttatttgagaccagaatcacctgagcatcctcctgtccccagctgtgtccagcctgtcgcagggacatcctgagaggaccaggctctcccctcatccacctgcctaagtgccactctaaccctgtccacctgtgccgtggaggggcgtgacctcaagctgctcagccagcagcaggttggccctggggggcagcagagacccaggtggctgtggggtgggtgcttcgtggcgtggtctgaaacttcgttggaagtgtgtggacagtgccttgcctgttctctgtgggaccctattagaaacgaggtctgagttactgggggtcatcactgtgttctgatggcccagctgtgtgaggccgcggtgcagccccatccaaggagccagggccctgggtctagccgtgaccagaatcatgccccggaggtgtttctcatctcgcacctgtgttgcctggtgtgtcaagtggtcgtaaactctgtgttagctcttggtgttcctgaaagtgcccccgggtctcaggcctcagaacagggtttcccttcatctcggtggcctgggagcatctgggcagttgagcaaagagggcgatcacttgaaggatgtgtctggccctgcctaggagccccccggcacggtgctggggcctgagctgccctcgggtggtggagaggagggagcgatgaagtggcgtcgagctgggcaggaaggtgagcccctgcaaggtgggcatgctggggacgctgagcagcatggccagcagctgggctgcagcctggtacccggcgggacttgtggttggggctggtttgtggccaggagaggggtggcaggagacaagggggactgtgaggcagctcccacccagcagctgaagcccaatggctggctgtgtggctctcagctgcgtgcataacctctcagtgcttcagttctctcatttgtaaatgaggaaacaaacagtgccagcctcccagaggtgtcatgaggatgaacgagtgacctgtagcatgggctgggtgcgtgtcacctaacatcaccagcctttgcaaggagagccctggggcctggctgagtatttcccttgcccggcccaccccaggcctagacttgtgcctgctgaggcccttgacccctgaccccattgcacctgtctccacaggagccgaggaggtgctgctctggcccggcggacggacctacggaggatctcgctggacacgccggacttcaccgacatgtgctgcaggtggacgacatccggcacgccattgccatcgactacgacccgctagagggtatgtctactggacagatgacgaggtgcgggccatccgcagggcgtacctggacgggtcggggcgcagacgctggtcaacaccgagatcaacgaccccgatggcatcgcggtcgactggtggcccgaaacctctactggaccgacacgggcacggaccgcatcgaggtgacgcgcctaacggcacctcccgcaagatcctggtgtcggaggacctggacgagccccgagccatcgcctgcaccccgtgatggggtaagacgggcgggggctggggcctggagccagggccaggccagcacaggcgagagggagattgacctggacctgtcattctgggacactgtcttgcatcaaacccggaggagggcttgttaaaacaccggcagctgggccccacccccagagcggtgatcaggagctccagggcggggctgaagacttgggtttctaacaagcaccccagtggtccgggctgctgctgggtccatgcgtagaaagccctggagacctggagggagccctttgttccctggcttcagtttcctcatctgtagaatggaacggtccatctgggtgatttccaggatgaagtagtgacagtaagggcagcctctgtgacactgaccacagtacaggccaggcctcttttttctttttttttttttgagatggagtctcactctgtcgcccaggctggagtgcagtgggtgatctcagctcactacaacctctgcctcctgggctcaagtgattctcctgcctcagctcctgagtagctgggattacaggtgcctgccactgtgcttggctaatgtttgtatttttgtagagatggggtttcaccgtcttggccaggctggtcgcaaactcctgacctcaggtgaccacctgcctcagcctcccaaagtgctgggattacaggcatgagccaccacgcccggtcggccaggcctcttttgaacactttgcacaccatgggtcttttcatccaggggggtaggtcagttgtacagttgaggacactgaagcccagagaggctcagggacttgcccagggtcaccagcaggatgtggcaggtgtggggctgggcctggcagcgtggctccagctttccagcatgaaatctgtgaaagcagatagtttgtcggtcggtaggggagactttctgagacccgcccagcggctcagagggtagtagccaggggccttcctgggggctcataacccagaacactgatgggaaaaccctgatggaggaggcgcagtggagctgtgggtgccgatgggaagtcccagggagctgggaggtcagtagcggtgctgccctctgtggagcacttagtgggcaccaggtggtttccaggttcatggccctgggacctgaagctcagaaggtgaagtaacttgcccagggacccgtcgggcagcggcgggcagaggatttgtgggctgtggagcctgtgctcgtggcccgccctgggggttgtgagtgtgctggccggggagcttttcctgcaagtggactggtgtctggagccagcatgtcaggcagcaggcagcgggagtgcagcaggcagcgggagcacagcagcagagggcggggctcgagcagccatccgtggaccctggggcacggaggcatgtgggagaggctgctccatggcagtggctgaagggctgggttgtgccccgaggagggtggatgagggaagaagtggggtccccaggggctttagcaagaggaggcccaggaactggttgccagctaagtgaagggaacacggccctgaggtcaggagcttggtcaagtcactgtctacatgggcccggtgtcctcatctgtgaaaaaggaagggatggggaagctgactccaaggcccctcctaccctggtttcatgagtctgaggatcccagggacatgggcttggcagtctgacctgtgagtcgtggggtccagggaggggcaccgagctggaagcgggaggcagaggggctggccggctggtcagacacagctgaagcagaggctgtgacttggggcctcagaaccttcacccctgagtgccaccccaggatctgggttccctccttggggggccccagggaacaagtcacctgtccttgcataggggagcccttcagctatgtgcagaaggttctgctctgccccttcctccctcaggtgctcagctcctccagcccactagtcagatgtgaggctgccccagaccctgggcaggtcatttctgtccactgacctttgggatgggagatgagctcttggcccctgagagtccagggctggtgtggtgaaacccgcacagggtggaagtgggcatccctgtcccaggggagccccagggactctggtcactgggcttgccgctggcatgctcagtcctccagcacttactgaaccagcatctactgacaccaacatttacaaacaccgacattgaccgacaccgacatttacgacactgacatttaccaacactgtttaccaacactgacatctactgacactggcatctccaacactgacatttaccgacactgacatttaccaacactatttaccaacactgacatcactgacattggcatctaccaacaccaacatttaccgacaccaacatttaccaacactgaatttaccgacaccgacatttaccgacaccgtttaccaacaccgacgtttaccgacaccgcatttaccgacactgatatttaccaacactgacatctactgacgctggcatctactgacccgatgccagcatctaccaacaccgacatttaccaacactgacatttaccaacactgactttaccgacattgacatttactgacactgacatctactgacactggcatctactgacacgacgtttaccgacactagcatctactgacactgacatttaccaacaccagcatctaccacaccgacatttaccaacactgacatttactgacactgatatctactgacactggcatctctgacaccaacatttaccaacaccagcatctaccaacaccgacatttaccaacaccagctttaccaacaccgatgtttaccaacgccgacgtttaccgacgccagcatctaccaacacgacatttaccgacaccgacatttaccgacactgacatttactgacactgacatctactgtactggcatctaccgacactgatatttaccaacgccagcatctactgacactgatgtttccaacaccgacatttacgagcaccgacatttactgacaccaatatttactgacatcaactttagccatgtgatgggggccggcttgggggcaggccttgctcttggcactggggatgcgcagagaccagacagactcatggggtcatggacttctgcttcttctccagcctcatgtatggacagactggggagagaaccctaaaatcgagtgtgccaacttggatgggcaggagcgcgtgtgctggtcaatgcctccctcgggtggcccaacggcctggccctggacctgcaggagggaagctctactggggagacgccaagacagacaagatcgaggtgaggctcctgtggactgtttgatccaggaggccaggcccagccaccccctgcagccagatgtacgtattggcgagcaccgatgggtgcctgtgctctgctatttggccacatggaatgcttgagaaaatagttcaatactttctgacaaaaacgccttgagagggtagcgctatacaacgtcctgtggttactaagatgttatcattcggccaggtgcctgtagacacagctacttggagactgaggtgggggatcgctggagtccaagagtttgaggccagcccgggcaaaggggacacaggaatcctcgcactgcttttgccacttactgtgagatttaaattatttcacaatacaaaattaagacaaaagttaatcacatatccactgccctgcttaagacagaaaacatgggtgttgttgaagcagaggcagctgctggcctgagtttggtgattggttcctaagcagttgaaggcagttttgttttccatagatgtctgttctccctttgctgggtgcagcctcgccctgctgctgtggtcggtttcagtggcctcgtcccgtggacgcagcctcgccctgccgctgtggtcgggtttcatggcctcgtcccgtggacgcagcctcgccctgccgctgtggtcgggtttcagtggcctctcccgtggacgcagcctcgccctgccgctgtggtcgggtttcagtggcctcgtcccgtgacgcagcctcgccctgccgctgtggtcgggtttcagtggcctcgtcctgtggacgcagctcgccctgccgctgtggtcgggtttcagtggcctcgtcccatgggcgtgctttggcagcttttgctcacctgtggagcctctcttgagcttttttgtttgttgtttgtttttgtttgatttgtttgattgtttgtttttgttgtcgttgttgttgcccaggctggagtgcagtggcggatctcagctcactgaaacctctgcctccttgggttcatgccattctcctgcctcagcccccacatagctgggattacaagtgcccgccaccacgcctggctaaattttgtatttttatagacagggggtttcaccatgttggtcaggctggtctggaactcctggtctcacatgatcacctgcctcggcctcccaaagtgttgggattacaggcgtgagccaccgcgcccagccttgttgagcatattttgaggttctcttggtgccagtgatatgtacatgtgtccccatcgcccatcgtcacccattgaggtgacattggtgcctctcctcggggtggatgcctccctctgttccagcaacttctgaaggattttcctgagctgcatcagtccttgttgacgtcaccatcgggtcacctttgctctcctcagggctcccaggggaggcccgaatcaggcagcttgcaggcagggcaggatggagaacacgagtgtgtgtctgtgttgcaggatttcagaccctgcttcgagcgggaggagtctcagcaccttcagggtggggaacccagggatgggggaggctgagtgacgcccttcccacgaaaaccctaggagctgcaggtgtggccatttcctgctggagctcttgtaaatgttttgtttttggcaaggcccatgtttgcgggccgctgaggatgatttgcctcacgcatccccgctacccgtgggagcaggtcagggactcgcgtgtctgtggcacaccagcctgtgacaggcgttgttccatgtactgtctcagcagtggttttcttgagacagggtccgctcgctcacccaggcgagagtgcagtggcgcaatcacggctcgctgtagcctcaatcccctgggctcaggtgatcctcctgcctcaccctctgagtagctgggactacagacacatccaccacacccagctagtttttgtgtattttttgtggggggagatggggtttcgctgtgtgcccaagctgatctcaaactcctgaggcacaagcgatccacctgcctcggcctcccaagtgctgggatgacaggcatcagccgtcacacgcagctcaatgattttattgtggtaaaaaaacatagcacaaaattgatgattttaaccattttaaagtgaacagttcaggctgggcgggtggcttatgcttgtaatcccagtactttgagaggctgaggtgggcagatcacctgagtcaggagtttgagaccagcctggccaacatgatgaaatccagtctctactaaaaatacaaaattagccgggcatggtggcaggtgcctgtaatcccagctactcgggaggctgaggcagagaatcgcttgagcccgggaggtggaggttgcagtgatctgagatcatgccactgcacccaatctgtgtgacagagcaagactctgtcttgaaaaataaataaataaaaaaaattttaaaagtgaacaattcagggcatttagtatgaggacaatgtggtgcaggtatctctgctatatctacttctagaacactttcttctgccctgaaggaaaccccatgcccaccggcactccgcccattctcccctctctcccagcctctgtcaaccactaatctactttctgtctctggggttcacttcttctggacgttttgtgtgactggaatcctgcaatatgtggtccctgcgttggcttctttccatagcattgtgttttccagattcacccacacattgtcgcacgttatcgaatctcattcctgactgggtgcagtgggttaggcctgtaatcctaacattctgggaggcaaggcgggacgatcacttgaggcaggagtttgagaccagcctggccagcctagcaagacccagctaccaaaaaattttaaaagttaactgaacgtggtggtggtgggcacttgtggtcccagctacctgggaggctgaggtgggaggatcgcttaagcccaggaggtcaaggctgcgtgagctatgatcgcaccactgcactccagcctggacaacagagcaagaccctgtctgaaaaaaaaacaaaaaaaaaagttcctttctttttgtggctggatgacatcccattgtatgccacagcacattttgtttgtctgtttatcgggtggtgggcagtggtttccaccttttgttcctgtgaataatgctgctgtgaacatttgaattcaagtttttgtttgaacacctgttggaattatttggatatatgtgtaggggtaggattgctgagtcctatggtaatgttaggttgacttactgaggaaccattaaactgttttcaacagtggctgcgccgttctgcatccccacggcagtgtgtgagggttctgactttacctcctcacaaacgcttcttttccatttaaaaaatattcagccaggtgctctggctcacgcctgtaatcccagcactttgggaggccgtgggggcggatcacctgaggtcaggagttcgagacgagcctggccaacatggtgtaaccccactctaccaaaaatataaaaattagccgggtgtggcagcgggcgcctgtaatcccagctattgggaggctgaggcaggagaatcacttgaacccgggaggcagaggttgcagtgagccagatcgcgccactacactccagcctgggtgacaagagtgaaactccatctaaaataaaacaaaataaaaataaataaaaatttattaaaacattcatcacagccagcctagtgggtgtccatgtggctttgcctcgcatttccctgataactaggatgctgagcgtcttgtcccaggctgccacacctcagcactttgagatacgtcgcacagtccccatttgcgaacgagaaatgagtttagggaacagcagctgtgtcatgtcacacagcgagcagggggtctctgagccgtctaccccacagccgaccaagctccaatccttaccgcctcctagtgttgtggatgtagcccaggtgctcccacatttttcagatgagaacaccgaagctcaaaacaggagcgttttgtccaattggatacacgatgtctgtggtttggtcctgaagtcactttatatctcagtggtccagctggagtaggacagggggttctggggaatggggaaggtgtctcaggtgaaaggaaggaatccagattctccatactgtccttgggaagttagaagactcagagggtctggcaaagtcaacaaagcaagagaaatgcagtcaggaggaagcggagctgtccaggaacaggggggtcgcggagctcacccccaggaactacacttgctggggccttcgtgtcacaatgacgtgagcacgcgtgttgattacccactttttttttttttttgaggtggagtctcgctctcttgcccagctggagtgcagtggcacgatctcggctcactgcaagctctgcctcccgggttcatgccatctcctgcctcagcctcccgcgtagctgggactacaggcgcctgccaccgcgcccggctatttttgtatttttagtagagatgggatttcactacattagccaggatggtctcgatctctgacctcatgatccgcccgtctcggcctcccaaagtgctgggattacaggcgtgagccccgcgcccggcccgatttcccactttaagaatctgtctgtacatcctcaaagccctataacagtgctgggttgctatagggaatatgaggcttacaggccatggtgctggacacacagagggacggaggtcaggaggtagaagggcggagagagggaacaggcggaggtcacatcctggctttcaaaatgggccagggagagacaccctctgagcatggtaggacaggaaagcaagttggaacacattgagagcaaccgaggtggctgggcgtggtggcttacgcctgtaatcccacactttggaaagctgaggtgggtggattgcttgaggccaggagttcaagaccagcctgccaacatggtgagaccccgtctctactaaatatacaaaaattagccaggcgtgatggtgatacctgtaatcccagctgcttgggaggctgaggcaggagaattgcttaaacctgggagcggaggttgcagtgagccgagatcccgccactgcactccagcctgggccacagagtgagctccatctcaaaaaaaaaaaaaaaaaagataaaaagaccaaccgaggaattgaagtggggggcgtcacagtagcagaagggggatcgtggagcaggccaccctgtggtcatgcactggagctcattacctgacgatttggagctcatcactgggggcctaaggagaatagatactgaggatgaggagtgatggcgcggggcacgggtgtctttggtggccagaacttggggactgcggggtgcctcactgcaggccttctcagcgccctttatatgcttacacaggctgtttctagagggggatacattgcataagcgttttcagactacctcatcatgggtccctttctttacctctgtggccctggtggcgcactctctgggaaggtgcaggtggatgcccagacccgcccgccatccacctgcacgtccagagctgacttagcctcgagattgctgctggcacctcctgcccgggacacctcggatgtgcccgtggagatgctggctctgtgttttctgctggagtttgtgcgtcttttcctcctgcaagtggccaccgctcttgggtatgtcctcaggcttctgcggtcatggctgcttctcaggtccttgcccagcgccaggagcaaaccctcctggcactttgtcaggggtggatgcgccagtgttcctgctgtggacccccatctcacatgagggtcttggcctgcaggctcgttcaggaaacacccgctgagtatgcagtgtgtgccagctgtgtcccagcaatggcggggacagtggctgctgctggggttgtggtggcttctggggactctggggaagctgaggtgcaaggagccacggctccttgaggatgcagttggactccaggtggaagggtggttgggggaggtataaatggggtcagggaggagacacatttggaacaatgggaacattttaagatgctatgtcgggaggcaacaaggtggccaacccaggtgctgaggagcccacacagccctggacgtgttttgccgctcacctttgctggggagtggtgggagagaggattccttccacgtggtggtgtgcgcagctgggctgtgtggagctgggcgctaggaggaaggtgcttctgcggggctagccgggctctgcctttgaacacaatcaggctccaggttttcagcatcagtgcatgagaggacttcacgggcagctgtggctgatcccttgatgaattgggagaagacaaaggtctatgaaatgaggtttcatgtagatggcattagagacgcccacaacagattacagagtggagcggagacggcggatgggtctgggaggcccctcctgctggccttgactggacagctgtcctgggaatcagcttccaggccgccccagcagcctgactgacacacacagggttttagccccatcctgcgaccagctgttgccatcatcagtgacagctgggagtggcgtggttccagccctgggcaccctccccacctgctggggcccacccagggcagtcctgacactacaggttgcttggagccgcatccgagtcctgccccaccacgtgtgaagcccgagtggcgtgggctgaggtcccctgattgcatccccacttcccttctgcttcacatagctgcctctctcaccgtttttccagcctcctgggctaggaattccagtgttgtgctggctttgccccggacacctccttagccctcttcctgagtctagagccccgggggttggaagttctggccctgggacacctgcagccacactcagcttctcctgtgagcctccagcatgtcccctcaggacaagccctcacgttcttgcctccccgcccacctgggctcagccaggggaaggcctggctggagcgtctcccctctgccctgcccttctcccctctaccctgcccttctctcctctgcccgccatggcttttatatcctgtgccacaagacatggctgtgtgtgaaagtggcagggtcggcatctctgtgggtctctgaggcccacgctccagtgccactcttcccacccgctggcctgccctcatgctggagggacagcccagccctctcccgaaccccagccccatgtgcccagtgcccccggccctctcccctggaagccggggtcactccagccgtatgccatggtggggaatcctgcttccttggccttccagggaaggtcctctttccaaatggcgacacctggtcccgcctggaggctggaagctgtggcccttgtatgcccctccagggtctgtgcgctcggttgcccgagttcccatcaccgtcgtcatcatcaccatcatcattgtcatttcgcttgtctgtagccggcctggtctcccagagcagagaccctctgaggtccagcctgagttggggtctcctgctgacccctgacggggactcaggacgtaccaggtctgggtcaggagtgacccccaaactcgtgccctttgacaggcacccctgacttttgctaagtgggtggaggtgacatcacttcagcgggagtgatgggacagggtctgttggctgcactgtgctcccagggatctggggagggctatatccctgggctttggcactgcagagctgtgtgtgtttgtgtgtgtgtgtgtgttgtgtgtgtgtgtgtgtgtgtgtgtgtgtttgcgtgcgcgcacatgtgtataagatcttttttattacatgaagcaagataactgttgctgtttccttttgggttttgtgttcaacaggtggggtacttcttccctcagacaacagaactctcccctttaaacacgtgctgtcagaggtgggtcttgggctcatgtctgtttgcacagccgagtcagaggaaacacagggttcttctaaaaacactgcacagcaggcgactgtccagagtcagcctgcaggacggcagcagccctcccctcagagcacagctagggtgggctgctttgggatctcccgtcattccctcccagctgcagccggcggccggcccattccttggtgtgctggtcaggggggcgtgcgcctgctctgtcaccctgggaatgggacagaagctggcagctcggagaggacagggctggacccttgggggcctctggctggaccatctcattgtcctcagacacagcctctcgggtctagtttcattcctgaaaaacaagtgcacagaactagagcaggagtcgagagctacggcccccgggccagtccagccctgccacctgttttcacaccatgctcaagctgagtgggttttacattttttattacttgaaaaaaaaaaagccaaaggaggtttcatgacccatgaaaattatatggaattaaaaaaaaaaaattatatggaattcaaatttcagtgtccataaataatttcttgagacaggtctcgctctgtcacccaggctggagtgcagtgctatggcatggctcgctgtacccttacctcccaggctcaagcgatcctcctgtctcagcctcctgagtagctgggactacgggttgtgccaccaagcccggctaatttttttttaattttagtaaagacagggtctttctatgtgcccaggcttttctggaactccatcttggcctcccaaagtgctgggattacaggctcggccacggagcccagcctgtttttgttttttcactgataaagttttgccgggtgtggtaggtgtgcctctagcgatttgggaggctgaggtgggaggatcgcttaagcccaggagtttgggctgggctcaagtgatcaggaggtgaactatgatcatgtcattgcattccagcctggggacagagcaagaacctatctcttaaaaatatatatttaaaaagtattgggtgtggtggccacgcctgtggtcccagctacttaggcatctgaggtgggaggatggcttgagcccaggatttgaggttgcagcgagccaagatcgtgtcactacactctagcctgggtgacagagcccgaccctgcctctttaaaaaaaaaaaccaaaaaacatgtattggaacacagccatgcctgtcagtcacgtgctctccatgctgctttctgctccagagacccttatggcctgaaagctgaaatattttctatcctttacaaaaaagtttgctgacctctgtcctggaaaattcatctccaagttctcttccggcactggcgttcctgggtgtcctaaatttggcccctgttatttctaactctgttttggctctgttccctcccaggagccaggacaggcacgttctctgcatctttcccctgacgcccagaggcttggctcggctcaggcattcttggaaatatctggctccagaaaggcagaggcctcctgagtcggcccagagggaacctgccccaggtctgggggaggccgacccagcagagtggcttttgccgatgggttgggccggtcaagatgtgctgaaagttgtctcagaaggccactttgggattccttcctccagtattagagcaactgagagctgctcatgcaagcctgatgttttcccagttggccgggtccaccgggtgccctgggattctgggatcgggtggaaagtagggggcttgggggagtgtcctgggttctggaatccaggtggcaagtgtgaggttcagggagtggcttctgagccaccataggggtctctgtgggaggctctgcccaccaggagattccgcaggccctgccggcccagagccagcgtcttgcgcttgccgaggctaagccagccccagccgggtggaacagcccgtcgcctcctctcactttgttttggggccactgggagtgtggagcaagggtagagagggaggaagtggctgccggccgctgcccagcaccttgtttgccttgggccctctgtgggctcctttttattgctcttcaatgaagccagggaatggacttccttgcctcacttcagttcaacatgtctggaagtttggtattaaaattaagaagtgtggaaatagagcaagaagagaaaaatctctccaagagataatagtgacctctgagtgggcgcggtggctcacgcctgtaaatcccagtactttgggaggctgaggcgggcagatacctgaggtcgggagtttgtgaccggcctgaccaagatggagaaaccccgtctctactaaaataaataaataaataaataaataaatacaaaattagccaggcatggtggcgcctgccataatcccagctaaggcaggagaatcgcttgaacctgggaggcaaaggttgcagtgagcaagatcacgccattgcactctagtctgggcaacaagagtgaaactccgtctcaaaaaaataaataaataaaaaataaaaatagtgacctctggccaggtgtggcagctcatacccgtatcccagcactttggaaggaaggccgagatgggcagattgctttagcacaggagtttgagccagcctggccaacatggtggaaccccatctctacaaaaatagaataaaatttaagaggaatagtgaccttttggtagatcgaaacctggattgctttctttttctaaatgctgattctttctttgtggtgtttgtgttctgtgccgatgtccctcccccagccctgttattgtgagggaagaaggggaaagggttcgcccgctactgtgagcccctcctctcacgctgggtgtcctggagaagcctgcacttcttcattgtacgccagggctgggtccctccctggagtggttcgtgctgctgggatggggccaacccctcagatgttttctgagtgtcacacacaggtgtgtcattcatggcctttgcgtgtcttcctgttgtggaggcaaaaatgtgaagaaccctagatattttgggaccagggctccatcacctgctgttcattgcacaccggagcatccaggcatggtggagagctcagacttccaggcacggtcgcaggggctggtctaaccatgttcccgccccctgctcgtcagaaccgcctgttgggagctgttatcatgataccatacctgggccctggctatccgattctgacttaattgctccaggttggggccaggccgttgtttgctgttttgtgtttcttctgtgacgttagccactgggctaatctgagcccctcagttacaggtggagaactgagacccatgggggtgcaaggacttgccgaggacccagagccccttgggggcagagcgaggcggggcctggctttgggtcccagagcttccagtccccttcccgctctcctaacagttttttttttgagacaagatctcaccctgtcacccaggctggagtgcaatggcatgatccggctcactgcaatcttcgctagctgcgttccagcgattctcctgcctcagcctcccgacagctgggattacaggtgtgtgccgccatgcccagctcgtttttttttgtacttttagtgagatagggtttcaccatgttggccaggctgatctcgaactcctgacctcaaatgatcccctgcctcggcctcccaaagtgctaggattacaggctgggatcacactgtgcctggcccagcagctttgtcctgtgccatccaacaacagatgaccgaagtctttgtttcttaacatgattccatctgccttacagttttgccacctgcaaaacagaggacttgtcgcttttctggtagctggaaatgtaatctggtagcaggaggcctgtggaagcttgcctttaatggccttgttctctttcatcctgtcctgagagccggagaacttggatgttgcacctaactcaaccttctgttaacatacagttctgcaggctcatggatcatcagaaccacgtcctatctcacgcggtgtatgcttccgttggttcaggtgtttttaccttgacagtattttctcctcggtggctttgcggtggttgcttttaatcagcattgactcttcaagaaaaatatttagctgctacatccagaggagacagggtggaaagcatctgagacctgcaggctcagacttagaaccagaagtccctcagagttcatccggccctgacccagcgggaaatgagttcacagagaagcgggagactttgccccaggccctgccgttgctcataactgccccaggtccttacatttgctccaggcctgccccaggccctgcagttgctcataactgccccaggtccttatatttgctccaggtctgccccaggtcctgcagttgctctgtgtggtgggtgtgatctggagccctccgcccatgctgcacctggggcaggcattgctaattgatcccaggactccttcctgcggagcacgcctggttctccaggcagccgctgcctgtcagcctgcagtggttcgggagaggacacctgctgcctggtctgttccaaatcttgcttctcatcccagcacaggtagggggtgctatgggaagggatcctcagttggccctgtcactgctctatcagctggggacgtggcatcctagtgaaacatcatggccgggcgcggtggctcacgcctggaatcccagcactttgggaggctgagggggtggatcacttgaggtcagaagttcgagaccagcctggtcaacatggtgaaacccattctactaaaaatacaaaaattcgccaggtgtggtggcgggtacctgtaatccgagctaccgggaggctgaggcaggagaatcgcttgaacctgggaggtggagcttgcagtgagccgaatcttgccactgcactccagcctgggcaacagagtgagacgctgtctcaaaatctcaaaaaacaaacaaacaaaaaacaaacaaacaaagcgtcatttatccagcacccctggggaacatgctacctggtgttttatggtacctggcaaggtgcaggtgaagttgctgctcttgggcttgaacccgtcttgtttggggcagctcaggccccaggcagggtccgggttggctctcgtggtgtggccctggcccatccagacctatatttctgccgtcctgcaggtgatcaatgttgtgggacgaagaggcggaccctcctggaggacaagctcccgcacattttcgggttcacgcgctgggggacttcatctactggactgactggcagcgccgcagcatcgagcgggtgcacaggtcaaggccagccgggacgtcatcattgaccagctgcccgacctgatggggctcaaagtgtgaatgtggccaaggtcgtcggtgagtccggggggtcccaagccatggctcagccatcagacttgcatgaggaggaagtgacgggtccatgcctgggcataagtgttgagctcagggccccgacctggggaagggcaggacaggaaaggtgacagtatctggccaaggacagatggaagggaccaagggagctgattagggagtggttatggactaggaatgtcggtaacaatgttagaaagtgactaacatttgttgagcacctgctgtgtgcccggccctggccgggagcctcgtgcccacagtgaccccgtctgcaaatgtagttccttgccctactcgcactggggagaggacgcagagccgtgcaactcacaggtgccaagctcaggactccctcctgggtctgccgggctgggctgtgcttgttgcccctgtggcccacgcatgtgcaccttccacctgaaagcaggatcttcaggacgctccccgaggaggtcgttgtctggcacaatgatttgtctcttccgaaaaggtgacagagttacactggagagagcagcatccaggtgcggcagggacaggcctgggctcgcgggcagggactctgtgtcctgccggggtcccacactgcacctgcttgtcagggcactcagtcaatctttgctgatgaaggatgagaggacagaggacgtgatgcttgctgtgcattgcctgcagtcctgggtgagatgcccgggttgactctgctgcccgtcgggtggagtgatgtcagatccccggctttaaaatacgagggagctgggaattgagggagcaggttgggcagaaagcacagccccgtggaagcctggagctgaggcagtgtgggcgacccctggagagtgagtgcttccttcatggccttcatcgcaccctgcagtcctcatgtaggggatgccaccatgaatttagttttcccagcctcctttaaaaacgcgttcatgctggggccggggcaggcagtggctcacatctgaaatcccaccactttgggaggccgaggcgggtggatcatgagtcaggagatcgagaccatcctggctaacaaggtgaaaccccgtctctactaaaaatacaaaaattagccgggtgcggtggcgggcgcctgtagtcccagctactcgggaggctgaggcggagaatggcgtgaacccgggaagcggagcttgcagtgagccgagattgcgccactgcatccgcagtccggcctgggcgacagagcgagactccgtctcaaaaaaaaaaaaaaaagtaaaaaaaaaaaaaattagtctgggtgtggtatcacgcgcctataatctcactactcgagagctgaggcggagaattgcttgaacccaggaggtagaggttgtagtgagcccgtatcgtacactgccctccacctgggcaatagagcgagactctgtctcaaaaagaaaaaaaaaaaaaaacatttatgccaggtgtggtggctcatgcctgaaatcccagaactttggaagactgagcaggaggatcacttgagcccagaaatttgagagtgtcttccctgggcaacatagagagactcatctctaccagaaaaaaaaaaattagcccggcatggtggcatatccctgtggtcccgctacttagggggctgacgtggcaggatcacctgagtctggaggcagaggttgaagtgactgagatcatgccactgcactccagcctgggtgacagacagagaccctgtctcaaaaaaaaaaaaaaaaaaagcatttactatccaccatggaaggtgagactgacctgtgagtgattttcaaagaacaaaaaataaaccccagagataagacaaaagggtgcctccatgggggtgtatttaaagctgagaaattgggcttcttccccctcccctctcaccccgtggtttgctaaagagatgggaaaaaggattctttttttggctgaaatatttaacactaaattaaagccaatttaacagcactttggttgatgagtgaaattaacagactggccaaaaataaacgaacggttgtactatgtgaaaaagaggcagctttggccatgctgggccaatgtgagttttcagggtgctgggaatgtctgtgaatcggaggaagggcctagctgggactctcaggagccaaggcctgaggggcaacttgcctggtccctgccctgaggcgttcactgctttcttcctgggccagtcacaggcccggaggctggaccactgggctggcactcttgccgagctgctccctgacttctgaccatgctcctttcagcagccttgctgcactttagtttccttgaatgaaaaatgggatgagaatagctcctacctccaaggtgaatggagtgagttcggacaggtgactccctggaccagtgcctggcgcctgacaaggtccagtcagagcccgcactgctgttactgataccctggctgtaccaggggagaacttggttgccattgccaggtgttctcccaccacccccactctgtccctgtttgatgtgtggcgggaataaagctgtgcacattggagcttttggcacatctggctttcaggtgaaaggtgcgtgtgtgtttgagggtttagcctggccaacccagccagaggtcggacctgacctgggggtgagtcctgagctcggcacccctgagctgtgtggctccggcagcattcattgtgtggcttggccgcacccctttccctgctgggctgttgatgtttgactggagcctctgtgttcgcttccaggaaccaacccgtgtgcggacaggaacgggggggcagccacctgtgcttcttcacaccccacgcaacccggtgtggctgccccatcggcctgagctgctgagtgacatgaagacctgcatcgtgcctgaggccttcttggtcttcaccagcgagccgccatccacaggatctccctcgagaccaataacaacgacgtggccatcccgctccgggcgtcaaggaggcctcagccctggactttgatgtgtccaacaaccacatctactggcagacgtcagcctgaaggtagcgtgggccagaacgtgcacacaggcagcctttatgggaaaccttgcctctgttcctgcctcaaaggcttcagacacttttcttaaagcactatcgtattattgtaacgcagttcaagctaatcaaatatgagcaagcctatttaaaaaaaaaaaagtgattataatgagcaagtccggtagacacacataagggcttttgtgaaatgcttgtgtgatgtgaaatatttgttgtccgttgagcttgacttcagacaccccacccactcccttgtcgtgcccgtttgctcagcagactctttcttcatttatagtgcaaatgtaaacatccaggaaaatacaggaagactttttttttttttttttgagacagagtcttactctgttgcccaggtggagtaccgtagcgtgagctcagctcactgcaacctccgcctcccaggttcaagcgatcttctgcctcagcctcctgagtagctgggactacagacatgcaccaccacacccagctattttttttatatttttagtagagacagggtttcatcatgttggccaggctggtcttgaatcctgacctcaggtgatctgcccgcctcggcactcccaaagtgctgagataacaggtgtagccaccgttcccggcactaggaaaacttttgccttctaaagaagagtttagcaaactatctgtgggctggccttctgattctgtaaagaaagtttgattggtggctgggtgcggtggtcacacctgtaatcccagcactttgggaggccgaggtgggcagatcacctgaggtcggggttcgagaccagcctcacccacgtggagaaaccccgtctctactaaaaataccaaaaaaaaattaaccgggcatggcggcgcctgcctgtaatcgcagctactcaggaggctgaagcagagaattgcttgaacctgggaggcggaggttgtggtgagctgagatggcaccattgcacccagcctgggcaacaaaagtgaaactccgtctcagaaaaaaaaaagtttgattggtgtaccaaagcgcatttgtttatggattgtctgtggcagcttttgttctgccgagatgagttggacagatctgtatgggctctaaagcctaaaacatgtgccatccgcccctttacagaaaagtgtgctgacctctgttctaaagtattggacaactacaatgtttgctcatttattattcatgatttgttttctgctttttgttgttgttgttgttgttgagatagggtttccc

SEQ ID NO: 5049 - DNA, 24742 bp, Homo sapiens
gcagttacccccatgctgctgttctcattattgtgagtgagttctcatgagatctgatgttttataagtgccaggcatttcctctgcttgcacctctccttcctgctaccatgtgaagaggacatgtctgcttccccttccaccatgattgtaagtttcctgaggcctccccagcctgcagaacagtgagtcaattaaacctcttttttgttgttgttgttgttttgttttgtttttttttaaataaactaccaagtcttgggtatttcttcattgaggtgtgagaatgggctagacaccttttctatattacaccatgctcttccacggtatgaatgaataagcttggattcatggccaaactgggagtcagaacaaagagggaaaaccctcttgcctgcaatgaaccatccttgcctatttattcatgaataaatagacaaaaaggatttttctacctcaggaaaaaacaagtgtttactgcaacaagacttcctttcaaatccacttgctatgactctgtccttctctttgcttgaactagggtacatgaatctcaatgtaatatagggatgtagaaaagtataagaaagccccagaataatcaatagacctctagtaagatagtcacattgctcaatatgcaaagtgacaaatactctaagatactcactacatgttaaaaataaatacagatatattgttcaggatgtattcatcaactacttaactatgtatctacccatgcatttaataactgtgagcatataccaggcctccattctcatggagtttgtattctactggtagaggcagataataaagaatgagaaattcaaagtaatttaaaaaataacacaggaaaggtcatagacattttggtctgggaggagatggcactatgtaggctgattacctgtgagggtgcactcactcacctcttgacttgtgaagaacatactgaaatgtacagggtgtttgggaggaaaataatgagatgcacgggcagtacttaatgtgaagacctcaccatagagacaggaattaagtcacctggagccagagaataccctttatgcctttgcttaaaagcaccattttctgtactatataccacaagacattggtccatggcacattaatggattctggactggtaatgggtgtccaaggataaaaggggttgaatgggtcaaaaagttgggaaacattgagtactctatctcctttcatagatgcaaataaacattagtctaatacatgttctaaggagtccttagaaaataaatctgtttttcctgtttaactatttgtttcttttacttacctgaacagagcttttttttcttcctagtaaaaactgttgttgtatataaggtaccactgattataaggtgtaccattactttatttgccctaagaaagaaaaaaaactctgccaattataattgtactatattgtcaattatatgagaccattctgctttgagaggtgttgacatgaaaaaaacatgaaacttaaaaacttgagatgttggatggaatgaggtttggtttttagatatgtcaggttaatgggaccttttttaaaatactatgcaatggaaattataggattctaaggttgtggcataaatacaacctgctgatcacagaattttgtgttcctcttccacagtatagtattggtgctgtgaagtggtgctcaccataagtgtgtgtgtgtgtttaagttttgggtagggggaagagccttgaagcttagaagatgagatcccttgcaacttggtattgtgttgggtctagttttggtcaaatgcaatgagagcgagataatgcatgtcacttctgagcagaggtagttaaatacatgatatcatcccctacttcttcacattctgcagtaaacttggaggctgcatgttgaatatgaaagtataatgaaataaagaagcctagaaccaggaatcatacctggggtaatccaatcagaaatatcctcattggtgtttcatgagccaggaaaacttttattaagtcacaataaaatctggaagtttatacacaattagcttagtctaacacttgtcagttttgtgcatatttcttacagcatatgcattactgccaaataaaagcaaacacttctaggtccctggcgaatatgggattcctccattgacgactgattatgggtcctgagttgaacttgctctgcatgaaggatgtaggcgatcaagtgcttgttttgcctctggccaaatctctaccactatgcttaagatgcgattaattatgtacacaaacccccatgacacacgtttacctatgtaacaaacctgctcatcctgcacatgtactctgaatgtaaaaataaaagtaaaaaaaaagaaaacaagaggtggttattattctactggggagaaattataggcccataatggtaactaatcaccacggtcttacctcattataatatgcatcggtaagttcatcaacataagcaagttagatctgataaccaaggggcttacagttctaatttgtatttgacacatggtctgccttctggaagagcagcatagaacctagatgttttgattaaggtcagtaaatgattgagtgttaatcccattcatttcccaggaaaaggaacctctttacaagtcaccaccagggattctccaatcacacataggaaaaatttccaggaaacttctataaaacacatgtattaacatctccgaaaacatagttgaaaggacttccctggcccttttccttagttcctcatctagactatcaagcggtttcctctccaaatgatgggaaaaagtgcatttgtctattacacacttgtattactctattcacttaagcactgtgtcccataatggggtctagttatgtctggcttgaaatgacccacatatttgtttctcattcttagaagtggagtgtttctgtatgtgtatatgtgatgggggtaggccaggagattttttatctggcaatacccagcctgaaatcattattagcatgacatgagttaaacgtatttctattttgaaagatgttttcaacagcaggatgaagaatcaattggaagagctggtacattgaaagagtgaatctagactttgggaggcttcttaaagtatattgaactagtctaggccgtgggattgttcaatagtaatggtagtagaaatggcgactgacattttggaattattttacagataaatttctacaacttggtggaacattttttaaaatgtaggttttattattcggctatggtaaaacaacagatcagaagatgatgccactggaaatatagtttgttgtttacagttcctagaagcgggggcatgccacaccatgcagggccacattggtagcaccagagtccgtcaggagcagagggagcaagaggaaattataggcacaagcttttattgttgttactgcagaaaagcaaggcaaggcagggtaagcagggataggactggctagtttgaataacctcagtgggcttggggtagagggtctgtctctagttgtctggtacctggacctgtgatgattagggctgataacagtgtctacttgggtgtaaaagccaggtagaggaggtggttcagaggaagggctcggattgcttagtgtgcataaggcatgctccagagcaaatcttttgctattttttagaacaactagccctggtaagtgcagtctcttcccagatgccagaacatcaagaacacagaaaaaagacaattgggttaatacatgtttagcatgagaaatgaggaagtaagggaaataaagtaaagagatttccaccttggatgactatgtcaaagtgaaacaccattaactttccagggactaaactttattgagcacctactctgtgtcaggcactgctctaaaatctttacatgaatatctcaatactcagagcaaagctttgacatggaggttgtttttatcttaactctactgggtgttgatggagtctacaagagtttgtgcccagtccaccacaaaatggtccctcacagctggtttttgacacgttggattggaagtgcttggaggatattacagtagaactatctaggcttagcatacataatattcctgttttaaatcaggttcttatttaacagaaacttacattcacttgctactttccagacactgtcctaaaagctttacaaatgccagttcatttaatccaatacaatactttgagatacatattatcatcttcattctatccacattttcaatcctcacatagctctcatttatggaatgtaatgatgatgctctagactagacgttttacgtaagtagcttaattcagtaattcaaaacacatgcgattatcttcgttttaaagaccagaaaactaaggttggtaggtttgtataatttgactaccattgcgtatctttattttaatacatttttaaatgcaagcttctgctatgattaaaagtgattaccacattttacagaccagaaagtataataagtgttggtgaagatgtgaaaaaatgagaactcctgtacaccatttgtgggaattaaaatggtacagatgctgtggagaatcatatggtgggtgctcaaaaaattaaaaatagtttaccacatgatccagcaatctcacttctgagtacgtatccaaaagaattgaaaacaggactttaagagatatttgtacaaccatgtttatggcagcattattcacaatagctaacggtggcaacaatgcaagtgtccatgaacagacaaatggataagcaaaatgtggtctatactacaatggaatattgttcagctttaaaaaggaaggaggctttgatctatactacacagaaagaaccttgaggacattatgcaaagtgaaataagccagtgacaaaaagatacatactgatgattccacttctaagagctgcctagagtagtcaagattatagagacaaaagtagtgctagattcaagggcctagggaaaggggaaatggggagttatttattaatgaatagtggtgtgattgtacaaaaatatgaacataattaatgccactaaattgtacacatacaaatggtcagataataaattttatgttatgtcatgttatgttatgtgattttaccataatacagaaatgaaaaaagaaaagaaagaaagtaaagcttagcggtttacatgacttgaccaatgcctcaagccatgagtcacccagctgagatctgaacttcagtatattccattctgaaatcccagcttttcccaatcttcttgtacttttcaaactgtgtttcagttgaggtttattttcagtttgtatgtgagtttcttcacaagaaggggcgggccaaattgtgtcctgcaaaaacctacaatcgaagtcctaacccctctacctcagactatgactgtatatggagagagagccttgaagaggtatgtaaggtagaatgaggtcattatggtgggccctaatccaacataactggtgtcttataagaaggggagattagaattcagacacacttgctgacaccttgagttcagactgaagcctctagaattgtgagaaaatgaatgtctgttgtttaagccacccagtctgtggtattccttatggcagccccagcaaactaatacaaatagtgtttccacagctgaaacaaaatggaaaatcaccgtcatcctagagagttacaagggctattttaatagaacctgattgtttcctaaattcaccaagcccaggcagaggtcagatgactaattgggataaaagccaactagttcctcttgctgtttctttagccactggtctgcaggcgttttcttcttctaacttcctccctgtgacaaaagagataactattagagaaacaaaagtccagaatgctaaggttgccgcttcacttcctctcaccctttagcccagaactgctttgaatacaccaattgctgtggggcgctcgaggaagagaagacaccagtgcctcagaaactgctcggtcagacggtgatagcgaccacgcattcacagggccactgctgctcacagaagcagtgaggatgatgccaggatgattctgcctcgcgcctggctgggactctgatcccagccatggccttcctctcctgcgtgagccagaaagctgggagccctgcgtggaggtatgtggctggagtcagctcctctgaactttcctcacttctgcccagaacttctcactgtgtgccctggtttgtttatttttgcaaaaaaaaaagagttaaattaccttaaagactcaagaagccacagagatcaaataattcattgttcagggcactagaggcagccattgggggtttgttccatttggaaattttgagtgctaacagggcatgagataacatagatctgcttaaggtccctgctctgctaccttgtggctctgtgagaaattatcaaacctgtctgagactagttttcgcatctgtaagagaattataatacctcttcactagagagtaagcagactgcttcagtgtcatttcttcccactggtggtctttacctcagcttcaagcagtcaccctgctcctttcaatctcaggaaaaagatggcttttgtgttgtgtctctagagaaagaactttctaagtgggtgtcagacttctgtatgcagtaatatatttagtccagaggatgaaaaaaataagagaatgaaaaaggaaaagagagagagagagaaaaaaaagcaagagggaaatatgtataatgtcagctaatgcaacagtttctttcttagtgaataccaatcagctggttggtaatcttattcatgatggatctcttttgtttttcccctggcagacttcacagttgctttagaaacccatagtagagccgaacagctaagaaaatgattacagtgaggcagggtcagaaactcaagagagaaaaagccagctgcagtcctgaagttgagatataggagaaaatcaagtaatatttagcaaagactaattcattatcttgaagccatccttccctcaattccctgcccatagtcctcctccttgtcctcttctctgtatccctctgcgttaggttaatggagatagattttctaattaggctcactgcgagataaaaccacagccaacttgacttcttttccccatgtaccttttcctgtcagtccctgaagcctgtccatccctcccatccccttagttccactgtaaggcaggccctcatttcccctggcattgactcttaccactaactgctttcctgattccagtcttcttcctttaactcattctgcacgttcttgttgttatgtacttgcatttgttgttattatttttccttaggcttcaatctaacaaattacttccttaaaaacttttaataactctccattgccattagaacagctttctaccacagggccttgcactggctatttcttctacctagaatgctagatcagtgctatccattggcaatatttgtgagccacatatgtacttttaaagtttttagtagcctcattaaaaaaagaaacaagtaatttaatttcgataatagttttatttaacttagcgtatttaaaataatgtttaaaatttaatatatatttacctattattgatatttttacattccttgtttggtactaagtctggatttagtatatattttacatttaccacacttctcaatttacactattcacatttcttgtgttgataactgtgtatggctagtgactaccgtattggtcagtgcagcccaagtccttttctgctttaatcactccattcagatctctgattaaatgtcccctcctcagggcagtcttcctgattgccccatgtagagctctccagcctcacttatttgcctcaaatccccttatactgttaatatttttttttctagagcacaacattttatatttttgtttgtttattttctctcttccctttgtaatggaatcggtaaggaggcaggatcattgctggttttatttaccactattttccagtggccagcacacagtagccgctagatgtgtaagtgataaatgattgaaataatgctgcaggacaaagtctgaggccctcctgatctggcttgccctcttacttagatttcacactcccaccactcaccagctaatctgagtttgttttccactctttacgtgctcacgtttcctctccttaggacatgtttttcttcccctttccacatatctaaaccttactcatcttcaagacccactttaaaatcttccttttctgggaagcctttcctgaatccagacttgatcctgctttctctgaaccacagggcatattttctaagcctattttatggccccttgagatatgttagctttgctcctatctaaactcttactctagactgtgagtccattgaagtctggactgcatcatatttttctttgtaatgcccacagcacttggcaggaaatgcctacaatttgacttaagtaaaccttcatttaatcagttattcaatcagttagtgattcagcaaatatttttgagcaccaaccatttgccagacaccattctgagtgctggagacaaagcagtgggcaacccatcaaacttgcaatggaatacaggagatgaacaatacgatgagaacaatcagatagcaacataatgttagatggttgtgcttcctgtgaaagggaataaaagagggcaaagaaaggtgcctggcactgtttctattagacaatattgtctttgaggctccatggcttgcaacattaagcagacatacgaatgaagatctgcatgtttgaactctgactttgcgcatattacttatttctttgaatttccattttcctcatctttaaatgcttatttgaagattaagtgaaagatataacaaacaagaactatgcaggcgtatggtaagggattaatgatagatgataataataatgttgacatctattgatcacttatactgtagcgggcttttaaataaactctttaaaaccttatctcatttaatccttcaaacattctattggtttcaaacaacagaaaactacaatagctggcttctgcaaggaattttgttggaggaaatgagagcattcagaaattagatggagcgttagagaattaggcttacaaagaatgtgggaaagtaggctagaaagcagtgtaaaacaaagacagcataaagcacttgaccttatttactaggttccaccatgggaatccatgcctctaaagatttccccctatttctacatcactttgctcaagggtcaatgagccaaggaaagaatgcagttgtcaaaatctgggccatgactaaggaaggtctggacatcttgactgccgacagtctccccaatgatatggagtatttagaatgatactggatattttatttatttttgtattttcaacttttaagttcagaggcacatgtgcagagcatgcaggtttattacataataaatgtgtgccatggtgatttgctgcatagatcatgaaaatatggaacgcatcatggattgtgtgtcatccttgtgcaggggccatgctcatcttctctgtatccttccaattttagatatgtgctactgcagcaagcacgatattggatattttattacctacattttacatatgtaaaatgaggctcactgaggtttttcttttgttcgttttattttgttttgtttttaaagcttggccctaaaccacacagaagagctggcatgaaacccagagctttcagactccggagctcagcccttcaccccgattccattgcttcttgctaaatgctgccgttttatcacggagttagaatgctgagcacgtagtaggtgctctttactttctaatctagagtaagacaattttaagcatgaattgagtgaatggatggatggatatatggatggaaggatggacagatggagaaaggttgactgaattttgtgcttgcacaaaaagaggcccctctccaccatctctggttaggagaggggagttgggagaccatgcagtaaagatacttcatgtcatgtgtaatcattcaggtggttcctaatattacttatcaatgcatggagctgaatttctacaaaatccccgaaacctccccttctcaaccaagaacctggacctgagctttaatcccctgaggcatttaggagctatagcttcttcagtttcccagaactgcaggtgctggatttatccaggtaatgaatcacttttacatactgcacaaggtgaggtgttcattgtcctatcatttcattattggactgaaagcttggtttgtggagtctcatcttcattcacttattcattcatacaacagatgtctattaactatataaccttgagcaagctacctctattctccaggtctcagttttctaatcgtgaagtaggcagttggctgagacagcttctaagggcaattctaattttaggttttctttaagacaggagagaaaattagcttaaattctttcataagcagctatttattgactacttctatatgttgtacactctgcaagaagacaggcatatattgatatataacacacagccccgttgttaaggaggcatatcttcttgaaagagttaataccttaaagtcctgggtatggtctgggtacatagtatatagtcaacacattttaattatgattttttggatctggaaactgaataaagatagcgacatataacagtaggtgataaattatgtttaaactaaaggtaactaatgtatttttcagaagaggggccttctctgtggtgggtagtcaagaaagatttcatgaacgcataagattcaaacaatgtctagaatattaaaactagtgtacaggatagggaattaggaaagacaagtaacccaaggagaaagatgtcaagattaaaggaaaacatctgctgtgggcgggaataatggctaagattttcttttctgatgcagggaagtatatcgtttgttgtggcagtgaaatgtcatcttgatattttaggggaaccaaattctaaaagggttttcatcatcgggccttatttgcaaatcgaactagataatggatcatgttctctgcaatggtttgtaaaactttcaaaacattttacatattttttattatagaaattattgataaagactaaggtcacatataaaaatcctttttagagcagacatttctgtagaagagtgaacatatgacctattatctctaatttggatatagataggatgtaacaaaggagtaatggaacaattcaaaggcagtgtatagtgcatagagtcctgttggggtcagaagacctgagccaagtttacccccaacattataaccatgtaaccttaggcatattacttcatctcccttaatcttagttttcatatctatcaatggaaatgatgaaacttattctgctggattaaatgtgataataaatattaatatctgtatatatttaaatttttataaaatatattttataagcataaagtattcttacagaattcattaggtttttaaaataatttcaacttttatttttgattcagggatttacatggtttattgcgtaatgctgaggtgtagggtacaatcgataccatcactcaggtagtgagcatatacccaatagttagtttttcaacccttgctgctttctctctatcccctctctagtaatcccagggtctatttttgtcatctttatgtccatgtgtactccatgtttggatcctacttaaaagtgagaactcatggtatttggctttctgttcctttgttaatttgcttaggataatgctactagctgcatctatgccattatgttctaaatttcagtttcctgcatgaaaattttgcaagtactctattaaggtagaccacctctccctttttttttttttcaaacaagaagtagttttcaccaaacaatgtctcttatgtaattcatcttcaatccactggatacccaataaattgccccagaaaccttaaatctgtgcttacagagaggccagcttcccttcttgttaaccataggagattctgaattagggcaagcacaaaagatagcacaatagacatcctttgcctttcgtacagtgttcacatacagtaactcaactagtcttgtaagaatgctttgtgatagacaggcagccttctttcccctatagaaatatatatatatttctttttataggtgaggaaacgaagcttgaataatttaaatgacttatatacattatcattgcttgttagccacagaccaagatttaagttcacatctccagaatccaacttaaatgttttctttgtcttaatactctattctctaaagtgattatcaccaatgtaatgatatagagacacagcaagaccctttcctttcacctaatgtatagagcaatgcagagatagaatgatgggctataacaatcatataattaaagaaagaacttcaaaaataatcaagttcagctgtttgatttataaatgtgataactaaacctagagaggaaaagaggtactcaagatcacacagtaggagaggactgcagaaacacaaacccaagctcttttgtccactcttccagcgttctttctactatactgcctatccttttctagttaccaataaataacaaaagcttggaccacaatgcttttattgtctaggaaactctgaagaagctaaataaaatgggtggggaatattgtaaatgtaattcaggctggattaaaaagaacttatttgtacattgtaactgacaagcacctgcaatgctgaaaggaatttttcttggcttgctgtttgctggctgcatcaaagccctgtctctaggacatgtctctgaacatgtgtgtagcatggctttcatttcttttaggataaaattcaaaaccctttatctggttggaaacctctgcctaattgggaaccttctttctccacaactccatattgtacactccaattcatctctgttctccaaccatggaagctatttgtcatgattcctccttgtgtcatttttttctgtcaaccttggggcttttgtgtttgctgttcacttcacctccttttattgttaactctactcatctttcaattttcaacttaagtgttctcagagaaacctactttgattttcttgtccacaacggttctctggatgtgaactcttatagcacataattttcacttttttccacaaactcgctcctatcacctgttacaagcatttacctctgataacaagaactttcaaatactagctgtcatgtaagcacttttcataaacattaagagtatctgtgacacttatgtgtatgtttcgtatctctgaaattgatatttaccagtcatttatcttggctaccaactaacaatatccatattatctgtaccaatcagatgtataatcacaattttgtgtgacagaaaatggtaaacttgatccaaggctattacatgctttatcaactgcacaatctttatatatgtcaatattgatctttaactgatttccttcttatggattttctcctctgcttatcatgtatgccaacatgacaaaaaagagcctatcattgcagccagtatgataatactcagtctgtggggctcttatttgcttattccatcatcatctgtcctgcttgatgtctttgcctatgcacaatctatgacccatcacatctgtatgaagagctggatgactaggattaatattctattttaggtcttattcagcagaaatattagataatcaatgtctttttattcctgtaggtgtgaaatcagacaattgaagatggggcatatcagagcctaagccacctctctaccttaatattgacagaaaccccatccagagtttagccctgggagccttttctggactatcaagtttacagaagtggtggctgtggagacaaatctagcatctctagagaacttccccattggacatctcaaactttgaaagaacttaatgtggctcacaatcttatccaatctttcaaattacctgagtattttctaatctgaccaatctagagcacttggacctttccagcaacaagattcaaagtattattgcacagacttgcgggttctacatcaaatgcccctactcaatctctctttagacctgccctgaaccctatgaactttatccaaccaggtgcatttaaagaaattaggcttcataagtgactttaagaaataattttgatagtttaaatgtaatgaaaacttgtattcaaggtctgctggtttagaagtccatcgtttggttctgggagaatttagaaatgaaggaaacttggaaagtttgacaaatctgctctagagggcctgtgcaatttgaccattgaagaattccgattacatacttagactactacctcgatgatattattgacttatttaattgtttgacaaatgttcttcattttccctggtgagtgtgactattgaaagggtaaaagacttttcttataatttcgatggcaacatttagaattagttaactgtaaatttggacagtttcccacattgaaactcaatctctcaaaaggcttactttcacttccaacaaaggtgggaatgctttttcagaagttatctaccaagccttgagtttctagatctcagtagaaatggcttgagtttcaaaggttgcgttctcaaagtgattttgggacaaccagcctaaagtatttagatctgagcttcaatggtttattaccatgagttcaaacttcttgggcttagaacaactagaacatctggatttccagattccaatttgaaacaaatgagtgagttttcagtattcctatcactcagaaacctcattaccttgacatttctcatactcacaccagagttgctttcaatggcatcttcaatggcttgccagtctcgaagtcttgaaaatggctggcaattctttccaggaaaacttccttccagattcttcacagagctgagaaacttgaccttcctggacctctctcagtgtcaactggagcagtgtctccaacagcatttaactcactctccagtcttcaggtactaaatatgagccacaacacttcttttcattggatacgtttccttataagtgtctgaactccctccaggttcttgatacagtctcaatcacataatgacttccaaaaaacaggaactacagcattttccaagtagttagctttcttaaatcttactcagaatgactttgcttgtacttgtgaacaccagagtttctgcaatggatcaaggaccagaggcagctcttggtggaagttgaacgaatggaatgtgcacaccttcagataagcagggcatgcctgtgctgagtttgaatatcacctgtcagatgaatagaccatcattggtgtgtcggtcctcagtgtgcttgtagtatctgttgtagcagttctgtctataagttctattttcacctgatgcttcttgctggctgcataaagtatggtagaggtaaaacatctatgatgcctttgttatctactcaagccaggatgaggactgggtaaggaatagctagtaaagaatttagaagaaggggtgcctccatttcagctctgccttcactacagaactttattcccggtgtggccattgctgccaacatcatccatgaaggtttccataaaagcgaaaggtgattgttgtggtgtcccagcacttcatccagagccgctggtgtatctttgaaatgagattgctcagacctggcagtttctgagcagtcgtgctggtatcatcttcattgtctgcagaaggtggagaagaccctgctcaggcagcaggtggagctgtaccgccttctcagcggaacacttacctggagtgggaggacagtgtcctggggcggcacatcttctggagacgatcagaaaagccctgctggatggtaaatcatggaatccagaaggaacagtgggtacaggagcaattggcaggaagcaacatctatctgaagaggaaaaataaaaacctcctgaggcattcttgcccagctgggtccaacacttgttcagttaataagtattaaatgctgccacatgtcggccttatgctaagggtgagtaattccatggtgcactagatatgcagggctgctaatctaaggagcttccagtgcagagggaataaatgctagactaaaatacagagtcttccaggtggcatttcaaccaactcagtcaaggaacccatgacaaagaaagtcatttcaactcttacccatcaagttgaataaagacagagaaaacagaaagagacattgttcttttcctgagtctttgaatggaaattgtattatgttatagccatcataaaaccattttggtagttttgactgactgggtgttcactttttcctttttgattgaatacaatttaaattctacttgatgactgcgtcgtcaaggggctcctgatgcaagatgccccttccattttaagtctgtctccttacagggttaaagtctagtggctaattcctaaggaaacctgattaacacatgctcacaaccatctggtcattctcgagcatgttctattttttaactaatcacccctgatatatttttattttatatatccagttttcatttttttacgtcttgcctataagctaatatcataaataaggtttttaagacgtgcttcaaatatccatattaaccactatttttcaaggaagtatggaaaagacactctgtcactttgtcactcgatgtcattccaaagttattgcctactaagtaatgacgtcatgaaagcagcattgaaataatttgtttaaagggggcactcttttaaacgggaagaaatttccgcttcctggtcttatcatggacaatttgggctagaggcaggaaggaagtgggtgacctcaggaggtcaccttttcttgattccagaaacatatgggctgataaacccgggggacctcatgaaatgagttgcagcagaagtttatttttttcagaacaagtgatgtttgatgacctctgaatctctttagggagacacagatggctgggatccctcccctgtacccttctactgccaggagaactacgtgtgaaggtattcaaggcagggagtatacattgctgtttccgttgggcaatgctccttgaccacattttgggaagagtggatgttatcattgagaaaacatgtgtctggaattaatggggttcttataaagaaggttcccagaaaagaatgttcatccacctcctcagaaacagaacattcaagaaaaggacaatcaggatgtcatcagggaaatgaaataaaaaccacaatgagatatcaccttataccaggtagaatggctactataaaaaaatgagtgtcatcaaggatatagagaaattggaacccttcttcactgctggagggaatggaaatggtgtagccgttatgaaaaacagtacggaggtttctcaaaaattaaaaatagaactgcatatgatccagcaatctcacttctgtatatatacccaaaataattgaaatcagaatttcagaaaatatttacactcccatgttcattgtggcactcttcacaatcactgtttccaaagtatggaaacaacccaaatttccattgaaaaataaatggacaaagaaaatgtgcatatactacaatgggatattattcagcctaaaaaaagggggaatcctgttatttatgacaacatgataaacccggaggccattatgctatgtaaaatgagcaagtaacagaaagacaaatactgctgatttcatttatatgaggttctaaaatagtcaaactcatagaagcagagaatagaacgtggttcctagggaaaaggaggaagggagaaatgaggaaatagggagttgtctaattggataaaattatagtatgcaagatgaattagctctaaagatcagctgtatagcagagttcgataatgaacaatactgtattatgcacttaacattttgttaagagggtacctctcatgttagtgttcttaccatatacatatacacaaggaagcttttggaggtgatggatatatttataccttgattgtggtgatggtttgacaggtatgtgactatgtctaaactcatcaaattgttacattaaatatatgcagttttataatatcaattatgtctgaatgaagctataaaaaagaaagacaacaaaattcagttgtcaaaactggaaatatgaccacagtcagaagtgtttgtactgagtgtttcagagtgtgtttggtttgagcaggtctagggtgattgaacatccctggtgtgtttccatgtctcatgtactagtgaaagtagatgtgtgcatttgtgcacatatcccatgtatccctatcagggctgtgtgtatttgaaagtgtgtgtgtccgcatgatcatatcttatagaagagagtgtgattatatttcttgaagaatacatccatttgaaatggatgtctaggctgtttgagatgagttctctactcttgtgcttgtacagtagtctccccttatccctttgcttggtggatacgttcttagaccccaagtggatctctgagaccgcagatggtaccaacctcatatatgcaatattttttcctatacataaatacctaagataaagttcatcttctgattaggcacagtaagagattaacaataactaacaataaaattgaatagttataataataattgtaataaaagttatgtgaatgtgatctctttctttctctctctcaaaatatcttacgtactgtactcacctattttcagaccataactgaccatgaaacctgggaaagtgaaacttggataagtgaggaactaacatacatacatgattgtttatctacagatgtatgcctcagttcttagtatgcttgaaaatgtatgattttgtgtatatccgtgctacatgtaagtgtggtctattcatatttgaatatgaattctgcataagtgtgtttattcaagcaaatgtacaagctctgagaaggaagatcaacatacaacttggaatatttcaaggccgaaatattcaaggcgacattggcctccttcctatcagttccctctcccagatggaaattctagaaatggcagggaggtggacaagcagggaaagaaattatatgcatagaacagaaggagaagaaagagtaagtcaggcctcagccagcctctttttagctctttaaatcctctggatttaagagggataagggtggaataaggataaattaatgccaattgtaatgccttaaatttgtgtgataccttaaacttgaaacatattcacaaaactatatatttgaatatctcattagctgagtaaggtagaaatcataattaactttttccattttattgatgggaaagctgaagttcaatgaagtaaattttcaatagcccacagagtaggaaagtgacaaaacctgagcctgggcctccaggtcaccaaggacactttctttcttccacacccaattgcttcatgcttaaagttggcaaaacaggagtgaaactcctgcagttttctgtgtggttgacactagcaagggtttctcagttgaagcatgaatcattaagccaatacatatgcatatatgttatacataccaaatgatttatttataccctatctttccataaaggacttgaaggagcttcaaacaaaggatatgtgaacaataggttaatcaataataagtagaaaatctggacatagaataaaaagaggagagaaagacaccagaatgagcgttaatacagtgctttccatttttctggtgttttgagtagcgtggcttttgagaaagccaaaactcaaattcactccttatcaactgtgtgccttgggctccatttctcgagagtctacttagctccaatgtaaaataagaatagaactatgactttgtaaggttgcttaaggattgaaaatcatgtattatgttcaatacggggacactgtccttatgggtgagtatcccctaagactttattaagagggcactaggagaagcactgggaggtcttctcagtaacacactaaagtaattgctatttttccagcctgtggaaccacagaagtgactgtaactaaattagacatttctttctgattcattctctactcacgggattgtcagaccccagtcttctttggactctataaactttttagaaatcatcagcaggctcctggagaagcttaaatgaactacacaatatgtgacagtgaactccctgggagagtgaaaaccaaagtctaagccagtgtcccatttacttgtgtgattgtgggcaagtcattcaagtgctttgaggctcaggtcttaatcatgaaatggaggtaataataccttgttggcagacctcacttggttaaaatgataatgtgatagttacaatagttacatttaattgatcaattgttttatgcaagggctttatttgtgtatctcagtttgtcacatcaatgaattagaaagatacgaaagtatttccaatttacaaagaggagtctgagtctgggagtcattctgtcatgtgtccactgtcacctgctcattggtgcagcactgagattaggatctaagtccacttcaccgcagaagcagggcttctaaatactgtctatggcaagagcaccctgctctcacaaaatgcataaaacttcctatctcaccattatattttgactgatattaaacaaagagaagtattattattattacttgtttttatttatatacagctgtaagagccaggaaaaatgtgatctaagttatgtgatcaaagattttttaacatgaacaaatcaggcccactagatgatggcctttctttgaacaacatgcctagggttgcttatcatgtctacagttggtctgacttcctgacgggcatcacagacttgtgattaaacacgaggttatgggggaagttccaaaagcttaggactttccagatggttggaataagatcaccactctggctgcccttatggagatcaccgaacttttcaactcaaagtaaaatctgtggataaatggtcgatcaaaaggaaccaactatattgagcaccatgcgtgatcatctgatcgtactgctaccttgtgagttaaaggctactcttctcattttagaaatgagaaaagagatgccagagaggacgagtaacttgccttaggtcacacagcttatattaatcacaataacatttccgcaccttctgtattttttttaagttgctaagcttttggtgcatgtctggcaccgtttagttgtatattatttcatttaattgttaaaatgaccttctgatgcaggtatttgtagcttgccattccacagatgaagaaacagatgaaaggactgaattgttcaataggaaggagcaaatcaggatatgaacttgggttggcctgattcttggggctgcattctttccataacatattgcttgctgtgatgtcctgggctactctgccaggggtggttagtggagtgaatggagataatttagacaaggtcagtaactcccatgccatctagaaattaaaagtttaaaaggcaggtctgcaactctccttgatttctacagaaataaagatgatccctcctgtgacagtgctagtgacaattctgagtgtaaatgcgctttttggcacaaattgtcctgtcctaatagtcttattataattataaaataatgggtttctgaaaggctgcaagcagttctgggaatggcaataaggtttagaaatgacgtgatgtttatgagagaagtgttttgttgaaaattaaactcactttaggagaaaggattgtgttgtatgctcctaggaaactatctcactatgtaattaaataaaaccagccagttaccaatttgagctcttgactcatactaacaacaccccatttcccagggccaagcaaggcaggactgacctgaaataacccagcctgactctatccacagccacccaggaccttgcccctccgtcttcctagggctcggccgtgagatgctagtgcatgaccctcctcttcctgggactgtccttgtctttccctttggactctgggaggtctgttctcctcccagaaaggaataaacactctttctatttgtgggattccctaggagacactatataaaaaatagagttaaaaaaactatttaaaaaaaagacaacttcatgtctctactctgacttcatctttttaagatgggtaacaaagactctcttcaaggttagaaaattttattttaattttttagatttagagagtgcaaatgcagttttgttacatgaatatattgcataatggtttagttgggctgttagcgtaaccatcaactgaacagtgtactttgtacctattaggtactttctatcccttaaccccttcccacctttctgagtcctcaatgtctgttatttcattctccatgccatgtctacaaattatttagtttccactcataagtgagagcatggatggaactggagagagtattttctatcccaagatcggttccttgatcttgtgtctccaaatcacttgctctcctcttacatcttttctatcttcttctagcctctttttgcaaacttcattttgacaaagattccaggcagtctacagctgattttatttcaatacaacgattaaaatggaaaccatatagaagatgacaaagttgagcaggtcccaaactctcacttttaaacaaatgcttggcttaaaatcacttaatgactttcattctgctatctatgtgtctgtgtatctaggtactaattattatctttatgatctttattgctagaaattctggttcaatatcagaggttagtcctaaggatttatattttaaaatattctcccagttttcgtgcacagacagatttgggaattactgtataatggaaaatggagaataaccacccacatttaatatggttattggttttgttcttgaatttattgctaagattcatgatagcccaggcaaggtcagataatgtatttttattttacctgtatagttgattcttctcaatcccactagatcagactctttgggatactaggattggctatttgatggtgagctcactacatccatttagatgttgtgtccatgcaatcattttagtctcctagtttctacctatcacgttgtcattttcccttctttatcatcctgggtagctggaccccacataaatatataccagaaaaatgttgtggtcttttctaaactctctgaggcactgttgtcaatgtgatgttgttttttgtttccagtccaaaatatatcaaagtaaaatttactccacttttgctaagtattcatcttgccttgagtactaagattccaaaaatgactttccctctgaaaaacacaggatttccttgcgaaaacttgctgggccactgccaatcttcccgaaactcctttttccttatcgttgaggggaattggggaagtgatcactgacggttgaaatcagtagttttggtctttaagctgagaccctgagtcttctgaggagtctactgctccccgtgggaaacacctgctgtcaaaattttcctgcttgcaaagagcacttttgaaattaatgcaggggatgaatatctggctagtgctgtgctcagctgagttattaatagggccttctgatcctctctacacatcatctttggctgaattagctgtggtttcagcacctgagagtctagaccactaaaggcagggaatacctttgccagtttctggcatattaacagctgagatcagaaagtgaacagcgatagaggtagtgaggtttaggattcaggtctgccaccgggagcgcactctgggctcaggtctctcatttgtaaaatgggacatttaggtcagatcagcattttcaaagtgtgacatgttagtaaataagatgattttatgtggttgacagatgaatgtattaccttagtggttatatgtttattttcatggttacttttatttataataaattttgtgactagcaagaatcaattatctctttaaaatatatttaagtttaaaatgtgggccaacttaggaaaaaacgggatgaaatgaattatataaaaggtatgcagatttggaaaaattttgaaggtgtacaagaaagattggcagtcagaaaggaatgaaccaaacggctgctgagggtcaggccagtctctgacattctagcatgttcacatctccagggctgtttccttacctataaattgtggaattggagtaaatgtccattccaggaattctattctatgattagaggtgtaacttcatctccagattttccagcatccttaacatgtggttttagcgttctaaacctgatgatgctattcaaaacgggagactcattcgtcaagtcatgatgtatccatgtatttataatatttccctgttccctcatttctgaaaaggattaagctatcaaccccattgagttataggtgaaaggtgtggaaacaagacattgata

SEQ ID NO: 5050 - DNA, 22751 bp, Homo sapiens
cacacactggggcctgttgcggggtggagggcaaggggagggagagctttaggacaaatcctaatgcacacagggcttaaaacctagatgatgggctgatgggtgcaggaaagcaccaggcacatgtatacctatgtaacaaacctgcatgttctgcacatgtatcccagaacttaaactttttttaaaaaaagaaacataaacattaaagcagaaatgaaaaaatagagactaaaaatacagaagatcaacaaaacaaagtgttagttttctgaaaagataaaatgaacaaacctttgctagactaagaaaacagagaagatcgaaatgaataaaatcaaagatgaaaatgaacattaccactgcgtattttttaatccatttttgacgcttcaacctttcctgtttcatgcgagatgagatcatcaccacatcctactctagtcaaataagaaaatctaatcttgagttaaaatttattaaaattctttaatgatagaatttcttttctatggacactgaaaaactctttctactgctatataccaaatatttatgtcccccaaaaattcatttgttgaaaccttatcccagtgtgatgctatttggagatagagactttgggaggtgattaggtcatggggctcgtccctcatgaatgggattagtgtccttataaaagagattctagagagctcccttgcctctcctccactagagaacacagcaaagatgggcatatgtgaagcacaaagcaggccctcaccggtactgaatttgttagcactttgatcttggacttcccagcctccagaattgtaagaaaaaatttctgttgttcataagctacccagtttatggtattttgttatagcatcccaaacaactaaaacaactatgtaccaagaaactgatattttagttcccaggactatgccatgggttaattcattcattcatcaaatatttatttagtgactactgaggaaaagaccctttaatgactgtggatacaacatataaaaaacaaagatcaattttaaggtctagtagaacacatagttagtggatgagacagaacaaaactttaaaatacgtgaagcaaaaaaaaaaaaaaaatacagataagtagacaagtaaaaataatatttaaacatttaaaaaccattctttcaataatgataattagaccaaaaaatcattaggacaatagaagatctgaacaaagctacaatcacctcacccaattgacatttatagaacactccattccaatagagcaaaacgcacattgttttaagtatatatggaacatttatcatgatgggaccatatactaggacatataacaagtattcatattttaaagtactaaaataatatagtatattttctggacacacagaaattaaattaaaatcagtaacaaaattgtatctggaaaatcctgaaatatttggaaattaagcaacttttttttttttttttttttgagacagagtcttgctctgttgtccagctatttttttgtatttagtagagacggggtttcaccatgttggccaggctggtctccaactcctggcctcaagtttccaccaaccctggcctcccaaagtgctgggattacaggtgtgagccactgcaccccgctaaacaacatacttttaagacatgagccaaaaacaattacctaacaaaatttgtggtagcaggaaaatagcacttgaagggaaatttatagcttcaaatagttatatgtgaaaagagctttcacttatgaagtcaagataataaaagcagttaaactcaaaataagtagaaaaagtaataaaatggatataaatctctagctagactgatcaaggaagacaaataaatacaacaaatcagaaaagaaagaatataactacaggtcttgcagacagtaaatacatagataataaagagtattattgttatgggttgaactatgtcctccaaaaatgtatgtttaaatcataaccccatacttgtgaacgtgaccttatttggtaacagggttgttttgcagatgtaatcatgtaacatgagatcattagggtgggccctaatccaatatgactagtgtccttattaaaagagaaaccacatgtgaaggcagagatacgcagggagaaattcatgtgatgacagagtcagaattgaggaagaagctgaaagtgcagtaacaccaggtactgacagccaccactggatgctagaagaggcaaggaaaactccatccagagtctcagaaagagagtggtcctgttaacacctaattttggactcctggcctccagaacagtgagagaataaatctctgttgttttaagccacaaatttctggtaccttgttacagtagccctaggaaactaatatgactatgaagaacaaatgccaataaatttgacaatgtagacaaatgaaacaagtttcttaaaagacaaagattacaaaattgacagaagagacagaacgtctaaatggccctgtctgttaaagaaatagtattctaattaaatacattctcccagagaaaagctcaggcctagattatttcactggtaaattgatcaaacatataaggaaagaaaaatacaaattctgaaaaaaaaaactttcaaaaatagagcatattaaaaaatatcccaaatgaatatataagaccagtgtcttccctatactgtaacattaaaaatttttaaaaaatagaccaatatctggggccgggcgcagtggctcacgccttaatcccagcattttgggaggccgaggcgggcagatcacctgaggtcgggagttcgagacagcctgaccaacatggagaaaccttgtctctacgaaaaatacaaaaaacttagctgggatggtggcacatgcctgtaatcccagctactcgggaggctgggcaggagaattgcttgacccaggaggtggaggttgtggtgagccaagattgcgccattgcactccagcctgggcaaaagagtgaaactaggtctcaaaaaaaaaaaaaaaattgaccaatatcttttatgaatataacacaaaagtcctttaaaaattacccaattaagttcagcaacatataaggaatataattactgcaaccacatgagatttatctaagaagtgcaagttttgtttaacatgcagaaatcatcaatgcaattcaccatattaagtgacaaaatgagaaaggctatgtaattatctcgattagaaaaaatgtataaaaaatcaactcccattcatgataaaactgttaatatattaagatagaagaaaactgcctcaaaatgatctagagaatctgtgaaaaaccaacagctgacctccacatcacagtgaaaaactaaatgcttttctctgtaagactgggaacaaggaacgaatgctactagaatcagttctctttaacatggtcctggaggtcctagccagtacaatgaaacagagaaagaaaagaacgaaaggaaaagtaaaactttccatattcttataggacatgattggaacatagaaagaaaactcttaaggaatctacaaaaaaaaattgctagaaataagaagtcacttagcaaagtgataagatatgaggttaatttacaaactcaattttatttctataaataacaacaaatactttgaaaaatattttaaattccatttaaaatatgatcaaaaaataattttacaaaatatgtgtaatatattctagccaggtgcggtggctaacacctgtaatcccgcactttgggaggccaaggcaagtggatcacaggaggtcaggagttcgagaccaccctgccaacatggtgaaactccatctctactaaaaatacaaaaaaaaatttagctgggcatggggtgtgtgcctgtagtcccaactactcgggaggctgaggcaggagaatcacttgaacctagaggtggaggttgcagtgagacgagatggtgccactctactccagcctgggtgacaaataagactccatctcaaaaagacaaaaaataactgggtaatatattccaaaaaagtaccaaatgctcagagaaattaaagaaatgagaactaaatgagagataaatcatgttcattaatctagcactcaatattattaagacgtcaattctctcagattaatctatagagtcaacgcatcccggccaaaatcccattaggcatttttgaagaaattttgagaaaatggaagaacctgaatagccagtatacttttaaaagagaatggatttggagaattggaacatttgatttcaaggctactatgaagctatagtcattgagacattatggtactattacaagaataggcatacgaatgctgagactgaatagagaatccagaaattgacccacacaggtaggtcaattaatttctacaaaggcaccaaagtagttcaatgaagaaaaggaaagtctttttaacagcttgtgaaaaacacctggatatccatatggaataataatgaacctcaactttttctcacttatatggaaaattaacttgaaatggatagaagctaaagataaaactatcaagcttctagaagcattataggcaaagatttcttagctctgtgctcttaataaaggcaaagatttcttagctagaattaagaagcatgaataaggaaaaaatgatgttaggcttcattaaatttttatgtattatttttccataggttattggggaacaggtggtgtttggttacatgagtaagttctttaggatgatttgtgaggttttggtgcaaccatctcctgagctaaaattttaacacttctgctcttgaaagacaccattaagaaaatgaaaaggcaagacatagcctgggagaaaatattcaattatctacatctaacaaaggatttgtatccaaattatataaggaactcttacaactgtttatcagaagacagatgaacccaaattttttaagtgggcatatgaatgttttacaaataacatatggccaataaacccataaaaagatgctcagtatcattagtcttcaaggaaatgcaattaaaaatgacaatgagataccactagacagctactacaatggctacaattaagaagcacaatatcaagtgttgaaaatgatgaggagcaaatgtaatcttcatatgttgcaactggagagtaaaatgatgcaaccacattggaaaatagtttcgaagtttagaagtttttttataaagtaggccaggtaaggtgtcttatgcctgtaatgacaacactttgggaggccaaggtagagtattgcttgaggccaggagtttgagaccagcctgggcaacatagagaaaccccattataaataaataaataaataaaagtaaacatacacttaccagagggcccagcaatcagatcccaggtatttactaaaaagaaattaaaacctgtccacacagatacttgcacacaaatttcatggcacctttattcacaatagccaaaaactggaaacacatcaaatgtccacaggtaatgaagaaataaattgtggtatatctgtacaatagaatactacctagtaggaaaaagacgaaatgctgatacacaaaaccatagatataattcaaaaacatgctgcgtaaaaataagcagatacagaagagtacatgatgcattaaattctagagtagggtaaactaatttgcagaagaaagcacatccctggttgcctggggcaaagtgggtggcgaagggcagaaaggaactttagagatgatgaaaatattctatatcttgatttcatactgggtaagatatatatatatggtgtgtgtgtgtgtgtgtatatgttaaaacccatattcctcatgacttaaagtgagtgcttttattgcatgaaaagtataactcaataaagttaatttttaaaatgtcaaggtcaagaaaagcctaaagaactgtttcagattaaagaagactaaagagacattacaatcaaatgcatgaattatcctgaacatggatttttaagaaatacacataaatggcattattgggacaatgacaaaatttgaacatggattacagattagatcatagtactgtactaatgctaaatttctgagtttgataattgcactgtgattatataaaacaaagcccttgatcttggaaaatattagacaaagggacatgaagtcctcaatttattattaagtggaagatagaaagagagaaattaaagcagagcaaaatataaacaactagtaagtatgagtaaaggttatatagaagttcctgtactatgcttgcaactttcagtaagtttgaagttatattttgtagcaaaacaaatgtttaaaagatgaggtaacttctagatgggaagaaaaaaataactacattctagttcacaatgctttcaaaaccagaagatgctggaatgatttatcctattgataagaaaaaagacccagatataatatcagagttctctaactggttgtataggtagttctgagaattagaaagaataataattcctcagggacattaaaggaaggaacaaccactctcaaaagagaaaatctcctttctccaggaagaaagatggcatctgatctttaaagtcatagtccaaaataattttcttttcttcctgttcatctttatcttttgaagaattaactaagtcccacagttaaaagcaatatttataatcagaaattattatgggaaacaaaaaaagaaaacattccattttcacctttcttcttggcgcacaccgaatcagagaaaatagagtctattctcttcccacagatacaatgtacgtttgaatgcaatcaatagttgccattcttgttgaggtcaaaaatgcacattctctctcccagaagaaaaacgcattattgtagaattactgtagaacagaaaacatatgtagtaactgtttaattccaaagcttacaactgcataaaccatgattttaaaaaattctgctgctaaatgtctagaatatggaaatgcttatcataacttcatcactaaaatattttcttttgtcttagtccattaaatagaatcatgacctcttaatcacacccacaatctcccattttatccacaccgacaatttttggtcagaaggcaaaagtaccttgcaatattgcaatgaaattagatatattgctttcttgtgctaattttttttcaataaaagtgagagattaaaaaagaaaatggtggccaggtacagtggctcacacctgtagccccagtactttggaaggctgaagaggctgatcactggagcccaggagttcaagactagcctgggcaacatagtgagatcctatcctaccaaaaaatacaaaaattaccagattatcagggtgtggtggcacacgcctgtagtccagctactcaggagactgaggcaggaggatcacttgagcccgggaggttggggctacaggagctgagatcatgccactgcactccagcctggtgacaaagtgaaatcctgcctctaaacaatttaaaaaagagagagagagaggaattgaatatctgtaacatagataaccagggctatgtatatatattgtaagaagaaaagggaagaattggaatatagtcagagatgagattgtcgattgtgttttctctccgggaagaattggaatatagtcagagatgagattgttcgatgtgttttctctcctttcctcccccaccctatagctaagagttattagctaatgacaatttttgaaaaatatctaaagcatgacttctattttagcaaaatggttaagtgccagaactacttcctattaaaaacaatttaaaatactgaataaaaaatatgttaagccttcttgactacttcataaactgttaagaagcagattcatactcaggctgaatattaagtaaaggtgggatgcagaagggcaagtgaagcactgaagatcgtttttcccttaatggatgtagtaggctgaatgaattccactcaagatggagattctaagtagaagataagctacgtaggactgagaaccaaagggatatacattcagtataaaccacctagaattgtcttgaaccttggatctaagagaaaagcccccacttaagaactcaaaatcaaaaagcatccgtatatgtttgcatttgcgtattacttaagaaagttcaaatctgctacaggaaaataaagaaacaggtaaggaagataatgaaaccaagtagtttgtgaggcataggtagaactcacaagatgtgttaggtgtgaaaggtaaaattagtaacatatgagatgttagatatagatacgtaagtaaagtatgtgagcccgaacatagacaaaaaaagaagggaccaaatagacactaaacatacacaaaataaacagaggctcatacaaactcaacattcttgaggtcttaaattcaccacccattggtgataccattctggcctctgcccaagaaacacaaattaaatccacagctgctcatcagggtaactgaaacttacagctgtggccaggcttacacattcctgtaagagagaatcttccctgtagacaacatgtgtgtgctggccacaaaaactttgtgtctgttgggaccccttactcacacgacagatgtccccatatcatcatcaggagaggattatgcagcagagagagtcaggtcgtatgagactgcataacccaagattcacggttatgcacaacccaagattcagggtgatcccttcccctgcaccttatcccaagtgcatcaacttatcccatctctttccctttgaactgtgcttgggttttacattggtttagccaactgtgatttgatcatcttaatttggcctgtgagccttctgttctctgacctctggaatagtttgcctgggagtgtgcttgaaggatatgattactcaaggtaattccctctgtgtgacatcttttgcaggtttgcagcccagaactacaatactgcagaacccacacttaaaattataataattaggattttttaaaagtcaatgaatagttaaccataactaaatgtaaacccaagagtttactaataatgtacttcaaaatagaaggtcatagtgaaggtgtgtgtgtgtgtgtgtgtgtgtgtgtatgtatatataaaatacatatgtttatgtgctatgtatgtataaactaattacataaagtaactcaaaataaattttttgctactcagaatactcatttgtggttgtgggagggatcattatggctgacttaggatggtcaatcacttcataccacccaccttcctttatgattttatttcattttatgtacctcataaacatatttctgagcacgtatttagcgtgatacttttaaaattattattaactctttgtgctcatctcttccttttctacctatacttcctaaaacactcttacccattgttctaattgtactaaagactcctgcttaaaaatgagttaaactgtgtgaaatgagaaaagattctcttagacacaatcatttcacccccgcccccccaccaatgttacagtttgaatgctttccagaacttacattccaggagatgtgccattatcaatccatttccacttactttccctttcatctatgataatccaatccagtaattattttcataaatctgagattgaatgaaggcctataaagaaacaaaacatatcaggtgactaaattcccatctgttcgatgagtgagaacaaggacggtcaaggggccgactgtttctatggccagtactctgctactctccacatcatccttcacccttttccctagaaaaacctctcttccctagatccctgcctttccatttcccaaagtattttcccctcatattaatatagtattcatttatgttaaaaaatggctgtcagtatcactactatttaaaacatggaaaagtttaatatccaaatatctaccaataggaaagttgttaatattttataatgctttatgaaactatccaaaatcatgctccagaagaatatttaggatgagaaaattgatcaacacttaatcttaagtgaaaaaaggaatcctcaaaacaaatctattaaataaaaaggtgtgtgtatgataggggcgcagtaaaatcttaagccccataagaggaaccttgctatagttccatagttggaatgggtgaagtatttggaagtatttactatgtctaaatgtaatatatcaaagtgacatattacataatgtctgattaagtgactaaatatatttaaaatacaggtttaaatgtaacttttactgtatcatatgaaattatttcataacttgattcatgaattcttttatgctatgattttttaaacattcattagatttgcatatacatttttgttgttttcctaaacaataaataaaagtttcaggctaatctttgcaaacatacctctaaaaaacatattttgagtatttggataactttcattagtaacagtttttaaaaattttaacataattgttttaaaattcaatattgttatattcaatattgttatcactattattccgtttgttacactatatcactatattttctctttttacaattctgttttaaagatacacatctgagataatatataagaatgttaaaaaaaagaaaaagatctcaaaaaaaaaagaatgttagtggatgttacctatgaatgcaatgaaaatcactattgaggctaatttgtaaagctgtatcacttttacgttcctcattattatctccattttgaagataggctcggagaggttaaaaaatactagaggtcatccatctccctttctaaggagtctgcagtataaccactgacaggagatgatttgcaaagacccaaacagcatccttaataataatggtcatcataatagataagtattgaatatttagtaagtagtagaattatatgaccattagcaggcattgtttcctggagcctcttaactacatcatttttgctcacacgacagacacacacaaagaatagttgaagctctcactctgggctccagcctgtcttcaatatcttaggtccaacattgagaaacagagccaagagaataaaagtgaatgtaaaatacgagttcatctttgtcatctatcttcaaaaggatgatctacaatgttgacaagtctgtttacatcccttccagtctttcttctgcatggtaaataataacagtttactccacaacaggacccgtggtcttcagagaatttgcctacaattataaggtgaatcatcaaacttcttgtcatctggtattctgttaaccagaggaatatgttatcagcccatcataactaaataaaatcccaatagcaatcaataattataatacaaggtcatcaagattctggaatacaagagataccttcactccagtgtccaatgcagcattattccaatagccaagctatggaaacaacctaaatgtccactgatggacgaatggctaaagaaatgtgttatatacacagaacggaatattattcagcttccaaaagaagtaaatcctgctattatgacaacatggatgaaccttgaggacataatgctcagtgaaataagccagtcacagagaacaaatactttattattccaattataggagggatctaaaatagttaaactcacagaacatagaatggtggttgcccaggattggagggaagttcaatggtataaagtttcagtcatcaagataactaggttctagagatctgctgtacagcgtagtgccaatagttaatgatacttattgtacacttaaaaacctattaagagggtagatctcgtgttgttaccgcaaatacataataaatgaaaggacatgaggaaacttttggagatgatggatatatctattactctgatgtggtgatggtttcatttctgtccaaattcgtcaaattgaaaacattaaaaatatgcattttgtatatcaataatacctcaataaaattgtctaaaaacaataaaattgaattaagttttaaaaaagattctagaatgttttctaaataaaagaaaaattttaaaactttttcttttctcctatattttatactatattaaacttttaaaatactactcagcctttacaaatagagtggtaaatttctactaattatcatacctaaatgagattaaatatacaaaaattctttgtaactctaaatcctaaacaagtatttagtagttgttgattaaccgggtcaattaattccacattatgcaagataatagagtttactgtatgagatttaatatttttatatcttaagtgcttcaacggtatcatcgcacagagtcgcacaaacattaacactgtggcaaatcttgcagagtgctacagggagtacatactggtcacaaatagaccaaatatgtgaaaccaaggcagaaggaaacacacacgtgtgcacgacacacacaattatctttataacagcatccaaataaaacccttgtgcccattttagcacaaatatatttttactgaaaacctccatattctatgtcacaaaaagtgcaagtctttaatttgctcacaggaccaaaatgatcagaattttcaggggatttacatacgagttcatcttttgggagcattaataatgtaagatgtgccaatgaattttggaactgtaggcttttactaatctaaacatggatcctggggtcccaatcccacatttgaacaagcaaaacctccaagatacccacactacatctaagaggcacagattaaaagttgccagtagacctcagaggtcgctaatactatcataagcctgtttattaggcttcaaggattaggaggggaagaaataatgcaaaatcatgcaatctttcattcaagatttcctttgtaccttattttgcaaaactttaaaaacgatctcattttctctatgacatctgttcttttgtataggcgtgaatccagttcctttttctgctgaaagctatttttgagaacgtcatattttaaatcttatttgtcaaaatctgctcttttaagtagttgtcattttgcatgatgtacttttcatacagtttcttagaatttcctgccgttgatgtttttcttgaatacactgaaagactaaattaatggcatagatataatacaaataagtactcataataattaaatattgaaatttaagcaaaagaaaaaatttcactctgacaaccattaatcattactttaattagtcattactttattagtaatttgacatttagaaagtaacacctcaacgaactggccataaaaagggaaactaaatttctcaccattagcaacttaagtgtaggataaataacatatctgaataaaattagaaggtgacaccttacttctcagtttagtttatttttaataactcatcatttacaaatagcactaaagtaaaagtcagtttgccaacatttaaccacatatcttctgcatatgaaaattgaactaagaaagaaacatgaagtgatagcacaattattattggggcagatagactatcgcagcagaaaagagagtaagatccagatacgtaattttatctgaatataaaatatcagtatttttttcaaaagatatgaaggaattcaaacaaaaggtaaagcttgaatttaatattaataactgcatgtgtagattctttcttttactaaaccatttcgtcattacatactttgagaatgtcaagagaaagccataatttcttttgaacagttgtctctcaaagaatgtttatctagattcacaataatcaaacccaaatggcagaatacatgtattactaaatcctctatgagaggaatattaccatgtattatacacagtgagacagctcatcacagattcagagtcaaggtaagtaaattaaaaatgacactgtcatatgcccagaaaaaaattaccaacaaaggccaggccacctgggacattctctgattacagacggggaacaatggacggagcatggttaatattgcacaatcagtggttactgctgctactcggacgagaaagctgtattttattactcacttttgtcaccaacactgtgactatcatcagaagaagtaaacagaggatcccaagagtcacgcaatgaggtgccagggcactgaaaattctttaaatacaaaaataaggaaaataatcacaggggaagagcttggctcactactaatcttgacctgagaaaccatttgaaacaaagagaaatatcctctaaaactctgacaaaaatatatcacacaagtatatttaaatttgtaatctgaaattacatgcatgcattgtagaaatcccgcacacaggaatagttctataggatttaaaagtccatcccacataaaagcaccaatagcagtagacacaaaacatgtagcaaaatctagctaacgtgtgtgttccttcctgtgatcacaactaatcatgaagagaaaggaaaaagcatcaataatgctaagaaattagtagtcaatagtggatattctgaagctgcaaatgtggatggtccatctttgagggagtttctagaaatcaacttttctttctttttcatcaattctattttctctaaacaatgctatatttatcctttagcttttgagatcctcagtgtctgaaagtgtatctctgattatctctatattaaagcagcaaaagttattctcaatgcatagtttaacatgaccacatttgaagggagagagagagagcatagaaaaattagaatgccccttttgatcaaacattgttactgcatcattgccattaagatttggtaaatacttaaggcacataaaaatctgctatctgcataaaaatgttgtttttaacattgatttttcatttcttacacttccctcatacttttatttctctaggaaatgtcatgttttcttcagatctagtctgtcctttgtatcaaggcctcacaaattcttcttgaccacatttaaataaaaacattctactagtttccaaatttaaaagaattcactcatttctccattctcacaacttaaaacaaaaatacttctctactctgccccattatagtttcttatcaccagccaagaacaagaagtacagataggaacttttttcaaatgtcaaaagtttgacaatccataagaaacaggtgaatgtaaatgcttaaacgcatacctttgtcatcagttttcccaggcctttgagtatcatcaggccttaatctatctgtgactctgaaggagactgcaaaaatctcagggttgaataaatctctccctgatcatcatctttagagtaagaaggtaagttttgcattcaaatcctgaaataggatggtttctgtgaaagaaaaattaaaatgtcagccaataagaacacaccaggatttgatgctgagagattatgtgtgcctgtctgtgtgtctattggcgtgtgtttattaactaagtgcctaaagcattagagtgagcctcatttatagaagaaatgaaaaatctttcaatacttttgttaaagtcattatacttctagtgatcacagccatgataatgagaaaatacagaaatgatgagaaaaaatctaccaatagattattgttctattcacccagccaattttgctcaaaatattcaacataatatacaaatgttaggtaaaattgataccactgcaaatcactgaaacactttatgagttaacaaacaaaaaatctaataaattctggaaaaataaaaatatcttggcttttaaaaactacatgtattctaatatacatgtaaatataacaaagttcttgcattctttccaactatactgactctatcagagtgctttccaaaatgtatcgcatataccttctacaaaagaattattgagggttaatattgcaaattggttaacatgccagactcagtgccttttgcaagatgtacaaataaaaatcacttcggttggagcccagataaatgtattttaaatctcaaatgattcctgtacgttaaaattttagaaataatcttccggtatattgccagagaagcctatgtgaaataacagttgtcaacaggcagtcattaatgtccataaaagattctattgattaatgaatgcaatatagaaaagaataattaaatagtaaatacctaaaatttacttcttatgttagtcatataaaaagatgatatccaagaaatgagaaatatgaaaaaacaaattgcacatgtaacctattcttttctaatttttttaatttacaaaattttctaacctagtcacattttccctaattcctaagaaaaagaagtattttctattatagagtcattcaagatggataaaatatgtaatcattagacttaagtaaaaagtaattaacccctcaaatctctattctttattttgatacacaaagcaaaaatcacagcatattgagaaagagaaaataactttttgttaatactggatacaatttccttcaaagtagtgcagcattaatacaatcagtagcgaatgctttcctatctttctgttataatgctaagtcatttgtagttaaatgccgtatttctagaattagtaagataaggataatctggtagaaagatctgagaaaataaaagtggatattacctgtatctgtgtatgcagtggtgcaggtggagaaaactgatttcaaaatgagggagaagctggcctttcggtcctggatcccttaggggctataacatgaaaggcagaaataaattctcttcgaatgatctgtaactcaaaattttctgccccacctcttgaccaaagtgataagaggaaattgtatctgaaagctggtactgacgggaaaggaaagatagtcaaaagctgcatattcctctatctcactaaccaaccacttagtactctttgcaaaataatgttcaaaatcaatatttgagggctaaaagataaaattttgtacacatctttggagaaaataaaactaatatcattaacaaaaactaacgtactttagagaaactgctggtaaaagacattactgaaatgtctatgtataaaatatagacatataaaagaagtgtaatgattgaactacttagctcttagtttaaataacagctctctgttggaaatgttctcctatatgtcattattttttaaaagttcctttttctatcgtttatttcaagtaaatgtattttttaaattactttaaaagatccgtaattcctctataaattgtggcatatattcttccagttttttttctctgtatgttgtgcttactatcaaggtggtatcattccttacacagtattttttatttattattttctaataaataatatgtattcattatttcaaagaaattcatctgaaatgttattttaaaaatattactcacagggataaacatcatttatttaggcaatcccctactattggatacttaaattgttttcaattttttctttgtaaaatatatttggtctgtactttttttttttagggaaactttttaagcataaaatgtatgtcaaagggtatatgtatttaaagaactctaatatatatcaccaaatgccctccaaagagatgttccctttgatgttccatcagttgtgtgtgaaaatgtgcacatttgatttttaagaaaaagatactggcaaattatttctctacttgagttttcccacgaaatctcacttataaaatctatccctaaaaccttccagcaaggcctcacattttcacctatatcgaagactgaaaaaattcatttttgtcactccaccatgaggcagaccctgccagaatgtactcagactctcattgacttccacttttattggattcagtctttttcaatcttctgattacagttcaggaaaccaacttaaattgttcaaatcaggtgatagtggttaataaggagtgtgggataagaggcacagaacagcaggcgaaattgctgatacagggacatgtagtccctgaagtcggcacatcatcatgtgcaggccatcagatgaaacatctcccagaggctaattttactcaatatgtaggcaaagtttcatgcatggagtttggacgcttcaggaatacttgctgctgggcatttcttctttccctccatcctggattggcttcgtcaatcccaaatcagagtaaagacggccatatccctttatctcaatgccaaaataataaataaaggaagttagttctgtgagagagataggaagtgggtgacagggtcaggggctggggtgtagtaatagcggatgttgaaaagtgacagagatactgtcacgtattggagtacctcttgtgcatataaccatattaaaacctccaacattgacaagtattttcgtccccattttacaaatgaggaaactaaagtgaagaagtcattgacttgcataaggaaacattattgctaattcttcattcctgtttaaaatctggctgactgaagacagagcacaatggaccgtgaattcagaaggacccgggcttccaacaaggtcttgccacaaagcatgaatcctggaaccaggcaaatctggcttgaaatgctagcccctgctcccatgtgtgacttcaggcaagttacttcatttctctaagtcttgtattcaccatataaaatagtgatattttttgccatccaaggttgctatgagggttaaatgaggtaagatcatctcaaagtgtctaactacaacctggcatatatatggtgggctctcataaaatgttaaaattgttacttgaagtccaagattcaaattgttcttatctataaaaatttgaacaagtcaccaaatcctcaagcctcacttttctcataggttcaataaaagtatcacacgcttcatagctaggactaattaaatttagcactacagacaggatttcttacacttcaaaataagtaatgttttcttgtttgtttttcttcccctaaggttctaataggggaaacaccaggactgcatgcagaaatcctgacatgttatactgagccaggttctctatcctgccatgaggcttggctgctagtgccaccatcactctagagaaaccattccgtggctgcatatcttactgccccatcagatagatactggttatgttgaggcatgtttctgttttgatttacatccacatagctgggagaaggtgaatagttctcaggatggagactagacaagtgcagagcacaattttttaactttttacatattgtctcctctatcataatataaagtccacaagtctgtcttattcatattgaaactgcagcacatgtaagaggcatgatgcctacaagtgcacctcatgaaccaagggatcaagttaaaaggaactgactataaaatctagatttcttcatagttttgaaaagagcagaatgaaactgacgacgggaaagccaaattttctagctgctcccctgttttctctttttaccaagctctgaattgctggaaaaggcaaatttctcctttaaaggaaaacacaatcacaccagaagataacagtaacttcaaatgagattgaaactccctacctggccttttgattaagaggcacaaagttggaagtattaaactttatcacatccagttaataaaacagaagagaatatacagagttttgaatgttctggtactttgccttccaaattcacttttgtgcaaaaatgcacataacacacaaatatgaatatatgaagtattaatttgctcatcttctggctccttcctgcaaaagccctttttatttaggaaaccacatattttactcattcctttctgacctaccgttagctagaagcttagaacagcttctagtcacaccttcaaaccttcgggtcacatgtcaaacctcagtggtttatcatttcacagcagcacactgctcttcctgccccagactaaatgaaggatgtctggaaaaacccctagcatgcagggaagatggtctgaatcacttcatgggaggactaacctcacccagacaagttgccatctccttttttatttgttctaatgccaacttttatcccactgcatgacactgaacttcctggctcttatagtaaagaaaaagataaacgaggccgaagcaggcacaaggtcaggagatagagaccattctggctaacacggtgaactccatctctactaaaaaaaatacaaaaaattagccaggcgtggtggcgggcgcctgtgtcccagctactccggaggctgaggcagggaaatggcatgaaccccggaggcggagcttcagtgagccgagatcgcgccgctgcactccagcctgggtgacagagggagactccgtctaaaaaaaaaaaaaaaaaaaaaaatctctagcttgagattttctgtttccctaatcacccgtttgtctttcttgtctttacagtaaaatacattcaaatgctctaagtttaacatacatgtcccaactgaacctctagtaattgatcaaacagcaaccatccttcctcttatttctgaaaaccaaacaagagggccacctcaggaactaagttaactatgatgacataatggcaaaaaaaaaaaggattcccgatggcaatttaagagaaaatagttaagctgatctgtaattaagcttctgattcttaaattagtattctctccaccacatcacacagttcaaattaggacaagtagatgccagagattttgagtggtagttatccaactttactgatcatcatacggaagtcgccaaggcagattctgaactcaccctcaaatccttcatttacctttgttgtttattaaattttaaaattttctattcgacttcattatccattcatgctaggaatccagttattaattaaggggtcagtggttaaacttacagcacagtccatgctcataggttcacacatttcaaacaaaacgaagtagtctaacaatagaatatataaatcatctcagttacattaatatttacttaaaaatatccatacaaatagactcagcctgataccaatgaaataccaaagataaatatctaaaggcaaataatctaaggacagagcaagacagcaaccaattcaacaaacttaaaaacacctactatatggaaaagactgtgctagggttctgcactatctcatgaatggggaagggtgggatgaggtgcagacagtacttggaaaaagtctgattatttcaagtggtctctttttaaggaaggaggtaaaaggaacataacctgagcgcaataaaaatctagtttcatataaactagtattatacaaaattcagtttctaatgatcactgtccatcagcaacttacaatcaataaaagacagatcaaagtataagaaaattgtagacggtaatattttcctaatgacctatctcccatcttggtttaaatatgagaaattctagtagatagtggggatagagctaaataacgaaaacgtaaggaagttagagaacggggacaaagacttaaagatttttcaacgtaagactatttctcctcaaccttgttcagtttttaatggatcatcttattcaacaggagccacacctgttttgaggaacaaccaacaactgtgggcctactggaagttcaaaagacgattgtcctgtttctgaggttgacatctaaatgcaagaaaattacaatacgatttcatactgcacatcatcaaggtctacaactggaacagaaacattttacatacaaaagacctgaagatgatgcgtacttgcataatgaagtggaaatcatttgactttccatggcaaacctgaagacaatggcatgcattttgaggagtgaaaaggaccatctagtgctccatggcaaacaggttaccagccatgctctagagctatactgtccaaacggtagccgctagacacgtggctatctaaattaatcaaaattaaatagcactacaaaaaaagtagtttattggcaccaattacaccagttagtgaaaaaccaagatttattataatagagatattacagtaaaaaagatgttaagtataaatctaggtaggggtaggcatataggtgttcactttatagttctcaagagtttttaatgtttatccttttcacgttagaaaaaaattgtttaaatagcaccataaattcagttatacaggcacacctcaagtaatcagtaggcctcatttggccagttgctaccctattggactgcaatagaacgtttccattattgcaaaaaagttattggactgcccgactctagagcctacctctcaggagtcctggcaagccttcagaaactaattattccacccaaaattcagtgctaactgttcctagggcaagtggattataactactggaacagtgcaactttttaagagtggggctcagatggaagaataaaaggaaacaaggaacatggttactaaaagtaatgaaagaggaatctatcagaaagaggttgaaaggaactgggaaactgaagtgagactcgtggtcaatagggttaaaaatatttatgtacattcatacatacatatctgtttgtctaaatgtttaacaattataaagctgaaaactcatttagttctcccccctcc

SEQ ID NO: 5051 - DNA, 20304 bp, Homo sapiens
  misc_feature (18801)..(18820): n is a, c, g, or t
tatgtttataaccctgctatagtatgtttaacaagcacaaataccagaacttgtcctactgggtgataaagcaattacaaattgcaaaaaaaagagggaaactatgggagtagccctcaattatctccgaactgatttacccattcactcacctagaactgcattaaaaaacttaagcagaagagtattttattctcttcgcaaaaatttgttcttgtcagtatcaaattaagagagtaaatcaggacttatcctgattaacatttatctccttttacaactatcaaagaataaacaacagtataaatcctctttttgtgattatagtttcacattgtcaatattccctctattataagcttgaaataacttactggaataatcattcatttctaaacataaatgaaatacactaatacagtgatttataaatatatttggtatgcttagttttagaatacagtatagtatatttattttggagatttaattacagaaaaaaacttctgaatagataacatggttcaaaatcagcaagtgcaaaaagtatacactgaaagttcttgtccctttgtcctgcaaccctgaggtccctttgttggaagcaatcagtattacgagtttcttgtatatgcttctagagagttctccgattgcaaacaactgcaaatacttctgcacacctttgtttttacaaacactagcatatactctgcacattaccattataattgtactacatttttctcgcatcacatatgctagagttgttcccaacacggaacattgtgcacaaagagcatattcagtcatcttttacagccacgagcagtccactgtatgcagctatcatgatttatctaaccaatccctactaatggacattaggtgtttctaatttttagctatcacaaacaagtagcattagtatgctttaaaataaacaatacggccaggtgttgcgagaagtcagggaccccaaacagagggaccggctgaagcctggcagaagaacgtggattgtgaagatttcatggacatttattagttccccaaattaatcttttataacttcttatgcctgtctttactgcaatctctgaacatgaattgtaaagattcatggacacttatcacttccccaatcaatacccttgtgatttcctaggcctgtcttcacttaatctcttaatcctgtcatcttgtaaaccgaggaggatgtatgtagcctcaggaccagtgataattgcgttaactgcacaaaattgtagagcatgtgtgtttgaacaatatgaaattgggcaccttgaaaaaaagaacaggataacagcaattgttcagggaataagacagataacttaaactctgtccgttggtgagccgggcggaacagagccatatttcttttctttcaaagcaaatgggagaaatatcgctgaattctttttctcagcaaggaacatccctgggaaagaaatacacgcctgggggcaggtctacagacggtcccccgggcgtggccatcttttatggttgtagactgtagggctgaaatagacctcagtctcccatatcgctcccaggcttattaggagaagaaattcccgcctaataaattttggtcagacaggttgctctcaaaaccctgtctctgataagatgttatcaatgacaatggtgcccaaaacttcattagcaattttaatttcacccagtcaggtggtcctgtgatctcgccctgcctccatttgccttgtgatattctattacttgtgaagtacttgatgtctgtgacccacaacctattcgtatactccctccccttttgaaatccctaataaaaacttgctggtttttgcagcttgtggggcatcacggaacctacagaatgtgatgtctcccccagacgcccagctttaaaatttctctcttttgtactctgtcccttatttctcaaacctgccgatgcttagataaaatagaaaagaacctacgtgactatcgggcaggttccccgaaggccaggcacagtggtccaggcctgtaatcccagcaatttcacgagggagccaggtggatcagctgagcccaggagttccagaccagcctgggcaaatggcgaaatcttgtctttacaaaaaatagaaaaaattagccaggcatggtggtgcacacctgtagcccggctacccgggaggctgaggtgagaggatcacctgagcttgggaggttgaggctgcaggagctgtgattgcaccactgcactccagcctgggcaacagagactctgaatcaaaaaataaaataaataaaacaacataacataaaaacaaaaaacacacctcaaattaccagctaggtatttacgtttcagacccagatcaattgcaaaatcaatgttcagctctcctggaaaagtctcatgtatggacctgacctctatcagttgattgtcttagctcaatcttacaatttggttactccataagctcactcatttggttaagtaaacaatgtctacagttctaacaattattttactaaaatgcataattatgtgatagttatacatataccaacctgttatgtgagacaactgacctgcaagtagtccaaggccagtgaatcaattactgcttgtacattgtgtgcatctcttcttgactcctaggaataactatgaggtctggggggggaaaaaatcacataatttttatccatgagaggccaagttttcatctcattgtctctgactaggctactgaatatgctcactgctataaaggctctgcccaaacagaacatgctgtaaagtacagataaagttaataaccctgaactctacacagcagaatctttactggttgagtatttattgattgaaccgattttcaatattagactggttgaatacggttgaatatttattacaccatatatatatatatagtatatagatatacatgaatatgctttacaagaagcaccatgttaaggaagataaagtggccctaaattcaaagacagctaatagtctaataagggagccaagacatgatactttaaccataactatgggctactttctacgaagaaaaaaaaaacacagcaggcattcaaggagcgtcttatatatacacatatgtatgtttatttattatttattgagacagggtctcgctctatgcccaggctggaatgcagtggcgtgatcttggctcactacaacctccactttcccggctaagcaattctcttgcctcagcctcccaagtagctgggtttataggcgtgcaccactatgctggctaatttttgtatttttagcagagatggcattttgccatattggccaggctggtatgaactcctggcctcaggtgatccacctgcctcaagtgatgagcctcccaaggtaatggattagaggtgtgagccaccgcgcctggcccttatatgtccttttgaatagccaactagattattggtataaagatttaaaaggtcagcacaggctggacgtggtggctcatgcctgtatcctatcactttgggaggtagacgggaggatcacttaagctgagttggtaccaccctggcttgaacatagtgagatggtgagcaagatgaaaggacatatgcgcttattaactgtcttgtaaatgaggttcatcatctacaagcatcaattcttatccctagcactggttaagtaacgaatccaataaattcccaagctccactcaattttacaacctttgaaggtacatttacagaaagatgcaactttcacaaggcagtagccatgattaggttaagccgtgattatcaggagcctcaaactgatctgctcaaggccgttattatgagtgggttccacagggtattccttaagaatacaatattataattatacaatatgtgatattaaatacaatttaatatacaatattattttaatattgtatattaatatagaatttaatatgcaatattaaaaaaagaaacaagcaagagaaaatgaaattttataaatatcaaagaatctaactaaaggactaaaaacttttgcctaagatataggcaaaattactcctgcttttagtattcttacctggtaccttttctccaaaatagactgataaagagcaataaaaacattagcatcacagtcttgaagttcatgtatctcagatgtatatgacacttaaaaagaaggttattggcaatggttacccactctgttggaaaaagggggaaagatcagtcttaaaaaccaccagaaaaaaatcacacagacatttaaaaatccaacaacctcccccccaacaaaaacagacactgaactttgcagaagataaggaattgattgttagagaatttcaaagaccctttaggcatggtttttaaaaagatgtatttaattcttgggatgatttccagagtgctgtaatttctacatagtcaaaactatactgcaaattaattgatactgttgcagcctaaaatcttaagttacttatataagccttacatgggtgttttagttaaaacatatttacaagtaaacaggaatattatgtcataaacaacagtttaatgtaatccgaggttaccagaaactcattaatggaggctgcttcgcacttgcaatagtattgtcttgtgtttacccaattatcttgtgcaagtcagggtttctctggtgccggaaaaagtgtgattaaacttaggctgttaagaactggtataataacaacatcaacggtaatgcatttgtagtttttcttttttattatatcgatctatatgaaagaaaatatgggaagtacatgaagtcagaattatcaatactgttgacgtttcctgcgtaccacattctcctctcccctagatatgctgggatttgcaaagtttaacggtttctgtaccaaaagtaacttagcttaaaatactgttccttgaaatgcctgggaattggtaggaaagcactttcaatcggtattagaaacaaaatctccactatgttctggacacgtaacgttctggaaacgaatgagagtgtattttccatcacataatccccctccccacgcccatttctcacagctggccaaaccatgacaactggttgtacgcagtccttgtgaaaaggatgaaagcgtcctagacaaccaaattaattcgctcttaaaagcggtgctagacaaagcccatgactctagagggcactgaagagaaaaaagcacaatattctacaggggcatattctactattctgcaggggcataataaatcttaagaatgctgtcctttaaagaccaatacaaaagcaggtacgacctcagggcccatagtgcaagggcggaggcacacggacagcggctagacgccccacagaaagacaagtccggggacgacccttctgccgctctttttacagccaggacccaagtgtcctaccggcctcgccccagtgcctctctcctcccacagcatactgctgttccacggcctcgaagcgaagaggtggtgaagctgagagacctatccagggaacccgccagcgcgacgcggcgtctgaaggtcacgagccccgccgacacccagacccagtccgggctagcccgaggcctccctggaggtggacggtttcagtccacaatactgggaccccagggagacactcaccagcatccgagcctgccatgtttcagaggcagtcgccgccggactccgacgcggccgggaaggcgacggtgtcctggaaggaccgatccaccagacccgacactggggcgcggacgcacgaaccaaagcgcggggaaggaggcgtgaaagaggacggacgttaaaagagcttctcgccgctgattggtcatcagaggagcacttcctttacaggacgtgaaacgggggcggtttgggaagtttagagaccattctccgccgaccaaaaccgtcaaaggattatcagacacgcgggtcggacggtccacatcagccggcagcccgggcggtcccggggtgcgagcagcgcacttccggtgagctatttcgttttgtatccctccgccacgtcaacgggaaagtagtgcggaccgctctctcggtggtccggggtggtacagccacggacaacgccaggccccgccttccccctcttttggttacagacgtgagggctctttggagcgtaaacatctccgagtggcgagggtgggcggggctgggcttgggaaagggcggggtggttgcttgaggtgtggaaagaccagaagaaggtgaggtcaagagagtgcagaatgaggcatccaatggtgggtgggccctgacctgagagagtggcgcggggaggggtgaaagcgcggcatcctggaacgccagcgggcgttgcggcctatgcgcgaggggcggggcgattaggtcatgagcggctcccagcgttccctgcggcgtaggaggcggtccagactacaaaagcggctgcggaaagcggccggcacctcattcatttctaccggtctctagtagtgcagcttcggctgggtcatcggtgtccttcctccgctgccgcccccgcaaggcttcgccgtcatcgaggccattccagcgacttgtcgcacgcttttctatatacttcgttccccgccaaccgcaaccattgcgccatgtcgggttattcgagtgaccgagaccgcggccgggaccgagggtgagtttggggccgagctgtcaggcctggcgggtggggggatgggagggcgggtcagggtggcggccgggggggctttgcggcttggacttggcctttccgggctatcttgggacttcctttcccgaagcttgcgccattttgatattcacgtcacagtgattggaagagatttgacggtgtagtgtttcaagcttgctttttgtgtggggattggggagctgtcggggcggctgccatttggtagtgttgagggagttgagagggagcgtattgtgcggatgaaagcgggacgcttcgaggcagcgaaggaacatctgttaggtgcggcgtttcgggaggtgtttttggggtggccgggcatttgtgggagcgaggggaccacttccaaagccctggtgctgttggggtaggagggcggccgcatcagccatgtggctgagtcgcgagtacaaaatgccggcctcggacatggcggcggcgctttgttaccccgcccggcggaggagctcaaaatggcagcgtcgagaaaatgtggcgcaagagaaatgcgagacaaagggggaagcgccgccccagcgggaacgccgcccggccgactcgcccgggccgggactcctcccccggtagtcgccggctcctccttttcttttttcctgcttatataattttgattcgttgatccggagctctaccgcggcgttcccccagctgggtttctagcagaagtgtttctgagaaaacccttgttctgttatcgctgactgtactgtttaggtcttaccactaaagctgtttggttccaaaacggccatatgagtaacatcgtcgtgatgccttcggttcatgtagccttgttattgctgatagtgaattgctaggctggtggggaagatacagtaaccacaagaagtggtgtgtgccagaatcccaaattctggcatgtgggtgacaatttccgacatgataaatccccggcttccgacatgataaatcccaggctgtttacatgactaagtaatgtgtacttgggactacgggaaatgttaactgtggctgttgagagagagagaattttcacgaaggacagtgctaggtttacctctcgaagtctgttttcagtggtttttagttgtgccaatggatgacaaatctatacagaaacctgggtatagccatttgaaaatgtgataacgttttttttcattccaggtttggtgcacctcgatttggaggaagtagggcagggccttatctggaaagaagtttggaaaccctggggagaaattagttaaaaagaagtggaatctgatgagctgcctaaatttgagaagaatttttatcaagagcaccctgatttggctaggccacagcagtgagtaaattcatgtggcttcatcaggctgtaactcgatcgtggattctagaaatgaaattctgacaggtgttttgcaaataactcaattttggtagagttacatgttctacttcataattgggaaaggtgtgactcacttttggatataggtggctttgggatttttattaaattaggttgagtataacaataaattttttttttcataatagggtgttcataggtggtccagattaaaatgaaggctactttaaactagttactaaattatgaagttaggggctttcaattacgtatttagctaggggtggtgtcatgaattttaagactgttataatttgtttgcagcaagaggtggaaacatacagaagaagcaaggaaattacagttagaggtcacaactcccgaagccagttctaaatttttatgaagccaatttccctggtaagtgctacttttcagtctacctacccgtgtttttgtttccacctaccccctctttttcttggcatcactaattttactaaatatctgttactaattatagcaaatgtcatggatgttattgcaagacagaattcactgaacccactgctattcaagctcagggatggccagttgctctaagtggattggataggttggagtggcacagactggatctgggaaaacattgtctgtaagtttgggagaactctgagttgatctgatatatgcaagaaaatgtaatggtaatttaaaaacgagtattttaatggatttctgtttgtccccactttcaccctaaatagtatttgcttcctgccattgtccacacaatcatcagccattcctagagagaggcgatgggcctattgtaagtatatatttttactttattagaagcataatgtgtagattttagactacatagctaaagatgtaatcatttgtgtggttttatatagaggttagctcatcctattcagctggagctgttttgggtattggacacacatgaagaaaggatctgctagtataataagttagcagtttaaaactagtatccaggttgtgctgaaagctgtttctctttccttagtgtttggtgctggcaccaactcgggaactgcccaacaggtgcagcaagtagctgctgaatattgtagagcatgtcgcttgaagtctactgtatctacggtggtgctcctaagggaccacaaatacgtgatttggagagaggtatgtaagaaaagggttttatttgtcattggtgctaaatatcctaggtattgtagttacacttacgatttaattaaaggtgtggaaatctgtattgcaacacctggaagactgattgactttttaagtgtggaaaaaccaatctgagaagaacaacctaccttgtccttgatgaagcagatagatgcttgatatgggctttgaaccccaaataaggaagattgtggatcaaataagagtaagttcctttgaaatatgtgatcaaactgaattgtgttttcactcttaagagtctgatactaattttccccccaaaatccattagcctgataggcaaactctaatgtggagtgcgacttggcaaaagaagtaagacagcttgctgaagatttcctgaaagactatattcatataaacattgtgcacttgaactgagtgcaaaccacaacattcttcagattgtggatgtgtgtcatgacgagaaaaggatgaaaagtaagttttattaactctgttatatttgcttcctaacaactttgtgtaaaattgagggatcattgtttggtgagttgttttaggttatttcagttggtgtgattcatttagttagcctactaatcctgaaaatttcttgaatccttcaaataatggctgtcacatttatagctttcctatagaaggaattcatgtgtcccctggttgacttaaggaccaaggtcgaactgctcgataagtggattagcaggcgtttcctctttgacttccagccatgtaattgaacttaatgttttgctgaccataaatgtgtggccctagcaatggtcttttaaaactaggatttttcctttctctctcctattattagacttattcgtctaatggaagagatcatggtgagaaggagaataaaaccattgtttttgtggaaaccaaaagaagatgtgatgagcttccagaaaaatgaggagagatgggtatgtgtgagctcctccattgaagcagattgattaaacagcttaggaaagggcaaacttggatcacgagcagtggatttttttcatatctgataggaatttaactttttcatttctggcgaaattaaagagatctgtgaccaaaagtggtcaagactggagtctgaggttttcaatgtgagtttaataacacaacttgtcttttaacttaggtgcctgccatgggtatccatggtgacaagagtcaacaagagcgtgactgggttctaaatgtaaatatttcaaatgaagtatttttcccccttacttaacctagctagaattctgctcagtaattgatcatgtatatgccttcctttgtagaattcaaacatggaaaagctcctattctattgctacagatgtggcctccagagggctaggttagtacaaactcgcattcatggcttgtttcccagaagatctccatttaacttttttaaagaaagtttattgctttctttaacctgattttttctaagttttttttcacataaaggtgctgtctttgtggcaaggcctaggcatgcaatcggaggactcgagggggatggaggactagtgatcggctggctgcttccagtcgatagagaggtgaaaaagctgaacgtgtgccagtaatcttcaaaaggcagaacatatcaccttgccccgtaaactgttctctccgagggaaaaaatggaagttatcctcacagttcactgcgtggtatttcttctgtcccatgctttgcatgactgccatggtacagccttgtttcaaacgttcactgtgatctgtgggtctttgagtttcagtgagtttgctgaaatgtcgaagaagtgttccaaacttcaatgttcaatgaaatttttgttcaagtttgaaatggagagagcagcttaaaaggtactaagccttttacaaattggtgagtactggcacatgagatctagagcagggcaacttctcacacatagtaagtgggaaaagaaagtgctttgaaagttcctccctcaccacacagtagtcgtcatgtcgagacctgccagagagagacacattctcaagtgaatcctgcttcttggaagcgcttgcctagacgagacacagtgcataaaaacaacttttgggggacagtatgttttcttgcagctgcggttgtaaggtcttggcaagacaagcagtgtggccagaatttgaacttctgatgaatgtgtaatgcaaaggaccttgtacatttttttgtttcaaggtctcaaaatgagcacatgaagaggttgctgtgaaactttaagtggccctactgcgcagaacattcagatgtcacttgatgatctgtaagggaacttgctgatttgggaatgtgcttaggaacacacattccttttgacagggtctgtcactgggtgggtgatgaattatacagatgactgtgcttttttttcttttttcaacctcaatggtattcctacaggaaatggataaccatttaactgtattttttgcagcccgtaccttcttgggaatacaattgtctaactttttattttggtctggctgttgtggtgtgcaaaactccgtacattgctattttgccacactgcaacacttacagatgtggaagatgtgaaatttgtcatcaattatgactaccctaactcctcagagattatattcatcgaattggaagaactgctcgcagtaccaaaacaggcacagcatacacttctttacacctaataacataaagcaagtgagcgaccttatctctgtgcttcgtgaagcaatcaagcaattaatcccaagttgcttcagttggtcgaagacagaggttcaggtaaggagactgataggaaatgttggtagttacgagtcacatcgttgtctacaaatccatttaaatgtattggagggtgagtaaaaccttgaatgtgaaaacttaagctgaaaaattgtaaaaactttcacgcctaccatgaatagatctgtttctttctgtccacaatgatttgtgtcatagaataattgatcaatttgcaattgttttcttgacaggtcgttccaggggtagaggaggcataaggatgaccgtcgggacagatactctgcgggcaaaaggggtggatttaatacctttaggacagggaaaattatgacagaggttactctagcctgcttaaaagagattttggggcaaaactcagaatggtgtttacagtgctgcaaattacaccaatgggagctttggaagtaatttgtgtctgctggtatacagaccagttttaggactggtaatccaacagggacttaccagaaggttatgatagcactcagcaatacggaagtaatgttccaaatatgcacaatggtatgaacaacaggcatatgcatatcctgctactgcagctgcacctatgattggttatccaatgccacaggatattcccaataagactttagaagtatatgtaaatgtctgtttttcataattgcctttatattgtgtgttatctgacaagatagttatttaagaaacatgggaattgcagaaagactgcagtgcagcagtaattatggtgcactttttcgctatttaagttggatatttctcacattcctgaaacaatttttaggttttttttgtactagaaaatgcaggcagtgttttcaaaaagtaaatgtacagtgatttgaaatacaataaatgaaggcaatgcatggccttccaaaaaaaatatttgaagactgaattaagtggaaattgtactttattttatataatgtcatgaaaactttgcttaagatggtctggttttttttttgtttttgtttggttttttttttccagaaaacaaatgactgttcctttttatttaatttgggaggcagggggaatcagaaggccctctttataatgagctattcatattgcaggagtcagaatgaattgatacaggtgaattttagttacaggctaaattgcataaaagctttgtcagcttccagcatcaggggagtcatttatagcctttttccttatttgctagtatggttaaatgagaaaatagtaaaatagatacaaatcatctatatagtgtgagaacgtgggtgactttttcaaagtttataatttaaaaagctcaaataactggctttttcaagagacttatactcatgctcttggctatactgtgaattactaaatgttgaacaaacctgtgaaagacatacattagccctttaagatggccaggagctaacttgagtctcctttactgaatttcgttcttagtgcaggttacttgtagattctagtcttacaggctccctggggctcttaactagtcacactgggagtcatgaatgtctttccaataatcagggaattctagagatcctcaaactgtaaggtctattcatactcaacacaaggaaaaacctcattaaaattaatgactaatcaggaggcaacgtaaccaaaagcacagtgaatgaagttttcatggtaggttcaacatgggtttattgctagaaagatccaggggatagctttagtttaacttcggctcaccaacgtaactttctaatcatttatttcagtaatagctagaagtggtctgaatgttttcccagagtctgatacgtgtttttttttgccagaagagaggtcttcggagacttcatttaaattctgattattaaactgaggctttaattgatgttaatgccttagtcaaatgtaaagttagaatttgctagggctgggatagggagtgatatttctaggacttgacattgaaaactaattcagcctgtagtaacctggatggttttcaatggcatggttagtaaattcatggttttaaacttagaagcagctttcgggggagagggtaggttggagcatttttacatattttactgtttaatgtcttaaccgtgggccttttaatttgtaaacactgaaagattgttgggctgtggaaaacatttacctatttaccttggaagttttaaaagacagtccctttttagcatgtgtgttgtgtccagcctgtggtcgtcttaactaataaatgtgattttctccccattctctctttttatttatttgcgtataggccttttacctggtgtgagttcctaatgtggaaaacacctggcagtagtacccagctttgcagttaattactatctagctggctttttttaaacccttgtatacacttgtaaagaagaactatttcctgaacctggtacagcctttactaatgataaaactttactcctgaattacattaactcaattgctaagctgttaccctcttaatcaggtagtagtttggtagtctcacagtgaaatgtagattgttcctttttcctgaacctctttaaaggttttcgtaactgaggctggtataagaaatcatggactttggatcaaacttcctcagtctgggtataccacttttccactttctgggtaggtcttaaggtctgacctatttaaatagaaactgcaaaatcagaaacctgcaatttaatcatgagtctcttataataacagtcacaagtctcattgttttgatgaacccatagaaggggcccctggaagaattgcacgtacgtggttttctctgacaccaggagggtttaagacatgtcagggccccttgtttatttctagtgcattcccaggtgaggcagatgctgctggctggggactgccctttggagccactgcaatatttaaagtgaccataccactaccctagtcacgaagcctatcgccccctccccggaagcttaagcgtcaagacaacggctctggggttaggcctaggccacctggcgcagcatttgcctagttaagaaggcctgggcttacaaatcaccgtaaaggactaaaacttttaaagggaaaccaaatgccaaatttagtccaagtgcttgattgaggtgtatatagaagtgatttggataatactgaagtattttaattttctggactgcaaaacagtggcagaaggagtgactcaagtggctacaccacggttataaataggtgggaataacctttactggtgctacgaggaaagaaaaaagtcaatctgaagggaggggcgcgacgcgaacggcaagctagcaagaaccatccgagccggcgtccgccatggtgggcgggggacggctgcggccggaacgcaacatgcgcttccggggtggggcctgccgcccgcaagcacgctcacctccgttgcgcctggccgtggcctctccggattctgttaacggtagtggtggcttgttgggatccgttgagtgtgggagagtgtgctctttaacttcggagagagatgcgctctcgtgtagccgtcagggccgccataaggtctgcaggtgcctgttgtctgggtttgggggtcgagtagatgcggggcagcggagctgttgacggaaaggagtagccccaaaggagggcatgtgaagtcgcacgcggagtcgaggggaacggcgagcacccagaagcccccgggtctggagagggaagcgaggcgctgtagagatctgtcagagaaggcatttcctaagtggaagcaagcagcagcttagccgggatctcttctgagtgggtgccaccccggcttcggacccttgggcgtagagttgcggaagaactggccgcagaatggtggacctcggtggtggtgttcagggagcaggtattcccggtggacccctccaccacaaaccaggccctttgctacccggggacagtgccttcaggttagtttctcagaaactctacgcgaaatcttgcaagacaaagagctgagtaaggaacagctagtagcattcttgagaacgtattaaaaacttctgggaaactacgggagaaccttcttcacggtatgttcacgatttcatgcttcaaaacaggtgtcgggtggaaaggcgaggcagtcttgctggacttggggattgcaactggccctgtattcccatgcaaggaagttagttagttctcatcttttgaagtagtcggatatattaacagtgctctaccctggagaaaactggtccatggaatcttgctgttccttaaacaatctgtccgaaggacctgggaacgctctcaatttcacggggcacttctgaacacagtgctgtcatttagtgcaatgtagtctaagtgcataaggaactacaagacattttgaacttttcttagatttattctaagtaaaaatgttgaaattataattctgaactatttcatgtatatcataggataaatcaaggccaggcgcagtggctcacgcctgtatcccagcattttgcaaggcagaggcgggtggatcacctgaggtcaggagttcgagactacctggccaacatggtgaaaccccgtctctactaaaaagacaaaaattagccggccgtgaggcgagcgcctgtaatcccagctacttgggaggctgaggcaggagaatcgcttgaacccggaggcagaggttgcagtgagccgagatcacgccactgcactccagcttgggtgacaaggcaaaactccgtcttaaaaaaaaaaaattcaaatagttgggttagttgttattaggaacaagatattcattgtaaaagaagagataatatgtaaaagaaggtacgtataaactaatgtaaatatggattggtaaattaaatatgaattggtaaattaaaattgaatatgggtctcacctgtcacccagactcgagtgcagtggtgtgatcatggctcactgcagcctcgacctcggctcaagtgaacctcccacctcagcctcccaagtagctggactacaggcacatgccaccaacccagctaatttttgtgttttttgtagagatgaggttttgccatgttgtccaggctggcttgaactcctgagcttaagcaatccgcccatcttggccccccaaagtgctgggattacggtgtgagccacagtgcccagcctcatgatttttaaaaatatatttcctaactttcttctttaaagttcctagaagcaatgaccctcagtagcaatgagcacacctagtgcccagatctggttcctttttttttttttttttgagacagagtctcgctctgccgcccaggctggagtcagtggcacaatctcggctcactgcaagctccatctcccaggttcacgccattctcctgctcagcctcccgagtagctgggactagactacaggcacttgccaccacgcctggctaatttttgtatttttagtagagacggggtttcaccttgttagccaggatggtctctatctccgaccttgtgatccgcccgcctcggcctcccaaagtgctgggattacaggcgtgagccacgcgcccggcctccagatcttggtttctaagatgaaccagtactgggagaaatggctgatccgggtctggggttagggaaagtacaaggtgagtttgaaacactttatggtgctaaaaacaaagaattgcttgaagactaatgggtcatataaaaaggtcacagatgctggcttgagggggttgtcactggccacatctaggacaaattgaacattaagatacatattaatggtaatgatcataacacattgactaaaatctaagagtcaatagtattaatcaaaaacaaataattaccctagaggtcgggggcggggggaagaggtagagaaagcttatgtttttacagaagcttggaataaatgtagaaggaaagatacattagaaaattcaccatttcatgatattgcaaacccgatatcattgattcaagcaacagtcatcaatggattctaaaatactgggtgaaatatgttggggagcaggatattattggggagtggatatttactaccttaaccaagtaatcaatttggtgtcttcagtagtggaataatttgataacatgttcctcatgttatgatgcaatagatacacacatctactatgtagtattttgctaaaaatgattagccgaaattaaatcataggaaacaatcagacaaatcccaaatgtgagacaatctatgactaacctggactcacatcaaagtcagtgtcattaatagcaaaattaagggggaaaggaggcaagggaaatgttctagttcaaatggatgaaagaaacctactcagaatgcagtacatgaatcttaactggaaagagacagtaaaagatatttggggtgaaaattggaacaactaaaatatcaccatatgttagatatattgtggtattatggttaactttttatggtgttataatggtatataggaaatattttatttttagaagatgtatgcggcagtatttgggagtgaacaagaaaaaaatgtggcaaaagttgataattgatgaatctaggtaaagggtatacaagtgttcattgtatatggatgtttttattttttcaactttcttatagatttgaaaatctttgnnnnnnnnnnnnnnnnnnnngaaatgataccactctcttcttcagataacatgttattctccataagtttcttcctgttgccttttgatgcaaaccaggcttcccatagctgtcttaggcagcaactagttggctgattaatacttcctgacagttcatgtaaacaacaggtccagttgtctcagacaaattaaccaataagattcaacagtaatatttttaattaagttatggtgttgaggcaatcagacccttacatctttaaagtgtctttttttgttcaattttaaaactatgaggccgggtgcagtggctcctcctgtaatcccagcactttgggaggccgagttgggcggatcacgaggtcaggagatccgaccaacctggctaacacggtgaaaccccgtctctactaaaaatacagaaaaaattagcgggcgtggtggcgggcgcctgtagtcccagctactcgggagggtgaggcaggagaatgcatgaacccgggaggcggaggttgcaatgagccgagaccctgccactgcactccagcctggcgacagagcgagactccatctcaaaaaaaaaagaaaatcttcaaactaaaaactcaggtgaaactacctagaattaagtggtgatctgtctttttttgtttttttttaagacagggttcactctgttgcccaggctggagcacagtggcaccatcccagctcactgcaaccttggctcccagactaaagtgatccacctcccagctttccaagtagctgggactacaaggcacaaccaccatgcctggcttatttttgtatatttttagagatggggttttgctgtgttgcccgtctggtctcagaactcctgagctcaagcaatctgcccacctcgacctcccaaagtgctggattataggcgtgagccaccaagcttagccaacatctgtctttatgctgtgttaacgtattactactattaatgtgtctattgacaaaaatgatttgggtttgtggactagatgtatcaatgattgatttatcttttgacaggtgccttggaacactatgttaattgcctggatctgtaaacaagaggctaccttatggccttgctcagattggagtgtgttttcatcctgttttgacactaagcagatacgaaatggtgttaaaaggtataaaaagtggcaaataacttggcctgtatttaaatagtcaaaaaccagtcatttccacttgggataaattatataattttcagtaagctaacttcctgatacgttttatatctaaagtattggtgagaagactgaagcttcgtagtatggtttactcctccgagaacttcaaaccagtggcttgatttctggttacgtcatgactccagtggtggagaaaggtactgcaataattacctttaatttaatagttaatacataattgtcttaatgtgtcagtggtaattcttctgacatacaagaaattatatttgatgtagtagctat

SEQ ID NO: 5052 - DNA, 19573 bp, Homo sapiens
tttaggagatctgcctccttttatttatttcattgcctgtcatgtctcgctttgttgcgtttgtttttgcttttgtttttgtttttttttaagacggagtttcactcttgttgcccagctggagtgcaatggcgcaacctcggctcaccgcaacctctgcctcccgagtttgagcgatctcctgcctcagcctcccaagtagctgggattacaggcatgtgccaccacacatggctattttgtatttttagtagagacgggttttctccatgttggtcaggctggtcttgaactttgacctcaggtgatcagccacctcgtcctgttggcgttttttaacattttattcatcctaagccctctagtgtacaactttggctttttatcaaggcatccagaagcttgcttctgcaagttcagctaagtaattctaaaccaaaaaagagtaatttttaaaaattattatttaggcgggcgcggcggctcaagcctataatgccagcacgttgggaggctgaggcaggcggatcactgaggtcgggagctcgagaccagcctgaccaacacggagaaaccccatctctactaaaatacaaaattagatgggtgtggtggtacctgcctgtaatcccagctactcaggaggccaggcaggagaatcccttgaacctgggaggcggaggtcgcggtgaagcgagatcacgctgtgcactccagctgggcaccaagagcgaaactccgtctcaaaaaaaaaaaaattatttagagcccattagatccgcaaaaactaattttaaacaaaagtgattagtttcccacatctggggatatgatcaattagaaaatggcatgaggaagatagctttgcccaagctggtgtttcattttggtttttgagacattgctctatcacgcagggtggagtgcagtggggcaccatcgtgctttctgcagccttgacctctggggctcaagagatcctcccacctcagcctcccgaatgctgggcccacagccacgtgccaccacacccagccaacgttttgatcttttgtagcgacctctcactgcgttgttcaggctgcaagctgttgtttcaaacagatgaagttggaaagttctcagcttctccagagttgtttttttgaatcaaggggttgtggagcctacatgtaaatacagtgtgccttgagttaaatctccgggaagacttagaacggccgtgttgccagagctctctagttagcctgcaggactgtctgaagtccgtgtccgtctgacatgttaccggaattaacaacctagggacggtgagtgctccttcatgtggctttctggctctctcacctgccactcatgccgctgtgacttagcagccagagttttcaggagacctccaacgtgtccgttgaaattagggtaagagttgagaagtttccctgtttgttctaagagttcttaccccaacctcagggaaatcaatagtaaatttactctgacttcaatgataataaagaagtgcccttgcctcatctctttatataaagcaatagagccacatggttcaaaaatgaaaacaatatgaaaaggtatgtaaaccgggtaagtgtctgagacaagtctcgcccatttagaggtttattttgccaaggtgaggatgtgcctgagacacaaccacagatctgtggcccccgcacactttccagagaggtttttagggcctcagtatgtgggatatgacgacgtttctcttcaaataatctgatcaatttttattctttaattcatagcgccccgccccctttttctccttttccctttttgccttttgagatgcccaggcacgccacagcaccaggcgttatcagtaccagctcacattcctttcttatttggaaagaggactaactttctagctcattacagacaccccttccccttcctctcgctttcttttacgggcccaccctatctaaaaaaatcaaatgtttagccaagcgcgattatttagattgtacgacctgaccccggccaatggggaaagggtagaggggcaggacttgtgcaggaacaaaggctctcgtgcccctttgttcaggtgtgctctcatgacaactggccaagaggcacccctctgcacagaagtaaaattgctttgctaagaatcctttgttcgagtgttcatttccttaggattttgagcattattcctaacaagtatttaaaagggaaagagcaggaaggagggaagagggaaaggaaaaatacaggagggtaggtagggagataagtggttacattttattaggctttgatcagcgctcaccaaatctacatgtcacagtgaaaggagggggtagggaacagtcagttttgcattcagctcagtaaatctacatttagcactcaccaaatctactgttacagtgaaaggagcaggcagaggaacagtcagttttgcattcagctcagtaaatcacatttagtgctcaccaaatctacatgttacagtgaaaggagcgggcagaggaacagttcgcattcagctcagtaagtctacatttagcactcaccaaatctacatgttacagtgaaagagcaggcagaggaacagtcagttttgcattcagctcagtaaatctacatttagcgctcccaactctacatgttacagtgaaaggagcgggcagaggaacactcagttatgcattcagtcagtaaatctacatttagtgctcaccaaatctacatgttacagtgaaaggagcgggcaacgaacagtcagttatgcattcagctcagtaaatctacatttagcgctcaccaaatctaatgttacagtgaaaggagcgggcagaggaacagttatgcattcagctcagtaaatctactttactgctcaccaaatctatatgttacagtgaaagcagcaggcagaggaacagttatgattcagctcagtacatctatgttttgtctcggctggtgagggatggtttctggtgttgttttgtcccttacctatgaagataagctgttaatttatattgtcaggtgagggagaccactggggagatatgtggccttctgtcttgtagcttatctgtttaggaacaaaaggaagtttttgcatattccatgactcaatttccaagcttaacttttccttttcgcttagtgaatttgtcccaagattttattttcctttcacagtataccccatgcccatcaatcccattccccctcatcctataggtaacctcttcttaagcaaatacaaatagataaatccttattttctgttttttttttaaaactttattttactgttactttctgctgtcctaattatggcacatttttctttctaggttctgtgatttacagagtggtctggctatgtggacagcttctaaattgtcccacattttggagcaagatgtattatttttacaattaatttacatttaacatgaatcatatcctaagtgcatcagaatgtcttcataacattcgccaaagaagagagggcagcactgcgttctacagtgtggctctcacctggtccacagttaccagaaatagttctttcgttgctggatgtcctgggtgggcttcattctttagtaatgtactttgtctacagcaacttcctgcactatgtgaacagatcttgaagacacacagtgaggtttggtttcctttgtcctcttaagttttatggttgttgcttctattgtttattggtcccagtgagaactgcagctgacctgatgcatgatctgtgaagatagtttctattaaagaagaagtaccaggaaatcccatatgccacgtagacctgcctttctggataccatttactactccatactccagccgccatgcacaatgttgtgtatgaggctcctgtgatcattaacaggagtagaagctgggctcagacactctggacttgcataggtcaaggggtgtgttgtgctcttgcaacaaatcccacatagacatccattgcatattgtcccaccgtcccctaagcagaaaccagggttaagtacagaatagtcccggaacattttggttgcccggccttaggtgagcctttctggggctgggattttgacaccatcgctccattgtttctaaactgctgtgttctggcgcatcaattgtttcatcacattatcatacggaaagcttggtctccctcaaaacatgaaccgggtaggccctgtgttccagtgggggttttggacttgactttagtgtttaggaggacagagtccctctcccctctgtggtgctgggtattagtaaatcagccttgaagagataaggggctggggcctcaacctcccaagaggcttcactggagaatggtctcctgccctcagatcttgggcatttccacagcacactgtcccctcgtccttccaaatacctacatacgctcttgtaataggagagctgggaactccacccaaaccatacaaaaagttagtctgtgtatttggacgcctccccagcactcagtcaccgagttctcctttccaacagcagtcactctcatgcagtttaagtgatttattgatgtctcggctagcttgcgacagtttcaggacatttcagccatcaaggtctaagaagccctttccattcccaggagccctcagccagcctccttcttcctcatctcctcactctggccgcgtagcccctctggcgtccatcttggacgcccctttgttcgcgctccacgccccccacttccttcttcgtagctcctccactttggccgcgtagcccctcatggcgtccatcttggacgcccctttgttgcgctccacgccccccacttccttcttcgtcagctcctccactttggccgcgtagcccccatggcgtccatcttggacgcccctttgttcgcgctccacgccccccacttccttcttctcagctcctccactttggccgcgtagcccctcatggcgtccatcttgcacgcccctttgtcgcgctccacgccccccacttccttcttcgtcagctcctccactttggccgcgtagccctcatggcgtccatcttggacgccccttttttcgcgctccaagcctcccacttggccctgctctcacgtctgaggccggagggccggggatgtcgcagtcgccctgggtggcctgttttacaagccgtagaccagcagcttctcctgatcgctcacgggacccttcagctgcttgaggccgcgcagctcgaactccacttggcacatggggtggtggaggcggtccctggtgctagagctggaggtggagagttggagtggctgttactactcgatctcagggggaggagacaggacgcgatgtttgtgttttgtcaagcacagattgcaagctcggggtccagcgtaaaccccccatgtttgggctcacacggcgcattttctggggaggaccagccgtcaaaaagcgtctagatccggaacgctgctgtctggagggggcggcgcggcaggagcgcgttgagggactgtagtggcgcgagctgggcgggtgggagtggaagcctcgcgtggtgcggccgcgctgggtgggggcgtcccgggggaggcgctcggtgggggtgaactgtgtgcggggcacgcccggggttccgggtgagggtgaatgcggggccggggaatcatgagcccgacccgctgggaccccggagaggggccgggcaggggacggtgcggaggggtctagtgagcgacgtccgggtacctgaggctggtgggagggctctgccggaaggcggcgctgtgcgcttggcgcgctcgttcgtgagactgcgcgtgcgcggcggaggctgtgggcggggccgggcggaggttgtgagcaggcctagcgcggccgccgtggctcctgcgtctcccatcgtgccgtgcgtcccgcgccgcgttcgattctcggaggggagggggcgttagccccgcgcagccgccggcgtcgccgccatggacctggtgggtgccgcggctccccggccccgggctgcgtccagcaatgcgccaccagagcggtctgccccgtcgcgtctcctcctgtcgcgcacgctcgcgcgggcccggaccgaaacgtccccgcgtcggggcgggtctaggggtcccggggtggccttggcggggggtggtccgggtccgccgcgcgttgggccgcgtcttgccgcctccggccccctgcgcttgaaaacacggagcaacgtgaagttagagcccttggaagcgcccggggctcgcgcacgtgctttgggaaacgggtccctccgagcacccctgggcgccccgacggcctcatttcctgaacggcagctgcgttctgagcaagtgtcttaacgctccaagtgtcttacgctcatgacgtttcctcatcgacagacggggagaatggaagtgtgtctccccactgagttttgggcgactttgcattgagatcgcgaggtacagtgtcccttgtggggttgcgcgggtcacacccgcggtgggggcggctgcgccctgaggtatcactttgtgaacctgcgtgcgtccggattcagaatcttacaggcaaggttgggagggagcccataggaactagatgctccctgctaaatcttggcacacgctgctaagccaggaggctgttctgggagagctgggggtgaggcaccccgagatgtgtcagcagtagtggctggggggaaatggtctggtccccgcccccagacagcttttcaggagcggaatggcaagctctaagggcttggagcccctcagccgtaattgcttcccagccccaccacattcaggtgggacaccctcagcaaatcgtttctgcgcctcagtgtccttatctctagagcaggaatctagtcctcaaaaggtgattgtgaatagaagagatcttacctgtgtaccacctagcacatgtctggcatggagtaggtgcttaataaacctaagaagcgggctgtggcaagcactagtaaccatccatgatagagtaccggagtattttccagctagtaaccgccctgggacttactcttcaaactgtgcgtacttaatgcgcctggaaggcaggtgtttagggccaaacatctgccaactaagccaataatgcaataaaattaaatttacagcgtcaggagggactatattttggaccctgggagagcctcctgagccagaaagaagggcggtaacccccagggaggtcccctcgcagcgtaaccctccctgggagtcggtctcagccactgtgagatgagatggattgcctcacaagtgggttacatagtgctgagcccttggcctgctgccgctcccataaatggtgggggggtaagatggtccttagtctcctggagtcagtgttttctctgctggtgtctggcctggaaaatggggaatatgagctcttgggggcatgacagactgaggaaggagtagcatctctactcctgggaaaggggagatgactcaggaatgaggaatagggagcagtgtttgcaccctgttttagtttctgggccaaaggaaacatacctgataaagacctacatcctttgatgttttgagctgggggaggcaaagaatagtgacaagattctggtcttgccaaccatgaaaaggttggggaaaccaacatttactgagcacctaattagactctgtaactggattcttactgtactctatctcatttatccatcatagcgtcccggggagatggggtcaggagatagcagtgcaacccactagcaagggcttgactggtatatatcacatgatccccaaaggcataacatgagtctgtattatccccacatatgcagaaggaaggcttggagaagcaatctgaccaagatccatccctttttttttttcggagatggagggggagtctcactgtgttaccccagctagtctgaactcctggcctcagggatccacctgcctcagccccccaagtagctgggattacaaggctagccactgaacctggccagaatcacatcatttttaaatggctgaactaggatttaacccatgtctgattaaacatcccaagatgttttccatggtaagtctgtgtcaatcgttagtccctgaaggaaggcttaatctagcacagtattttctgtatctactccctggtttctccacagagctagggccatgagtaccttgtttttgactggaaggagctgtggggtggaccgttccctgaaagctagaagaatgtttgaagcctgttcccaaggcaagtttataaagagtgaggcagggcttgtctgattccttctgtgcccattgctctgtggctatgtgattgctctgtcccattaccctgtggctgtgtgactgctgctgtgcccattaccctgtggctgcgtgattctgctgtgcccattaccctgtggctgtgtgattgctctgtgcccattatcctgtggccggtgatcgctctgtgcccattaccctgtagccgtgtgattgctgctgtgcccattacctttggctgtgtgattgctgctgtgcccattatcctgtggctgtgtgattgctctgtgcccatatcctgtggctgtgtgattgctctgtgcccattatcctgtagccgtgtgattgcttcttgcccattaccctgtggctgtgtgattgctgctgtgcccattatcctgtggccgtgtgatgctgctgtgcccattaccctgtggccgtgtgattgctctgtgcccattaccctgtggcgtgtgactgctgctgtgcccattaccctgtggccgtgtgattgctgctgtgcccattacctgtggccgtgtgattgctctgtgcccattatcctgtggccgtgtgattgctctgtgccattaccctgtggccgtgtgattgctctgtgcccattaccctgtggccgtgtgattgctcgtgcccattatcctgtggccgtgtgattgctctgtgcccattatcctgtggccgtgtgatgctctgtgcccattatcctgtggccgtgtgattgctctgtgcccattaccctgtggcctgtgattgctgctgtgcccattaccctgtggccgtgtgattgctctgtgcccattatccgtggccgtgtgattgctctgtgcccattatcctgtggctgtgtgattgctctgtgcccatatcctgtagccgtgtgattgcttctgtgcccattaccctgtggctgtgtgattgctgcgtgcccattatcctgtggctgtgtgattgctgctgtgcccattaccctgtggctgtgtgttgctctgtgcccattaccctgtggctgtgtgattgctctgtgcccattatcctgtggcgtgtgattgctgctgtgcctgttaccctgtggctgtgtgattgctctgtgcccattacctgtggctatgctcccttcatctgtcatgagaagctcagctgtcatgtcctgtggtacatctcagtggcccctgtagtttgtactgtcctcctatttctaaacccctctccccacatccctgctggcccagcctttgctggagggtctcgcctcagcagcccagctttttcttttcaccacttttcctgaaggatctcattcaccgtcttggttccggtgatcccctctgggcagatcctctcagaatcacatttcccagcttacttccctcctgaacttccacctggcatttccgtgctggaggacatctgtaccttgatggccaaagctgaactcatctttcctcacacctgcctgattctcctccattccctgtatgtgatgtcacctggtggcctcccagttcccaggctgagagctcggaagccattctggattcctcggccaagtccttctgactccagctgtgcagggctcttgtagtcatcccttctccccgtccgctgatgtcctttaaaacccttgtcatctaaaccatgacagcctactaacagcagtggccatctggaaacattttcactatactgtctatttggcttgtctgtgtgcaggacccttgaacatctgtgaagaaatgactattctgcatgaggcttcttgctggccgagcagctgttccaccctaaggcactggcagaattaacaaagctgactgggaacgtgttggacggcccatcgtggaggccttaagggagatctcctcggctcagcacactcccagccctttgcctggaagaagaaagccctgatcatcatctgggccaagttctgcagccgcaccccgtgaccccgtccgacacagagacacggtggcaggaagacctgtcttctcggtgggcaacatgatccccaccatcaaccacaccatcctcttcgagctgctcaatccctggaagcttctggactctttatccagctcctgatggccctgcccaccaccatcgccatgcagaactagagcgctttctggaacatgtgaccgttgacacttctgccgaagactggccttcttcctggacgtctggtgggaggtgatgaagcacaagggtcacccgcaggacccctgctctcccagtttagtgcaatggcccataagtacctgcctgccttagatgagttccccatcctccaaagaggcttaggtcagacccagacgcgtgccccaccatgcccctgttgccatgctgctccgcgggctgacacagatccagagtcggatcctgggcccggggaggaaggctgtgcgctggccaacctggctgacatgctgactgtgtttgcgctgacagaggacgaccccaggaggtgtctgcaaccgtgtatctggacaaactggccacggtgatctctgtgtggactcggacacccagaatccctaccaccagcaggcgctggcagagaaggtgaaggaggcaaacgggatgtcagcctgacctcgctggccaaactccccagtgagaccattttcgtgggcgcgagttcctgcaccacctgctgcgggagtggggggaggagttgcaggccgtgctccgcgcagccaggggacaagttacgacagctaccggctgtgcgacagtctgacttccttcagcagaacgcgacgctctacctgaaccgcaccagcctgtccaaggaggacaggcaggtggtcctgagctggcggagtgtgtcagggacttcctgaggaaaacgagcacggtgctgaagaacgggccttggaggatatcacagcttccattgccatggccgtcatccagcagaagatggacgccatatggaagtgtgctacatttttgcctctgagaagaagtgggccttctcggacgaggggtagcctgcctggggagtaacagggccctcttccgagagccagacttggtgttgaggtgctggaaacagtgatagacgtcagcacagctgacagagccatccctgagtctcagatcggcaggtgatccacctgatcctggaatgttacgcagacctctccctgccaggtaaaaataagtccttgcaggtatcctgcgttcctgggggcgaaagggcctctctgaaaagttgctgcttatgtggagggttttcaggaagacctcaatacaacttttaaccagctcactcagagtcctccgaacagggcttggcaaaagctgtggcctccgtggcccgcctggtcatagtgcaccggaagtcacggtgaagaaaatgtgcagcctggctgtggtcaatctcggcacccacaagtcctgggccagattctcactgccttccctgcccttaggtttgtggaagagcagggtcccattcatctgccactttcatggtgtcatgcctcaaagaaaccgtctggatgaagttctctcacccaaggaagaaaagcaatttttagagctcctgaactgcctgatgagtcccgtgaaacccaagggattccagtggctgctcttcttgagccagacgaggtgctgaaggaatttgtctgcctttcttgaggttagatgttgaagaggtagacctcagtctgaggatcttcatccagctctagaggcaaacgcgtgccgagaggaatactggctccagacctgctccccgtttccatcctcttcagcttgtgccagctcttggaccgcttcagcaaatactggcagcttcccaagagaagcggtgcctctctttggataggaaggatctagcgatccatatcctggagctcctggtgagattgtatcagccaatgctgagaccttctccccggatgtctggatcaagtccctgcctggctccaccgcaagttagaacagctagactggactgtgggcctgaggctgaagagctcttcgaggggcacttcaagtgtgaagtgccagccacactttttgagatctgtaagcttcagaagacgagtggacctcccaggcccacccagggtacggggctggcacggggctcctgcctggatggagtgctgctgcgtctccagcggcatctcggagaggatgctgtctctcttgtggtggacgtgggcaatcctgaggaggtcagactgttcagcaaaggctttctggtggcctggtgcaagtcatgccttggtgcagccctcaggagtggcagcgccttcaccagctgaccggagactgctggagaagcagctcctccatgtcccttatagcctggaatatattcagtttttcccctgctcaacctgaagccctttgcccaggagttgcaactctccgtcctcttcctgggactttccagtttctctgcagccatagctgtcgtgattggcttcctctggaaggctggaccacgtggtcaaactcctctgtggcagtctgacccgcctcctggactcagtcagggcgtacaggcagctggcccttgggttcaaggaccagagcaggacctgacccaggaagccctgttgtttacacccaggtgttctgccatgctctgcacatcatggccatgctccacccggagtctgtgagccactctacgttttagccttggaaaccctcacctgctatgagactttgagcagaccaacccttctgtcagctccttgctccagagggcacacgagcagtgcttcttaaagccattgctgagggcatcggccctgaagaacggcgccaaaccctgttgcagaagatgagcgcttctgacttggcgtggggagctgggccccaacatggcgggtctgcagaagatcagcacttcttacctgtgcgggagcgaaaaagctgggcttcaacatggcaggtctgtaggggtcgacccgagcagcctggactttacagttatgtgaaactgtccacaaaaagtcatggcaatatggtgtaaagaaaatagtttcttgggtatttgtaacgtacaaactatcataaaaattccctctttcgcatctcactttgtctcttctaagtcggcctcagcaatagcccaggattaatatgctctgaaattgggtttagtgtcttcaagatcaaatccagccgggaggaacatgttataactggacttttccatcctagattttggcaaataagcccaaagttgaaaccatgtgatggaaaaagcattacatggtacgtataacccccttcaagagttatttcgtcttttaatgttttttcttgaggtatcttggaaaggacagcagcttggaaaagaatccagtccagccctgctctgcctctggccatgagactgctgtgcccgagaggcctgcacaattctaaaatgagggattggaggaccaagataaactcagtggcgaggggctaggttagtgacctcaagaaaagggtcccctctgaattgaggagtgtgtagtctttgttgctcagactagccttgaaccccggactcaagtgatcctcccacctcagcctcctgagtagctgggacaataagcacacccattcccatacagtcttaactccatctattcagtcacccccaaaggggctactgtgaagacagacctggcaaacccagcagagatgtgctgaatggatgggtcacgttagcttttgcctcggaggggttgtcaagatttggatgaatgaatggtttggataagggaatgatgtgtgcagaacataaaaaatgagtttgggccaggtgcggtggctcacacctgtaatctcagcactttggaggccgaggcgggaggatcacttgagaccagccaacatatggaagccctgtctctacaaaaaaaaaaccacaaaaattagctaggtgtggtgacacacagctgtagtcccagctaccagggttctaaagcaggaggctcacttgatcctgggaggtagaggctgcagtaagctgaatcagaccactgcactccagccttggtgacagagtgagaccctgtctaaaacaaaaaaaaaaaaattgagagtgggctaggcatggtggctcacacctgtaataatcccagtgctttggaggctgaggcaggaggatcacttgaggccaggagtttgagaccagcctgggcaacagaataacctgtctctacaaaaagaaaaaaaaaatgagtttaaggtgtctgaggtatgaggaactatgaaaattggctggggacatgtttaatgtgtgagatgaaagggggaaaaaatatgcccatcactccctccatatccacaccctccttcacaatggggcattactcaggttctcccaggtaaagtaggcttggctccctgaccaataatcggtcttccactctcccaattcctataagattcacttatgaagagaagaaacggtctcaagttacgtgtgaccactacgcttgactctgggaaccttcaatgtattactgagaccatgaaccacaaaaataggtttgagtgagtgtgagctagacctttctggaggctgaaagcattcacacacacacccctctgctagttaatggacacagaccttgagccacagcacacggcagccagtcgagctaggtcacaggatgatcttacaggacactgatattgatgtatttcacaaatgagaataagttgggaatgttagtcaatttaatcaccgtaagggtgacttttaaagatacactgatagttaaaaaaaaaagacattaaaaaatagcattttgttttttaaatggcacccattaaagactcaacagtcaaaatagacaaatcagtcctttagacgttcacagacaattgaaaggcactttaaaaatccacttttaaactaccacttgagaacacatggtagcacagtcttaaattcatcctagttgatcggaatgatgaatgagtgttggcaccagaaaatcctgcttgcagaagggggcgcaggtgtcgtccacgggacagccactggccaggctagctgccgcctcactccgcagccttctgtggctaatggcaggacggacacacaggaatgggctttggaccacaagctctggcatatcgggagcaaagcactcaagtactctgcagtctagatgacacatttcatggtttggaggacagaagaggtttccacatcacatgaaaaggacagtgtcacagtggggttacccagtaaacagctacaaagccatcatttcacgcttccctgtagttttatgagctcgccctctgcatgtggataggggaaagccgggcatgaaggggtgtgtgaaaaagaacagcctctgtgactgactgcagaagctcacaagtttgtcactgtcagacttagcaagtcagcctgcaaaggttgtgctgattcttggccacactacctactcaggttcccatccatgcctcctgcctgcccccacccccaccccaccagtgagacttctgattggaagtctatagacataagaattcaactctgacccaggatgagaggatgaggcaaagaaccaatgggttatctagtaaacgatcaataactacctcccacaatgattgtcccaggccaatgtcacaagacgacattacttccaagaaccaagtctcccttgcttctgcgggcccagtgccacgggtactgtcctgagtggtttggaaggtgggagccgctgatacagggacaggcagatgtgcagacacttaccaccctggtccaccgatccaccccatgcttccacctcccagagctcttgagataagaccttaagaaggatccttgggctgcattaaaaccactttgctgtccgtggaggtctgacaggacccaatagttgttactacaaagtgcttttgcaaatagggcaagttagaagaaggaggtaatatgaatattctttagaaaactcaaatccatcggcttatcaatacccaaagtctgaggctacccagggcacaatttgtccatggaatgctgagtggaggaggcagctggtgtgaggctgcgcctgactcccaggacatttagccatcctttttggcttggggagtgtcaaagagccggactgccttcctgcacacagacagaaccagtagatctgaggagctacgaggaaggcattggccacgttgcagtagatgggatgctgaagggtacttggagcaggcttagtccctgctggcggccataggaccagtcatgaaggggaagagaaggatccggcaggaaaggaaggtggccagcgtgaggattccatcaccttgtacagaagggtgtgctgctgctttagctgcaatagaagaggaaggaaaaaggaaggtcaccaagaagctgggcatcagggagcgacgggcccaagtcccaccacagtaaatccacacaggtgcaggtgctcatcaagaccttggctgtcagattccctggcgcccagacgttgtctagttttctaacacttggagaagacattcttgaacactatcatattgagatgtgaaataacctcattttctccaatagtgattttgaatttgacccaggccacccagctgacagagtacaggaaccgtggattaaagtatgtgtgtaaccagggaaaaaatagaatgagctgatcaaactatcaaacttagatcaaacctacaatttcacccccactggctgagatgaccactgacctttaaggctgttgaaggatctctcatcccactctcctggcactagggatttctcacacccaccatctccgaaggaaaagcagaatccactccctcccacactctttctgccattcattcatgcatgcctgaatcagaaccctcactctctctgccattcattcatacatgctgaatcagaaccttcactctctctgccattcattcatacatgcctgaatcagaaccctcctctctctgtcatttcattcatacatgcctgaatcagaaccctcacactctctgtcattcattcatacatgcctgaatcagaaccctgcccagcgacacaaacggagtgctcagttctccgtgaagatgcagccgacaaagaagtccccaaggtctccccggagcctctgcggatgagaaacgaaaaggggaagtaagtggaggttaagaaaccaccagaaggaaaattccaacgaggctactgaaaagggtaactgtgacgggcaaaggacgctcaataggcaagcgcagactatgtaccgctgcttccgtggcaacagcactttgatggtccaagccctaggatccagaggcaattcagacaggatgacggcgtcccacaccaagctctgaattttgatgacagccggaagaaggctgcaagcctacttttgtgtatcgaacttagtcatgccaagacactcagcctgttggttcaataaaatgtgccaggccctgtgctagatgttagggtctcaaagcaccctagatttctggttcctagatggtaggtcccagacacttcttaaagaatttaatgcacgttaccctatttatttattttatttttattttttgagacggagttttgttcttgttgcccaggctgagagcaatggcgtgatctcagctcactgcaacctctgcctcccgggttcaaatgactctctgcctcaggctcctgagtacctggaactacagatgtacagcatcacacccggctaattttgtatttttagtagagatggggtttcaccatgttggccaggctggtctcgaacttctgctgggattacaggcatgagccacctcgcccggcctcttttttcaagaaagcagtaagcaggtaaaatatcagctctgccacttagtaccactgagagatataagaatactcttagagcccagtttcttcatctacagcataaggctaatagcttctaatatttagcaagctatgaactttaaatcacatgcctggcagggcgcggtggctcacgcctataatcccagcactttgggggctgagacgggaggatcccttgagcccaggagttcaagatcagcctgggcctcataagagacccccatctctttatttaaaaaataaaataaaactacatgccggccaagagcagtgctcacgcctgtaatcccagcactttgggaggctgaggcaggtggatcacctgaggtcagagtttgaaatcagcctgaccaatatggtgaaaccccgtctctactaaaaatataaaaatagccaggcatggtggcgtgcatctgtaaacccagctgcttggaaggctgaggcaggagatcacttgaacccgggaggcagaggttgcagtgagccattgcactccagcctgggcaacagagcaaaacgccatctcaaaaaaatgaataactaaataaatgaataattaaaaaaaaaacgcatgccttcccctggccaggcactcaagagtgaggaatttcccctcagctttcccatgcttttctttgttgggtgggcttttatggggaaatggatctggggagaaagtaggaggcatttgctttgagaatctgtgttttgtgacctaagaataatccacacagtgctctctggcctgttatgttgctttgtattatatttgtattttatattgtttttatcttgtattgaactaggatagaacctctgacaaacgctagggaatcacagagcgctgggggtttgttaaaaagatgttggggccgggtgcagtggctcgcgcctgtaatcccagcactttgggaggcctaggaggaggatcacttgagtccaagagtttgagaccagcctgggcaacatggagaaactctaaaaaattacaggaattagctggacgttgtagtgtgtgcctgtgttcccagcttcctgggagcagaggcaggaggatcacttgaggccagtagtttgaggctacagtgagctgtgatccacaactgcactccacccggggtgacagagtgaaaccctgtctcaaaaaagaaaaagtatttgatgttgatgttggtaaggaggatcatgaacgtttcatgtgtaatggtgttcctccatattcacctgggggaggtggctctgaagcagcaggcacaaggagaatgggtgcctatgatggcaaagaaaagaggggcaatcccgactcctaagtaacggtcaagacatctagctcagccgggcgcagtggctcatgcctgtaatcccagaactttgggagg

SEQ ID NO: 5053 - DNA, 57536 bp, Homo sapiens
ccagatagacatgcatcagtgtcctcggtgtgcagcacacaggatccagtctgtgttagtgtcagacaccacaggtgaccggtgacattccaatccttgccaactgggcagggctcttttcccaggaggctggcactgcccggggaagaaaaaataaggggttttgaactctgagcctgctcctcacatcctgtccattgaggggtggacgcccaggccctcaaaaatttatacttagtgagacacaaatgcatggttttccttagtgccttcatctattcaatacatatttattcatgtttccagctggaggtggtggctcatgcctataatcccagcactttgagaggccaagcagtcggatcacctgaggtcaggagttcaagaccagcctggccaacatggcaaaacccatctctactaaaaatacaaaaattagctgggcatggtggtgcgagcctgaaatcccagcactcaggaggctgagacaggagaattgcttgaacctaggaggcagaggttgccgtgagcaagattatgccactgtactccagcctgggcgacagtttgagactctgtctcaaaaaaaaaaaggatatttattgcacgggtcagaggtgtcctggtggcacccaagctgaaacctgcaagtaagaaagagtttaccaggagaagagggaggatgagggaacagtgtttccagcagaggaacagcatatatgaaggcccagaggtagaagccttttgaggggcactgaaagtagcctatttggctggatgcaggcaatgagcgtggaagggaactcaagagtcccaggcaccccgcagagaatgtaagggtcacagtcaacaagtattgagccctgctgtgtgtagcagtccaaggaaaacagtccctgcccccaccaaagggagagtggtaagaagctgaaggaaggcagtagaaggtctgtgtgggagtttcagtggagaagaaatcatatgtagttgggaaaaaatcagtaagattcttggaggtggtagcatttgagattgaccttgaacctcaactagaatcttgtcgctggggaggtagggcatggatattccttgcaattcacagcagaacaatgaacatatacgagcatttaccacataccagggcgttagctggctttctccaagcaaccttctgaggtaggactactatcattcgcactttatagagagaaaactgaggcctagaaaggggaggtcacagtccaaggtctgtctagctcaaagacagcataatacctatagtacaatgtgccgtggagaatgtttatgaagccatctcctgggggcaggctcatctccatggctgctcttggcctgtttttcatgcgctgcccatttggaggcatgtgcctgttgagtgtttaagtattgatctcacatggtatgacaggcacaaatatttaaacattcagcagtgaggcctcgttgcccaagattgtcccagcgtgactcggggacagaataacaaaatgaacttaggtcttattatctcctggaggcttattgtggtttctcaagtgattacgcacattaatgcagggactccttttgctatgggggaatttctggcatggaggggggtgtggttaaggtaataacatttcttctgaaaaaaaaaaaatgaaggcctgcttccctacaggggatattttcttaggttgaagggggactttcagtgttactacaattttggaaagcctggaatatgggattctttgttgtcatggagacgagtctgctatgagcagcagatggggtcctggacagagggcctggacaacgggcaggaggcaaagcaggttggtgacaagtctgggggtcctgactcccagattgggtctcttcccagtcgtcacctatagcctaatgagaggctctctggggcggcagaaaaactccctggcaggatcatgagcttacaggcccagagccctggctttggaggagcccaggcctgagctgagatcagtctctgctcctctcctactgtgtgtctctgggccagtggttcgtcctctctacaccttgtttccccatgtgtcaatcattaccatgcagcaagtgctcaaaaatgtagctagtaggatggttttcgtggctttgccagcagatagccaagtaccctcaggcaagtcagtgcctcttctgggcctcagtttacctgcaaaagcattcaactagctaatatctaaggaccatttctgcctaatggcctgtgagtctatgactcaatgaactctcccaactcgagaaagagagaggctatgataatgacattcacaatcgacatttccaccatctattgggtgcctactatgcgcgggaaccctgctgggcaccaggtcctcctcgtctcacacctacagtgcagcctcctgacatcttctcacttctgatcttctcccttttaatccatcctgcatacctggccagtttcagtttcttaaacgctgcctgctcctttgctccagaacactcagtggctccccagtgcccctaaggtcaagacccaactccttaatgtggcaagcgaaccttccatgctcaagcccttcccttgtcatggactctctgacagactgtgttgtctctttgtctagtcctccccattcctcgactcagtaggtgctcaataaatatttgtcgagtgaatgaacacatggataaaatgtttcctaaattaggctactcaaactttagtcctttgcaaagcagccacaagagttttgcaaaatctgcacaccatgtctatttttatttacttaaatattttccttttttagattaaataaagtatctcaaaaggaaactttacatcatgctataactagaaggccaatattacttgccagaataggtctccattaaaataaatacaaggacaaatgagcaaagcattcaattctaactaatactgttgtctaccaaagctggcagcctctcagttaaaatgggattagtcagtgctttgagaggtgttaaagactaaaccagcaccaacctgagacttgcccattgacagaaatcacaggatgtaacaaagggatgaataggggagaactgtttcactccaagttatttcactccatgaaaattatcctacctaccatcagaggttggcagcctacattttggaaaccttgttctcagagcccacagctccagctcaggaggtatgcatatgagttctctgaaagacttcaactaggctttttgaaagagtattggaagccctgcatgcaactacctcgccttcacaatataggtccctatctgaagtctcactgcaccagagacagctctcagagctcgactgtgataagatttgttggaaaccatcttcctggtggaataatgagctctccccatccttgcagagatgcgacatacgctggacagtcatgggtgtagggcaggggcagggaatgccagcgggggcaggaatgtcatggagataattcaagcatcagatggtcagcctatgaaattgacctgatagctgagtttgctttcatatgtaagcaaaacaaatccagagggatgaaaagagagaggaattctttctggtcagcaacgtagaaaaaacagagagacaattgtgaatgaggttacccagaaacacgaaggacaaaagggggatgggaatggctattattattcctttttataatgcttcatattctcaatccaacactggattcatgaagactattttggttttaagcaacataaactgattcaaacttgtgtagcataggaaaaacaatttaatgatataaatagctgacactgccttaggtatggctggatccagggacctgatatacatcaagactcactccactctctgtctctagttctgctctcctctatgttggcttcattttaggtcgggtctgctcaagttctgcaaaatggctgccaacacctctatgcttaggagctttggtggagattgagtttctgtttgacatagttttagcaaaagtcccagacagagttctcattggcccagcatatgtcacatgtccctcattgaggtcagagtgatgtgctctgattatctgtgccctgggtcacatgtctgtctcaggaggagggagccccacccaaccatattgaatatgagtgaaggaggggaagtttcccaatgaaaattgaggttctgtcacccaaagaagttgaaatgaatgtcaggcaagcaaaagtgccttcatttttgctacccttgtatctccactcaaagctatgccccacatctccatccaacagctcctactcatccttcagacctcagttcaaatggcgcttccttgaggaaaccttccaaaccatcccacactagactggaatcccctgctggactagaatcccctgcatgtgtgccctggcagagcttgtcattctgggtttgtgcggttatttgatgaaagcctgtctcccatctggactggcatcaccttgaaagctgtggcctgtcttgtccatcgctctgtccctggagctaggacagtgcctggcacacaggtggaactcgggaaatatttatttgaaataccaacgaagtccacagcacatatgacctggtgatcagtggtgggaggtgaatgggtcaagaaagaaccaagattccctgctcatgagtgagagtgtggggaaacagaagaagtcagggtgacctggtgagcactgccctgggggactcgaggatggatgaaagcagggaggaggccagattagtggggtagaggacctgaggtccatcagcaaaggccatccctggggacaaagagaggagggaagagtaggtctgggctggagagaaggaatcttttctctgagttcctggggaccccaggggaagggcagatgtggccccattcccagaagcctttataaaagagggtggggaggtcagccttggcaaggacaagggaaggagtccctacgtgctggattgggattggctggaaagggacttctctgggagaatccctcaaacctcaagaactgagagaagggtgtctggggctccgccaccatccctgtttcccttttaagtaatctgtttccccatctgtccatccatacacaagccacttgtgtctccatgaccaaccgctggcagtggaagggtgtccttcccacccccatcttacacacactcccagctggtacccagagcctggtcaccccaggccaggcctgtgttccaggtgtaacgggcagcagacgctgccctaggactagagcagggagggggcacgggccaccccaacccacagcgacccacagagggcgaaaagaggacgaccgcagagagaaacggaaggacaggccaacggaagcagtgctgcaaggctggaaggagaaaagccaggaggggagtcttgctgtgaaagacagggagacagagaccaagacggacaggcagacaggctggtgaccaggatgaggccggaaagagccatcaaaggaaggagaaggaaggagagagattggagcggacggcggggcaggcgagggaaggagggggtggggagagggagggaggaagagaggggagaagagggaggaagagaggggagaaggagggagaagagagcgggagaatgcgagaggaaaaagggagaggggaggcgtagaaggggagaggaggtgaagggaaaaggagagagcctgctgcggcgaagctgcaagaggcagctgcggagggagcgcgcggcgggcctgggggagcgctggcgggggcgggcggtgcgggcagggctctccccgagctgggcgggctccgggcgccgcggccctgccctccccctccatccctccggactcgctcccccctcctctcccttccccgctccctccgcccgccctcggaagaccgagacagcggagaggttgcgggtgactgcgctgacccaggagccgaggagtcgggagcgcagcgcagcccgagcccgagcccgagcggccccggtcccgagcgcatcggagcggccgagccgcccggtgcagcgcctgtcccgggcagcgcaccccggccgcaggtaggaaagggcggccggcgtcggggcgcggggcgcagagcctgggaaacggcgcaggaacggccagagccccgagccgctgccgcgagccgggccgggtggggggggacacctcgagattcaagcccccgcgccgcaccttccctgagccacatgaaggagcagggcgccgctcggaccccgacgtgcgcccaggccatccgtcccctgggacactcgggaggaggagggctggaacagaggcgagagttgcatgccccttccctcccgcggtgccccactgccccgcaagttggcactggattctgctggagccgtcgaagctccctattcattccccaggcatggaggggacgcggagtgaatgacaagagcagcgttggggggccgtgcgccactttccaatcctggggtcagctgagccgagttagagctatgcccctcatttgttctctgcgggtacggcggggtcgggtgcgacttgaggatgggacgtctctgggacagcccaagctctcaaaacgttggcttaaaagcacaccggggcttgggctgagtgcaccggagctaagcctagtcaccagagctcgcgccgcgctctcccagccccgactttctccaagagatgtggggtgcggcggtcccttagagggctggaggacggtgcctccttgctgcttcgggaactgcgctcccttcttgcttttggtctctgcgtgtactccccggcgcgacaccgctcaccacggtagcctgggcagtgcccattgggttctgagcacacgtccccacgggtggcacccacagatgtcctttctaggcttggctcggtcttcagacaagaaactcagaccgggcagtcccctattgaggtctgagctaatatcctcccaaaatagacatgaaccacaaggagaattttttaaaagccaatgataacaccacgttctttccggatgtggggctggagcgctcattccctttcccaggagctcagccttatccccatgaagagctgggggggcggggagggcgggaataaaatggctctgagatttgtgacaccccaaaaatcagagacggtatcagactgagtggcattgggggtcacctttgtttttctatgacacacaaggtgggtgtttggcaagagagtagggatgttggggctggatagtgcctagattctgtgtctttgggaactttgggggaagtgtcctcctaaggagccaaaaaggctgctaccccagtcccccaaattccaaaacaaaagaggtcagtgaaagtactcgcattttgcatgttatctctttatctttggagcacattgggaaggactgacccactccagatcagggtctgattggggcaggacagaccctctccaaggcagagaaggggaaaagaacttgcccttagaagtgggagtccctgggggagtgggacagaccttttcccagagcgccctggcaaaatggctgagcctcccttgagcctcagaaataaatcgtcaggcaggcagaaacaaagaaagagctctgtctccagccaagcactggctcagtggccagtccttggaggcaaacagtgagtcccaagcagagagacgcagcccggcctgtctggcagagcatctggaagtggggttcccctaggaacacacaggagagaggcagccactctggaggtaaaatcagggccctctgtcctgatgtgggacactttatttcaggtctggaggcttgatgagaagtgggttccaggaacttagatggggctgggaaggatgtctggagaccaaggagtaggtagcttaggggtaaagatgaggcaaaatcaagtccatcgaagccaaaagatgcacagtggccacgtcctcctgcctgccacggattttacatgcctggtgaccccggagcagcagaggctataaattttttacacgtggcccagcacacagcaggacctcaataaacctcttagaataaagcctgatggatggaaggtgatgctatcactggcatggacctacctgcaatctgtacctgtctcatgagccaggaaggctataaaatgtggccccttagtccatagccgggaatgaacgagcccagatgagggtttgctttgagctggggcattgccatttctggccaggtgaccttgggtacttcttgttcctgttggaaggaaggaatggagtacccaaagcttccaatgtgccagggatattcctacaagaaccgtgtggagcaggcactattctaatccccacttcagaggcgatgaactggatgcagagaggggaagtgacttgtccaaggtcacatagccaggaggaggaagggagggatcttaaccctactgttctaatttccaggccaactctgtcctattgtgggtctctggcctcggtttttccatctgtaaagtgaagtgatggggtggtagttcccgtgggcctgcatgggagcagtggctggtcctctaccttggtggcatatgacatgtggagagcaccatgaataaataaagcaccaatatcaggccacttcttgccatcacacaaagactccattccttgcttggctgtgagctcagcagctgagatagagttccatgctacttggaatttggagatgtttttccaccctcttgcttgtctatgggtctcaggcagagtgttaatgaccgttgattcaccttgccaccacctttagccacctgcatcctgaagtccatctcctttgtccttagaagccatccctgttgcctagcccaaaatgtgcccaccttccccttgactaccacccccgccccgcagcccctctcctcagccacagccccaatgccaaacccagttagagccacttcatccctctctgcccaaatgaaaactaaaatgcaagcgtcagcaggcctgtctatgcctgtgtcggactaccccttcaattcacccgtgcaacgtcgcctgagcttctctgtgcctggagaatgtgggcagggtatagccccgctgaatgacagcaacctcgaattgacttcagttgccaagacattgggcacttcccccacaaggtgaaaagatcatcctgtgtccactgctctgtggcttgcatgcctcgatgctggcttctcagacaggccctgcacgggtggctcttcttgccaacttaccccattctctgaagggcactgggagatggaggggaagaggttggtgcttgaaaaagaaagattgggaggccagatgtgcaccccaaaataggacttcccaggaaatgggtctcaggagcatattaacatccagcatcttcatctactccatgctcacctaagacctctggggtcggggaaggggctatggagtcagtgggaagtgggccagtagcagacaggagagttgcctgcataggcagtaggtgtgaatgcaagctgtgatatttcagcagagacctggaattcagtctaaacagaaaagaaagaaaacactaaatattgttccaatgcaattgtatcaaaaacagtataactgtcagttactgcatgttggcaatatgccagggactgtgctgtgtgctttatatgttgcagttaattttcacaaaaccctgtgagatacgtagcataatgatccctgtcaggggaggaaactgaggaggagaggggctaaagcacttgctgcaggatcactgggctggtaaaagccttaaagcccaaactcagtcacagcatgcttaaatctctgccactgaaaagcccctacactgcttacttggcaatgaccatgagcgccccccgctgcctccaccccagttaaggactgcacagtttacaaagcacttcttcatccattccatctgtggagctttgccacagctcgggaggctgggtggcatgatagcttctgcgtgataactggggaagctgacttgcagagaatgaatttgtgcccaaggtccctcagctgctaggttgcagaactggggttcaaattgagtgtccagcctgttacaacatatttgggacctagattttaaattcatttgcagctagtgcgatgtcatgcactcagccacctttccctaactctcgggtatcccccaattttgtccccacatcttactgctcaggaagctattgagagtgccctgacaaagccatcagctgcatttacgtgatctgacatgacacagaagtggcatccgattctatgcaagctgcctgcagcgaatgtcttctatttttacatttctcacaaattggaaattacaaggaggccaggtcttgcagcggattggctgtggtgctctgaaagcaggggatgtacaactaggtggaacaggccactttagatgccaggggcactgttggctgtgaaaggggccccctggctgctggggctggatgggacctggcacacaggccaggcttggggatgcaggagttagtgactgccttggacggtgaccgcagctctgcccacctgtcagctgcctggtgtctgcaagttctgtgtctcacgccagctctgagataactgagccctggccagagggacattcaaggtcaaagatgccctgaaacatcacagcaggttgctttcatggctgtgtagtttgataaggagattctgtgcagggagagggagcagccacagggaggtgagcaaagacatttggtatcagtgttgcggtttgctgcaactagcgctgatcacgatactcccggtcatcagaaccgcactttatactttgctaaaaatgccttgcagctgctttttcttttgatcatgtatgaagtattccaggggaagaaaatatggtcttgagatcctggagaagaatcctctctccaataaagagtgatttttttaaagctagtttcttataaagcccaaatcagaatgaccttgacccaaatgaggctcctttgcacacatgtcgtacatgcacacgttaacacttatgtagaatttcagttttcaaagtgttttctcagtcaagcttgtgacagccctgggaacttcaagtgaaggtaattttattgttattattggtacattattatccccatccaaaagatgaacctgaggctcagtgagccctgactcctcatctcgtcccctagtttcccagctgatgaaaatcacctttgctaggctgaaatccaagttcaccggtagccccttgagaaggagcccagatgaggccagatctggtaggaggcagagcacagacactcaaagatcgagacttacaagagagcgtgggaaggcacggctgtgaggctggggagaaagggccgtagcatcttgtaaccttacctgagctctggccagagattaacatctccttgttatgcgcagagtttggggtccaaagtgtgatcatttggccggggggtcccagcagtaccaggcctggagggagaggaagggatggttgctctcacacacctatgtgcacacaagaagcttttctcggtgaattgggggagaaatgaacaccagggaccccatgagatttcatagaggatctaaaggtcttggtagccaggaaggttgtggggagtgtttgtatgtgagcctcagtcagacccactggaggagcaggctgtgtgcttctgagccatgcccaggcaagagggcaggatcactcacctctgcctttggactgttgccatgctggagattgtgaaatatcatgagtctaggagcttccctctggggtgcagggggaggcaagagacctgagggtttgacagttcctggctggatggtggggagagaacttgtccagctgggccctgacagtgagttcagagggctgctgggcactggtccctgagccaaggctgatactggatgataggtgctactctctcctctgccagagaggaccctgagcccaagggtggtggagtcacttgccacagggtgcacagacaagtttggtcccaggtcttggtgatgccaacctcatgctgcttctgaaaagcacctgaacaagataactgttggggagccaggggctttttctctgtattcgccatttctggctgtgcatgcaagggctgagaaaaagtgaaagcaatacaaaataaaagtggccaaaagcaaaagtaccagcttcctgggcaccgtctgagctgccagcctgcaatccaggcttcactgccgccgagctgaccaagcccctttccgcccaagtcagatgtttccagagcttaagatccaggaccacctatgattaaaaaaataataataaaaagtaggcctggggagagagaagaagtcatctactgaagagtatttttgaaagatggaatttaaatgcacgcatgtattacatatgcattttagcaggttggttcagcataatgacacagaatgatctgatatgtacatctctcagtctgggctctgcctgtgacctaggcactgagccagtacttcacaagcattgtcccaggatcccaataaggaaactgaggctcagggagctcaagaagttgcccaaggtcataccactgacaagggcagagctgggaatcagatccaaagctgcagggctccgaggcttgggcttgcagactgagaaagaagtgggagagccgccttctgctgggcctcaagcctgtgggggaccgtgggaggttctttcccctcttggctttgcatgctcagttcatacagccaagaggtttggaccatggataggatgatcggctgctccccgcaccaggcgccagttctccaggcaaggggagggagttgcacgccccacttcctcctctcctcctccatttcccccataatagcctccccgagctaatgactgaggaagataagagccctttctccaaatggcagtgaatgccactaatgacgagcagatgcagcactgttaattattccacgggtattaaatgaaaacgccagccctggagagttaaatagcaccactgatctggcaacgtctgtgcttaaaagtgatgccatcaaaccggccggggcagagcagccccctccccaaacttggagctagacaggagtcacaaagtaaggtcccctcattggtcacagacccctcttcagctcagggtccgaagcagctccttggagaatggatcggtggctgctttgggagattttcttaaaggcccctggggggcctagactagtatccttaggggcagatgtggacaaacaattggaccgaataaaactctgagcacctactggtgccaggtcctattttggattgtagaaagaaactggatgctgttcctgccctttgaagtccacttgcattgaaaaccgtagattccttaagagcaggaatgctgtgttgtttggagttctggtcccatagtcaagaacacagagtgggtacctctgtattactttgattatctgctgttccttgaatgagagccagaggccacacagattgtggccagagtgagatcggtgggcaagggactgggccagggtcaggctgtcttcttcaggtacaagcaacatgaccttcctggaagcttagccccaggttctgaaacaagccatgacctggatgaagagccgggttttccactgctgaggcaccacaggcgactcctttgccctctctgagcctcagtttgcacatctgcaaatggggaggataagggccatgatggctgcaggcaaaacaactgtctcctaaccaatcctgccctgaatctggaggatcacagagacctcatgaatgtttgaagagtgacattctggagaaattcagcagagagagagagtgtagtcaccaaaggcagcatctggttcttcctgtgggctcactcaaatctcactccaacccccaattcatctccagcagctcaggtcacttgttccagcttcctggacctggaaagctgtttctcaggtctttgtaggctagagaacatcacaaacccacccatttcagacacacctgtgttatagatgggtaaactgaggcctagagaggaaggtcctaggtcttgcagaggctaggacccagagcttctaacccctaacccagtgctctttccttccaccaagccagcccagctcctccgttaagaaattattaaatagagttggtggaagactctggttgccgtgacaacggagcctgtgtcctcgggagataatggcgttgcacaagcagagcgatgtgtgttgaatgctgattcaggacctgctagagtgagagtgagtacaagagagagtggaggggaccgtgtctagaactcgagcttccccaagaaggaggtgcgggactgtaggggtggggcaaattgccttctctacttccatccttcctacagccttgtcagaatggatacttccctgcacttcgtggaggtgcagagtcaggtgaggagaggtgaagtgactcatccaggtcacacaaccaggaaagagccagagctgggattatacctccaaccaacacggggcctaggctatagggagggcctggaaggaggctcacctgcaggggcaggggatggttgatgagacctctctaaagtcttaagtgcttgtggaggtcctgatggtccaggaatgacaattcagcccaagaggaagagaaaacagaatgtcagcatagctaaaagcatcagctttggagcaaagtcacatctctccctgccacttactaaactgtgtaatcctggatgagtcactttcttctgagcctcagtgtcctcatctgcaaaatggggataatgccggcacctacctcataggttgtggtgagactgcatatcatgaggaagataaagcatcgagccccaatcctggccatactcaatcaccagcagctgttgttatgaaccaaaggggagaggctgggaaaaggatccaccccaaccatgtatcagcttgtaatttgtggtgttggaagagcgaaactggctaacacagacaagcatgatacataacagggctcttcattccaggctagtaaatatcactagaacaaagaacagctccatcaccaaaaatatacataaatattttgcatttgaagagtgtgaatgtttacctcactgcaaatgtactgtccttaaaaacctccatgcacacctcactgagggaatggtgttttctctgtgccagctatctaaatgaccccatgctgcaaacgcttttggaaaataacactctcacccacccacctagtttctcttctagaagcacagctggttcagtgtacttactccctaatcagggattggagaacatggggttaataccctgtgaaaccccaaagtgcatatttgcatgctggcaaagatgcaggctggcagacaaccccattccattttggaagcggaagagggtgctggactcaggcatttggctgtttgaaaagcgctggtaagagctgggatccgatgattgagatgcaagcaaccattttgtttgtttccgcaaacctgtttgagcaaatcccccccagagatagcaacctgtttctgggtcccctgagagagagggtcatttgtttgctgtgtttctggggctggatgccaagctatgaggcaatgagctgacgaccttggatcctgaccccctattctatgcaggcaggagaagggtcagggagactgattcagtgaacaaataaagcggttgacatttaaccaggattttaatgggtgtgccaaattgcaagatacatacacatgccactttgggaatcatgtttaataaacaatttgccctaagaatttgattcaatcagcattcccagtgactcccaccattcctttatattgattgcctataggttaagataacactgggctggcgcagtggctcacgcttgtaatcctagcattttgggaggctgaggcaggcggatctgaggtcaggagatcgagaccatcctggctaacacggtgaaaccccgtctctactaaaatacaaaaaaattagccaggtatggtggcaggcacctgtagtcccagctactcgggaggcgagggaggagaatggcatgaacccgggaggcagagcttgcagtgagctgagattgcgccctgcactccagcctgggcgacagagcaagactccgcctcaacaacaacaacaaaaaaagtaacactggcctgccttccacccaggactttttcccatcactaactaaaaatataaatgaagccctgatcaggtggtttattataatatctgccaggtatcaagcatttactatgtccagatgctgtactaactacatatttccccatttaatcctcatagcagccctagaagtagggttatcacttctgttttagacagagagagtagatgactaacctacagtcacacagcattaaccagagctgaaactcaaaactgggtgtccttgcccctagggaaggacaaattttcttaagtcccacgaacaatgggcatacttatgaagagctgctgcttgggatatcatagagtgtcagaagtttgtttgtcaggagccatgataggggcaggcagaagagggcattgctcattttcatgggacttaaagaaaatttgttcaataaaaatctgatttttagccagacatggtgcacatgcctgtagtcccagctacgtagggggctgaggtgggaggattgcttgagcctgaagacagaggttacaatgagccgagatcatgccactgcactgcagcctaggtgacagagtagaccctgtctcagaaaaaaaaaaagaatctgatgttaccaaatgggtagactgttcttctacataggagtttccactttacaaaaacaaggggctctataccataaaattcctttcccagctaagtgagtgagtcaagaacagatgcactggtgaacgtgagcattcaagtcttttaaaataaaattagcctttatattgtgggaaaatattttagaccctggaatctgacccttattgactctgaaaatacacgcctccctcattcttgcagactattctaaagcagagtctcctgcggttttttaaatccaactgagcttttattaagagaccaataggatttgttgtttccaaatataaaactataacaccaaacatgctttttcaaacttcaccacccccaagagtttacatatcccccaggaaaggggcaatattaaccctcatccatcttccactgcttagagaagagttctactgagtgactaagattgtaccgtgtatacaaggattgcaaattcaggggccttgagggccagacaggtcacagaaatgagtaaagaggtcagcgataggatgacagtaatgtgggacttgtagtaaactagaaaacacatcaccacttcccttctccaaagcatgcaagtcaatttctaaaattcaaatctgataccactcaatcaagcatagctgtgggacccattcgctcaaaaccaccacgttgagatccctggtggttcttattgtgaccttgtgtgatcttgtccagacagtttctctttggggctcagtctgattgtctctagaaggggctgatagagccgcagagctgctgagagagaaatgcagtcccaggtgtggacacttaataaggagccatgggctgtctgcagccactgtcacggatatgccttctgcgaccctaagccagctctctgtttggctgtgctcctgcacgtcacttatttagttcatcgtttagttcagccagcccttgcaggttattttttcttttccccaaatctgaatgcttaaagggcctttatcttaatgcccgtcgagccttccaagcacatcttgaacaggaatgaacagctattttaaccccacgggcttctacaagtgtgttttaaaaggcaaagagcgatgtaaaagaatggcaaaaggtcatcgtgccctcttatttcctggtctaagtcagtcctttctggccggttgagcacagggcttttacagggcgtcccctggaactgaagtcctccagaaagccccacacccctcagaggcaggaggaaaaaggagcctggaacaggtggtgagggtgcagagggtgggcacccggacctgttccacagggctcgccctcgtgcccagcacagggttgggtgctcaagctggcaatgggagacagctccctgagtggaaggttgagactaatgggctggcccccagcaaatacagtcagaaccaacgaaggaagtcagtggaacaggccctgcagcctgggttcaaaaatcccggctcctcagcccttttgaccttggcctccgccaacctcaggcttctcttggctgaaaggtaggctccttcctccctccttgggttcagtgagcgacacagtggagccttgcccagctcacaagcagtgatggcgcatctgttttctcttctgtccttccttccttctgcccttatttttcctctttccctttctgatcccttcctgcgctcctcctttcttcctcctgttttcctcctcatcactctctcctttaccccagcctcctccttgtctgtttctctcctcctctccttccataccctttctctcctttcccctccttcccaccctcctctctctccatccctctccactctttcaaatcacccagggagatgcctctgagttcctgtgtctgatcccagggttcgatgttcctcatctgcagcagacgtctctgcgggcacccaccagccccagcatgcgctccagggccagcccagggttgacatccagggctttccttacaggaagcaatcaagagagtttccagcattaaacactcaggaagcaaggccagtttctgcccgagagcatgcctcactggccccacaagaagaacaggcctaaggctcagtggtgtgctggagcctgctcacagatggcacatacccaatccatgacctcatattagtaccttgcacaggccacagtgggagtgtttacaccacagaaatcgcagatgctgcaaattgagtcttctgttttgtttcctgagagcccattgttaaagcttacagcacaccattgctctgtagacctgccaccttctcccaagcaaacgtttctgtgctgagccttgtaagaacaatgtcctctgccatagagggcagaacccagaagagcgcatgcatactagcactgttcaagctgcctgctgtcggggaagcagagcgggtggaagacctgggcccgttcttgcataggtgacagtgcagctgggaagctaagagagaagaatccgtaattagtccgagagaagccatgttgtatagggcgaccaggccttcctcctcgcccccaccatggtccggttcaggcgctgtcccttatccttgcaccatccctgttacagcaacctccacccatgcccctctcctctcctcctccccacacagctgctgggcggtcttgccaagtcaccatcacacaaatctccccatcttccacggttcaggtggcagccctggtgaccaccccatgcccacatggagagggatagttaagaacatgggctttggaatcaaactgcagtgtctgggagctggaagttgttttactgtctgaacttcgccttcctcatctgtacagtgtgcagtacagaaatcagtaaatatattaagcacttcctcagccttcggtgtgatcatcattcttattacagggaagatgcgccctcttttcctgcatcagagctctttactactactggcggcttcctggcccgttcccctaaatcaccccagattctagcccccaacaagcctcctcactgtctccaaattgttctgtattttggctttgttctatctgcctggaatggaccaggagtggttagggttgagttaaaagcaaggagtccggtcctgctcctctagctgtgattatttgaaaaatatcccacttctgctcccttttccaccaaccgcaatgctacccctcccagttgcctgcctgaaccagaccccggggcagggtgccacctctccttctctgcgtgctgtggaagaacttaccccgggatgtggattgtccatggcccatctcccagctgtcccgagagctcagtggcagcaggatcagactccaacttgcatctttgtccctcagcacccagcatgaggcccggctccccggagtgcacagtcgatgcggatcagattgaaaattgccttgacaaaatgaagttctcagttggcactacagataattaggggccagaacagacgttagtaaaccactgatcgtgtgagcgaacaagcaggactggatcagagtgaagtggagctggaaattggagtctgactgtcctgctgcacacagaagaaagctgaggcacagagaggggaagggactggcataaggtcacacagcagtaagtttagagagagatttcaaacctgtgtctactggacttcagggcgtcaagctaatgcccttcctcctcaggtcagctcctcgcagcagctgcaaggcacgagccatgtctgcattggaggagagctggggtctccaagaggggagtgctgcccctagaggctggctgcctccggggactctgattagagcctgcagccccacagctcagccagaatcccacgtgacctcccgggtctccctggatacctgtaggctttgtccagcgcaaccgtagaagccattttggagcagaactcagaggctctcatgctagcagcctctcttgggtttcttaaaaagaacagcaggcttgtccttgtggaggtttgtcctggagggaggtggctgctggggacgggccatacttgacaccccaaatggagggtttggggggttccacaggtaccccattagagacagcagagtgttaagagtttggacacaggagcccagctgcctgggtcaaggcttggcatccttagctccaactgggagacctttggcacgtcactttaacctctctgtgcctcagtttacccatcaataaatgggggctaaaagcaattgaatagacagaaagcatttagagtggccccggcacattgtaagtgtgtccagctcacttcctccctgtactgagctcttctttttctttcaccccttttaatgaaaagttggggaatttttcttttctgtaggcggctgcagaaggagaaccatcccctggaatctgtttcaccattggatgggtctgtcatattccagtagtcgcaaagttgaattgttctcgcctgggttgtcggggtggggatgccctctggccttcttccacattgtggttcagaggtgtcctagaaaacctgacttctaggctctcagaggctgagagcagaggggaaggctagagcttccatttattcatctgtcctaggacagtgaggctaggcaaactcatctcatgcagtcacatttctctccctctggcatccagcagccatgcttgggcagatcagatcagaggcctgataggtctaatggtttcagggaatttcacacaggccagcgcctgggaggcatttctggacaagcaaatagcaccagactataactcagagggcctgggtcaagtcctgtggaccttgggtaggccatttgacgtctctgggccttagtgccatcatctgcaaaatgggacaatgatcagtttagcgtcaatgtatttagctcttgctgaactgggcacggtgctagaaattcaaatccagtcatcacagagtgggaagtgcttactattgacctcctttattgatgagaaacaaaaacttttttttttttgagacgaagtctcgctctgtcatccaggctggagtgagtggcgcgatctcagctcactgcaagctctgcctcccgggttcatgccattctcctgctcagcctcccgagtggctgggactacagacacccaccaccatgcccagctaatttttcgattttttagtagagacgggttttcaccgtgttagccaggatggtctcgatctcctgaccagtgatccgcccgcctcggcctcccaaagtgctgggattacaggcgtgagccaccgcgccggccaaaacaaaaactttgagaaaataagtagcttacttgaaaatcacagtgggatgtgtgaacagtaggcacgcgataaatactactgacaaagacacctgcttctgcaaattcccctcaggtacgttgaggcagctgaggggtttataccaaggcatgaaactgctttccttcactcttgagtaagagtatgcggctggctgggagttgggagtccataaggttcaggccacttcaggctgtgtgaccttgggccagccaccagtccttgctgggtttttttcttcatctatgaatgccatggtagaccaggtgcaccagtttggcatgcagcaagtctggaccaggaagggaccagctgggtcgtggccctaagcaccactgtgcatggggctgaggtccaagaagggagcctcccatttagaccccaagctgtcccaaccagctcatttctcctgtagcctgcatccaccacaggcctggctggcctctgaggtcttgttaaaatgctgggccttggagaccctcttggcggctccctttccattagagcaccttctccagggagctttccctgacctccaggacgcgcgtggcaagcactgcccacagcaccggctgtcccacacaattccaacctccctctaccttctgtacctgatcatccactattaattggtcttcacatttgtataacatttttcaatacaaagcacttttgcggccattcatctctttgagtggcagcctaagctgctatttattacacttcctgtgtgccaggcccttggctggcctctttccatgcattatcatgcaattctagagcaattctgtgaaatccacatttacagatgagaaaattgggactcaagcaagccagtatgtagccctattacacagagatttgaacgaagtcccatgaaataatctgggtcattctaacaacagcttctgaagctttcctatgtgcctaaatcacgggacctgtttaaaaatcacttctcgttccacaggtcttgagtggggcccaagattctgcatttctgacaggctcccagtgatgctgatgctgtctcttgaagaaccgcactttgagaagcaaggccctgaatcactggcaatttgagaccccaggctggcaaggctgtttccttatctgtcagatgggtgaggtaccctggcttacatagatggaatgactcccggatgatatagtgcctgtgaaatgcctggccacaataggcgctcaataaatgctagctcttctccttcgataggagctggcatgagtctggtacacaacggatgctcaataaagccttgtccaatggattgagcctagcatttttcccaaggcagagaataaactgtattatgtttccccttggaatgaagccaaactcaatattaattctttcttaaaccacagagtttcaaaaagaaataaaggcaaactagagtgattgcagttgaagcgagcctctgtaatttctgtaattacagaacgagagcaaagcaaagcaggcatggcacagtctcatggagggagtggggtggggatagggggaggggaagagcaggccctactccagacccactactccccgtcctcgattccctggcttttcagggctccccactcactcctggcggggccatggcctgggacaatggcagccctgagactccagccctggcctctcggttctgcctaggtccccaccccacgcagccgcctgtccctctgatgcagtgggacagaggggattgtccaaggcggtttccacacacttccctcccccttgcctgccatctggtccagggtgggctgctcacagccaatcatccagcaaggcccatggcccacgggccccacccccagatagatcctgggtgtcggtgacacttcccccaacttctgcccatccagccacccccatgcagccaccatcatctctctggactggcagcctctgatcatgtatccctgcttcccccttgccctatgcagccttttctgggcagccagagggagactcttaaactaaccgtaagtcagactcccaccacttcaacccccacttcctcccatcccacttagaatgaaacctgaatccttctgtgacctctgagacctgtgtgacctggcccctgcccaccacctctgcctgaatccattcctctcacactggactccaaccaccttgggcaccttggtgtctttcaaaagtgccaggtccttcctgcctcagggcctttgcacttgctgctccctctgtttgaaatactgtatcccgagagtcccatttctggctcctaattcagactgaatttttttttttttttttttttttttttgctcaggccaaataaaacaagcccaagggccagttttgacccattttgccacttctatgtagggcttccaaactgtacatgttttctttccctacaaagcatcttgtcattcagaattggcagaggaattctttgtgcttggtttggccccatttttatcaatggctttaacactggtcatagagcatccactgaggaaggatgggatatcctgggaatgttttaccatcttctgcctggagtgtctttcactaactccgtccttcccagaggccccatgagcgagtcatctctggtttacgaatctgatcccattatcagccctgccccatccctgcagctagtccccagttccttagtccggtgtccaagacccttcatatactgaccttcctagcttcacactgtatctttagtacatgtgtttccctccacttggaacgccttttctctctttttaaacctgatgacacctattcaaccttcaaagccttgctcaaaggacgcctcgcctaggatactttctctgctgtattaatgcgtttcttctaggcctcccgtgtcttgttcttacacctcttgcagcattatcacagggtattatgatcagctataggcagaaatatttctccttctaggccatgacttgacaagggcaagggtcttgtcttatgaaattctcacaccctgagtgtccaccccagcccacccacataggaggcctcagtaaggatttacagaaatgaatctttctgctggaacctttagttcactgattcggattctggtgaccagggtgtagttcagaatacaaaatgcttgagagacggctccattgtcgtttcagcacatagcatgtgctcagtaaatacttgcagaatgatgtgttagtgagtgagtacagaggacctgacatgtcatcactggtggtctcacgttaaagtgccctttgaacgtggctttggtggaattaagttaatcgtggtatagtatgcacctgaggaatgtggagccgcatgctgggtctgcagaatgttgtcacctgatgaagaagaactgaagacgctggaagaaggctttggaaaaatgcccagatcatgagaaggtgagaggtgtttttccgcctgctccaccagcaggtaaaggaggctgatcacaggctggcactcagggcgagtggaagaaatgcgtggtcttgccactacagacccgcagagctgtcctccaacatgatccagagagccacaaaacacaggggtgtgtcttgggaaaggaaaagtaacaacttgcaaaaagttggttctgcttcagagaaatgttctagaaagacagccaagttaccctgccgtgaactacacacacctgtgctttctgcatgttatgtttcataggagagggaagtgccgggaattaaattgcggatgcactgttccccaggtgtgtgggtgaggcacgcttcctgggaccactcctttaagcattgggtcccaggcatgttcactactagcaggaggctctttatcaatttcctccgtggaccagatgattgggatttttttttctaccagactttattacagaataactattttgtattaactaagcaaacaaatgtaccgctcccagcttctgactggcccaaggtgctggctagacctctttgctttggtacaaagagagcccaaagccaagagacttggcatttctgtagctggtattccccagggtgactaaaaggatgatttccattggattttttaaaatgctaagacactgaaagacctgaatagtaagcccgtaataaacgttattcggtattattattgtgttgttgtagccttctgggaagttgcgaatgccaaattaagaacaatggacccataccagatggtggcgattgcagtgataacaatggctgagatttcctaagccctaactatatgcaggcatagttgtacatgctttacacacatgatctcatttaatcatcaccataaccctcgaaggagttattattatcttcccattttatagatgagggtcagagaggtgaagtaactcaccagcattagtaggtgttggagggagccgaggtctgtctgactcagcaccagggtggcttgctgctgtgtaagtcaaagagccttctccgttctaaatcctcaaagaagtatgagttaatcaattcatggctttactttgtttatcttcatatgtgccacatcttctaaaaggaaaatccaaatatagtcatgtggctcctcctagggaattataggcatttggctgaatctgaatcatatccccgtattccagaaattggaaatcacatgtatgtcttctttatggtgaggtctcagagcagccaccgtctctgatcgttcagggcttggcatgaggaggtgctcaatatagtatggagaagaactcatggactgaacttcctggtgaaccagagggatggtgcagagatttagattgcaacaggaacccccaagccaatgtaagcaaaacatctatttcatgactatgggatgttttgtaaaatccaagcaccagcctgaagaaagcctggaactgcaaactaggagcttgagacactctatcttttgatgtctagttttctccttcctcagcagaccaaatctcacttgagtacaagatgggcagaggatggctgccccagagtccccaagtcactagcaaaactgccttcttcctgggtcccatgccaaattccagagaaggaatttgattggctagcctgggtaggtggtcagtcctgattcaaggtgattggatcattttgaacaaatatggcagctggagccacaagggtagatcatgggaccgttaagggcatcattgttaccagagttaatggctgagctgctctctcctgcgtatcccaagagtccctggtagaccacagaatcggccgcctcctctatcctgccattctccagaaggggaggcaggcaccctactgagtccagagctctctctacattgccatgcccaggccaggatctagatgggcatccaagaccagcctgtgtgccgtgaggagttcaaagtgagcaggccatccctgagaacgaggagcaggggtgttaggaaagttggattatctgaagatggcctggttctccgtgaactctgggaggagatgatggtgtttggaatggggactgcatgcgaggggctggagggcgagtgcacagcagactgggcccccgccggcaaagctgcggggaggaggccgcgtggggagggccagggccacgccgcaccttgctttgcgcagctcccagctctgagggaatgcagaccgcttcacatgttctggtttgttctgaggttccataagtttattttttgttatattattaatttaaatcagttttgtagagcattatgaaattaaaaaagcacaaagaagaaaacaaaagtcactcaaaaactaagcattgtaacctctttgggtatatccttttttaaaatagatgtggggggtgggggcaaaatgggataattgaaataaactgtctagaaacctgcctttctcaccccaaaacaaggtgctctttctcgtgtcttacgtggtctttttgttacatttccacaagtttggatggaggacagagaaaagtctagcagcccctctgttggtttctcttttcttctgataaaattatggaatgtcttctccacctgccctcatcccacgcccacagctgtcccgagggcagcgggccccactcctgcatgttccagcaccccaagggccagtgccatgctgcatggtctcgctgcggccaccctggctgggacgctctgcgggacacgcgcacagcccagacgccctggcaggcttcctgcacccctgctccctctgtaggagctgcctgcctgccccatcgctgcttcaccatccctcctctcctcccttctctgctttgcaggatctcacccagggtggcagaaggaggccttctggagctgaccccccccgacgaccatcaggtaacgtcaacagccccggtaacaacatccatgagtggagtttctctcttaaccaggttggcgaaaagcactcttgcagcgattacagctgagttttgatgaactctacaagccagaggggattgcccccattttatacatggggaaactaagcacacacacagcagtacttggtagtagtattgagtagtagtactgagcagtagtactcagctggtaaaggcagaccggagatttgaactcaggactagtctcagcccaatttcctccactgtacttaccccacgctgcccctggaaataaaaaggtaagaaggctgcagagtgtcagtagaatacttagggtgattgaaggctgaaagaggtcatctaaaccagtggcccttagctgagggccgggctgggctaccagtataagaatctcctttggcagagcttgttaaaagtatagactcagacttcctgcaacccagtgagagatgtaccagtgtcatcctcattttaaaagataggggacacagaggttgagtgtacttaaggtcacacagctcaaaagtggtaaagtcggggcaggtgcagtggctggctcacgcctgtaatcccagcactttgggaggcggaggcggaggcgggggatcacgaggtcaggagatcgagaccatggtgaaaccccgtctctactaaaaatacaaaaaaaaattagctgggcgtggtggtgggcacctgtagtcccagctactcgggaggctgagcaggagaatggcatgaacccgggaggcagagcttgcagtgagctgagatggcaccactcactccagcctgggcaacagagcaagactccatctcaaaaaaaaaaaaatgtggtaaagggactgtgatcagaggtcgtaactcctaggctctgtcgtcttcacccagacacctccgtgtggggacacctttctccccattcagccacaggtggagcttctttcttgctcaccctgggatggctagtatggccgcagagtgtgacaaggctcccaattgcatccttggaggcaaagtaaagattttatgattaagtacttaacatttcctgttggaagtttggtggcctcagattctcctctgagcaggacatacaacagagggttggacacagatggccagagttgaagctagccaggaaacatcgctgtgtctttggaaacaaaagtcaccttccttcctccaggagcaaggcgggtgagaggaagagggcttatagagagccttttcaagcccctagcttgtttatgggtattttgtttttgtcattttagggtgaggcaactccaaggtcctactctctttctgtgctgttacccaccccgtcctcctagggtgcccttgagccgcaaaactgctgtccacgtggacgggggtgacatcgcacgtccatctgccaggacccctgcgtccaaattccgagacatgggaccaacggcagcaaggtggccgacgggcagatctccaccgaggtcagcgaggcccctgggccaatgacaagcccaaaaccttggtggtcaaggtgcagaagaaggcggcagacctcccgaccgggacacgtggaagggccgcttcgacttcctcatgtcctgtgtgggctatgccacggcctgggcaacgtctggaggttcccctatctctgcgggaaaaatggtgggggtaggtctggcccggggacctcctggctgggtctggaccctgcaaaaaggatcctgcttaggcattttctggggcaactgtaggagaaaagcccccctaaagactccagagggagcaccaggcccatttcttgtttcttgtccctttatcaaaagattcctgaaggacaattgtcctctgttatgataccaagaaattcatctattcacctgcaaaaaatgggatgtatttcacatatggcttccttgggcctgtggttggctgtgggtcctgcttttgaggcaggtataaagaaatactgatggggacccagacccacgacactccctctaccagggcgggtcttgaaagtcttggggcacgagctctgtcttctttacctgcaggagccttcctgatcccctatttcctgacactcactttgcgggggtcccactcttcctgctggagtgctccctgggccagtacacctccatcgggggctaggggtatggaagctggctcctatgttcaagggtaagtctgcagatcagggactgggtggtggtgcccctgcccacacacacctcttgccctctggagagagcgagctgtctcccagaccagggctgacatcacatatccatccaccaggtgcatatctgagcagagtgaggctgttgcaaggggccaggtggcagatgacagtgctggtcagaaactagggaggtggagtggagaggcccaatccagagtcccccgcacatcagcctgctctgtcctgttagcccatcatttcctctgcaagggctgggtgtgactttctttgcctcgtgctcagtgcctgacaggccccaggtagatacatggtgagtcatgctcactgaccgagggcctgggcctcacctcgtcggcaagctgagaccccagccctgcctgccaccagtctgcactgggccccagacatgagtctggccccctggcttgtcagatgtacatgaccttcagcaagtcactgcctctctcttagctcagtgtcctcagtaatgcctgtctccgagatcaataagattgtagaggtcatggaactgccacgacagttcatgttaattccgtattaaatggacgcgtgtctgtgttccgctcccggcgtgggccttgcggctgctgtgctatcattctggctgaacatctactacatcgtcatatctcctgggccatttactacctgtacaactccttcaccacggtgagtggtccctttgacaccccatccagcagaagccacacccagagcccacccttggcccaccacggccaccacttgctgacaaggccattcctccaggagtggggaacttggtttgtcttttgtgggccttggctccccacaacagccatagcctcacaaatttagcatctcctgtgagacaggcactccttcaggctcacatccaatcctcatgacacccctctaaagtgggtattgttagcacattttaatggacacagacagcctgggttcaaatcctgactctactatataccagctgtgcaacttagaaaagagacttaacctctctgagtctcagtgccctcatttataaaatggaaataaaatagaacctgccccagttcctcaaaaaattaaacatagaattaccatatgatccagcaatctgcttctgagtagatacctgaagaattacaagcagctctcaaagagatatttgtacaccctgttcacagcagcactattcacagtaggcaaaaggtggaagcaagccaagcgttcacgataaatgaattggtaagcaaaatgtggtctatacatacaatggaatgtaattcagcctaaaaggaaggaaattctgacgcatgcatcaacatggatggaccttgaggatattatgtcagtgaaataagccggtcacaaaaatacaaatagtgtttgatcttgcttatatgagttcctagagtaatcaaatttatagagacagaaagtagaatgatggttgccaggggttgtgggtgggggatgaggagttgttgtttagtgggtggagttgcagttttgcaaaatgaaaaaagtctggagctggatgctgacaatgttaggcaatacatttctcacaatgtactcccattgttagtgacacatgactgtatttgcagaggtgtggcagggttcagggagctacattatgggttacttaatgcttctaaattgtacaggcaccaatagttaagatggtaaatgttgtgtgtatttatcaaaattaaaaaatgaaagaaaacaaaaagtgaaacccacctcatagggttctttgaggattaaggagcagatatgtgtaaggaacttagaactgcgcctggcagagaacaagcctgtaagtgtttgctggtgtcgttgcagtgagagttagatgggcaaggtctcttgcccaggtcacatggtggggaagtagccccggctgcagcttggaaggctgttctcacagtgaaaggttgaggttcaaatctcagctctggcacttagtagctgtgcattctcaagcaagtcatgtccctctctgatctgtcaaatggggatcataatgctacttgcctcccagagctgctggaaggggaggtgtgaggaggcttggggaccatgagggtgggcagggtgcactgggaccatcatgccagcccctgggagcccagcaggatgcgtcctcatgactgtgtccttgcagacatgccgtggaaacagtgcgacaacccctggaacacagaccgctgcttctccaactacagctggtcaacactaccaacatgaccagcgctgtggtggagttctgggagtgagtatggggcatcaggggatggcagggacggggcatgtcagccagagcccggcaggagacagaggcccccggaggggtaacagaagaggtggataaaggggctacagtcatgtgtcacatcatgacatttggtcatcagtggaccacatatgcaacgatggtcccataagattataataccatattttactttaccttttctacgtctagacatgtctagtaccgaaatgcattgtgttacagttggtacaatattcagtacagtcatgtgctgtacaggtttgtagtctaggagcaataggccaaccgtatggcataggagtgtagcaggctagaccatctaggtttgtgcaagtacacgctagatatgcacacaacaacaaaattgcttaagaacgcatttctcagaacatatccctgttgtaagtgacacatgactatacttgcagagttgtggcagggctaaggcagccacaagggatctgaagaccttttctccccaaaaagagttggaccacagatagagccatgagacacacaactctgacctttgatagcaaaacccagctactcacaaagccaaggtccagcaggaagaatcattccccaacatctctgcctctaatctcctgccagctcctcccaatggtcaaacccagtagaagccagagggcaggggaccagataatgtggccatagtcgtcagcatcctggggccggcacagagtggtcaaggggaagagtggatcagagaggcaaacggaggggaataaccagatagccaattagaatcacctggagaggttgaccacatcctgattcatcctgaaaaccagctgatctacttacgaacctagagtcactcggaataaacatgcacacacactctggccatgtgaaggccgtgctgattgtatcttcaggggagtaccttgtagagatgtgtgtcgggggcactgatgtgacacaatgaggtgctggggcccaaatctctctggcatgaaggaagcatcatgctggacagctcagaaggatccgggagcagtctagaaggtctcagagcaccttggatagctcccaggaggagctgttctcaggcactgtcagaatcagagttgcctgatctcttcaggccaatgtccatggttacactgtttctttacaaataaaaatcaaattctgctctggtggttctgctttctggcatctcccgcatgctgctctcaggcacgttcggacttttcattcaccatttattcagtaaacacttcttgatctcctactatgtgccaactgatgacaggcacgacatgcagacaggcaatggcaccaccaggcggccaatgcggagaggagggaagcccaggagctgggctgcggggacctcagggagtcccctggaccaccccaggtcgggagtggcatcagaagagaaaactgcagggcaggcaggtgctggagagaaacagtgtgaaggctgggaggagatgaggtcaggccaggcaccggcaaacagctgcagtgagtgctgagaggagagagagtgcaagggccttgaaaggctggccagggagtttgggcttcattctgagaacaagcgggtctattcatcgcagtaagcagaggagtgacatgatcagacttgcaatttagaaggctctcggggctggagaggggatagagcaaaactgaaggcagggtcccactaggaggccactgggcatccagatgagcagtagtggtggctgactaaggccctggcaggtcctgttctctttgactcttgaccaaacagcactttctactgattagtataatgggcctcacagtccccagctactcttgaatcacggtgatgacggtgtcagcacagttctagggcggggatatcatctgtgccatgccctgggcacccctgggtcactccggctcccaccagctctgtgtaactttctccccctccactgtttgaccaggcgcaacatgcatcagatgacggacgggctggataagccagtcagatccgctggccactggccatcacgctggccatcgcctggatccttgtgtatttcgtatctggaagggtgttggctggactggaaaggtaagggatatatgtgcacagtggggaaggagggcactggatagaggaacaggtctacaaaggaagctctgcccacaactcccaaggtcccatccaaccttgaattaagcaggtcccttcaacactcggtgtgtccgtttcttttctgtgaaatgggaataataacattaccttaccttctggggcagttgtgaggataaaaggaatagtgcaagtcaagtacgcagcacagtgcgaagctcacagtgagtcccatgggattcactgggcctaacagagtcatctcaaaacagagggcaaatgttgctcctggactgttgaaaaacttttccagagcatctgctctgcaccaaaccttgttctaggtgcagaaactccagaatgacagcttcacatcctgacccttgaggaacaacagagatgaataggttaatggttagttcaggctctgtattaagcagtccatgagttaagatcccaacctcaccatttactagcttgagctcaggcaagtcactttgcctccctggaactcagtttccttctctgtaaaacgggctaataattatacttatctgttggtttattatgataatcagatgagatggtgcttttgtaagcgctcagcacccagcaaggagagttgttattactcttgtttttattctcagcaagtcagagcaaatgccaagctgggatgtctagcccagggacacccgggaggtggaaaactggcttactccaccttttctccctttcaagccctaccccaggagcctgggggcagaagatggagtctctcactggccctgacctgaagggaacccggaggacaagtgtgttgtctcagatctatggcaagtcaagggcagagaagggatttgtactgaataagatgggaggcaggaaggtagaactacccaagaagtgaatgcaaggttctagaagcagtagtagaaatgaaccaagcaaaccttaacaaattccacacttgggcagggcagagctgatgaaaagctaccctagtttctctagtgggaacttctggacccactgggttctcaaatccaaggctggtgtaaaagtatcctgatccattcctaggactagggacgccggaggagggcacaagtatctcccagtctaaattcaggagcagaaaagtatagggcttatgggctttggaagggtttgagtctcagtccctagcttctagctgtgtgcacttgagcaagccatttcatctctctgagcctcagtcccctctctgttcaatggtcacaataacagtaccttacagggttgtcccaaagactgagggagatagtagaatgcttagcatatgccttacacatagtaagcactcaatacatagtatcaattaaatcattttggagtggtaattagagttcgtgctacattaggagactggccacttcttgggacagagagtagggccccctcactgcatatattgaggatgtcaaccaatccatccacaacatttattgaatacctactatgtgcctggcttcatgctgaacacggaaggcacagggaatacgagaccaaggtgacatataataagcctgcggcatgtcctgatgtgactgacctttcgagcagtaggtgtgactgtgcctgattccagacaagagaaagtgaagctaagagaaaatcaacattgaccctaagttacgcagcttgtgggtgacacagatgagtttgaattccctttcctagctccaagtacaatgggttttctcttggattgtggctgccttccttaatcctgcaaatctcggggtcaagtcagggaggtgaagctaagccagtgaactgtccatgctgaccggaaacaggctcacattagactctgagatacaaaggtcatcaaacttgaacattgctcttcatactagtgagcaaagaaatgcaattttagacaatgatcatcagtttggcaaaaaataatgtttaaatgatgatacctagtgctggccttgtgacagaaaggcactctctgtaatgccggtgaagttccatttctcgaaagcaacaaggtaatatggatcaaaagcctgtgatgaattattccttttaattcagtagttccacctctaaaaatttttcccaagagtggtataataatttgtagctgaagatttatatacaggggtgtttaatttggtgttatttagagtcacataaattggaggtaacctgaatgcatagcagtggggaagcttaaaagagaatggtaggacctctgagggactgttttgtgcaattaaaacgtcaaattgttcatgaggcaataaaacaacgttagtgaacaaaatgggaaacaaacctgtatgtactgcgttttttttaactctaaacatttacatggaaaggcaagtacctaatttgaacctcattttgtaagaaaatgtgattgcattgcaaaggagagtttcagaggagcattaaagtaggaacatccctgcatttatgtgttcgcagacaattcttgagtgtctactatatacggtggactgttctagacatggggatgtgaaaacacaagccctgccccccacataacttacattctaggtgctggttaaaggaactttcatttatgtgtgtgtgtgcatatgtaatttaaaagttttcctgtcaccacatgcaatacttgataatttagaagtcaaaaaataggaggggacaggggaagggaaaaaccaaatgtgagcggttggctcagactccaaggaggagcttcagataagtggccaaggagagcaaggatctggaaggcttcctggaggcggaagaactggaatcaagcccagagccacaacagatacggattaggggaaatgggggaggaggaagcaagggtgtacaggaggaggggtcaccagtcacccctttcctcccaggtggtctacttttcagccacatacccctacatcatgctgatcatcctttcttccgtggagtgacgctgcccggggccaaggagggcatcctcttctacatcacaccaacttccgcaagctgtctgactccgaggtgagtgcccctcccagcccggattctgagccccacttagcagctttgagataagcttttgcatctttctgaccctcactgtagaccaggttgttgccagggagagctggtgggcacatggaaaagttcctggatagctgcggctatggtattacttttgacagtctttgataattctgcctataggtgtggctggatgcggcaacccaatcttcttctcatacgggctgggcctggggtccctgatcgctctcgggagctacaactcttccacaacaatgtctacaggtttgagaggacagctgcgggagccccttccttcctggcgagccctttgagtccacatcccacactcatgtgttagggccctctttggccactttgcatctcagcttaacctctccctgagccagtcgtttgtttaactccttctggagacacagacttcctgttgtccccctttcctgaccctgatcttctggctctgccctcctctagcttgctttagggcctgtgcatctgggacctaccgtgtagccccattcccagccccctcctccgggcacccctccataaccacagccagcagctacaccttctgccagctgcaccctcctcacccacccctccctctcttcagggactccatcatcgtctgctgcatcaattcgtgcaccagcagttcgcaggattcgtcatcttctccatcgtgggcttcatggcccatgtcaccaagaggtcattgctgatgtggcggcctcaggtcagtgcaacactgtgtggggccgggctcctggcagggggcactaaccatgctggcctttgccatcatcaccattaccaccaccactgtggctcctggccttgagcactccctatgtgccaggcaatgcactgagcattttacatggactgtaccatgattcttctcaacactttgcaatacacgctattgttagcccatttcatagatgagaaactgagactcacctcctaagggtatggagctagaaagatggcagatctggagttggacccaggtctggctgactcccaagcctgggctcttagtctcttggctatactagcatgtcagcacaatcctggacaatttggggagaagatccactcttgccttgggagtataaactttgtattgggggaaattcacccccgatatttcacgtaggttcttttctattttacctaagttcagctggtctgagaaataaagggaaagagtacaaaagagagaaattttaaagctggattctgggggagacatcacatgatgcccccgaagctgtaaaaccagcaagtttttattcatattttcaaaaggggagggagtgtatgaatagggtgtgggtcacagagatcacatgctcaaaggtaataaaatatcacaaggcaaatggaggcagggcgagatcacaggaccagggcagattaaaattgctaatgaagtttcgggcacacattgtcattgaaaacatcttatcaggagcagggtttgagagcagacaaccggtctgactaaaatttattaggcaggaatttcctcatctaataagcctgggagcgctacgggagaccggggcttatttcatcccttatctacaacttaaaagacagacgtccccaaagcggccatttcagaggcctccccttagggacgcattcttttctcagggaagttccttgctgagaaaaagaattcagcgatatttctcctatttgctttgaaagaagagaaatatggctctgttccacctggcccacaggcagccagacgttaaggtatctcccttgttccctggacatcactgttatcctgttttttttccaaggtgcccagattcatattgtttaaacaatttgtgcagttaatgcaatcatcacaaggtcctgtggcaacatcatcctcagcttacaaagatgatgggattaagatattaaagtaaagacgggcataggaatcacaagagtattgattggggaagtgataagtgtccatgaaatcttcacaatttatgttagagattgcagtaaaggcaggtgtaagaaattataaaagtattaatttggggaactagttcaatgaaatcttcacaatctatgttcttctgccatggcttcagccggtccctctgtttgggtccctgacctcccgcaacactttggctcaattcagacatgttcatcaccatactacaagaccactaaatccatgcttttgtctcagctccaaaaatgttctcgccaagtgggccagcccactctgctcaccacacagtcatcaatgccacagaacccaaggaaaaccccagacacccttcgctgcacagccaggcaagcagccaacaggtggaacccactgtatgcagggcagggcccctgaggctcatggaggccacacggctggtcccttgaagaagtgggctggttccggaaaggagcattctctgctccggttctaatctccccttcaagggcagccaccatctcgttctctgcaattccccaaccattcccccacccccatccggagccagacccagggaggttaaatctctttccttctcattccgagatttcctgatctcttagacacccccaccaactactaaacacaatacatgccaaacaaggctccaaagccttctcctccaccatgctccccatcaagaagggtcccatggtccagtgcccagggtggagacctcagcattgtcctggactcttcctcaccctcatcctgcaaaccagccaataccagcacctgcccctccatcccctacatattctctatctggttgcctctctgcacctgcactatcctcactactggccaagccatgccacccccatcgagatgatggccacagctcctcactggtcctcttgcctctgggcacaattatatggccccacatcccccaccctctttctgcacctggaaaaaggggctgaaaacactcatcaaaaggttactctgaagatgaaatgaaataaggcttagaaaatgggcagtgtgctggaaggctgtaggtgatgagtaccttttatttttcttcttttttgcacttctctgttcaggcccgggctggcgttcctggcatacccagaggcggtgacccagctgcctatctccccacttgggccatcctcttcttctccatgctgttgatgctgggcattgacagccaggtgagggcccccccccgcaccccaggagctctccatccccagactcctcagtccccgagtaaacaggagaggaggcaactcttaggctgccaagaagatgaccaaaaattccaggtccctagaatgtccactgcatgaaatttcaggaaacagctcagccaccttctccattttccagaaggggaactgatgcccagaggggagggactctcctgaggtcacaaagtgagtcacaggcagaatcggctggaccctgggctctcctggctcggtgctgctgggcctcccgtccttccttagaggccaggctttgggtgggttggggctggggctgctgcaggtggctgacctctgttcccaccgaagttctgcactgtggagggcttcatcacagccctggtggatgagtaccccaggctccccgcaaccgcagagagctcttcattgctgctgtctgcatcatctcctacctgatcggtcctctaacatcactcaggtaagctcagtaagcacctggcactcccccagcactgcccaggccatgcccagggcctcctctcccctcctctgttgtatcccacctttcctgccttcattggcatcatctctgtgccaagctctgggcacataacagtgagtcagatggggtccctgcccccagaggctcccaggctggtggagacacaaacattgagctaagacatataggacagagcagagaatgcagcacctaactggactcggagcaccagggactgcttcttggaggaggggagtagaaattgagctttgaaaggcccacagaaggcctggcatggtggctcatgtctataacccagcactttgggaggcagaggccggcggatcacctgaagtcaggagtttgagaccagttggccaatgtggtgaaaacccgtctctacttaaaaaaataaaataaagtaaataaatatacaaaaattagtcaggcattggggcaggtgcctgtaatcccagctacttgggaggctgggtaggagaattgcttgaacccgggaggcagaggttgcagtgagctgagatcgcgccatgcactccagcctgggcaacaagagcgaaaaactctgtctcaaaaaaaaaaaaaaaaaagaagaaagaaagaaagacagaaaaagaaaagaaaggcccacagaaattagccagaaagtcaattggagttgagcctttgaagttgacactgcccaaagctttctttcattcccatttttttttgtattgacatgaatgagaaatgctcacatagctggtgaattgtgcaataaatataacgactctagcaacatgagttcagcactgcgggtctgatttttataatccacaaatcaccccaccccccccccaccagatccaaatgtagttctgctccagagttagtattcattcatccttcattcatagttgtcaaatacctactatgggcctggcatgaccccagaaatttggcattaatgtggcagatactaccatgtctgctgtcttggagcttacattttggtggacaagctgacagacaaattagatgattttggagagtgtcaagtgccctggagaaaagaggacagagcacagagaatggccagtagcacaggaggggcgctccctcagacaaggtagtcaagggggtctctctctccaagaaagcgacagttgagctgagacttaaatgatgagaaagagccaccagagaaagatctggggaaagagagcagagtaggtgcaaaagccctgaggcatttgaggacgagggaagccagagtggtggaggcagagggagtgaggcagtgggtgggagacgaagaccagcccatgcggaccttgcaggccaagacatttgggtgggatgggatgggatgggatggatgggatgggattggatggcatgggattggattagatctctctctgcttatttatgtttatattattgtctcatttaagtcctgaaaggttttaagcaggggagagacctgactgattacactgtaaaaagatggccctggtgaccaactccgctttctgccctccaaccttaccgaaattggcattttcctctaccacctggacatttccttcccaatgcccggactgtcaattccacatcctctcgtggtcacaaagccctcagtgcttcatctaatctaccctgaagcctatcccagccccatcagcctccagagtccatgtggtctgtgaactggatgcagtgggcgcggggacaatgcacctgttctcacctcttttcatcttgcaggggggtatttatgtcttcaactctttgactactactctgccagtggcatgagcctgctgttcctcgtgttctttgaattgtctctatttcctggttttacggtgagtatcagcccctcatcccttattcattcactcttcatccattcattcctttcttgagtcatcattcaacaagtgcaatttgaaccccaggtttctccttacatttatttatttatttattcttcacattacaattcaatgaggttagtccggagtcccccatgtttagaagatataagagcagttaaatgaattcatttaaaataagtgagattttatccagaaaagggaaaccaaaactactttttaaagttttaaagttatatattaacacagtctaggctgtaattaaaagtgtgcactatcttaaaacaaataacaaaagaaaattgattttgtttattttgtggcctaagtttcttgagccaactgcatgatagtaaaaaagacaacatcctttcctgcacctttgattgtcccatcagagcaaatgtttttaaagaagctgatattttgtgtccccctttgcaatatctgccacctcatcctccttgtcattgtccctcttttttgtttgttttatatgtataaatttaagggacatgagtgcaattttgttacctgatatcttgtgtagtggtgaagtctgggcttttagtgtacccatcaccacataatgtacatctttttttatttttatttttatttattttattttattcatttttttgatggagtcttgtctgtcaccaggctggagtgcagcggtgcaaactcagctcactgcaacctctgcctgccggttcaagcaattcccctacctcagcctcccaagtagctgggattacaggcatgtgccacacgcccagctaattttttgtattttagtagaggcagggtttcaccatgttggccaagaggtctcgacctcctgacctcatgatccgcccacctcggcctcccaaagtgctgggattaaggcataagccaccaagcccagcagtacattctacccactaagtaatttctcatcatccccccagctcccattcccccacccttctgagtctccagtgtctattattccacctgtgccagtgtttagctcctacctttaagtgagaacatgcagtatttgacttcctgtttctgagtgttttgcttaagatgatggcctccagttccatccacgttgctgcaataggcatgacttcttctattttatggctgaatagtattccatcgtgtatgtataccatatttcctttatccaccatccacggatggacacttaggttgattccctatctttgctattgtgaataaacacgatgcaaatatctttttgatataataatttcttttcctttggatagatagccagtagtgggttgctggatcaaatggtggttctatttctgattctttgagaaatctctgtactggtttcatagaggttgcactaatttacactcccaataacaccttctctctctaactgttccaacaggtcagatcctcactggtcagtgactctgcttataatttgagcagtgcccgaagccgcttggtgaacttcaagacaccagtttggggtttggggtttttctttttcatgagatttgcattctttgcaattgattgtcaatttctttttctttcattcattcatttatttatttattttttatttatttatttatttttgagacgaagtctcgctcttgttccccaggctggagtacatggcacgatctcggctcactgcaacctccacctcccaggttcaagcagttctcctgcccagcctcccaagtagctgggattacaggcgcccgccaccacacctggctaatgtttatattttagtagagacggagtttcaccgtgttggccaggctggtctcgaactcctgacctcagtgatcctcccacctcggcctcccaaagtgctgggattacaggcatgggccaccgtgtcggcagattgccagtttcttatagcatctgaccatcagggagaaacagcccctgcccaggaagcctttgaaggaatggctgggatagatgtcgagtgggagggacattgagagtggcagggtggaggggatcatcatgtcagtctccttttgttggtagatatcttcacattaaagtgcttgctcacctacacaacccacttgctgtgagaattgggctattgaaaaatacttggtacgaggacccccagagcataacccccatggtacagacaaggaaactgagactcagagaggtaggtgacttgcccatggtcacactgtgagaaagtggtagaaccaggctttgaccctgagcacccacagctcatccatccctcctgctcccaatgtcacaggtgtcaaccgattctatacaatatccaagagatggttggatccaggccctgcatctggtggaaactctgctggtcttcttcacaccaatcattgtggcggtaagaacaaggcctgactagccctgttaggatgagctagaccaagccctggggggactcaggtccagggagaaacttctagaggcagaggcagggggagaggcccccagaaaccctgttccttaataatacttctctctaccatttgttgggctctattctgcaccctgcatggtacaagacacattatatcatcctccacaaacctcagaaggaggcattattgtcccactttaccgctgcaggatctggggctcacctagccagcatcaccagctagtcagcactgggattcgaaccaagcccagtctcttggcacttggagactctcttctcagggtccctcatccccacaagcaggagctgaagcaggggcgggcctgggaggggcacccaaggttcttgaggtgggggcagagccactgcatatgttgtgtccacataaggggccctgccaatggcacattgggagctgatatctcacccttgctctgcttttgaagctgggaacttggaggaaggggttcccttttctaattagtctccctagaggagttgccttttcctctgatcttccctgagagggtgtctttttctattatgcacaaaggcaccttatgtgctagagcggtgctgagtgcaggactcccaagaccttgggcctctgtaagggtcagcctcgggggagggtggagggcagtcagcctgctggcttcagggtggttcatcctgggtgactgactctccccctccctcccctcccctccaccctctccagggcgtgttcattttcagtgctgtgcgatgacgccactcaccatgggaaactatgttttccccaagtggggccagggtgtgggctgctgatggctctgtcttccatggtcctcatccccgggtacatggcctacatgttcctcacttaaagggctccctgaagcaggtaagcccttccccacccttcaaattgccagtgccctctcccactgtgtcaggcacagccccaccccttgtgaagctcacagtctagctggggaaaagacaagtcaatagccaatgacagtagagtattagagacactgagattagggaaagccagggggtgggagcaaacagcctgccttagccctacttgggttaaggaggattaaagaagctcccagaagaggggataacaaaggagaggcctggggataaaccaaacttaaaagtagaacagaaagtatgtttctagaagagggaggggaggagaggttggaaagcatgtgcaaaggtcaggggtataaactgcattgggtcaactgaacggagatcagtgtggctggaaggtaaagggaaaggggtgcgaggaggggacatgacaagagatgaggttgggatgtaagaaggtccaccagatcatgaagggctttgaaaaccaggacaagaactttgaactttatcctggcagcatggggtgtcatgaagggcttggaacagacggagggtgggatcacatttgcccagggctcctctagatctcatttgtagggttgatatagagaaaatgtggtcttacccacaaagaaagcaaagcacaaaagacctgctgcctgcagcaggggcctcaccatcacatagggttctctgccatgcccacactttgttaaattgcactaaattcttgagggaagcaaagaagtgctggagtgccaggcaggtgcctcattgatgaggtgtgtgcaggctgaaaagatgccacggggagagtggagagtcggagtgtgagggctgccccggaaggccctggatgagttgctgtccacttagtgccctgggaaatgcacctgccagacccaggggaagcgctctcaggtctgagatacgggaagcctggctgcaggttatgtgctgccgtggagttactggcccatcttcctccaactcagatgaagaaactggggaaccacaggggttgagtaagcaggttcccagctcaggaagtgtgagcagagctagggcttgcagccctttcttcccaatgcaagtccaaagctttcatttccatgatccactggagagcctcaaacagcagctgggtcttagcgtggcaagaggttagggggtgcccttgcagaaaacagcacagcttgtgcaaaggcccagcggtaggaagggccagacatacctgaggccagggtgtgagctgacggggcaggatggcgaaggcagtagggggtcatccattcagcacacatggacggaaccctgatgatgtgccagacactactgtcagtgcggggacacagccatgaacaagataagcagaaattgcaccctcctggagctcccattcaggagaggaagataagcaactaacaaaataaaagcacgtgaggtggcgaggagcactataggaaaaatcaagtagacagggtgtttagggagtgccggatgaggcctcactgagaaggcgaacatttgagccaagacctggggaagtggaaagcgagctgtcgctatctgagaggaaggtctgccagacagagggcacagcctgtgcaaacgccctggagcggaagcgtgcctgctgttttgcggggcgtcgaggagtcctatgcagatgaggtggatgtgcgaggaagaggggaggcactgaggactgggaggtggcaggggccaggtcgtgtagggccttgaagaactttggcttgcctcttggtgaaatgggagccttcattgggtcctgaagagtacaggggcatgatctggtctggttttcatacaactctcctgctgctgtgttgacgacagaatgaaggggtgagagacagcatgaaagtgggagtggaagctgagggctgattgggagttgttgcaataacccaatgagaggggctgtggcgtggcccatgtggggcagtggcaggggtgcaggaggtggggattggctggagtctgggtgtagtttggaggcagagcagacaggatgcacttgaatagagagaggagagggaagcggccagttcctcaccatcccaggctgggattttccccagagagcctacaccttcctccccggtacccacagcgcatccaagtcatggtccagcccagcgaagacacgttcgcccagagaatggtcctgagcagccccaggcgggcagctccaccagcaaggaggctacatctagggtgggggccactcaccgacccgacactctcaccccccgacctggctgatgcgaccaccacttgatgtctgaggataccttccatctcaacctacctcgagtggcgagccagacaccatcaccacgcagagaggggaggtgggaggacagttagacccctgggtgggcctgccgtgggcaaggatacccggtggcttctggcacctggcgggctggtgacctttttatccaggccccatcagcatcccacgatcggccttggtaaccgccgcggtagatcattttatcccgccagggagtgtgatgcaggaagaccacatgcgctcctggcttttaaacctgttctgactgttctcttactgccgaaacccttgactgttatctcggactttgcaggagttccttccctccgaacgctgctccatgcacaggaaaagggcattttgtacaatggggacttccgggaacgcttgctcttaagtaccagaagccggcggagctctggctttcgtgtttttggtttctccttcccaaggcagctggattgaaaaaacaaaacaaaacaaaaaaacccaggggctcagtcgatattcccagggccgcttctcctgcagtctgtggagcgtccttgtccccgccccggaatgaatgagcattctgcagcccgatgtccctgtcccctcctcgccgggccattcgattggacctggcccagtgcaatctgtccagacaagccctgcttgctggaaaactgccaaagcacaattgatctctttttatcgccattccaggggcctcaggtcctactggggaaactcctataccggagctccagtttctcttaagctgcccaatttcacagagtacaaaatagtgtaggggaaatcaaggtgaaggatctgtccgacagtcaagacggatccacagtaatcttcggtctccttaaactaccaccctcgctgccacccaccccaagctgctgccgcctcacctccttgaaatttctcagcgggagtctcctcactgccactaaaacccacccagcccactaatgaggagctagtgttaatccagagaaccccccgcaatgtgcttccgagattcagactgctcattgggaagtatgatttgttcctttctggaattgggctccgtggtggcggcggcactcaagcaaagacagtttcttgcaagctccagtagctccgcgtgtctcatttgccaggaagtgggttcccacgtagcaaatcgtacattgtgccctgtagctccttagctagttagctcaaagccgtgttttatgactaatccttaataactatggtaaataactgtgactgtggggttttaatctcttgtcattctcatccaaaagtgaccagcataccagttcttgcaataagatataccctcagaatattaagcacattattgtagagaaaaaaaaatatgtgtacacatatgacgcacaacatgcacattcatcctcacatgtggcacgtaaggtctcatttgatattgtgtggaaatctgaagccttttcctgaggtcatctgtaaaatagtctcattgccaaggcatcccagtgccagctggtgaatccatgatcaaaatgcatacgtattgttaaatgataaggtttgaatgacaggaacccatcactgtgtctcatggtcccacttccccatctgtgtgtgaattctttagactaagggcaggaagacttccagctttctctttgttcttcaatgtgaaactgaaccaagtctctctaagacaaatgcagtgtatttaatgtttgtaagcaattctaagtgagtgtttggcaagaaatcccctaactgatttccatccaaacctaccttatagagcacaatataagtgttgtacaattactgtgagaactgtgaatatgtgtaacttttttttagtatttgccggggggaaaaagatattgtattatcatatatgcttttttgcaataaggatttattctagaacaccaagtaaatctatctctatataaaaaatatatgtaatatatacatattcaaatatatacagagcctgttttaaaaaatacagtattatttagtaaaattatctgttctatgaccaaatgtaaaatatttataaatgaagatgcattttaaatgtctataaatggtgtcatactagagcacgggcgttatgtaagtttctaagaatttagaggataaataataaaggttcatgatatacaacatcagaccttcaattctttggggtgggggcacaatatcctctttcatacaacaacaacacatacacacagaactatttttccccagcagacagagattggggctcaaacccaacaaaacggagctggacttccccagagtcttaaagtcatagaaaatgattgtggctgcacgagggaggtgctttcactgtgcatggggtcaactaaataaagatctaaaacccaggagaccaggagcacatttagtgaacaacagcactcgttcattcactcactgattcttcctcaacatttttatctttttaaatcgtatttagaaaaatgcgaattctacagagaagtgtaagaatagttccgtggacacatctgcacttcacccagatttgccagttgttaacactcgccacttttatcttcactaactctctgtcagtcaaggttcagcctggcaagtggagcactggatatgatggaatcagggctttattacaggaacggaccttagaccactgcagggcgttggaaagtaagagtctgcggtttctctacctggtctgctcttccccggctgtcctcacactggttccttcctttcattcaggtctctgctccattgtcacctccttacagaggctttcctgaccaccttggctaaaataacatgctccttcatctctctctgctccctcactctgtttatttttcttattctcagcattcacaagcttactaatttaatctctatctctccccatataaaggaagctctgggggcgggcacagtggctcacgcctgtaatcccaacactttggaggccgaggtgggtagatcacttgaggtcaggagttcgagaccagcctggccaacatgggaaaccccatctctacaaaatatacaaaaattagctgggcgtggtggtgggtgactgtatcccagctactcgggggctgaggtaggagaatcgagtaaacccagaaggtggaggttgcgtgagccgagatcgtgccactgcactccagcctgggcgacagagagagactctgtctcaaaaaataaataaataaaataaaaataaaggaagctctgggaatatggggacttttgctattcactgctctgtcctagatgcccagaacagtgcccgtgcccgacacacagtagaagctaacaaatacatgaatgagtgagtgaaggaaagaatgaatgaatagatggacggacggatgcaggatggatggatgggcaaggaatggcaatggaacagccatcgcaggcactggctttgggtcagacagctctccgtgtgagttccggctctgccgctcactctctcagcaactctgacacgttgcttaaatctctttgtgccccagtttcctcacaaaattgttgttacagtgaatgagttaaaacaaggaaagcacatagcacggtgcctagcccaaactgagcacttaaaaaaatagtggttttattacagcaatggttcctgaaatgttcccttagaagaacctctttaacggggtccatcccccacccagagccccatgttttgaaggattttgtctaccaaactgtccttaataattaagctgtttcccctctttttattaatcagatgtggctgctaattagagccccgattagcatgaggtaaccagggtgacagcactaatctgatatcattccaggcagaacaaagaaatgtagcatttggggtcctcagcttacccagatggtttgtaattatgtgattcctctgggctttataatatggaaaaataaagttctggatgtcccattgacttttccaggaccctcacaggttcaggacctcaggtggggtctatgtctcacaaaatgtttggctgcagctttgtatttctctttctttaaaaccaaaggttgctttgaggagtaaacattttccaggtaggtgaccacgagctttgatccagctaatacatatcatgcaaatggctcccagttttgagctcaggttttgtgcacacctctatttctttctaataaactcccagcagtgaaattgcgagtcaagcggtctgtgcatttttaaggctgttcatgcctcgtgccaaactgtccgcaggaaagtggcgaccatttttattccccccagaagtatatggtagtgacaatctccccacatttttccaaaattagatcttattattttttagaatctttttcaatttcacagatgaagtatcttaatagttgagcttatatttctttgaattttactgatgcaggactttttttcatgcctttctggcctgttgtatttattttgtgaatttatagctcatgagcatcttgctgttcttagagatgggctctcgctctgtcgcccaggccggagtgcagtgatacaatcactactcctacagcctcgaactcctgggctcaagccatcgtcctgtcttggccttcccagtagctggactacaggcatgagacaccacgttcagctaattttttaatttttcttttgtagagacaagtctcgctgtgttaaccaggctggtttcaaactcctggcctcaagcaatcctcctgcctcacctcccaaagtgctgggattataagcatgggcaactgtgtccagccagcatcctgttttgtatttgtcttatttgtttggaagagttatttttaatatattgaggatattaacacatcttatgtatgttgaaaataaatcacaggatgtatatggataggtatatgtgtatgtgatgtacatgtatatgtatatgcgtatgtacatgtgtatgtatatctatatgtatagataatgcatatgcacatgtatgtgtgtagatagatatagatagatgatagatagatgatagaaatctagatagatagatagatagatagatagatagatagatagatagataatctcttctccaaggaagtctttctgttttctagttcctggcttcttacttccaaaccttttacagttgagccaaaggctaggaaaacattttcagccatccccttttccaaccctgtgctagtgtacccctctcttgggtggaaatgtgagagcaattgcatcttccactcagggctgaggattctggcttagtaagtgtcaagtgtttagaacagggcctggtacataggaaactctcatattagccattctgtgactttctgtgaccgcacaatagcaccagctgcttactcttctctctgcctcacaaaccagcccttttatgatcctcgtggaatcttccctggcacacccttcaggccactgagccacggtcagggctgctcagagaaggcaggtgttgaagtagtggcagttcatacaacagtgataatgataacaactattcattcaggccctactaagtttgaggctctgtacaaccaccccacaagatttttctcacttctcccttgggaccaccccatggggtatggctacccttcatgtcagtgctccagccataacactgaagtcccttttccatcttcatttttggcacactggctcccgccgtgcctgcactctgacatccagcacttctgtctgtgtcagatcaagcattatttttataataggaaatacataataaactatatttttaaatacacaaagtatggctaggcacattggcacatgcctgtaatcgcagcactttgggaggccaaagcaggaggttgttaagaccaggagttcaagcaagacccacctaagcaacatagcaaggacccatcgcacagaaaaaatttaaaaagttagccaggcatgatggtacatgcctgtagtactagctttcaggaagctgaggcaggaggatggcttgaacccaggagttcaaggttgcagtgaccttgattgcaccattgcgtgccagcctgggcaacagaaggagaccctatctctaaaaaaaacaaaacaaaacaaaacaaaaaggtatacaaagtcacgtgggcttgtcaatgtggagaagacaatttactgacaaggcatctcattataatgcacataaaattaaggactttgtatatttgcttttggaggaaaatcttctttcaccaaaaaatgctaatgggacatgggtgaggagacaaccatgacagacaactctaataatatcctaacatgagcgaaggagaaatcaagggttcagtgatgtgtttactgatgtttcacctgatactgtcaaagagaatgtcttggtgttttcttgaggttggtgtcagttcaggtccgccaagaagcagatgccaagacaaatgtagcagaaaatggacctgtgggtaaacaccttgaaattttgtattgatgtataataattgcacattttatagggtacatgtgatattctgatacatgcatacaatgtataacgatcaaatcaggcatttaagatgtccatagcctcaaatgtttatcatttctttgtgttgggaacatttcagttttttcttctagctattggggtaaacacccttaaatgacacaggggagaaagggcaggccaggcaggaagacacccagccacattgatggctggacaacaggagaaggaaggagtcagtgtgggaagaaccatagactgcagtgcagcgctgggacagtctcagccagcccgccagaatccccactgcaaaggctgtgctttgaagagttccacattgaagaaatgtccaggcccattaactccactatgcactcagtgctgccagggacagtgtaaacttggctcaacactgtggacatcccaaaggcactgcaactgggggccactagcctactgtactccccacagcagtctccaaattacaggaatgtggaggcaaggaaaagatatccttatttcctgaatgccttcgtgtgcccggcactttctcgtggaatactgtttactcctcaccacaaacctacagaacatgcaggtaattactggcattttgatatggtgtgcatgttcatctcctccaaatctcatgtgaaatgtgatcccaaatgttggaggtgggcctagtgggaggtgtttgggtcatgggggagatgtctcatgaatggcttggtgccctccccatggtaatgagtttgcacaagagctggtgtttaaaagaacctggcatctctctctctccctctctcatatgacacactgactcccctcccttccaccatgagtaaaagcttcctgaggcctcatcagaaaccgagaagatgctggactatgcttcttgtacagcctgcagaactgtgagccaaataaacctcttttctttataattacccagtctcaaatattccttgatagcagcacaaaaaggactaatgcacgtttatagtgaatttcctcaggctcagagagggaaaacaactttctcacaaagccacagagctgaaatcacaggactggaccctgagcccagatccttccactatagcacagtggcctccatggtccaaacatggcacagggtataaggcaaagatctaagaccaggcagagttaaggcaagaggggatcaggaaaagcccatggcatcaatatgaggggcttctgcccctttcctgctggagtttgttacagcccaaaggggttcttcttgcccactgcaagatgaagccagaacattgagaagcagtgttgctgtagagaaagggtttaattatcacaaggtaactaaacaaaaggatggagatgtttttcaaatctgcctccccaagaattcagaagctagggtttttaagtgtacttaaaacagcaggcagagggctgggaaactgaaacaattgattggctggggacaaaatcacggggtctctaaactgtctttgaacagctgagtcagttcctgggaggggatttcaggatctgtggcatctc

SEQ ID NO: 5054 - DNA, 31309 bp, Homo sapiens
  misc_feature (9122)..(9141): n is a, c, g, or t
agaagtaagacagcttgctgaagatttcctgaaagactatattcatataaacattggtgacttgaactgagtgcaaaccacaacattcttcagattgtggatgtgtgtcatgacgtagaaaggatgaaaagtaagttttattaactctgttatatttgcttcctaacaactttgctgaaaattgagggatcattgtttggtgagttgttttaggttatttcagttggtgtgatttctttagttagcctactaatcctgaaaatttcttgaatccttcaaataatggctgtcaccattatagctttcctatagaaggaattcatgtgtcccctggttgacttaaggaccaagggtgaactgctcgataagtggattagcaggcgtttcctctttgacttccagccatgtaaattaacttaatgttttgctgaccataaatgtgtggccctagcaatggtcttttaaaactcagatttttcctttctctctcctattattagacttattcgtctaatggaagagatcatgagtagaaggagaataaaaccattgtttttgtggaaaccaaaagaagatgtgatgagcttaccgaaaaatgaggagagatgggtatgtgtgagctcctccattgaagcagattgattaaaacgcttaggaaagggcaaacttggatcacgagcagtggatttttttcatatctgatagtgatttaactttttcatttctggcgaaattaaagagatctgtgaccaaaagtggtcaagcacggagtctgaggttttcaatgtgagtttaataacacaacttgtcttttaacttaggtggctgccatgggtatccatggtgacaagagtcaacaagagcgtgactgggttctaaatggtaatatttcaaatgaagtatttttcccccttacttaacctagctagaattctgctcagatattgatcatgtatatgccttcctttgtagaattcaaacatggaaaagctcctattctgatgctacagatgtggcctccagagggctaggttagtacaaactcgcattcatggcttggttcccagaagatctccatttaacttttttaaagaaagtttattgctttctttaacctgcatttttctaagttttttttcacataaaggtgctgtctttgtggcaaggcctaggcatgacatcggaggactcgagggggatggaggactagtgatcggctggctgcttccagtcgattaggaggtgaaaaagctgaacgtgtgccagtaatcttcaaaaggcagaacatatcacctctgcccgtaaactgttctctccgagggaaaaaatggaagttatcctcacagttcactgccgtgtatttcttctgtcccatgctttgcatgactgccatggtacagccttgtttcaaactgtcactgtgatctgtgggtctttgagtttcagtgagtttgctgaaatgtcgaagaagtagtccaaacttcaatgttcaatgaaatttttgttcaagtttgaaatggagagagcagctttaaaggtactaagccttttacaaattggtgagtactggcacatgagatctagagcaggagcacttctcacacatagtaagtgggaaaagaaagtgctttgaaagttcctccctcacctaccagtagtcgtcatgtcgagacctgccagagagagacacattctcaagtgaatcctggctcttggaagcgcttgcctagacgagacacagtgcataaaaacaacttttgggggacaggttgttttcttgcagctgcggttgtaaggtcttggcaagacaagcagtgtggccagaatttgaacttctgatgaatgtgtaatgcaaaggaccttgtacatttttttgtttcaaggtcctaaaatgagcacatgaagaggttgctgtgaaactttaagtggccctactgcgcagaagcatcagatgtcacttgatgatctgtaagggaacttgctgatttgggaatgtgcttagggaaacacattccttttgacagggtctgtcactgggtgggtgatgaattatacagatgacatggcttttttttcttttttcaacctcaatggtattcctacaggaaatggataaccattttactgtattttttgcagcccgtaccttcttgggaatacaattgtctaactttttatttttgtctggctgttgtggtgtgcaaaactccgtacattgctattttgccacactgcaacacctacagatgtggaagatgtgaaatttgtcatcaattatgactaccctaactcctcagaggatatattcatcgaattggaagaactgctcgcagtaccaaaacaggcacagcatacacttttttacacctaataacataaagcaagtgagcgaccttatctctgtgcttcgtgaagctaacaagcaattaatcccaagttgcttcagttggtcgaagacagaggttcaggtaaggatgatgataggaaatgttggtagttacgagtcacatcgttgtctacaaatccatttaaatggtttggagggtgagtaaaaccttgaatgtgaaaacttaagctgaaaaattgtaaaaacattcacgcctaccatgaatagatctgtttctttctgtccacaatgatttgtgtcatagacatattgatcaatttgcaattgttttcttgacaggtcgttccaggggtagaggaggcatgaagatgaccgtcgggacagatactctgcgggcaaaaggggtggatttaatacctttagagaagggaaaattatgacagaggttactctagcctgcttaaaagagattttggggcaaaaaccagaatggtgtttacagtgctgcaaattacaccaatgggagctttggaagtaattttgttctgctggtatacagaccagttttaggactggtaatccaacagggacttaccagaatggtatgatagcactcagcaatacggaagtaatgttccaaatatgcacaatggtatgaaccacaggcatatgcatatcctgctactgcagctgcacctatgattggttatccaatgccaacggatattcccaataagactttagaagtatatgtaaatgtctgtttttcataattgctcttatattgtgtgttatctgacaagatagttatttaagaaacatgggaattgcagaaatgatgcagtgcagcagtaattatggtgcactttttcgctatttaagttggatatttctctacttcctgaaacaatttttaggttttttttgtactagaaaatgcaggcagtgttttcacaaagtaaatgtacagtgatttgaaatacaataaatgaaggcaatgcatggccttccaataaaaatatttgaagactgaattaagtggaaattgtactttattttatataatgtcatgtaaactttgcttaagatggtctggttttttttttgtttttgtttggttttttttttccatgaaacaaatgactgttcctttttatttaatttgggaggcagggggaatcagaaggcccttcttataatgagctattcatattgcaggagtcagaatgaattgatacaggtgaatttttagtacaggctaaattgcataaaagctttgtcagcttccagcatcaggggagtcatttaatacctttttccttatttgctagtatggttaaatgagaaaatagtaaaatagatacaaagtctctatatagtgtgagaacgtgggtgactttttcaaagtttataatttaaaaagctccaataactggctttttcaagagacttatactcatgctcttggctatactgtgaattactgaatgttgaacaaacctgtgaaagacatacattagccctttaagatggccaggagctaagctgagtctcctttactgaatttcgttcttagtgcaggttacttgtagattctagtcttcacggctccctggggctcttaactagtcacactgggagtcatgaatgtctttccaataattcgggaattctagagatcctcaaactgtaaggtctattcatactcaacacaaggaaaaaactcattaaaattaatgactaatcaggaggcaacgtaaccaaaagcacagtgaatgaaagtttcatggtaggttcaacatgggtttattgctagaaagatccaggggatagctttaggttaacttcggctcaccaacgtaactttctaatcatttatttcagtaatagctagaagtgggctgaatgttttcccagagtctgatacgtgtttttttttgccagaagagaggtcttcagggacttcatttaaattctgattattaaactgaggctttaattgatgttaatgccttatgtaaatgtaaagttagaatttgctagggctgggatagggagtgatatttctaggacttagaattgaaaactaattcagcctgtagtaacctggatggttttcaatggcatggttagtcaattcatggttttaaacttagaagcagctttcgggggagagggtaggttggagcatttattcatattttactgtttaatgtcttaaccgtgggccttttaatttgtaaacactgaaatgatgttgggctgtggaaaacatttacctatttaccttggaagttttaaaagacagtccacttttagcatgtgtgttgtgtccagcctgtggtcgtcttaactaataaatgtgatttttctcccattctctctttttatttatttgcgtataggccttttacctggtgtgagttcctgaagtggaaaacacctggcagtagtacccagctttgcagttaattactatctagctggccttttttaaacccttgtatacacttgtaaagaagaactatttcctgaacctggtacagcacttactaatgataaaactttactcctgaattacattaactcaattgctaagctgttacccccttaatcaggtagtagtttggtagtctcacagtgaaatgtagattgttcctttttccctaacctctttaaaggttttcgtaactgaggctggtataagaaatcatggactttggaatcaacttcctcagtctgggtataccacttttccactttctgggtaggtcttaaggtctcgactatttaaatagaaactgcaaaatcagaaacctgcaatttaatcatgagtctcttaatataacagtcacaagtctcattgttttgatgaacccatagaaggggcccctggaagaaattcacgtacgtggttttctctgacaccaggagggtttaagacatgtcagggccccttggttatttctagtgcattcccaggtgaggcagatgctgctggctggggactgccctttggaagcactgcaatatttaaagtgaccataccactaccctagtcacgaagcctatcgcccccctcccggaagcttaagcgtcaagacaacggctctggggttaggcctaggccacctggcggcgcatttgcctagttaagaaggcctgggcttacaaatcaccgtaaaggactaaaactgttaaagggaaaccaaatgccaaatttagtccaagtgcttgattgaggtgtatatagaaggtatttggataatactgaagtattttaattttctggactgcaaaacagtggcagaaggaaggactcaagtggctacaccacggttataaataggtgggaataacctttactggtgcttacaggaaagaaaaaagtcaatctgaagggaggggcgcgacgcgaacggcaagctagcagagaccatccgagccggcgtccgccatggtgggcgggggacggctgcggccggaacgcagactgcgcttccggggtggggcctgccgcccgcaagcacgctcacctccgttgcgcctgcgcgtggcctctccggattctgttaacggtagtggtggcttgttgggatccgttgagtgatggagagtgtgctctttaacttcggagagagatgcgctctcgtgtagccgtcagggcctgcataaggtctgcaggtgcctgttgtctgggtttgggggtcgagtagatgcggggcagccgagctgttgacggaaaggagtagccccaaaggagggcatgtgaagtcgcacgcggagctcaggggaacggcgagcacccagaagcccccgggtctggagagggaagcgaggcgctgttaagatctgtcagagaaggcatttcctaagtggaagcaagcagcagcttagccgggattctttctgagtgggtgccaccccggcttcggacccttgggcgtagagttgcggaagaacctgccgcagaatggtggacctcggtggtggtgttcagggagcaggtattcccggtggacgcctccaccacaaaccaggccctttgctacccggggacagtgccttcaggttagtttctgcaaaactctacgcgaaatcttgcaagacaaagagctgagtaaggaacagctagtagcatttttgagaacgtattaaaaacttctgggaaactacgggagaaccttcttcacggtatgcttacgatttcatgcttcaaaacaggtgtcgggtggaaaggcgaggcagtcttgctggatctggggattgcaactggccctgtattcccatgcaaggaagttagttagttctcatctttttaagtagtcggatatattaacagtgctctaccctggagaaaactggtccatggaatcattctgttccttaaacaatctgtccgaaggacctgggaacgctctcaatttcacggggcaactctgaacacagtgctgtcatttagtgcaatgtagtctaagtgcataaggaactacacagcattttgaacttttcttagatttattctaagtaaaaatgttgaaattataattctgaaatatttcatgtatatcataggataaatcaaggccaggcgcagtggctcacgcctgtaatccagcattttgcaaggcagaggcgggtggatcacctgaggtcaggagttcgagactagccggccaacatggtgaaaccccgtctctactaaaaagacaaaaattagccggccgtgacgggagcgcctgtaatcccagctacttgggaggctgaggcaggagaatcgcttgaacccaggggcagaggttgcagtgagccgagatcacgccactgcactccagcttgggtgacaagagcaaactccgtcttaaaaaaaaaaaattcaaatagttgggttagttgttattaggaaccaaatattcattgtaaaagaagagataatatgtaaaagaaggtacgtataaactaatgttaatatggattggtaaattaaatatgaattggtaaattaaaattgaatatgggtctcactcttcacccagactcgagtgcagtggtgtgatcatggctcactgcagcctcgacctcgggctaagtgaacctcccacctcagcctcccaagtagctggactacaggcacatgccaccacaccagctaatttttgtgttttttgtagagatgaggttttgccatgttgtccaggctggtctgaactcctgagcttaagcaatccgcccatcttggccccccaaagtgctgggattacagggtgagccacagtgcccagcctcatgatttttaaaaatatatttcctaactttcttcgttaaagttcctagaagcaatgaccctcagtagcaatgagcacacctagtgcccagatcctgttcctttttttttttttttttgagacagagtctcgctctgccgcccaggctggagtgcatggcacaatctcggctcactgcaagctccatctcccaggttcacgccattctcctgcctagcctcccgagtagctgggactagactacaggcacttgccaccacgcctggctaatttttgtatttttagtagagacggggtttcaccttgttagccaggatggtctctatctcctgacttgtgatccgcccgcctcggcctcccaaagtgctgggattacaggcgtgagccactgccccggcctccagatcttggtttctaagatgaaccagtactgggagaaatggctgattccggtctggggttagggaaagtacaaggtgagtttgaaacactttatggtgctaaaaagcaagaattgcttgaagactaatgggtcatataaaaaggtcacagatgctggcttgaggaggttgtcactggccacatctaggacaaattgaacattaagatacatattaatggtaatggacataacacattgactaaaatctaagagtcaatagtattaatcaaaaacaaataattgacctagaggtcgggggcggggggaagaggtagagaaagcttatgtttttacagaagctatgaataaatgtagaaggaaagatacattagaaaattcaccatttcatgatattgcaaacccgatatcattgattcaagcaacagtcatcaatggattctaaaatactgggtgaaatactgtggggagcaggatattattggggagtggatatttactaccttaaccaagtaatcaaattggtgtcttcagtagtggaataatttgataacatgttcctcatgttatgatgcaataagaacacacatctactatgtagtattttgctaaaaatgattagccgaaattaaatcataaggaacaatcagacaaatcccaaatgtgagacaatctatgactaacctggactcacatcaaagtcagtgtcattaatagcaaaattaagggggaaaggaggcaagggaaatgttctagattaaatggatgaaagaaacctactcagaatgcagtacatgaatcttaactggaaagagaacgtaaaagatatttggggtgaaaattggaacaactaaaatatcaccatatgttagattatttgtggtattatggttaactttttatggtgttataatggtatataggaaatatttttattttagaagatgtatgcggcagtatttgggagtgaacaagaaaaaaatgtggcaaaatgtgataattgatgaatctaggtaaagggtatacaagtgttcattgtatatggatgtttattttttttcaactttcttatagatttgaaaatctttgnnnnnnnnnnnnnnnnnnnngcaatgataccactctcttcttcagataacatgttattctccataagtttcttcctgttgacctttgatgcaaaccaggcttcccatagctgtcttaggcagcaactagttggctgatttaaacttcctgacagttcatgtaaacaacaggtccagttgtctcagacaaattaaccaaatagattcaacagtaatatttttaattaagttatggtgttgaggcaatcagacccttacaattttaaagtgtctttttttgttcaattttaaaactatgaggccgggtgcagtggctcactctgtaatcccagcactttgggaggccgagttgggcggatcacgaggtcaggagatcgcgccaacctggctaacacggtgaaaccccgtctctactaaaaatacagaaaaaattagccggcgtggtggcgggcgcctgtagtcccagctactcgggagggtgaggcaggagaatggcagaacccgggaggcggaggttgcaatgagccgagaccctgccactgcactccagcctggggacagagcgagactccatctcaaaaaaaaaagaaaatcttcaaactaaaaactcagggtaaactacctagaattaagtggtgatctgtctttttttgtttttttttaagacagggtttactctgttgcccaggctggagcacagtggcaccatcccagctcactgcaaccttggcctccagactaaagtgatccacctcccagctttccaagtagctgggactacaaggcacacacaccatgcctggcttatttttgtatatttttagagatggggttttgctgtgttgcccagttggtctcagaactcctgagctcaagcaatctgcccacctcgacctcccaaagtgctgggttataggcgtgagccaccaagcttagccaacatctgtctttatgctgtgttaacgttatactactattaatgtgtctattgacaaaaatgatttgggtttgtggactagatgtatacatgattgatttatcttttgacaggtgccttggaacactatgttaattgcctggatctggtaacaagaggctaccttatggccttgctcagattggagtgtgttttcatcctgtttttgaactaagcagatacgaaatggtgttaaaaggtataaaaagtggcaaataacttggccttgatttaaatagtcaaaaaccagtcatttccacttgggataaattatataattttcagatagctaacttcctgatacgttttatatctaaagtattggtgagaagactgaagcttcgttatatggtttactcctccgagaacttcaaaccagtggcttgatttctggttacgtcatcgatccagtggtggagaaaggtactgcaataattacctttaatttaatagttaatacataaatgtcttaatgtgtcagtggtaattcttctgacatacaagaaattatatttgatgtatgtgctattaatatattatacaaatacaaaaactctttgtaacaattttcattgttctagatacaaagttactttggtaaaaacatttgttgggctcagatgtgtttgttaattagccttttgtgtaaggtaaaattcaaagccctcacctagcattcctggctgatgtagagtttgaccttgaccattgtcacagcttcagcttttgctacctacctccatgaactttccatattagtaaaatggctctgtaattgatgatcaagttttagtactcactgaaaaaaaaagagttgaataagcatttttgtcttgccatgtgttatgttaccatttcccgactcaaacatccccaaaacccatttaaactgtatgaaataatcacgagtcatcaagaacttcgcagaagggtaagatgaggactatgtgatactttcttctttatcccactttagtcatggttaacttcccctctcattggccataaaagtctggataacatcaacagttttttctctgtagttctttcctactaaaaacaatatgttaagcaatatactcagtattttcactttttattttattttatttttttgtctgtttttggttttttttttgttttttttttttcacaagtaccagtcatcttttattggaggttaattcccattaggatatgaaaggattcagcaacaatcgagattgtgttgctatggaggggttgcagccaagaaggttgctgggggagtgcagagcatgtcttcttcagtgtacttgcatagccgctcgtgcttgagctccttgtaggaaaggcagtagatgaagagcagtaccctgccagcaccatggtaaaccccgagatgctccccttcttcacgttgatgtactgttgtagtaccagtagtaacctctttgaaacgctccatcaaggccactagggctgaagtccacatcaagatccagcttggcagctcccctagtttgacctccagaagtttcttgtcctcactggtacaactgactccatcttggtttttttagagacatagtctcactcttttgcccggctggactgccgttgcacaatcacagctcactgcaacttcttttattatttgtagagagaagtcttgctctgttacccaggctggtctcgaagtcctaagctcaagtgatccccctgctcagcctcccaaagagctggcataacaggcgtgagccactgtgcctggccagtattttactttttaaaaattaaatttcagcaacctgtggtcccagctactctgaatcctgaggcagaggattgcttgaggccagcagtaggaggcagcagtgagctatgattgtacctgtgactgccactgcactctaacctgggcaacagaatgagacacatctcaaaaaaaaatgtaaattgaataaactttaaaatttgtattcgggacttgactagtttcgcacatttgctgaataaaagtatcggacaatttaaattcttacagataattatgggagttaaattagtgtttatttaatatgttaagacaaacttaaattttcttttccagtttgccatgagtccatctaacttcacagcagtgactgtcaggatgaagaaggccggaaaggaaacaaactttactacaattttcctggggaaaggagttaatagaaaccctgtggaacctaggagatcacgaacttttacacagtatcctggcaatgtgtctaaattacatgtatgttttacctggagctcctatgtatttttacccagattctctataatcatttccgaaccatttgagaataaggtgcaaacgtggtgtttaacacttcattgtgtatttttcagatgcagagacactcacctacataactacaatccgtcatcaaaatcaggaaattaacagtaatccactattgccacagagccctacaaattgactgattatctcaataatggcatttataggtccaagatcttgtctttcatgtagttgtcaatgcctttacactccttcaaatgaacaattcctcttgtcttgcgtgaccttgacattttgaagagtacagtctagttaatctgtagaatatgccttggctgggatctgtctgctgtttcacgtgatttatgtatttttgtcgggagtactacagaagtggtagtactgagaagctctttctcagtgtgtcatatgaggagtgttactggtgatgttaacttttatcatttagttaaatggtttctactagatttctccagtgtaaagctaataaatagtttgtatttattaattacggccaggcgcagtggctcacgcctgtaatcccagcactttgtgaggccgaagtgggagatcatgaggtcaagagattgagaccatcctggccaatgtggtgaaaccccatctctactaaaatacaaaaattagctggatgtggtggcttgcccttatagtctcagctacttgggagctgaggcaggagaatcgcttgaacccgggaggtggaggttgcgatgagccaagatcgtgcactgcactgcagcctggcgacagaacgagactctgtctcaaaaaaaaaaaacaaaaaattaactagtaattaataagtgttgtgggcagatactttaagatgatgcagacaatttcttgtcaccaaattttgccttactggttgcagcatccattgatgattcttgcccagatcagtactaatgtgaggtttgccaaatggtgatttttttttttctttatttgagacaggatctactctatcactcaggctgaaacacagtggtatggtgatagctcactgcaacctcaaactttgagctcaagcaatcctgcctcagcctcccaagtagctaggactacaagcatgtatcacatgcccgactgatggtttaatatttgtagagacggggtctagctttgttgcccgggctgtctcgaactcctgggatgaaacaatccccctgcctcagcctcccaaaatgcttggatttaagaatgagtcaccatgtttggccatgtcaccaaattttgccttactggttgcagcatccttgatgattcttgctcaaatcagttactacgatgaggtttgccaatggtgtttttttcccttcccttttttttttttttaaaaaaaaacaaattccatcattccttctagatttacggtcagcaatatactgtagagcttttccttctcctccattttttttttaaattggtattcacagattactttctcagggggttacagtgtgttactgtcattatttattttgatggtcaattgtcctagacttggccagtgtccttttgacatatttccatcattgtcttgacgagccttccttaccttttgtagcaatatattgttccaggatcatcagtgagccaagactgtgcgctgcactccagcctgtgcaacaggatgagaccatgtctcaaaaaaaaaaaaaaagaaaagaaaaaatatatagcaaaaacataggagtttatatataatgagtagaaagtagattaattttatttttttattttttgagacagcatctcactctgttgcccaggctggagtgcagttcgcgattcccaggttcaagcagttcttctgcctcagcctcctgagtagctaggactatggtgtgcgccaccacgcccggttaatttttgtatttttagtagagacagggtttcaccaattgaccaggctggaatttttaaatatgaataactaatgaaaaactagaaggcttattactggtgaacattttcctttaactccaccaccatcacacttcattttggggtactcagcttcaaatgaaacttattggttattatcatagttaacgaacagctcaaccttgtgactaggatttaaagatgatttttgtattgtggctattagtgtcttattttgttcttttttttctttgtatgaagaatggggtctcgctatgttgcccagtctggtcttgaattcctgggctcaactgttctcctgcctctgcctttctgagtgctaagattacaggtgtgaactaccatgcccgattattttgttcttttattggtatcattttcactaatgaagagttttcctattgcagaatttttctcttccatgacattgttccttttctgtttccagagttcacaaaattatttatattagttgaacatgttataaaatattaagtagaatttctgtcatttagtatgctttcttaaatgtttctgaggccatttctttctttttttaaaattatttaatagagatggggtctcctgtgttgctcaggctggtcttgaactcctgggctcaagcaatcctcctgccttagcctccaaagtgctgggattataggcgtaaaccactgcacccagcctcttaggccattttgtactgtttttagttgattttatggttaatgtccaaatatattttttagagaacagtgaagcgaccaataaaggctgaagaacagttaggatagaaaagaatttattctggatagtgtgagaatcagatattgttggaagagttgccaccagatatcctgacattgttggatatccaatttcaaaaaattagaaaacaataaacaatcttttttgtttgttttaaatagggatgggatctgccatgttgcccaggctagtctcaaactcctgggctcaagtgatcctcctgccctggctcccaaagtgctaggattacaggagtgagtcactgtgcccagcctaaagcattcttcataagattcagatttagattttgtttgattcaaagcgcaccacagaatctttcagtacttggtttgtctttttttttttttttttttttttgagatggtgtctcactctgtcacccaggcggagtatagtggcacaatgtctgctcactgcagcctccacctcctgggttcaagtgatttcatgcctcagcctgctgagtagctgggattacaagcatgcaccaccatgcccagctaattttgtctttttagtagaggtggggttttaccatgttggccaggctggtctcgaactccgaactcaagtgattcgtccaccatggcctcccgatgtgctgggattacaggcatgagccctgctcccagcccagtttatcttattaactatcagttcgacgataactgtgtgaaatacactggtagaatagagtcccaggtatcagaaagtttactgcctttgagggcaaattcttggaatctttaaagtatcatatgcaattcaaataggtttaaaatgtcagtacatatatgtataatgaagactgtggttgatcatgaataattaacagaagctgaggatttaaatttgtgggttttctctcttttttttttgttctgtgactctagctaaaggtggttatttaagtattttaaaaattacatgaatatccaggtgaacaatgatttacaaaaaaagaaagatgaaagtgaactgtttttatccaaaacttaagaaatttctaggattgaaatttttaagaagtttgaatgattcctcttcagtttagagaagaagtaagtctgtttatcaatacttaattcatatcagtactatgtgtagtttgttttcataattatggctttaatgcaaaaagtaagtttttgaagatttcttttttatgaaaataactttacgtttcagaaaattatactccaaacccctttcctaaagcacaccatttttttccctaaggcctcttttgaataatcagcaaacaatttttattaaaagtgttacctttcgaggtagggcgcagtggctcacgcctgtaatcccagcacttgggaggctgaggtgggctgatcacctgaggtgaggagtttgagaacaacctggccaacaggtgaaaccccgtccctactaaaaatagaaaaaaattagccagacatggtggtgtgtgctgtagtcctagctactcaggagactgaggcaagagaatcacttgaacccgggtggcagagttggcaatgaggtgagatcatgccattgcactccagcctgggtgacagagcgagactcgtctgtattaaaaaaaaaaaaagtgttacctttctgaatactaactctgagctcggaagattaaagaaatagtctgtagggctattgaaaaaattgatgcctaagtccctctccagttagttcgttcagaatctctgggatagagcccaaccaagcaccatagttttaaaattcacattgggcctcgctgatgaaacactgagctcagtgagagcagagaatgcatctttatcgtctcgtgggcccagtgcctaccacaggcctggtacagagtgggtgctttgtaaaatgaaacttacttttgtattctgattgtgtaagtctaaaatatgtactcaggaggctgaggcaggaaatcacttgaacctgggaggcagaggttgcagggagctgagatcatgccactgcactccgcctggccaggtgacagagtgagactccgtctcaaaaacaaacaaacaaaaaaagttcttgaaatgattatttttcttctgtttttctgtgaagggccgagatggacgaaaaaatgtgttccttgtgttctctctgtaaatggggacctagaccgaggcatgctggcctacctctatattctttccagctgacagagaactcctttacaagaaagaaaaatcttcatagaaaggtgtgttgatatttcagagatagacttgggaaactaaaaatatgggtttgtttgttcttaatttagtgtgctcggtttctaacataaactctaaataataaatttagtgcatgtagtctaatatttttcagtttttttagaatctggccacaggaataagaatcaggttctcacagaataaacaaggcatccctaataagtaatcccaaaggcatttctgtttaattgtgaacagacagtatctctatgactcctagcccctgaacctttccactgtgggcttccatttgtatcagaactgaagcattggtacataggaggaagaaagacccggatcagggagacctgtgctattgactctctgccccaggtgtctggcttctggtcttgtgccacatggctggttcctggatcagggagctagatgtgggcctggaaaggctgattttagtgcatgaacatgcacttggagcattttatgggtcaaagaaaatcgagaggagaagttgaagttataggagagaaaagaaatgataatggggcaagatgaaggaaaccggaggggtcaggatgggatcaagagcccaagtagagaatgtatcttgaaaaggagatatttgaaacagcagggaagaagaaaaaggatagtgagtataaaaaggctactgggctttttggtctttgaaggacattttactgatgccctctatttctcagggagttaggaggcactattagtttaaatgtggaagagtgggggtttaaatggccgagtggggaatagtcatataccctttgaacataaaaggaagctgccccaaatcaaaagtttaacaaataatgttgagtgttcagctgggattgggaaccatgagtttgtaggaaaccctcttcttagttaagtgatttattatacagtgttcatttagcctgctataaccatagagagtctgattatagaattattctggggaatggggtttataaatggtttgtagctaacaaaaaaggaatcctttctttttcttacactccacttccaaaccatcagcaaatcctgtttgatctaacttcaaaacgtatcctgagtctgaccacttcctagcctgtctactgctaccacctgctataagccaccgccactcctcctcccctgatagagtggccctgttaaaaggtgcatttgtgttgctcctttgctcagaacactccaggaaagcttctcatctcactcaggaaaaacgaagccctctttttgatctgctgttctccacctcactcagtctgctccagcagcactgccttgctatttctagaacatgctggagatgctgccagctcagagccctgtcatttgtatccccattgcctagagtgctctttcttcatcatccatgtctcgtccccccaccttctttcagtgtttgctcaagtgtcaccatagggagagaaccttttctgaccaccttaaagttgctaaaacctcccccagcctgcctcttgccagcatgttccatcttcttccttttttagcaccaccaccttcacatatattatttacttatttttattgtctgtttctccctgccacgagagcggagatttttacccctagcacctggaactgttcctggtatcagaggcattaaaatgttgttggatggactaatgaatgagaagagaaggctgggctgaatggctcacgcctataatccagcactttgggaagccaaggtgggtggatcattcaggtcaggagttcgagaccagtcttctgggcaacatggcaaaacttcatctctacaaaaaaatactaaaactagctgggcgtgtggcgtgcacctgtagtccctgctacttaggaggctgaagtgggaggatggcttgagccagaggtgggggttgcagtgaggcagtgagtggagcattctagcctgggcaacagagccaaccctttaaaaaaaaaaaaaaagcaaatttcatttaaaaatttttttcattcaaaaaaaatatataaaaagagaagaacagtaggttttgacaagagagagaaagttgaaatggtaagcacgtggcccaggctggtagggtccaaagtgatgctgaaagaagcattttgactgaggggttgtcagaaaatgggagggtctcaagttaatttgtttttttttttttttgagacaggactcactctgtcgcccagactagagtgcagtggcacgatcttggctcactgcagccttgactcccgggtcaagcattcttcccacctcagccgcctgagtagctgggactacaggtatggccatacctagctaatttttttgtatttttttggtagagagaagttttcaccgtgttgccaggctggtctcaaactcctgagctcaaggaatccacctgcctcagcctcccaaagtgcggaattataggcatgtaccaccatgcctggccaaattaatttctttctgccaaacatctagtggagaaatctggggggcagctgaatatgttactacatggtgtttttatgacctcagtaacttctgttttcacacagaaaattataactgttaagaaactgtttgttaatacttgtttatatttaaacttgtgttatatttaaacaaactatgctttttcccctttcctgtcttcccctcccccatttaattgccttaggtacttaaacttcacccttgtttagcccctattaagttgctttggatgtaggaagaggccccacattggaactaagacaggtgagttaaatgagttaaatgtcattttaattacagattgagtattatccaaaaacgctttggaccaggaccatttggatctcggatttttttggtatatttgcatctctaatccaaaaatccaaaatcttaatgttctgatgagcatttcctttgaactcaaggtttcaggttttggagcattttggattcggattttctgattagggatgctcaacctaacccttactctaagtaaacttgatagcttccatttaaaattttattttgattcatttgctttttaaaatgttttaggtcgggcgtggtgctcacgcctgtaatcccagcactttgggaggccaaagcgggtggatcacgaggtcaaggatcgagaccatcctggccaatatggtgaaaccccatctactaaaaatacaaaaattagtgggcgtggtggcacgcacctgtagtcccagatactcaggaggctaaggcaggagaatccttgaacctaggaggcagaggttgcagtgagctgagatagcaccactgcactccagcctggcgacagagactccgtctcaaaaaaaaaaaaaaaagtttttaatttgcctggccaataggcaaaacctggtctctactgaaaatacaaaaattagccgagcataatggtatgtgccttaattccagctattcaggaggctaaggcacaagaatcacttgaacctgggaggtggaggtgcagtgagccgagatcgcagcactgcactccagcctgggtgacagagcaagaccctgctcagaaaaaaaaaaaaaaaaaaaaaaagctttaattaaataatgaactgtgggtaagtatgtgattatatataattttgaagtgtgttaaagaagctgaatacagttcattgggtttgtgttcatgcccattcatagtttcactttttagtgagtagacatagtaattaaaatattttacacatgttagtgaatgtgacttatttctttcccctttgaactttttatttatttattatttattttgagacggagtcttgctctgttacccaggctggagtgcagtggcacgatctggctcactgcaacctctgcctcccaggttcaagcaattctcctgcctcagcctccctagagatgggattacaggtacacaccgccacacctggctaattttttagtatttttagtagaacagggtttcaccatgttggccaggctggtctccaactcctgacctcaagtgatccgccacctcggcctcccaacgtgctgggattacaggcgtgagccaccgtgcgcagcctttccctttgaacttaacacttttggtaactgactatattcagatattctagatctataattttatttgatttttctaatttgttctaatgattaaatactcttaagaaaggccatgggggatgctttcatttcgttccagagactccttcagcagtcgtcatttctgtctgggtgattgagaccagcccagacctgaatgcggacactaaaaagatttaaagactttgagagtcccccagcttctgaccctggcttttgtggagaggtctgggaagatgggagatagtgagctcaaagaagagaagataatggcgtatgtcccacattttctcccagggtatggcagcctccctaataccttataagctaggaagctcctaggatgctgtagctcagtcaccatttagtaatgtctgggagatttgtggttgtcctaagagtgggagggtgctgcaggcctctcctggaggccaggatgctgctaaacaccctgggtcagcagtgcaagggtgaggaaccctgctctggactgttgtgctagactgttaaggggtttttaaattttgctttgttttgcttccctattgcttgtaagaaaacagttaagtttactgtgtcatttattcatcgttacttctgtatttccagtcaagttttgtctccagcattccagtgaaatgggttgatcagtctcttcttgaaacattttccgggtttgcttctggaataccactctcctttttctcatcctttttctttcctggctcttctcctcttcctgacttggtggtataacctagggctcaggtctcacctctcagatgagggcttgagttcatacagccctttggatctcctggtttttttctgacagaatctgttttggtttgtttgtgttttgaatgatactaagggtaataaaaattcttatttgatatacaaatttctagaagattggcatttagtattcagctttgctatgcttaattacttcattttcagaagaatatacgatttataaagtatatgatatggaagttataaacattaacatcacataattaaaaaacatacccattttagagattgaagagggtgatttgtggcttcacaaaaatagaataacactctagctaccattatttctttcatatttgaagtttttctatttctttctaggtttgcaagggctatttaatgagttactagaaaatgggatttctgtgtggcctggttatttggaactatgcagtcctcattggaacaactttattcgaagtaagaattgtattttcattaaaggtgtatttattcaagagtttttgattatgtttatgaattacagaaacaaatctcttctaatttatatataaaatataattttaaattattcctcagtttcccttttacagaactatgtcatttagttaattgcctcagcagggaacagtattcagcaagtatgtttgagcacatgcttatgtagttccaagacttaatgtcatgaagtatgtatacctcagcttatccacttatggtgaaagtatgtatgtagagagcatgtgttgaatcaagactgaaggaatatgagtggaatcctttctttgctggcattgtggtccattctgagactgagtggaagggaattctattctgagggatggtctgttctagtcttctaagggattggcacctctgttcacccaattgctcaaacagagaaactggctatcatccttaactcctccctcttcctcattctctacatccagtcatcatcaaatgctgtcagcttgcttcctaaatgtatctcatccatctctgtcttcgctgcactacccaagttagagtcaccaatatctcttgcctggattattgaaatcatctcctaatgagctctctgtgtctagtctcaccccatgctatttcattaattgttgtttttaaataaccattcttgttattttttttaagctttttgtgttgaatatgtatcttttgggtgaaaagtgtgaaccattgtgttttgatcttcagttctctgaacatttgttaaaatacaccttccagctgggcgcagtggctcacacctgtaatcccagcactttgggaggttgaggcgggcagacacctgaggtcaggagttcaagaccagcctggccaacatagcaaaaccccgtctctactaaaatacaaaaaattacctggccatggtggcttgtgcctgtagtcctagctacttgggagctgaggcaggagaattgcttgaacccaggaggcggaggttgcagtgagctgagatcaaccactgcactccatcctgggtgacagagcgagactccttctcaaaaaaaaaaaaaaaaacacctttcagatgatgtccaaagaaaagtagttttctataattagagcatctaatggtttattatgtgtaaaatgaaggggcagcacttgaactttcttgtcctctcaggttctcaatcttatcctttgagccatgtggacattgtcaagttgcagttgttctttatatggtaaaggtttattgtcccaggatatttttatgaaattattattaaacacgtactatgttttattcatttgctatagtggtgaacaacacagaaaaatgtatcattctttttttttaagacagagttcgcactgtcgcccgggctggtgcaatggcgtgatctcggcttagtgcaacctctgcctccgtgttcaagcgattctcctgcctcagcctcccgagtagctgggattacatgcgcctgcaccacgcccagctaattttttgtagttttggtagagatggggtttcactatgttggccggctggtctcgaactcctgacctcatgatccgcccatctcagcctcccaaagtgctgggttacaggcatgagtcaccacgcccagccatactattcttgttaagcttatattctagtagacaaaatagacaataaataaacagagaaataaaaagtttctgatggagtcctacaaagaaataaacagtaatgagatagtgtgacttggtaagcatacagaaggtcagccgtgcatcatctgtttggttattgctgaactagaagctataagctagctactcaataaaggaaacatattttggtataatttgttataccaaattgcatctttattataatattgtttattgtaaggacttcagtctaaaataattgttcttggattgcatccaagaaccaaaaggctgaggttatatgcggttcttctgtgatatcaccccaaatgatgtgttgaggtaccagtgtttattctagattttattttcttttatgacttttcagctctagcaataagttagaaactgtctgaaatattactttaaatacaattcagaaactttaaaaatgttgggtttttttggtccacccttagccctgagtctgtgactcttgagagtgcatgaacactgaattacagctggcaacgtggggaatttattatttacatttgtgctcatgtgtctgtttaactacttttttcttaggtatatgaaatgagtattctcttcacagttttggttactgaaactactttggagaatggattatacatctgagaagcagagacaccacaatgaaggaaatgatgcatatatccaaattaaaaactttttgattaagtatatatcatcagctaagaatgtatagatttttatatttgtataaaaatattcttctctcctaatttggttgtcttatgttcacttagatttatttctagccccttgcacttataaagtggacatttgtggtgcttgctttcattcagtgtttatattttttagtctttcattgtatcaggaatatgttcagctacaagaaacaaaaatctactatactggataagcaaattggggtttgtttttcttacatacaagaactctagcgggtagactgtccaagctagtattactgtttctatagttagggacccaggcacttcccttctgttctgccatgttagtacgctggtgtttatcattgttgcttcgggatcttaggtggctgctgtatttccagctaattatcattctagttaggagaaaagttaaagagacaagagctagtcagccaacactttcccttttaaattagggaagtaaaaacttttccagacatcccagtcgggagatgtcttacatctctttggtcagaactaaatcacatgataatttctaggcaaatcaccatccaaggaatgaaaatgatctgatttagatcaaacgcaatttatcccttgaggctgcaatagtatctactctctcagaaatgggctttgttaccaggaaggaaaaggtctttatggaatctgccaatctatactgtcagatatcaaaaattaacctaaaactaaacttttaaaacttagagtattacggatttttgaaaagcaactaaaatatatgttagatgtcatatattgtagtttgtttctgtctaatatctatgtttataagaaatcttttaacttttatgtgttgatatgattgtgaaaatatcccattgttaccaacttgacaaaaattccaactgatagtgcctgtaaaatattcaaaagtttgactgacttaattgattttacttggtaggtttttctctttttttttttatttaattttaattttttttgtagagacagggtctcactatgttggctaagctgatctttactccgagcctcaagtagtcctcctgccttgacctcctaaaatgatgggataacaatttgagccactgcacctagccttgttttggttattttatgcttttttttattatggagaatttaaaagcagacatataattgtactaattctatgtagtgatcatctagcaccaacaacaacaacctttggccagtcccacctcatccactaataccacccttccatattatatcagtaattatttatttacatttatttattaatttaagagacagggtctcactatgtggcccaggcggtctcaaactcctaggctcaagtgatcctcctgtctcagcctcccaaaatatggggatacaggcatgaaccacctcacctggcctccttgaatattatttcaaggcagatagcagctccatttaatctggaaatatttaaggatcttttgttaataaccacactattatcacattaaaaaataacactacatgatatcaaggaattatttacaattttgttgggtgtgataatggagtatgtttatatttttctttttaaaaaaatccttgtctgacagatacatacatttatgtaattgagacttgctttataattctcctgtttaaaacaaacttttttaagtggtgggagtgaaataagaatagcactgagttggccagtggctgacgcttgtaatcccaaccctttggaggctgaggcaggtggattacctgcggtcaggagtttgagaccagcctggccaacatgggaaactactaaaaatacaaaaaattagctgggcgtggtggtgggcgcctgtaatcccagtacttgggaggctgaggcaggagaatcgcttgaacccaggaggcagaggttgcagtgagcaagatcgcgccattgtactccagcctgggtgacacagtgagacgctgtctcaaaaaaaaaaaaaaaaaaaaaaggaagtggtagtagtgtctgtttgtttcttttttggggtggccacaaccattgattaatacctcaagtggtgagttcattaaagcttgcaaaatggtgatatttatcttccttctttgttggctagagtactttttttgttgtttttttttttttttgagttgagtttcactcttgttgcccaggctggagtacagtggcgcaaactcagctcactgcaactccgcctccgaggttcaagtgattctcctgcttcagcctttccaagtagctgggattacggcatgcgccaccatgccctgctaattttgtatttttagtagagatggggtttctccatttggtcaggctggtcttgaactcccgacctcaggtgatccgcccgcctcggcctcccaagtgctgggattacaggcatgagccaccgcacccggccgtttgctagagtacttctatgagaaaagcttctcaccgagtatttgcttacctagaggtatgggaaaggtaggataaatgcggattatttaaagtaattattccttttgatgctcaaattgtcccatctttggccaatggaacctcaagttggcctcaagtctttttttttttttttcttgagacagtcttgctctgtccacagtctggagtgcagtggtgcgatcttggcctactgcaacctctgcctcccgggttaagcctccctgcctcagcctcctgagtagctgggattacaggcgcctgctaccacacgtgttaattttttgtatttttagtaaagtttcaccatattggccaggctggtcttgaactccgacctcaggtgatctgcccacctcagcctcccaaagtgttggaattacaagtgtgagccctgtgcctggccagcctcaagtctttttgacacaccttactagtctttgataatttcctctaataactactgtagagattgtatattccaaggagctctggggttttttttattggaaaaagtggacaccatactttggatactaggaatgctcattgatagaaggcagtctttgttctaggcctttccagtattaagagctagcaaatataggagagtgtgtatttcctccctgaaaaaaaattggccagatgtggtggctcatacctgtaatcccaatactttgggaggctgaacaggaggatcacttgagtcctggagttcgagaccagcctaggcaacatagaccacatcctaaaaaaaaaagctttgaaaattagccagtcatagtggctcaggcctatagtcccagcacttgggaagctgatgggtgtggacggcttgagcccggggagtcaaagccgcagggagctggatcacaccactgtactcctgcctgggcaacagagcaagaccctgtctcaaaaaaaaaaaaaataaggccgggcacggtggctcacgcctgtaatcccagcactttgggagactgagtgggtggatcatttgaggtcaagagttcaagatcagcctggccaacacggtgaaacccgtttcttctacaaatacaaaaattaactgggcatggtggcaggcgcctgtaatcccagcacttgggagtttgaagcaggagaattgcttggacctgggaggcagagattgcagtgagcaagatcatgccactgcactccagcctgggcaacagggtgagactccatctccaaaataaaataataataacaaatgaaaaataaattatgagttcacaccaatattttccactcaaatcaggactgcagagggtctggggtttgtatgtctgttttaatcagttttattaagatacatttacatacaataaatttacctcttttaaatgtacaaattgatgagtattgacaaatgttaaccatctccacaaaggcaatgtagaaaattttcatcaccccttaaagtccttttacattttttttgagactgcctcagtagtaaccactgctaaatttatcagagaactgcacaccggattgtattttgacagaacttccttccaacccaattgcttttaataatttttttatgaaaatttttacccaaaatgttatagaatttatttacaaagaaatttcgtaagttgtattttcctactggtgtggtattatgctaaggaaacaggtctggagtcatgaaatccttaggtgctaatttttctaacctgtaagtttctgtgctactgcagatctcagttactgtctctggtgtgggtgtgtgctgcggaagagtcagaggtaaggcactagtccatttccttccaggacattgagaaagaaggaaatgaactccagtcatcacaaatccactgttgatgattcctctggcaggtctcccctttaaatccttagggagaagcaacactgagaaaagataacttcttctttttttttttttttgagacggagccttcctctgtcgcccaggctggagtgcagtggcgcgtctgggctcactgcaagctccgcctcccgggttcacacaattcttctgcctcagcctccgagtagctgggactacaggtgcccgccacctcgcccggccaatgtttttgaattttttatagagacggggtttcatcgtgttagccaggatggtcttgatctcctgaccttgtgatcccccgcctcggcctcccaaagtgctgggattacaggcgtgagccaccacgcccggccaaagacaacttctttagttgtaatcccccatccctgagagtagaagaggcagaaggccaaaagtcgaccacacatgtttgcagctcctcatcccagcaagatttctgtgctgccctggtgtaccctgcagatgccaccttttcccagttttctactggattattggtctttctcttaatgtttgtaaaagctcataatattatgaaacttcatacaatatctgagacctgggctcaaaaacagtcatgcttcacctaacagtggaggtcactgtttgaacagcatagagtgtactcaccaaacctagatggcatagcctgctacacgcctagggtgtgtgggatagtctattcttccagggataaacctgtacagcatgctactgaacactaggcaattgtagcacaatggtaagttttgtgtatctaaatgtgtctaaacatagaaaaggtacagtaaaaacacggtattatagtttttgggaccccattttatatttggtccatgaatgactgaaatgttattatgcaacactcatggtgttttctccctagttattcttttttttttttttttttttttttttttttttgaatggagtcttgctctgtcgcccaggctggaatgcagtggcgcgatcttggctcactgcacctccacctcccaggttcaagcaattctcatgcctcagcctccccagtagcagggactcaggtatgtgccaccacaccaactaatttttgtatttttagtagagacggggtttcacctgttggacaggctggtctcaaactcccaacctcaggtgatccacctgccccatgggattcagacgtgagccactgcgcccggcccctagttattctttggatttagtttatgatttctaatgtaatttttaaatgtttcatctaattaaatgatttatctaattaaatttaacaatctttatgttttctgggttgtgagtcatacctataaaagtcctccccacttcaagattattttaaatcccctgcatattcttctagctcttctgtgactacatctatcagaattaattttttgtaaagaatgaggtaggagtccaacttttttaatgtgattctcaagtttttacaatagttgaataatccatcttttccccattgatttaagatgccatatttatcctatactaagtcctgtacatatttagaactacatctggactttccgttccattgttctacttgttcaatccatacaaatatgtttgtagagacagggtttcgccaagttgcccaggctagtcttgaactctgggctcaagcaatccttctgccttggcctcccagggtattgggattataggcgtgagcaccacacccacccctattgttgccattgttctagttgctgtgatagaggaaatgttggaggtggtgtatctgccacctctgtgtcctgtgtcatatccctgggccttccctctgaccagcagcatctgagggtctactcactttgcactgatagtg

SEQ ID NO: 5055 - DNA, 77564 bp, Homo sapiens
catctcatctacttttccttactccttctatgccagccacacttttcttcctgctcctctctaactcaagaggtcggcaaactttttaagggtcagtcagtatttactttctttcagcttttgggcaatgcagtcttcaatgccgtgactcagctctactgttgtactgcaatgccatcacggacaatacgtacatgaatgagcacggctgtattcctatccaacaagctggggacggattggactgcagcctgctgacccctgatctaactcttcagtcacacatctgcctccatcctctgcacctgctgctcccctgacatacacatggctctctccctcacctcctgcaggcttcattcaaatgtcaccctctcaggaagccctgcccaggccacactagcactgccacctgcttttgctcttaacgctcattttggttattgtctgtcacccccaccccccaccgactgaataagggattttgtctgtttttttcaccagcgaattcccagctgccttgtatatagcgacattcaagaaatattaattaattgaataaatcagtcttgttacgaaatttaggaaaagggagccatttcaaaaacaatatcccaaatgtaccctaacacaggataagggtttgcaaatctagaaagcccaggtcaccagattacatcataattagtgatgtcactgttgggaaaatctcagggtatcctctgatgtaggcctttcaggccttgaatccagtgggattgagaacttctaagagtggtgcggctcttgacaacatgtgggctccaccagcagcaatcatgggggagggcccaccaagaaggtgggcaaccaggcccccctgcagacacaggccctccagactgctctttaagggatggcccggcgaagcgggccgtgtgggtccgccatacgagttcagagcccaagaacctactgaatcaaaggcagccaaggagaggcccaagcaggaggtgaccaaagcgtggtcgtggacctgggcactggctactgtaaatgtggctttgccggcctgccaagaccacccacaagatctcaacaacggtgggcaagccctacatggagaccgccaagactggggaaatcgcaaggagacattcgtggggcaggaactcaacaacacaaacgttcatctcaagctgttaaccctctgcgacatggcatcatcgtggactgggatacagtgcaggatatctgggatatctcttccgacaagagatgaagatcgccccggaggagcatgcggtcttggtttcagaccgccactgagcccacacaccaacagagagaaatatgctgaaatgctgtttgaagccttaacacccctgcaatgcacatcgcctaccagtcgcgcctgtccatgtactcctatggaagacctccggcctggtggtggaggtgggccatggcgtgtcctacgtggtccccatctacgaggttatcctttgcccagcatcaccggaaggctggactacgcgggctctgacctgacagctacctgctgggcctgctgaacagtgcggggaacgaattcacccaggaccagatgggcatgtggaggacatcaagaagaaatgctgctttgtggccctggatcccattgaggagaagaagtccctctcagtgagcatacgatccgctacgtgctgccggatgggaaggagattcagcttgccaggaacggttcctctgctcggagatgttcttcaagccatctctcatcaagtccatcagctgggcctccacacccaaaccgtgtcctgccttaacaagtgtgacatcgccctcaacgggacctcatggggaacatcctgctctgcgggggcagcacgatgctcagtggcttcccaaccgtctgcagaaggagctaagcagcatgtgtcccaatgacaccccgcaggtaaacgtctgcctgaaagagacagtgccgtgtggaccggtggctccatcctggcctcacttcagggttccaaccattgtgggtccaccgctttgagtacgaggaacacgggcctttcttcctctaagaaggtgcttctgaacggcgacgaggatggacactgcactggcagtgcctaccctcgaagggtgagcgcactcctacacacagggggtggagccggcgcttattcctgtagcattaacacccctcatatgcccctccacagtgtgtttctctacttcctgacttcataagaaacaattcacacgtgcagcatctgccttaaaatatacatttcccaaaacaaaagcaggagtaggggaggatgaacaaaaaagggcatgcattgtatgtggattgcttaaacattcacttgttcaaaattatgctgccccttattttgtgcattccccgctttaggaactactttacggttaactctgcttggaagggggagtgcaatgaagattagagggtaaatgctgttggggcatatagcagttccctttccataaatgccaataggaagtatgctgtaacagtgcaaactcccacaagcatcagtgtccatttcatacttcatcaacaaccctgagggactggaaagagctggcaagctgtctgagccctgctttaacaggagtttcttttagttccaacagtcatttatgtctagtaccagttcttactaagccatcacagcgactggctgctgaagcctagcatattacaacaaggcatttgtatgtgccttaaagggcaactcttcagagaacaagtgctatacagattcccattttaaaaactgaagtaagactgatcttgggttatcagcagagaggttagggattaggccacagtcattctctagacacttcaagtagtagctgaccatctcccagcaggctggttctccatcagcctagaacacacacggttggagtctggggtgtgctgaggatagaggctctggttctggggctgatgatatgggtctgtgggaggctgccctatgtgggtcattctaacccactggggagcccaaagatacacagagaccctcagtagccagggaagcccttccaggcccagcgagctctctggtgttcctgcagggggagtttgtaatatgagcactttaaattgagattctttagaacagcctccaatacattctctgtcttgtctttaaagttcaaaatctgacactagttggtgcacaaaacagaggatagaacatgggctctggactctgtggtttgaacgcaattttgctaccacctaactgtgacttgagtttgtttgcttgcctgcaaaactgagataaatgcctacctcacacagctgattaaaaaacagcgaaaaatatctgaataccagtactagactcctgggggtcctcacaatagctagctagtatctttaggtttctacctcttatcagaaggccagaagtctcttactatagtccttagccacacaggtactcaaaggcaggcatctgcatttagaggagagctggcacctccaccatctccagggagaagccctccagagctctcactggttccaggcttgcctcgacagccttgaaagacctaaagtgcctgaccctggaccaggtctggtgactaagagtatctggctggcaccagcagaaagagagccacagaggggatgtgaggttcccatggttcagcacggatgactaagccttatgctggactgtcaaggaacaggagttggggacactgacctgagagagagggacatctttacctcagtttctgcccaaccgctctactgtcaacccatgatcattcactgatgcgcaagttgaagtttggttagttctaacctttggacctctttggcaggggtggtaaacccataaacctcttcttagaataatgtattaaatgcataaaataaaatgtatgattacagagaaaacctatcatacagaagtatgtctatctaccgatcccttaggggtaaataaaccccatgtcaaagatccctaaaaaaggcagggtcttaatgaagaggagggttgggaggtggttctggaggatgggcgtctccaggcctcctaggcctcaatgttcatttttaaatgaaaaatgccaactgaaggctgaacaattgtcagtctttttcaaaccactttatgaattttctcacttgatcctcacaagtatgccccagagaaaaagagaatctcctcataaaaaagtgatagttactaagtatttggaacttatcttgcacagtagttctcaagcagggggcaactttggcctgtaggggacatttaacaatgtctaagatatttgtggttgtcataacaggggtgggagtgtgtactactggcatctaggggttgagatgagggaagtcgttaaacatcttacaatgtgcagggaagcacctcccaacacccaagaaagaatgacatgaaccaaaatgacaacagtgccattgagaaactctgcttagcttgtgggcacacacaagactgaaggaaagcaaggctcagtgagattaagtgactttgtccaaactgctaagatggttggacacatggcccaaagccttgttctttcctttataaccaggagacaactgctgttcctaaatgtcctgggactgtagagccagtaagaatagtggtggagcacccactgcaggcacaggcaagggctcagggagcacagagagcacagaaacacgagaatcaaagcaggccttcagcactgccaaatgttaccaaattagctttgtcttatctccagcctgtgaatatgtacagctacctagctcctaagatgtttatttgcacccagttactaataaaacaacaaacaagaaacaacagccaaagactccccagggcttgtccaggcggtgcttctaagaatatgggagtacaataaccagcacaagaggaagaacaaatctaattttgcttctcaatttgcagtcaccttaagttaccaagcttcatcagttttacttatttttaaaaacaccccttcagctattgctatgacaaatctctcaaatgtgtatgtatatatacatgcatatatattaaatttaatttaaaatatgcagcagggctaagaaattgcaccaagctacatccataaggcatataaaaattgctcctaagttttgttttgttttgttttgtttttttgagacagagcttgttcttgtccaggctgatgtacagtggcacgatcttggctcactgcaacctccacctcccaggttcaagtgattctcctgcctcagcctcccaagtagctgggatcacaggtgccaccaccacaccgcctaattttttttctatttttagtaaaggtgagatttcaccatgttgctaggctggtctcaaacacctcagcctcccaaagtgctgggattacaggtgtgatccacgcacccggcctcagttttttcaaaagcataaatttaaaatgcactttgaccgaagaagaagtcttctgcaagttccttcttgaagtttagagcatctgagcaaagctatctgactcaaggaaccaagaaaagtgaaggttttagcttattgcagcatgaacttgctttgggacaggaccaaatttatgtactcttttctaaaacttgacagactctttcccccaaattaagcattctcactcagaggagtttcctccttttctcatacactcaattttcccccatgaatattcaatcttggctttgcctcaatttggaaggtctcctcctgcctgcttcttctaaaaaggaacaaatccaatcctgctcagatgagagaaacagtaattgatagtaatttgcattcaaacaaatatttcttgctgcttcaatacattatttaaggaaactgaatgtccaggaaaattcacacattatcaataaacacatttacttctatttccagtctatcagcatgggtccctttacagtatccaaagcaagagcactatatttcaatataagttaccatgcttatttacccatgccaagagtgattacaaagtacttgcagcctttcaatattgggcacttaattacagcaaacccagtaagtcaaaaagtagatttctccaaagcaaagtatatcttctttctcttctttttaaaactcctatgagattgtgaaaatgttcaaacatacagaaaagttgaattttacagtgaatctcctagattgattctatagttaacatcttgctatactggcaaaggcttcttaaattacattttggctatatcacttctttgaggatcaaaagcagcatttcctgttagtttatgtacgtgctgtagtttaggcatttgtttccctaaacctcatgttgaaatgtgatcaccagtgtggaagtggggcccaatgggaggtgttttggtcacaggggcagatcctacgtgaatcgctgtgccatcctcgtggtaatgagtgagttttcactctattagttcctttgaaagctggttttgttatagagacacaaatgggctaagatacacagtaagaaaggtctggttctgatattaaaacatggaagaatttttaatcagaatgaagtgggcgttttctagactcaccatgaaataaaatattctcattttgagacagttttttttggtgagggcgtggagaattgaataaaggaagtcagtaaagtaccatgacgaaaaataaatgaagtggcctagacactaacaaaaattctgagttaaagaaacagtatttggagaacagagaataattcacaaccatgcatgccatcaatgcacactgatcactcacaccaactgtgcatgatactgtttagaaattctaatctgtctagctctaacattgctaactctctagcagaaaatacacaggcagtaaaacagtcccttagacattgtaattataggaggctcagcccagttataactgaaagcacatgacctggtagatgttacaaaataatagctgtcagcaaaggagggcttataatttcaaaggatacttttattctgctttagtttaaggtgacaagaagctatttaagtgattacatttgaccaaatgtgcactaatagccattgtaatcttctccgccaacaaaataagacaatttagaaacattgtttacttgtcttcacactttggaggtagaaatcatgaaacattaatctcatgattaccatattatgctctcaaacagcccaagtgaaagaacaatcattctcacaaaatggtgccataaggttaaagcttaatgtcttgctaatgatcaagatgtatacacaacataaaataaatagattgcttgttgtctgctgaagttcttggcaatgctaaggtaagttatcattttactctttcagttctcaatagccagccctcaaagagcaaggggtggtaggacaacaggaatgagtggaatggtcttctctgtcggatccctcctaactgcagtcactcagtctagcaggctcagctccactgggttcttctgttgatctttggtggtataaaaagctcagcatctaaaagcaagaaggaagggaaattgtgacagacatactcttgttggagggcgctgaggcagtaactctaactaaacaaactaggcaggtggagtttgcagcaataagaccatcagagccagagttcatggtctgctacccctgcaacctccaggtcagagcaaacacaacctggaggccctgccctgaaggagggactgcatttcaacctcaggcatgctcacccagtgattcaaagtggaagaatgtctgtatttcaaactggtgggaggggtggtggcagcagtcacatggctgtatacatttataaaactcatcaaattgtacacctgaaatctctgcatttcactatatgtaaagtctagccaatttttaaggaatagcaaaatgtgatagcacatattcagtaagtgaagttaatggacggaactactttatgatgaaacttcgacaaacatgttgatcaataaagatgcccctgcttaaaaaaagtgaatggagagagagggttaggaaaagattctgtcattgtaacctaaaactccaggcactctttcacttagatttgttaagtttcttttctaaccaggaatcatatactgaagcagagataggagaaaatatgtatatataaggattttctttttcagcattatttatgtaaacttccagcagtaaatctgtacatatgagccatgcaggcatgaaaaattacagttgtccttgaatgtagggttatgggtgcggacccccctgcacagtcaaaaatctgcatatacttttttttttctttttttgagacagggtctcattttgttgcccaggttggagtgcagtgcacgatcatgactcactgcagcctcgaccccctgggttcaagcgattctcctgcctcagctcccaagtagctgggactacaagtgtacaccaccatacctggctaatttctgtagagaaaggtttcaccatgctgcccaggctactctcaaaactcctggtctcgttccacccacctagcctcccaaagtgctgggattacaggtgtgagccaccacacctggccccatgtttaactctgaatctccaaaactcaagtaccaatagcttactgttgttcggcagtgtattggcagataaaaagtcagttaacaaatgttttgtatgttatatgtattatatactacattcctacataaagtaagctagagaaaagaaaatattaagaaaatcataaagaaaacaatatttactttcattaaatggaagtggatcatcataaaggtcttcatctttgtcatctccacgttgagaggctgaagtagaggaggaagtggaggggttggtcttgctgtctcaggggtggtagagagaaacaggtaggggaggttaaagaggaggcaagagaggtgggcacactcagtgtcactactttacagaaatacaccataatttctgatgtttttgctttttcatttctctaaggtaccatccttccacagtttcttttagtttcagtgcccataacatagaatcatccatgttgtaaagaagccaaaggcagtcttgaataattggaacctttggaacaaatgtcaatttattttcggcactgcttcttttatgtaatcttcctcattgtctggcgctggtttggaagtactcattccatcaagtcatcttctgttaattcctctggtgtgatgtctatcacctcttgaatttcccaagattcctatcttgaaatccttcatgcaccattttttttttttttttttttttttttgccagatccacaatctttttcatgatttccttgattggctgtcgtaaagcctgtgaagcatgcacatctggacacagttttctctagcaggaatttattgtcctgggcttgatggcttcacagctttttctataacaatgatggcatcattgatggtgtaattctttcagactttctgttctgtcaaggttcttttccatacatttgacaatcctttctatagagtactgtttgtacgagccttaaaggtccttatgacaccctgatctagaggctgaattagagatgtgtgttgggggcaagtagatcacttcaatgtcttcggtgttgaactcatggagtttggggtggcccgggcattctccagtatcaaaagaactttaaaaggcagtccccttactggcaagatactcttaacttcagggacaaatcgacaatggaaccaatccagaaaaagtgttctccttgtccagccttcttgttgtatggtacaaccaaaagcctggcagctggtgttaatcttttcccttcaggctcgggggttagcagctttacagataagggcagtcctgatcataaacctgactgctttgctgctgcctcctggatggcaggagctgcttttcctattatccagacatttacaaaccaaacctctttctaaaattatcaaaccatcctttgctggcattaaattctccagctttatccttcatctttttgctttaagttctcatacaatgactgtgctttttctcaaatcatatagttgtataggtatgcctttctcatagcaatcctgcacccacataaaagctgcatcttaatacaacataaaaaggtattttgcaaaaagtacaaggttttcatgcctgctggcataatgcagtgacagcttcataaatttccttttcttttataatagtccttgcactgggttcattatcttgaagtggtgggcaactacagctgcagacctcaatctatagtacatatcgagcagtcaactttttcttgtaatgttatgacttttctctgcttcctgggagcaacacttgtggacttcctataggtctcatggtgttatttaaggtttacgatattacattaaacgtgataaaaatacacgacaatgcaagagatcacttttcgctgccatatgcaattaatggagactctatgtgctgctcatgtggagatggttagcggcacatggcattttaagcagatattggtaaacttgagctcactcaccacaatagcaacaggaggtagctacaaaattattacagtagtgagtacatactacagttaattttatgcagttatgatttaatactacatctttatgtttgttacatttctctccactaaatggtgccataaagatataagaatatcaatactgaaaaaagctacttaaataaattcactatcaacaaggtatttcataaattccaattaaagttggaatagactttatcttaaaaaaactagttacaggccgggcgcggtggctcacgcttgtaatccagcactttgggaggccgaggcgggtggatcacgaggtcaggagatcgagaccatcctggtaacacggtgaaaccccgtctctactaaaaatacaaaaaaattagccgggcgtgatggcggcgcctgtagtcccagctactcaggagggtgaggcaggagaatggcgtgaacccgggagcggagcttgcagtgagccgagattgcgccactgcactcccgcctgggccacagagcaaactctgtctgaaaaaaaaaaaaaaaaaaaaaaaaaaaaaaaaaaactagttacaaaaatatgtgctctatctcattttttaaaattaggcataactacaactatatttgattctagactaacttgaaataaacacaaagtacagacttttgggcaagaaagtaattattctgacaaatatatgacagcaggacatgacatatttcacatttccatatgtggatttcacagcacacaaaaaggccatttttataaaaataacttgagggcttttcaatttttctaaggacctctctaatcctttgatagtcaaaatcatttgaagcacttattttgtcatcaattgcaacaagtcaacccagctgtgattcaagtacttttccaatatcattttaatctattttatgtaatactaatttttgcaagacttgcaattgatctgcatgatattgtattgcatcaaagcaggaaacatcagaaatgacccatcaagtcattgatttcacttgtggggatgtgccaatatacttaatattgttagctggggaggggcagctgagtaatatttgagtggcactaattttgtgattattcatcagtggcaatttttgaattataggaacttaccttttcctatacatccttgaaacacaagggtaatgataataaacactcagataatgaggggctctcaaatattacagagtgttttaaggctcagctggaaaacaagaaagtgctctttgaagtgggaaagccatctagaatccctggggaatgatgggactgacctaacctgaaggtcagcatcaggccagcaacgaggacacaggaggcagaaatcacaactggattggactacagcacaaaataaacaatgaccaaaggcctcaggtctaatgtaagttcctagcatctgggaaataagtgggctgggcacaggggagacgcctgtaatcccagcactttgggaggccgaggcaggaggatcacttgagaccaggggctgagaccagcctgggcaacatattaagaccccatctgtttttttttctaaatgaaaaacttaagaaaaaaaaaggaataagtggatatgtcgaaactgataccaaaagaaccttgcattctctagacagaagaggagctaggaatacagtagttacagtctggatgtatgagttagctgggatggaaggtagctgttcttcctggtagcaacataagctgttaaagtcaaactaatttgaatccccacaggctacttcaaatgtcatcaaaatgctattacagtgtagcactcggtgaaaaaaaatttcagaaagttgcttgtcacatgctagaaatgcaaataatagcagtaaaactgccaattattttagaaactatcattcacttttcaaagctaagatgcttcattatccaactataagtaagggcaaatactgaaagtcccaagctgactcatcaaatgtttctaccaactttcaaaagaaagcgcttagggtttttaatttttagggatataagtaatctaatgagaatcatctcccctcaacaaataaaacacttcatgcataactaaacaggaaatatgataaaatgctaatattctttggatttgccttcaaattatattgtcaatcctaaacataaaaaaaggtcccactcataagcaaggtttatgaaaatgcccccaagatgcaaagcataacgccaatagccagtaatgatgcttcagaagaatcttttgatgtatatgtaaatgtagacatttagactgaaactggaactgtggtgtgcctttatgaacaagcatatgccacataaatattttaaaaattacacatacaatggtcatgctggattttcctgcaccaggtctcccaccgtagaagcatgaaactgatcatactaaagatgcggtcttagaattgaggaagaattgtagcaattttttgtagtgaaaaattgtatccaatctctccttatactgctgatcttctcaatcttacagaaagatagtccttctgcttagtattgtaatattaaatgagaaaaaatactaacaagaacaggaaccgaagtcttctgttgctgataagatgccatgatactatttgcagtaaattgggacctagaacctgaggagaaaatagactgtatcagcaaagattatctaatactctcaagacttccaataccaaaggccaaatccctaccagcagaaaacagcctgtcatttcactggtatggtgtgaaacacagtaattctctttcccaatgtgattttaatttgccagttctccagctgcaactcagacttctaattctcctttctcccagaacaaggtaaagatgggggtggaggaaaagaaaagaaacgaaactctacagtgatatatcttggccttttctaaatggcaaaccactccctgaggaaagggaaaagagtaaaagaggctacaaatacgtagagtataattatacgcaaagagttatgggaaacaaacatttttaggttgaaataaatacaaacattgcatactatggagcagaatggaaactgtgcacatgtgctccaggtaaaacacaagactcgcaggaatttcaagcctgcagcgagcctctgggcacacccctggttagtgcagaccctggtggcacactctcaagagcaatgccatgagaagtcactcacggtatcctgcacatacccaaccatacttcaccaatcaaaaccacaatcataaaattgatgtcttagaacttaatgtggaggcatggtggcttacacctgtaatctcagcactttgggaggccaaggcaggaggatacttgaggccaggagttcaagaccagcttgggcaacacagcaagactccctctccccattctaggaaaaaattttaaaattagctgggcatggtggtgtgcacctgtggtcccaattatcaggagactgcggtgggaggactgctttagcccaggcattcgaggctgcaccaagccagattgatcatactgtcactgcactctagcctgggtgacagagcaagaaaaaaataaaataaatagaccttaatgtgaatatgtgatcagaagagaagatcactcatgggagtggtatttaaattattatcttcaagccgggcacggtggctgatgcctatagtcccagcactttggaaggtgaggtgggcagaccacttgagcccaggagttgttcaagaccagcggggacaacttgtgacaccctgtctctacagaaaatttgaaaattaaccaggtgttgtggcatgcgcctgagtcccagctactcaagaggctgaggtgggaggatcacctgagcccggggcggtggatgtgcagtgagcggtgatcactgcactccagcctgagcaacagagtgagaccctgtctcaaaaacaaaaacaattatcttcaaaagtactacagttttgaagatgatgatcacatttctttaagaaatacctattataataaattcaagaagttctggggccctgattcctagttgctttatttcaacggtttgtaaagtgcttttacacacaccctcttatttaaccttcaaagcatctattgaagcacacagagaagtcttatgcccatttctaaatgaggaaatcaagacatgaaagcgtatgtgtttctaaacactgagctgatttgtaatctctcagctccaacccaccctctatccactgcttgtggtgctggggctgggcacctgaaagatattcttccttgctgctgcttcccatcatgtcctgcctacagtgaacaccagagggggagtacaaagctggaggatgacaaaagatttctagatttcttccgtgattggctggcttttttttttttttttttaaacgagattcgctcttgctgcccaggttggagtacaatggcacgatcttggctcatcacaactctgtctcccaggttcaagcgattctcttgcctcagcctcctgagtagctgggattacagcatgcgccaccatgcccgggtaattttgtatttttagtagagacggggcttctccatgtggccacattagtcatgaactcctgacttcaggtgatccgcctgccttggcctcccaaatgctgggattacaggcgtgagccaccaccacacctggcccgaccggctggcttttccccagcagcagctgttccttccagtttccatttacttctgtacgcttggaaccagctccctcgaaatgccaggattagctggctggcaccctcctctcagaggttcaagagccagctctacgggccccacttccaggcttctaaattctaataatccccaacaactcctcctgttccctcgctagagggtaaagctgcttcctacagttactatctcaatgtccttcctctgtatttccttttgccttgtttagtcctctaatacttatttaacaaatccatatattaaattctgtgaaaaataatagataggcttttgttttcctttctagatcttgactgatacaccagccttttgaatccaaataaaaactcttaacaatagacttgaagtataagagagtgaacagaggtataataataaacagatgacaatatactagaattctgcgatacaaagctgattcagccttaacacaacccgcaaagtccatcataacaacatagaagtgacaagtcaaatttttcataaaaaaaaggaaaagcaattacctggggtccctttaaagcctgatcccatccctgagttctgaaggaaagtgagaggccgtctctgaccccatcttcccccatctctccccactccaacctcttgaaggccaggagcaatcatgtgactttcccattttctccatgacagctacttcatccgaaaggaaaatgacagtccatttaacctatgccaaggtatactagtcactctacaggcaatatcaaatcttactgacagcttacacataaatctaagataatttaactatggcatctttgttttaagaacaggaaaactttttgacttggagattgtgtgaatacaataacccatgaaatgatgaaaaaaatgcacaccgtctctgagaaaacttaccggggtagctgaattctgcggtaagtaagagtccaaatttctggaagtgacctttccatcaactgcagcgtatcttcaaggccttctgtaattcccttccttgttcatcaaactcaaagagaaagagtacctttaaatatggtatacttcatctagagagaagaaatttgaaagagtggtaagttatattcccagcccattgacagaatcatacatagcttctatccaaagccaaaaatttctatgatcccactgaggtcctttctcccacattatcttttttcttcccaaatgctggaataattaaacacatgactacaaaaagaaaatcaagcacgctggggggcctacgcagaaagcagtgtcccacaatctttatcctggcctaagcatctctcccagttcagttagggggatgccaaatggaggaagcttctcagttaccagctaagaagggctgcttcaggaatgtgtgcagacatgacccttccgctaaaagttctcatctttcctcaaattgggaaaatggtagcttaatcacctactgaacctgcctgtctgtactgcctattcactattgtttgtggtcaggaatcatcatcaggactggaatatacctttcaggttttcagtgttctgcaccacttcactcagtgcctccaggagggcaggtcctccagcggactgccttctttgaggctgtgcttcttccgctccgcttttcggcattcttggatgatctcctgttagaaattacacagatatttttaagcctcctgagtagctggactacaggcatgtgctaccttgcctggctactttcttgcagttgctgatgaccccaccaacttcacagatctccattttaaattcctaaagcaaaattcagtttgaatatataatctgcattgctttacacatcccaagcaagactataaactcttataactcatatctccttatagtttttggtaacatctactgcacctaccatatgagtgctgaataaatatttctgacaattactatatttggtaaaagtgttatgacttattttacatttatggtctcttccaatcctattttgaattgaagaagcttatcttttcattttttcagtgcctataatttagtcacaactttgttcaaaaaataaaatcagatgttaatataaactgagcattcaggggaggaactgctcgtggggaatgggaaaacacacaagccacaaggctgaggaagaaaaccttccaatgccagtttaatgtctcagatatgctgggaaagtgtctgaacaacttccacacagcgctgaagatattctccccactcccactacaccgtcccagtagaaaaccaatctatttgcttccacttccctatatgcccaggatatagtcaatgtgctgaatcaatgtgatacgtacgctgatatctggagttactatgggagtatttgccactcatctcactgccactcacgacactgctagttcagagaagaggtctgactcttgcccgtggggtacctcatcatctagaaaagaagaaccgaagccgatgaaaacactgcctgctaatgtgtgggtttactttcagggcggtaaatgaataactagagtcaactggtgcatatcaaaggatggatgaaaatgattgcaaagttgatctaaaatgaatgagataatattaaatacagtaattactaatgtaaatcagtagtttcctgacttttttctggaaatgaggaaactcattttgttagacacggaagtggtcagctgctctggtgaatgggggtaggtgggaatgtctggcagagctctccccattcatgcttggtcctgccttcaccaacacacaaacacagacacagagggccctgaaggggctccacagaagcctcaacttgcccatggcacagtaatcagattgcaggcggatcaccaagcaatctagacaatgttggcgttacccaaccccactgcccccgcacgtcgatggccttcacgcagatactcacccgacctgcctgctgggcttgctccttgagctctcgaactaccaataaacgtttcttgtgggactgaatgtggctgtctgagagtccagaaatgccatataatttttctgggctggagatcagaatggaaaatagtttgagcatgaggtttaagcaaagagaaaaaactaaaggcgggggcagtgaaggagggttaaaattcagcaaaaagaaagaggttactaggttttccaagcgactctttttccttaataagcattaacaaattagagactgagattccagatcttagagttctcaacattatcccagaatatgcgctaccactgaacttgtaaaatcacctgaacgaagactgatacctaaagcaagggaggattggcaaaacaaacaaacaaacaaaacaaacaaacaaaaaagggggggtaggggaggggagctcagttaacaaaaataagaagaaaattacctaaagtttctggctaaacatccatcaaaatgcccatggatgtggaaaaaatgtatctaataaaattgtccaatggaaaaatacacaagagaaaaataacactagtagaatacattttaaaaagcaaaatactactatccaaggatgcattttattaataggttttgggcctatgtagatgattatcggcatttatctaagaaaggttctcattagtggtgaaaatctaagtaagagctggtagattattatagatgaggaatgatgttttcagtacccagttagaggtacctaaagtgatgacataaaaagtaccccagcaacgttttaattaggatggaggaagggggtgcagacaagtaagaatgtgcatacatgtaaatgtcagaaaggccagacgttacttacagggtagatggcataaaaatgcagaacttaaaatcaaccactccctaaggtttctataagtcaaactgagtccttctccactttgcttttaagaggtcacagtgaccatctgagtattctagaactggaatattcatatgttctctaagaaccacaaacttcatttgaaaaggtaacttttaaaaaaactttgaaacgttgaaacctacataaaagttgtaagagttcaatgaacacacatataccttcactttgatttaccaattactaacattttgacatttttttgcttcctgtttctctgctgcatacacacattcattaatacttttgtggaaccttttaagagtaaggcagagatatgtccttcattcctaaatatttcagcatttatctcttgagaataataggatattatcttattaaccacaacatgattattaaatgccagaaatttatcagtgttatattattatctaataagttcatattcaagtttactatttccaaatacaaagattcttaatcatatttgatcacagtttctaacatttaaatattttgttaccatttaatagttcagcatatttaaaaattctatgagaattaaatattatatccaggtggtaattttgattgagtctacatgacatattattagaaaacacagtaaataggaggagactctctcatctctctctcctcaccttcttccaaagaggaattctatctaaaatggaaccctcaccttctaaaatggaaggctttacgttggttctataatatccagtctgttatatttgtatacctagaaggaaaaacacaataattttaggaggaaaacttctagtcactggagagttaagatacttagaaagacatggattactttcagggtaatcagaatattttcctgaaaaacaggcctcctacaaggcagccaaggaaattcaatcatttcagtaaaagacagtaatatttcaaattattatcaagaatgataaaaatgatttaaaaacaccgcttttccttaagccaggaacctgacctatttctacttatttcatgaacccagaagacaagagattccaactgacctggaatcccttgcttgctctctctgcttagcaccaacatccagaggatttacaagattcttaccagcctcaaagcttcttcccaggcagctcttctaacagcaagagcacagcttcttcataatcctgacaagggaacaggaagaagacaaaagtgaagagagcatgtcagatgtcatcacagccaactacaaaactaaccacagacctgctctatctccctggccaggggagaactcctagttctcaacatcatgcctatcctagagtcatgactccataaatattgatacaaaagacaaggaaggggtgtaaatcctgaaaataatacaaaacacaaggtaagcatcatctctctgcacgcctggacatcaaaaccaccagaaactctgttagacatgcccatctccccagctttactaccaagtttgatttagcaggtttagggggctccagaattgttaacaagaccaccctttgaaaaaatagtagactagaatagcaatttctaaatttttttttgttcttttttttttttttttctcagacagggtctcactctgtccccaggctgggatgcagtggcataatcacagctcacggcagccttgactgcctggccccagtgatcctcctgcctcggtctcccatgtagctgggactacaggaatatgccaccacaccagctaattaaaaaaatgtttttagacagggtctcactatgttgtccaggttggtcttgactcctagcctcaagcaatcctcctgtctcaatctgccaagcagctgggtttacaggcgttgctcatttcaaaattgatttaactggctttctgttgttgagctgcaggagttccttaatattctggatattaaacctttatcagatataggatttgcaaatatcttcttccattcttatgctgtcttttcacattcttgacaatgtccttgatacacaaaagttcttaatttttataaatccaatttatcaatttattgattgtgtttttggtattaattctaaccatccattgcaaatccaaagtcatgaagatttagccctgttttcttctaagagttttatagtttcgtttggttttgagacagggtcttgttctgttgtccaggctgaagtgcagtggcgtgaactcactcactgcagtctcaaacttacaggctcaggaaatcctgccaccttggcctcccaagaattgggactacaggtgcacaccgccatgcctggctaattgtgtttttattttttgtagaacaaggtctttctatgttacccaggctggtctcaaacccctgggctcaagtgattgtccccctcagcttctcaaagtgctggaatcacaggcatgaacctctgtgcccagccttcaagattttacagttttagctcttaaatttttgttgatccactttgagtggccagcagtttttgaaactcggaaaatactgaatcttttggaaaaaaaaaaaaaagaataaacatgaaaggtcttaaaaaatttccttaaacaatcattgatcacttaaagcaaaagcaataacaaagtatttggagtgaatactcttgtaaggtttttacactatatatgaagtagtatacgattatctgagatatggtcagttaatgatatttattataaatcctacagcaaccactaaaatactgaatgaagaagtatagctaataagccaacagtggaggtaaaatggaattatgaaaaatactaatccaaaggaaagcaaaaaaagaaaaaaacaagaaacaaaggatcaatgaaacaaacaaaagcaaacagcaagactgtaggtttaaatctaactatattggtaatcacattcaatgcaatgtctaaaccctccaattaaaagacagagattgtcaaattagatttaaaaaaaaaaaaaaccaataatgctatcaacaaggaacgcactttcaaaataaagactacattcagctagataaaagtaaaaggatagaaaaagatatgcaatgaaaagactaaccaagagaaagctggagaattatattaataacattaaagtcaaattcagaattaggaatagtaacagagaaagaagatatcaaaatgaatacatctataacatactcataaacatgtatgcacctataacagagttcaaaatacattaagcaaacactggtagaatcaaaggagaaatagacaaatactgggaacttcaacactttcccagtcattgatagagcaagtagtgaggaaatcaataaggatataaaagctagaacagcatgatcaacctaatctaactgacatttatagaacactccatccaaaatagtagctttcatattattttcaaatacacacacaacattctgtaaaacagaccatatataaattaaaataaattataaatttaaattaataaaatgtatgttctctaatcacaacaaattaaagtagaaattaataacaaaaagatggctggcaaatctccaatatctgcaagtaaacatacttctaaataagccaaggttcaataaagaaatcacaagggaaattaggaaataaaacaaaacatttcaaaatttgtataacataactaaaacggtgcttgaggaaaattatgcattatatgcttaaactataaagtaaggaatcatctcaaatcaatagctttaagccataccttggtcaggcacagtggcttacacatggaatcccagcactttgggaggcagaggtgagggatcacttgaggccaggagtttcagaccagcgtgggcaactagtaacaccccatcttacaaaaaaaattaaaaattagccaggcatggtggcatgcacctgtaatcccaactacttggaggctgaggggggaggacagcttgaatgtaggagtttgagactgcagtgaaccatgtcgtgccactgcactccagcctgagcaagagtgggaccctgtttctttaaaaaaacaacacaacaaaagaaaaaaataagaaaaaaataaaagtaagccatcaccttaagaaactagaaaataaagagcaaataaaataataaaataataaaaaaagaatgatatagaatacagaaaatcatagagaaaaacaatgaaacagttcattctttaataagatcaataaaattgataaactctggccagaataatcagaaaaaagaagacacatcaatatctagaatgaaagacaggaatcaccatagaccctacggacagtaaaataagagaatactataaacacttcataccaataatctgacaatttagatgaaatgaacaaattacttgaaagacataaactaccaatgctcttccagaagacacagataaacttgaataggttaatgtctactaaagtaactgaactaatgtgaaaaactttcattaaagaaaactcctggccgagatggccttactggtatattctacaaacatttaaagaaaaaaatatctcccaagagctgggagaaagagctgagctgtcaggtttggagtagctgatcaaagcaacaagtcaaaaatgaattaagccttcaggcattgcattgtataagcaagaggctaaaaccagggaaagcaccaactctctctgttccattttttcccaggaacaactcactagtcaagagtcagctggatccacacagacatgagggttggttcacgttgaaggagcttggaaaaaaaggctttagcagtttgatggatcttgggggtatgggtgaaaggaagggggctaagggtggaaaagtactgggtagtgagtcacagtggaaaaaaatgcaaggtttttccactccttcttgcataaacaggccttggcagaggtgcctgaagaagacttggcccatggcctcagatagagagacctaagaatgaaagtgccaggactctcaatgcaatactgttacaagagcatgactaacagggggccctgagtccttgactgcaactccctttgaaactgtaatgcattggcagtacgccaagtctggtgtagggagggcagcttttccccagtggcctcctaggtaaagtctgtaattgtttatggtcaggtctgaaacatcacacatagtttttaaccataagctagactctcataccaattctacatgaaatcctccagaaaacagagtgtaaaggacaccacccctcatttttgtcacccctcaatgacagcagcattatcctgaacccaaaacatggcaaagacacgaaaaaactacaatatccctcatgaacacaaacacaaaatcctcaagaaaattttagtagatctaatctgccacaagagaaaaagggtaataaatcataataccaagtggggttgaacccagagatgcaaggttggtttaacagtagaaaatcaacacctagtcccccatatcactcgtctaaaaacaaaacccttcatagttgaaaatgcattgacaaaatttaacacccattcatgatacaaactctcagaacaaggaacagaagggaattcctcaaaccaagagggcaggaattggcaaatttttcctgtaaaagattagacagtaaattaggccttatgggccaaactatctgtgtcacaactctaactctgctgctgtagtgttaagcagccatacacaagatgtaaactaatgagcatggctatgctccaataaagctttatttcaaaaacaggtggcatgctggatttgtcacaggttgtagtttgccaactctgcaatagaagcattaaaaaaaaaaaaaaaagcaaatatcaggccaggcacggaggctcatgcctgtatcccagcactttgggaggctgagacaggcgaattgcttgaatccaacagttcaagaccacctgggcaacatggcaaaaccccatccctacaaaaaatacaaaaattagccaggcatggggcatgttcctgcagtcccagctactcaggaggctgaggtgggaggatcgcttgagcctggaggtcaaggttgtagtgagctgagatcacaccactgcactccagcctgggtgacagacaagactctgtctcaaaaataaaataatatagaataaaattttaaaaaagcaaacatgaacttaatgctaaaagacaagtgaattttctccaatatcaggaaaaaggcaaggatgttcctcttaacacttctattcaacaccacactggaagccctagaaaatgcaatacagatagaaaaagtattgattgtaagaaagacataaaactatatttatagaaaccatgtttgttgattagaaaatcctagagaatacacccaagagcttctagaactaataaatgagtttagcaagttgcaggatacaaggtcaattatacagcctccctgcaaaacacttcagctatatttctaatactagtaataaaacattagaaaatgaaattaaaaactagtcaagccttgagatgacttagccctggccaataccttaattgcagccttgtaaaggaccctgagccagaggccccagtaagcccagccaagattcttggcccattgaaaaagtgggataatagggtctgttgttttagctgccagcttttaaggtaagttgttacgtagcaatagataatacatctagtgtcacataatacacccagtgttggtgagtataggagtcactgaagcactctcacatatcactgagggaatgcaaaatgatacggccactgcagattagttctgcagcttcctaaaaagttaaactccacttaccacgggatgtggcattcctactcctgtccccataaagacctgcactagaagttcatggctgcgttattcataataaccccaaactgaaaacaatccaaatgtacatcaatggtaaatcaacaaattctgacatatacatataatgggatactattcagcaatacaaagaataaactacaacatggatgcatctccaatgcactatgtgagtgaaaggagccagattaaaagactacataccatatggttctgtttatatgaaattctagataatgtgaaactttacgactgatcagtttgccaaaggctggcagtggagggagaaggctgactgcaaaaggggaatagggaacttttgggggtgttagaaatgttctagatcatgagtgcaatggtggttacacgctacaaacatatgtccaaatgtactgaattcttcatctaaaattggtgaattagctttttatatgtaaattatacaactgtacaacacataattttattgtatgtaaattacacaaataattttatgcattaatcttcctttacaaagaaaaaaagataatgacatcttatccattaattaaccctcgatgtggtatatctttccaacccaacctatctacccttttaggtatgttcattcactggtattttcaattcaatcacccaacaaatattctctccaggatctaattaataaaattttagttatcgtctttcacttactgttattacacaagagacaattaaatattttaaagcacaattaagttacataaatgtgctatcagtaacaactgtaaaaaacactctccatcaaaggtcaaaactctacaaggcaataatccctggtgtcaactgtgcacctgtgtatgttagtctgtggccagtgttactgcagttttattattttcataataaatcctataatataccaaatgctcatatgggtacttatccttataatctgctgtacctccaggtccctgagtaaaagagacatttccaatagggagaatgagagtaaaagccaagagtatgtagccttcatgatcctgttttataatggtcctttctcattgtttctactttggcaaactcaattttaaaagcacagctaccttgagatgtaattaagtactttctaccaaggtcaaaccagtggtatttaaagtagagcaccttcatattctacctcaccaaacttagagatgtactaaatttagattccaagtcaagccagcaagataagacctctggggcaaacactatctctggacttaacattatgcacagttcctttaactttcatgatcactaagatacaattgagaagacctttcttctgactggggggtttagaagggaggaattgagtttacctgggcacactcttccaaaacctggccgcatcaatgtgcttcctctgctcaaccagctttcctgtagagacaataagcagcgttgactacaaagttaaacagatactttagctcaagtgcttctttaatatgtctttatttgtatgaaactatgtactttctgaatttctgtgagggaataggtatatacaccacagagcctatcttaaatggcagctagaatctaaatttagcacaggaattgaaaatcatatacagcaaaattagccttgaaagatgcttccaaagcatgtatatgggaaaatgacctggtatcttcactaaaccacttcgtcccttaacagtaagagaccactatttctttggttgagcactaatggaggtagctgacttatgtttgagtcatgcagtgtctttagatcctagaatcactctagcccaattgagataaaccacaatgagaggcacagagaacccaaggctttcgaaggagcggtagattccggtctctcattgcatgctcactccagtgcatatatcactaaaaaaagtagtaaaatcacctccactatttaaatagttacctttcttttgctctcttgtgtaaactgctacgttaaatgtacacacagagtgactccagtgtgtaacatttctcaaacatctttgacactgccctccccacctacttttgctaaacatctgagaaaaactagaaatactccctcatagacatgggaaatagcaagctaagagctgtaaagaatagaagagatccaagaacagagaagaaggtataaacaaccaatatcataaatttctaaagcagaaaggaacaatggagaccgacgaataactaaaaggcctgaaataaggaattctcgacatttgtaaaaagaggccagcaggaaacggagggatttgggaaaggctaataaccagaaaaagaaaagtgataatcccataactggtataatcccaagaaaaaaagaatactgcaaatgacaaagaaggactggtacataatttaacaaaatttaacaggatagagtttggaatttttttaggactgctttttattttttctttgagatctcaacaatatttacaagttagggaaaaaaatataccagtcattgctttcttcaagcactgctgagatgaccagagcttctgctcatctcttttcataggtgtccttacctttcctccactctggtactagagcccctggtaccagcctcgcctctggttcgggcaaccttgtccctgacgcagctaaactgcctttgctttcagaatgcttcgacatttggcctttattttccccacctcattcctggctattccaacaacctactgtctataacagaatggaccatccaaaaattcatctttaccttcttacagggcacagcccatccagctacatggcgtgccgagatggaatagaaggtgatagtttaacttccatccaggtcatttccaacttaaaggaaatgttttaccatgattctaacttctccccactctccttccttccccacagctgtggaataacccagctacaaccatctgcctaaaaggttgcagagccacacaacggaagggcctaaaatccctatgggagagagaaataaacttctttccatattgggccactgcattctgggatcttgctgtagtagcttatcctttaaagcattctaaattaatttttatcagtgagaacagactgtctcagagtattctgccctaaatttatttgcaaaattaccaaacaaaagaaataattttttaaaacctttgtagatgtaaacatataaatgattgtacttacctgccagagtttgccgaggcccaccagctggtctttggtaaagttaagctgggctgccacacagagggctgcttccagttgccacatgtcagaaaggctgagagagctttctcgtgggcaccgcaacggcaaacatgagccccgctggctcatacatgtgctcctgcatcaggtgctccccataagcatgctgatatcctgtgacaagaggagatttaggactgaggaggaaatatgacaatcattttctaaagctccagtgtagctgccttagttcctatacttggaactcccttgaaagaattactgggaaaatcttacagttgatcagttagtacagtcattttttcattcaaaaccttactaggatgtgccatttattcactcaacaaataattactcttaactacatatgcaccattctggcagtatggatactacagcaaggcaaaaaataaaaccaaacaaatgaaaaaccatatagaaccaccaccaagttgctgctcttatagtaacagaggatggacttagggacaaaatatgtctatagcataatggcaaacgtgagtaaagggacagaggacagtctccttgcagctctagggagtgtgagctctaatggctgtcaggagaataaaccacgtgatgagatagggggcacaggcagagggcacagaaggcaccatggccatgcagcaggaatgtgtatagcaggtctgggagtaacaggacggccagtgtgactagagcagagagagtgtggaagagaacagaaaacagggcaaagaggtagccactggccaaatcctcgattctccaggctggatgttagccagaattcagagaggaatacaacatggagtccctgcccttaaggagcccacagcctggtggagcgacaaaccagctaatcagcagtttgacaaatgcaatcaccaaggcgagggcaggctgcctgggggctcagtgtttggcgcctggtccaggaatggcattcaggagtaacccaagggtctgatggacaaatggggctaaaggaaggctggtgggtagagaaatgacagaggaatcaccgatgtgacatctgtagaactacctacaagtaactgggaatgtggacagtggcagaagcggtgctaaagaagctggcaggggcttgatcaaagaaagatgtgtatattgtctgaggacaactgaaaatggtgatgctggtggcatggtagagtggtggttaatggcatgggcagggtgtcaggcagcctgggctctgtatcccaggtccagcactttgtagctctggatcctcaggaagttgcttcctcatctacaaattgtgtacagcaccctatgaggctgttaagaggatcaataacacatttaacttagaagcaaagtgtgtggtatataaaaaaagctaaagggatgcttttcaagcaaacaaaaatttccctttatgctgaaatatatgggaaagatctgtacttgtaggataatcagacttacagcagtaaggttgggctagaggaggggtgggaaagaagcaggaaccccacgaggaaggtgctgtggtattccagatgaggaatcagagaacaggtcaggacattctcccagataagaagttcaaattgaggctaattagttttaagataaattttgaagcaaggatggtgttatgaacttaggatcctcactcctttcctactaaagcaaaaagcaaaacaggagagcctcattttcacataccacatacctggtactgttgtgagcttggtgaatatacttcagagcttcgttatacaagtttttatcttttatcaagtttaagcattctgggaagactcaggtcctgcaggaaaaagattcacacaaagacaggcttaagacatgggaagcatatggacttcatttataccaatggtcaccaaacaaaataaatgaggaactttttaagacctaataatcagagaatctgaagaatgggatcctggaatttgaatttttaatgagcaccactcagattctgaggcaagagcagcactgattgggatcagcatcctacttaagagtcccagcttccagcccagtgttttctcagcctccttgaaaagacatcacctgggaagcttattagaacatgcacgcctcagtcctatcccagaccacctgaatcagattctccaaggatgccagcgctgaaggcttaacatgcaccccaggtgattcttcctttcccccatcagtcctcagtaagaatcacaactgttccagcatgggaagaacaactggcaccccatcactgtcaattaaaatgcgtcttgcagggcacggggaggtggcctcatcactctctccagacaagcagagtttcctgacatgtctgcaaacagcatgagaaggaagaactgtcaaccaattttgattctgagaactgaagttaacttcacaggtgctcattcttaaccaaaaaaggatctacttgacgttctacctagggagctcctccagttcattaaaagtgattaccttcagcttttcagaacacaggcaaaataacgtgagcatacataattgttagagttttcaggagtgggaagtgaaatcagtactgtctaaactaacagtttaatttataccttgcctagttccaaagaagatctgaagtaagataaacatactaatccccacacttaccacatttgctgaggtggccaatggctttttctatcgtttcaagtatttgtctatagtaaaccgctgataattagtttccattttcttaaggtattaagaaatggaagatattctttgggatcctaaaaaaatgattaatgagaactttatacttgtgatattcatatataggaatagaaactagcatttacatatagcaataaacccaagctacataatttttaaatgtgtattatatattaactgcatattatataatatataaaacaaactacagttgtcccccagtatctatggggaattggttccaggacaccccaaggatacaaaatccaagcataccccagtcctacatttgaccccatggagcctggatacacaaaatttggccctctgtatctgcaagtttcaaatcctgcaaatattgtacttttgatccacactattgtggatgcagaagccgtggacacaaagggccaactgtgtttgagagagatccacattagataaacccacacagttcaaactcgcacagttgaaactcacgttgtgcaagggtcagtgaacatcaaacaagctttggcaaaaatgctttcacatacggatattaataagttacactggaataatagtaacttccttaactaagtctcacagtatcatttatttcataggctaatagggaaataaggtttcagtctagaagatattcaacaaatgcatctaagtttctcctaaagtctaagacattgctcttggtgctgttttcatgacattccatgctctcctgaaatgatccattaaaacaaacataaaattatactgagttggacacaaaactctgagaccctgccaactagtatttattggcactatcatctccagctctatgccatgccctgtaagcaaattgttttcttcctaatggagaggtgtttcctgtttttaatgcaatttccctgggctgacaggataatacatgtaagaacaacataggaagaaaacccaagacaacaaataattaagtgctcattccagcactctgggaggccgaggcagatggattgcttcagctcacaagtttgagaccagctgggcaacatggcgaaaccccgtctcaacaaaaaaaattcaaaacttagccaggcatggggtgcacgcctgtaagctgaggtgagattgcttgagcctaggaggcgtaggttgcagtggccaagatggtgccactgcactccagcccgggtgatagagcccgaccttgtctcaaaaaaaataaataaataccgcactctagataaagacacactgtagtctgcaggggtaggcacttgtgcaacagaagcatataggagggtcacctcacccagtccctggagggaagcatgaatgcttactgggaagaggccaccttggcatcctttaacctagattagtgagaattagccagggaatggtgagggtggaagcagtcaaagcccatggatggcagaagtaatgctgcccaccaggcatgtggtggtgaggggcaagggaagggggacaaaagcattgtctttcctccatggcagaggaaaaaaagacaataccaagaagtgagaatggaaagatacacagaggccaggtcaggaagggtttttaagcagtattatggcttctgaattatatcctcggaacaatgggagccatgaagtattttaagcagagagatgaaggatccgattttcatttttggagaggtcatgggaagagactgaggctgcaaaaaaataaataaaaaatatgcataccagtggtgttcaaatttttgatcatagcaaatgtaccaacataggaaaggaggccatgagccttctgtgctcctgtgcccaccctccactagaaaaaagagccatgtgagaaagaaccggagtggaacatgaccacttgttacatttcctttataagagaagaaattagctcacacatatgcccatcatctaaaaataaccatgtaattttaggccgcacatggtggcccacacctgtaattccagcacttgggagactgaggtaggcggatcacgaggtcaggagatggagaccatcctggctaacacgtgaaaccctgtctctactaaaaatacaaaaaattagccgggcgtggtgatgggcaccttagtcccagctactagagaggctgaggcaggagaatggcgtgaacacgggaggtggaactgcagtaagccgagatcgcaccactgcactccagcctgggcgactgagtgagactccgttcaaaaaaaaagaaacaaaaaaaagccatgcaattttacttcacttcttcaacctcacatcaaaacactttcataagcacaggggcttaggaatgtgggccctagaaactcacagatcgtctccagccctgcactcacagagtgatagcagaaaagctactgcactaccagaagcaggtttcacactatcattatataaacaagaaccaaatggcataaaagtaagaactccacatccttctgtgacttctcagctaccatgaggaccaaatcaaagtcataggtgccaagagaagatcatataattcattaacatctaccagatgcagcaaatatttcaaggcctcttcagcatcacagcatcaggatcagagggagcatttcctaacagtgtttagaaaacaaaacagaaccaatcatttggggaaaaaatccacagacctaacaacataaccaaaaagacaataaattttctcaatagaactggacatcagaagaatatatacttctgatacttttatatatgctttaagggcagcactgaaaaaaactgacaagggtcttaaaatggcaactaaaaagtcacatgtaaatctgtggtgtggcaatgacatggtgattgtcacctgcagaagactagtagcagtcaggccaccttaagcactttctctgtgagcggatctctaccttgaagctcgtgtactttttcagtacaatttccagttctggggttgtcttctttacatgagatgtaagtatggataggcgtatctgaggtaataagtgaagaacaccagaatgagaaaggtaagtaggctggacaaggcaactacacacttcggtttttcaaaggatgccacctggtgacagcatacatacttatgagatttatgctctccatgactgctctcatagcatcgcagacaaggtctattttattcccgcaggatccctggacaggtagacactgctggtaactggtgcagggtacatggtcttcgtgcatcttcttctctaagaacaggtgtgtatggaatggtcatcaacagaacatgtagcccacgatcaaattactaacatacacctggcatgctgatgatgataaataaaaatgacttttgaaaagagttgaattataaaaatattgagaaataaaacatgtccacaaaagacttatacaatgtttgtagatgttttagtcacattagccccaaacagggtagtacaatccacatgtccgcaacaggggaatgaataagcaaatagtggtgtatttacacaacggcatactactgaccataaaaaaagaatgaactagtgatacatataaaaacacagatgaatctcaagacaatatctgaatgaaaacagctttatgcagaagagtaatactgtatgcttccatttaggtgaagtcttgaacaggcaaaactgatttatggtaaaaaattcagaagagtagttgcctggggaatggacagggactgattgaaaggaatctgaagcagctttctgaaaaggagtaaatgccctcaacttgacagaggttcaggttacatgaagtgtacatttgccaaaactcactaagtggcaacttaagatttggacatttcactgtagataaatatgacctgaaaaaacacaacaaaaccacccatacacaaagaatgccctctagttaatgatatacaaggagaagtacaggtggtaggtggactgatgtctacaactcacttagcaatttgtctacaaacaagatgaatgatggatgacagattatagagaatgagaatgtgtatacagaaaaatataaactggcgaatccaggtgggtatatataggttgcttactggacaattctctcaacttttctctattttgaaagtgttcattaaaaagttgaggggaaagatcatcagagagaaagatgccatttgatttcagtctctaggaaaaacaagtagttttatatgtatacctaaaaatcaagtgaaataataattctgatgacatgttttaaggacatagttttaaacaggctgttttaaaaagaacggaaaagagcaaaaaccaactggcatctaagagttatagcaatttttaaaaatgaacagtaaggaattttcttctctagctatttatgcttgatttccttaacaagaagagagaaaactatggaaaagtacacatgaattattcaaaatacttacttcaattctgtaaaaaacaagttaatatgattacagaatctatctgtttaatgaaggtttccacatttccaagaaacacctaccaaaaaaagacaaaacatcttcgttcagatcatattagtttaagtacaaagtaagctagagtaaatgcagcttagaaagttaccttagggttatgatcataaatcagattgagattgattctcagcttctcatgcattcaaatgcctctttaaacataagtctgtgagaagacagagaaagaataaaaagatattcacaaaaactgagctccatgggcccagcatattttcattatgatacaaacagttataatcagattacagccccaatgccaagctgctatcactggatttctactctgaattacagaataaaaaaatcaggtaccacattcatttaccttcttaaaaggtgtaatttatcatcatgactgtctgagaactacatcttcacatacatacaacagaaaatcattacagagcccgggcacggtggttcacacctgtaatcctagcactttgggaggccgaggtgggcagacacttgaggtcaggagtttgagaccagcctggccaacatggtgaaaccctgtctctacgaaaatacaaaaaaaaaaattagccaggcgtggtgcacacctgtaatcctagctatgcggaggctgaagtgggaggattgcttgaacccagaaggcagaggttgcagtaagccgagatgcgccactgtactccagcctgggtgacagagcaagactctgtctcaaaaaaaaaacaaaaaaatcatcatggaattcaggtctactttttaaacaaaacattagtatagatctttccatacaaagtttcctccaaataggttcagaaaatcagtcatttccttcacaagagtagctcggcttttctgggtcataggccccgctgtaaatctattgaaagctgtgggctttctacttaataaatacacaaagacaaggtttggtgtgtacaatctccctgggttcacaggccacctaaacccacatgtgttccctcaggttaagagaagccctcctttatatgatgagtgtcacgttctttctgctaggaatctccactacaaaatactgcattaaagtaaaaaagttaaaaaaaaaaaaagagcctctaagaatctgattgatgatataggtaatgagggcttttcataatttaagttctcgaaattgtaataaaatacttattgtcttcacacataaatcacaagctaacagtcgcaaacagtacaatggcacttacttgtccaaccacttccgaatctgagctaaaacagggctcgatgatgaacaacttctaagtttccccttggcatcttaaataaattaaagcataacatttttaattaagtagaaaacatttaaatagccaggatacaccattttacctaaccttcacagagaattaccacaactctctaaaatcagcacacttttagcagaatcttgttgtctctatatttatcttgactttcaagaaaagtttcgctttgagccttatggtcacagccgtatcaacactcctttgaataaagctaacagaaaactatcaaggaaaggtttacaataacgatacaaagaataagaaagcctaaaatacaacctgcaagaattatgcttggtacttggtgaatgacaatcagactatctatcttgtctgaaaaaccagcttacctgtaatacaagcttgtgtcctggggcacaacagtgacaatccgtgaacccctctccactttccgcagaacttcccatgggacacatgattgctgctcaggccggcctgtaatgctaaacacaccattaactataagccttaattatcacaacaagccactctccattaactgcaattgaaaccgcacacatatgtgaaatagaagagaacaaataacaaccatgtgccttagctctcccactgaacctcagactatcagccctgctgatgaacacgctcatccctggaacttgccctctctcttacaggccctcatgcacattcacatacacagcttctcaaatgatgtggagaaacacagttaagattggggcaacttctctatttcttagcattatcagtgtactataatcatatcaatgaaagaagattccctatttccaagttggaagcaaagaaaataagttggctttttagaataaggacacacacacacatacacgccacacacacatacacgccacacacacatacacgccacacaacatacacgccacacacacatacacgccacacacacatacacgccacacacacatacacccacacacacatacacgccacacacacagagatagatagggcatggaacagaagacaaatgcagccaatatcctacaaaccactagatggagcgcagatgtacagtggagggtgggcaagtgggaaaagactacacagaaggtaaaacattggggatctacatagtaattccaaataaatattagatcagttacataataaaatttcctgaaaagtttttaactttagaatgtgctcttaaggaaggaactcccttccttggatgtctttactaaagtgcagaatgatttaactggatattatgttgagattagggtctaagtaaaataactctaaagattttctccagcctagactccttgataaaaagccaaaataaatgaagaattcaaaaagtcatcaagactccaaaaacattggagaagggaccatttctgttttatacattgaaaacttacttttaaatgaagcaccctcaggcaaaaacactggcaggtatgggaatgggttgtcaacaataaaaactcatcaatactgcaaatgacgtgatatttgacgcaacctgcaagagaaggccagagaggcatggggaaagctagctagattactcggagctaacactgtgaaaaggatccaacaccaaaccaagcttgatacctcaatgtcattgatgaaaaagcgacacctgtcagtcagaccaaggacacatcctgcaaagaaataaaactgaaatcacaagcaattctatctcaaatcagttaaacctacttttctatcacatagttctaccaccctatgatttcacacctaagttcctgtaatcaggctaaagatagatacctaagacgtggctggtccagtgcaaaatggaatgtgaagccatccatccatcagtgagccctgacatctccatctcctacacatatctcaaacccatctccttttcccctcactaactccactcaaccggtgttgatcccatattccagtctcgtcactctccatcaagtctcttctgggcagccagaatcactgtccaaaccatgaagcagaacacattacctgttattaaaaatcacaagaagtttctaatctttgttcaattaaagaacccaaattcctcctatgactgtcactgagctccagccacaatacttccatccagtcccttgaataagatagctcttgctaagctcaaggagtttgttgttccttctgcctggagacagagccttcttttcttcacatctcagcacacacatcactgcctccgagaggccttcctggaccaccagatgaggactcccattctcatagccaccatcctcaaattacccctcaaacatctcagtattcttaccagtatactctgtccatttccatcacactcccaacaaagggaatcattacattgaattaatagatcacaagttccagaagagcaggaattagtcaagcggttttgttttccagccctgcattctaccatccaccacaattataggcattctagtatgtgttgaataaaaatctataaaactattctcaagatcacatttctgtttcccctcctaaataaaattaactttgaatatttgtacaactagggataaaaggttgctaatcacatatattatctcatttagtcttctaaccctgatagacagatactgattttcccattttatagatgaataaggtgtggcttatgaagtgagatcatttcccactattgtctaggcatttagtggagacccaagtccacctccaagcccacgctctttctacttaatgccatcagtccctgggtaactactttaagtaaatttctgctccgtgttcacctacctcttctccaatcatggccaattcggtctgggtgcatggaaaggaaaccgaacaggaaatccaccagagttcttccatggtttaatagccagagaaggtactctgcaagattcacagatctagttcacaaatagctgatgcgctctttgcaaaaaacctcaacatcaacatttgctaaaacacttaacatgcaatttcaatcactttttttctctaagctggcattatttatttatatatatatttttattatactttaagttctagggtacatgtcacaatgtgcaggtttgttacatatgtatacatgtgccatgttggtgtgctgcacccataacttgtcatttacattaggtatatctcctaatgctatccctccaccctcccccacccccgacaggcccaggtgtgtgatgttctccttcctgtgtccaagtgttctcactgttcagtcccacctatgagtgagaacatgcggtgtttggttttttgtccctgcgatagtcatcaatacttttttaagagtacgttagttcattaaaagaggaaacaggagtagaatacacttgccattccactctaaagcttagggttttccagggtagttaaaagacctgacaatcaatattgactgacaagatacaagtacatgttcttaagaactaagcatctatgtaagtcataacatgtttcctaacaccttgatactcaccccaaaggtacttaaatatctggccatcagccagcttaatactactgacttggtcttggaattgcaacatagactgattatgaccccatccaccgtgcagatgaactgacaaaaaaaaggagaagggagtgtaaacagaccatttttctcaaaatagtgacatttcactgattttgaaaatcaacaatttccttttgatgctgcactacctactcaatacaatgtagacaaaatacatatatacacacccaatactatacacacacacacaccacacacacacttatacacttagagacagacggttagatgaatagataaaactactccaaccaaagcccagataaagccacatctgctacatgacaccattttccacaaacccaataagtagttgtttacactgtgaagtcatcattcctcttctggccacaacttactgcaacttatacaaagtattgccttcattagacatggatggtaccaatatcatttctgtctgcttaaatagttaaagcagctggtctgtaggaaaatgagcacactcaatatctctatcactatcattcgattgatggaaaattgtggattttcactaatgagatgaagggaatttgttatcaccatacattttttccctgagtcaatggagcgaagtaaaatttcactattttttttttttttttggacagtgtcttgctctgttgcccaggttgaaatgcagttgacacaatcacagctcacgcaatctcaacctcctaggctcaagtgatcctcccacctcaccttctcaagtagcttggccatagccacggaagcagaatttctcaaaagaggaggaagaggtagtgattaaaaaaagaaaaagagacaaagaagtagtgataaaagcaaatgatgttaatgctaacatttaattcaagtttttaaccaatctacaaaaaaactaaacattataacaatagggaattcctctacaatgcttcaaattttgtgaggataaattatctgtcaagaagagaacaaactctggagctagctcgctgggatttgatcctggctccacctgcatgatctcaggcaagttatctaactgctcatgtcttagttgtctcatctgtaaaatgatggtgcaaatggcatatactttacagaggattatgagaaataagtaagctaaaacagacaaagcatttagaagagtattttttacaaatataagctaaagtaaatgtaaactaaatcgagggactttgtagtcctcaaaagcattaaattttatatgaacaaaacagtctttttgagaaataaaagtcaaagcagtagaaatatacgtaaatgacttctcatttcctttacagcaaatgagatgactgcatcaagcttttgcctcacaagctaatgatgaagaatttcaaatctgaagaagtagaaacttagtaaattgctccgttttcaaaaggtaatctaatggcttactttaagtgctacatatttctagaacatattctcatttagacatgttaacaaaaggctttttcaaaatatcacgaaagactatgagtcaaaggtagcagcaaatgactgcattaaaatgttttatgtctataaatttatgtaatgtatataataaaggaaaggttcctaattttgcaacaacgtttctcagaaatctcaccagtagggcttaattacaaattaatctggggattagtgtcagtggacaaaggtgccaagtattgacactgaaacaaggagttctgggaactggctagaaaatgctatcaactatacaacagggcttacttacacagaagagcattcattaactgaaacctgttacataatgaagatatagtcaggaacaaaacaaaactcaggcccagagaacagtgaaatttcagcaaagaagaatagagacttttaatggtaaatgtagtcaggtacaaaataggatatatagaagaggaggctggaagaagcttttgaagtcaccacatcaaaacaaagcatatatgtgcaattatgcatcatttaacgatgggatacgtctgagaaatgtgttgttaggtgatttcatcattgtgcaaacatcatagagacttacacaaacctaggtggtgtagcctactacacccctagcctatggggtatggcctatgctaccaggctacaaacctggacagcatgttactttacagaatactacaggcaattgtataccatgtcaagtatttgtgtatctaaacatagaaaaggtatgtatacacacacacaccacacacacacacacacatatatgcgcatgactgcatttatacaaaatttcttcccatccattagcccatgagaattagccactctaattatgcttgacagttattaaaatcaattatacatataacaatcacgctggaaaaatgtgggtagatgctaaattaaaatatttaacatactttaaaaagttgcttcatctactaatatttatcctatttttcaccactttttgatatattttggtctgttattttgacatggctcataactagacttaaccttcttgttaagtgtgttaacaagaaagctactgctcctcaaccttgatcaatagaagtcaaaagttgtatgctcaaaaagacaaaaacctaactccatttgcttaacatgtggagtacagggaaaaactgcaatcctgacattgagctgtccatgctcttcatccatctcagaagaagctgcagtcaaatggtaatgacagaccgggggctgaactcactgtggcttacagccaggaagacgtcttcttcaaccaagtgagaaggcctagtttcagcgggtttacatcttgatcttcattattctcaaactgattctattgtaaatattgaagaatatccaagacatgaataaaacttaaaaaccactgaacgttcctggatgaaggaagactgaagcatcttgtatacagtccactcctaattatttgagggacaaaacctgagatactaccaaatactacaaaatctaaaattaatctttgtctggttaagaatacgtttttatattttccctaaatttctcataccctgaaatctttaaatttgagagaacacttgaggaaactgactacacaagaaaattaccagccctagtccctacactatgaaccccagagcttttccactgccatgacttaccagcattcaaaccaggctctggcagtatgtcacttgcagtagaatgggtcctttcctaagcacctcacattaaactgactgactgcttgagagatggtctccatgtctctaatgcattctttggtagcatttatacacctgacagcgcactgttcttgtcacctcacgtaggaaccgacaatggctacttcctgccttttagtcaggtggcaaatccgcagctcccactgaagaagttggtcactagcctgatcttcctcccaaacatctctccccggactcaggctctccattgcattcacatagagtatcccatggagatcagtcccacctctggttttcactgacactttcttccccaccagacccaatgttcccattctttgccaaccccaaacctatcccttccccaagatcacgatgagtactcatgtcttcgtgaaatctcagacgaattggcattatccccatcaattttttttaaatgaaactatatttaaactgcctcatactttctaatttgtcctctatctctactctagtggtttcaagtctagaagtgaaataatgcatgtaaatgctctttaaaaactactaagcattatacaggcagcccaaaatcatacagaggttgaacacttctgctgtatttattaaatatatcacatatatttagaaacattatttattaaattctgctatttgttgtactcagttaattatttctattaattaacaataaatgttccctggaggcagagtagtttagtaatgaagaacatggacttatcaacagaatagaatcaaaccctaaattctctagttaccaggtccatgaccttgggtaagttcctaacctctacactttgtttttttaatctgtaagtactcaataagtggtactttttaaaaagttctctcacagatgtggcattataatttggtttctaggtcattttgcaaatgccttagtgtacctgaggtattcaataacatccaattgtttacaatactgtttcaatggaagatgcattctgatttccatcccaggagcctcaaagcacagcacccagaagttctagattctggatggagcaaagacagaggctgcattaggtcatccatgttaacaacccatacatcccctttatgtaagagaatgcagctccgccttatcattgtcatctccatctttcccacatgattttcctggagaaccaagcgctattgggagtaggtcctaggctggcttacaactcatgcttcctgctacctatcaaattatatggcattcagacaaactacatgactggcttctccaatagatccgaaagtcagggcctgggtgttgtctttatttcttgttccactcagcaacaggctagaactgttatcagatggctgaatttaggactgcatgctggctgattctgttcccagagcccaagataattaagaacctacttgtatctcttttccaaatgaggagttctaaggcaactttaaatccacttccacccacagctcccagtttcactgtagggtcagcacttggacaacacctggaaaacaaaaatgcaaatactatcatcgtaaattataagatttcacctaatacaaggggatggtgtctgcaattaatgagttctagaaggcaaacagcaatctagaaaataacacatctcaacctccttaaaatctctgctttcctcttaagaacacatcagtcataatctccctgacaaaggccacatctcagcaagaccaggtgaaggggctaccctctcagcccagtctgtggacaatttcctccactgtcttcaaccacctctcaatatcctcaaattctccaaatcctaagcacctgcttaaaagacattttctttctattcttcatccagtttattcactgccagcagccaatgcaagcctttaaaaaattcagccagaacactgcactcctctgttctaaccctctggtggctcctatctcactcggagtaaaagccgcaaggccctacaagagcagatcccatcaccactctgaactcacccaccaccttcccctcctttgctctgctgcagccacctggcctcctggctatttcctaaacacaacaggcacttcggtggttgctttttactctgctggaacgctctttcttttttcttctttgccttcaagcatagaatgcttgggacgctcttccccagatgtctgcgtggctcccactgtgattctcaccaggtctctgcttcaatgtcacttcacagagaggcctttgggatcacactaaataggaaagacaccttccccctgtaaaccttatccttaagctctccctaccccttattttgcttaatttttctccacagcacttgccactgatagatcatatttaattgatatcttttgtctacacctagaacaacaagttgtagacaagtacaactagttttctagtacaacaagccaagtactagaaaaaagcctggcatataaaaacaatcaagaagcaatgagggggaaaaaggagtgatactcaggatgcatcaaacacctctttgaaaactttggcaacgaacttgtctccacaccactcaaatgtctaccacttgacccaagttcttaatttcccttccacttgggcacggagccctgacctgttccagtccaagactctttttccagattctcttatatccaaactctccccagtgggttctttaacttctcaggtttttacttcatggatttgttatgatctttctcttctttccatttctatgaacactgcctggctcaagctcttgctagctcctgcctggacacttgacaacagcttctcctaactagatctctgcctccaggtgcccctgacctatggccaaccccacatattgatgccgaacaattttcaaaagtggagctctcaacctgtcctatctcatcacagggagttttctctcaagtaaatgaatgcagggtggtacagggtttcattctgaggagataaaaacgtcctaaaattgacgtggtgatggctgtacaactctgtgaatatacatatatatacatatacatatgtatattattcatacacacacatataaaccattgaattgtacactttaaatagatgaatgatataagctattttttaagtgaatgcagaacaaaacataccatacatcataaagtgacatataactcattagcatcatacagttaagtcccacaaaagcttacatctgattctttttgccttgcaatgaacatatttgcacttttttttaaagctattttgaaaagtttaaggaggactgtacagcattttacacactgaaactataatcagagaaactggtgagacatccagataggatcatgtacacagtgggctgctgacttaacagaaaagctgatatgaaagtaaggacttcccattaaattaattaattttgattattctctcttggcaactatctaggctttttctgagaatcaaaagatatttgaaaacaaggctaacactgccatatgccagcagaatttatgacataacacagaactcacaagtaaaaacaaatttcagattctccagcacatcaggaaagtaatgagaactgacagcaatggggctgtggcaggacaagtggattaggagctagaacacctgtgtgaggtccttgtccattcttgttcaaacaaattacaaaacctctgacactgtgttccctctctacaaaagaggaaaaccccatctctgacacagctcctaggagggatgagatcaactgaaatatgtgtaaaggctatgaaaagagtaaaacatgttaacaatgtataacatactatgtatttccagagtccaatgttattcttaaataactgactcttcaagtcagtaagggaaaagaatggctcgtacaaaccagtataggattaaaaaaaaaaaaaacaaaaacccaagccaataaatatcataatgataatgatatcaactgcagacttaaaaattttgagaaacactagactatggcaacaccaaactataatttgcttttatgtaggagtagaagggacttgattcagacatcttggcaaaagttttataacataccacatttataaacagaaatctggttactggctctagaacagcaaggtcattactcttttgagggtgtgctaagaatgtgacttgattcacgggtgtgggaacagcagttggtaggtgcacatgggaggcggaaccacagtctgccggaaactgtcaccaacaccctgtctgcagtgaaaaagaaagaagaggattagacctagggatatcaatttgtaagataagccatctgaacatcacagtatatctaaacaataatggcaattccaaaaaaataactttcaatgtttttctcaggaacaagtctaaaaacagtgtgggatgggaaatgtcatgggttctgtccataattggctattgtcacctctaggcctaggggagtccactcagtacctggagtttcaggtgccagggactaaggcaaaaaggccaagaggtcagaccctagctttaaacctgggcctgcaaccaagccacactaaaccaagggaattaatactttcaaatccttaaagcactttcctatgtgtggatttggtaataacgcagatctgattaagtttctatatagaatacatgactataaaatcagtattatgtagaatattacacagaatatgattaatataccacctcacattacaatcttagaagccagtgctccctttcatatcagcaataaactattcattaaggtgactcttcagtcttgcccttcccaccccaccccctaaaaaaacttctacctcattataaaatataaacctaatcttcatattaggcaaacgtttatgcatgactgaacatactggagaggtatatatcagcaagcatttgtatcaggaaacaaagcaacaaagtggggtggtataagggtcaattataaatctgtgtcagggcaaacagataaagctaaacacccaatcccacaagactgtactgttgtcatcctctctacctagagtcaaagttttcgtgtcttcaaaggccaggcaagtaaacgtgtgaaggccacagatgcagtataacaggaactggtgggggaggggggacaatggttctcaggagagaacataccccaccttatatcccatcaataaaaaaacaagtaacccaaacagccaaaacaaataaagattccccactgttccatcaaaccaccacatctgcaggccctaggctcaggaccccttgcaggctcatggacacactcccaggagcttacttccatcaatgacagccacattggacaagtcacttgaattatctccacgctccggtcagtcgtccagtgccaatcataggcgaggtaatgccagccctgacagaaacatgcagccggtatggggtcacagggtcccacatcagagacacaatcttgctcttccacaggtgctgaaggataaactttgcttgagataccagtgatagtttccaacagtccagactgaactgcaagggaaaatgaaaagaaggccgttagaggctgggaagcagacttcatccacttgccagaggggttcaagggcaatcttttctttttcaaaggacccttcctgctcagctcgtctctaaaataagaacaataataactgccaaaaaatagctttccatgcagataaaaatcaagaatcaataaggtcagaaatatatgtttattttcttgttttttttctatttttacttttattcatatgtttattttcgttttttttttttttttattgacacagagtctcgcttgccggccaggctggagtgcagtggcgcaatctcggctcactgcaagctccatctcccggttcatgccattctcctgcctcagcctctcgagtagctaggactacaggcgcccaccacacacccggctaattttttttttttgtatttttagtagaaacatggtttcaccgtgttagcaggatggtcttgatctcctgaccttgtgatccgcctgcctcggcctcccaaagtgctggattacaggcctgagccaccgtgcctggcccacatgtttattttcaactttacttccaactttatgatcacaatggaaggctaccaggaaaaagcattcttttagtgggttttctcataagatttaggaagaagataacttggcaattagagtaaaagtattaaaacacttaatccagatctagactagcatcattgtgttgtattgggcttaagatgcttattttctttcaggtgtttgcaagcacttatgttcaaggctatctgggtattaatcctgattcagctgtccaaagagataagcatgaaattatccttccaacatctattaagcaagcaagacttaatcatgccaaaccaacctttactaaacagatgacatataaattaagaccttagttatattaggaattaagttatattaagaaatattatttatattaaggattttctcaatctccttgctcactaatcttaacttagtgatcacagcaaacataacctagtctcaaaccgcattattacaacacttgaagttagaccacatgctgatgttctgtgagcacagatgttgtggctgttcttgtgcaagtgtgtgtgtgtgtatatatatatatacatgtttttgagatggagtctcactctgtcaccatgctggagtgcagtggctcaatctcggctcacggcaacctctgcctcccagttcaaggattcccttgtctcagcctcccgagtagctaggactacaggcgcgcaccaccacgccggctaatttttgcatttttagtagagacagggtttcatcctgtgcaatatttttatgctcacatatcacagtgccatcccttgacacactggttaatcggtggttctcaactgcggctgttaaaatcacttgggggcttttggtttttaattaaatacttacgtataatctccattccacacactgaactgaactcttgagatgaagcctgaatatcattttttttctaaaggtgtggcagggttaagaactgttgtgttgaatgaataatgagtttcttaacattgcagttaaaaggttctactgaggccgggcacggtggctcacgcctgtaatcccagcactttgggaggccggacgggcagatcacgagatggagatcgagaccatcctggctaacgcggtgaaaccctgctctaccaaaaatacaaaaaattagccaggcgtggtggcgggcgcctgtagacccagctatcgggaagctgaggcaggaaaatggagtgaacccgggaggcagagcttgcagtgaccgaatcgggccactgcactccagcctgggggaaagagagagactccgtctccaaaaaaaaaaaaaagggggggggggttctactgattaaagagtttgaaagctacttagaaaataatcaataaaaagatttatgaacaaaaatgtaccatgcattgctgtttacaataatgagaaatgaaaaactgtaaatgtctaacagcatgagatttaatgaacgagaataaacgagtattatacgcaatttaaaatgatgcagatgtatcacacctacacttttttttgttttgttttgagacgtctcactctgtcgccaaggctggagtgcagtggcacgatctccattcactgcaagctcgcctcctccaggttcacaccattctcctgcctcagcctcctgagtagctgggactacagcgcctgccaccacgcccagctaattttttgtatttttagtagagatggggttacaccgtttagccaggacggtctcgatctcctgacctcgtgatccgcccgcctcggcctcccaaaggctgggcccccaaagtgcatgagccaccgcacctggcccatacctactacgcttttaacaaaacaagatgatagctatactgagatatatacatgaaaaacctagaagacaagaaaattgaatagtgattattacgaagtggtagaactatgagatttttttctcatcttattttctacactttcaagtattatttaatacttaaaaccacacacttatacattttaaaagctataaaatattcttacttttacgcttaatctaaatcttctttcacgtccacagaattcctttgttagtgttttttctgtggtaataccatgcactagggaaagcacgtgatgacttacaacattaattttattgtgtcaagttggctaggctatggcacccagctatctgctgaaactccaatgttgctgtgaaggtattctgtagatgtgattaatatttataatcggctgactataagaaagcagattattccccataatgtgggaaggtcccattcattcagctgaagaccttaaagcaaaaactgaggcttcgcagaaaagaagaaattctgccttaaggctgtaacagaaatctccctaagtttccagcctgccctacagatttcatactcaagacagcaacatcaattcttcctgaatttccagcctgccaacctgcccccacaaatttcaaacttgccatcccctacatagctaatcttttaaagtaaatctatccacactctattactctctctccctcccgccccacctattccctctctcaccgtctctctatgtaagtacagctgacccttgaacaacacaggttgaactgcacaggtcgatttatattcgtatttttttcaatgaatacagtcggcccttctattgtggattctatacccgcaaccaaacacacatcaaaaatatggtacttgaggaatgaaaacccaagtatacaaaaggctgacttttcatatctgagtgttctgcagggttgactgaggacttgaccatgtgtggattttggcgtccatgggcaatcctagaactaatcccccgaaatactgagggacgaattatatatatgtattatttgtttctctagagaaccccaaccaaacatgactgaaatccacaatcaatcaaaacctaaccacccccatttccacctacccactcagcatctttgattctactaagggactaagtagaagggatgaaggaaatcccatacctgctactttcaactacgttttatggggcagaaggctggggtactacagctgtcttaccacagttttcggaatggagctttcttctctctgaaggtcttccagccagactgcaagcacagagaatctgcattccagagcaagtcatttacctagaagggaaaaaagatctgtcattggcttcagttatggatttacttccaaatctttataatagctgtatttcctctctcaaatcaaaaatcccactacctgagctcatccctagctgtaaatcactaacctacagaggcattaaacaatctgtaaaatatgtcattattatgtagaggacttaaaaaaaagaaatacattatgctaaagattaaaagagacttaagaaacttaaccaaatacaaggtgacatttttagacaatcgagaaactggaatatggactgggtgttagacaacacagagataagatgtaataatagaatatggttatgtaaagaaaaatgtccttaactgttataaataaatattgaaaatatgattctagaattaaaactccaggaaataaaaatatatgtaagtatatgtatgtataggccaaaagttgcggaccgatgaaaatagttttgcaaaatgttggtatctactgaaagtgagtaatgttacatgggagttcattaaactcgtctctcaacttaggatgtttaaaattttacacaggataccatttgatgtgttctcacttcagcaagaatcttaatggtatacaaaccacttaaatttaaatgttataaatgaaaaacatcttcattactggaaaaattatgcttttgtcaaataaacaataaaaactagcatttttatttcctacttctgttttatctaaggtgggggacaatgctattatttgcaaaatcactggaaaaacaatattttattaaataaaaatcagttctggaagccaccatttttattactatttactctaaagctactatttatatatccatatcaatataaatcccctctataggccaggcgtggtggctcacgcctgtaatcccagcactttggaggcagaggcgggtggatcacctgaggtcaggggtttgagaccagcctgaccaacacgggaaaccccgtctctactaaaaatacaaaattagctggctgtggtggcgcaagcctgtaacccagctactcgggaggctgaggcaggagaatcacttgaacctaggaggcggaggttgcgtgaaccgagattgcactatcgcactccaacctgggcaacaagaatgaaactccatctcaaaaaaaaaaaaaaaaattccctctatagctatggaaagtcctctacattcgagggtgaacaaactcaggcacttaccttaacctcatctttaaggaagggaagtgtaaagtgtccataaggagtccatttttctcaaaaaacacaatatcctgctggttgggtttatcttgtgtagtgcaatcaaactgcctgagggtcttaaagcaaactcagagtgttacaatatcgaaagctacctaactaaagaatagataaaatccagaagagttttttttccagcaaacatgaatgaagaatgaacgaattaatgaatatctttatccaaggaagttttaaatcccatgtgtccctttctctcggcgagcggttcatcccactgtgggactgtacttgcccagaggaaagagtgcctttcctgttttacacagaggctccatttgcccacaaaaccttacatatttacattgcattggatgactttaaaaataataagttatctaaaccattccaggtataatgtcctaaaaataaaatctatttctccttccattatacaacttcagcaaatattctatgctccagtaggtctttttaagacttcaccaaatgttgaaaacatcttaattgcctcatcttattcatatttgctctagggttttaattcaaatacatttctcttctgctctatcatataataccattcagaactggtgggaaacaagaggtctacatacaacagatatcaccgaaacagaggagatacatttctatctaaaatcaggcagccacatatgacaggcaaattgtaacctgcacaagggtacgggccaaggaggagaatggaaggaaagagcagggtctgaatccagcctgcatgctccttgcaagcagatcctctgctgtaggaattttgtgccaaggaaggaggctctttccctaattccacaaaagcaccatttgccccacagagccttgcaaactgggccttcccttctaaacacattttctgctctgtacaatggcttcatatataccctgccttaaaaccacagccttttaaagttaggaatgcaaaatatatgcggccttggaacaatgaaatctgtgaagaagcgtaaatctactattcgagttgaattcagacttcagggaataagaaaaaaaaaaaagaagaaacaagatagatacagccttataaccaaatgaagaaacgtaaaaatccttttgtgttacacaacatctgtatcatctgtatccatgtgtaccaccacctctactctggttccaagaatttcttaaggtttcttctcccactcacttccaagccagggctggtcccagtcctgccacaggctactggttgactgcaaagcaaactctcggttccacactctgaccttccgagcccctgtgcggagtggagtcaaacacacatacacacttaaaacattatgataaaagttgtcaattcagactattcaaacaccttccttacaaataaaaactgccatggttttacatagccaattagataattttgttacaaatttgtgtccaccaggtaggaggatggaccaaatggcctcaaaggctcttctaattcttaactctaacctcatttcacatttaaagcagcacatccttgcctcaatgtataattaataccctactcaaagcaaaagaaagaaaattttccttaattttaataaataaaaattttttattgttgtttaactgcaatatatttccatacctgtttctgggcaaaaacactcacagcaaaaaactgtccatccccccgccaggtaacttgtggtctatggtcatccagggcaaagcagactcatgctaaaaaggggaacaaacaccaatattactgggggacctaagtatcccagaatcaaacaagcctcagaccactagatacagatgttttttaagaggttaagctactttgaaagcctgcctctagaatcagaaaccatccaagggttggttcttagacgcagaaatcatcaaaaagaagaaaaaaatgtaaaacaaacaaaatcctcctttcggcataaaaaaaaaaaaagtggcctctgagaacagcaaaagaggaaaagagctacagatctagtcctgaatataatgagctaaggaacctatcaggtaactacaacaaggaaacaagtgttcatttgtccaacagggtagagttttgtttacatattgtgtaagcttcacaacagggcacaatgagttaagatgtgaacaaggtgaatagggaggagccacagaggtggtaaaggcagcacagacaatgacgaaaacatggaaatgttctcattctgcagcatgacgggaagaaacgtccctccagggccacgtgtatctcaatcctgaagccaactctaccgggtgggagacagatgccacccgggcattcatcatcatattctagtaacagcctaagaattctgctagtactgtatgtagtctgcacagtagggaatacataggtagcctaacaaaatttattctcaatgaaacgtcctagggtatagaaaccaaacctcctttactgaagggttaaggcctgaaataggcatatatgaaatagaactggaaataattaaggacagaaaacgtagatggcaagcagggtattttgagtcatctattctagaagagtagctcatagaaatttctacatataattatgcttcctttgttcaggcccaacccttggtatcctcctcaattcctccctctcacccaattttttttttttttttttgagacggagtcttgctttatggcccaggctggagtgcagtggcacaatttggctcaccgcaacctctgcctcccaggtacaagtgattctactaccttagcttctcagtagctgagattacaggcatctgccaccatgcctggctaatttttgtatttttagtagaataggatttcaccatgttggacatgctggtcttgaactcctgacctcaggtgatctgccaacttggcctcccaaagtgctgggattgcaggcatcagccactgtgcccagctaaatgcacctcttgaatcagtgttactgggcactaggagagcccaggcagggaacaggctgagggtagaataacacaacttaaaaaatcaaagtaaattatgctcacatgagtacttgtatctgctactccatggatttttgttttcttttctgaagggtagctgtgaactttcaaaccaagagaggccctagaaagcctttagaaaaagttcatgaaaaaaagctagagtagtttactggaagtacattagataacaggatgctcggtttttttcccccattacctggatcatcctatacattaataaaccctaattttgttaatactagataagtcttactctagcaggtaccagtagaaagtgtcatcttctccagagtttaacaaagtatggaaaactgccttattttcaaaactccatagattcctttaaagtactattttttaacacctttactgggatataatttacatatattaaggttcacccatttgaagtacacaattcaatgcaccttgggatttttttttggtttttaaactcagtggtaagaatcaatgtttttaaagtatatttacaaagttgaatagccacaccataatctaaattttgagcattttcatcatccccaaaagaaaccccatatccattacagtcaccccttccccaccccaccccacagccctacccaaccactactctactttctgctctgtggatttgccccttctgggcacttcatacaaatgggatcatattatatgtgatctttatgactggcttctttcacttagcataatctttatgaggtttacccatgtcataacattatgagtaaagtgctatttttaaatcgaaaagatatggtcttagaaagctgtaccataattacttgttgcttatagcaagaaagaatattcaaattgcaccaactatttacttggtcagttcctgtttagtcaaggataccttttaagtcctgccaaaaaaaaaaaaaatcacttaaaatcagggggacatgaaaaccacttgtccaaagctgggcagttgtagtggatcacccccaagaagcaaggttgtgtctcagagtacttactccatgtttctgccctctaataatccttactgttctaataagtcaatagctttcagaatgttaaattagacccactatgcatattttctcacaataaagttgttttgaaataaaaactacgctttaaaaagtttcaaaaattattttctactaaaacaaaagcagcaactaccatttgagtgcctacactgtgctgatgctatgaagctgttttatatatgctattacctgcccatctcaacccttgtaaggagacattatgtttccactttacagagaatactgaggctcagaaacattaggaaacttccctgccaaggtctatagcttctaaatgttatgaggataatgtaatctgtacttttctaacagagatctgtaagcccctgggggtacttggtagtgtgccagagggtaaatatggcacatcttcttggggcataattttactcaagggtaatacttttcaattcatagttttaaaaaatattcatattgtaaaattaaaataaaatataagagtttaaatgaatttaatgtgacacggacactacttcccaggtgccccaagagtctgcactcttcttgtgtccacacacctctgccttcaggggccgcccgcctacattagaagattaaaaagtcctgccttgagtcatcaagacatcattatatggcttcagaattttccaatccagaagtaaggaaaacaaagagtttcatccaacagaaaaagaaaatatctaatatacacatatatgggaaaagtatgagaacatgcatgtgaatgaaggaggcagctctctctggagaggaaggggagggacatcgggacgggatacacagggggtttctttgtctgtgatgttttattttttaaactgggtgatgaatattggttataattatttgcactatgaaaataaatcacaaagcaacttggcaataacaaggaaaaaaaggatctttctaagggattcatttcctgaaggttctaggcagttttactaaagcagaagagaactgttcatactggcatctaagtggacaccaaagagttcctggtgggtggcaaacttacatttgttccgtcaaggctttttatccatcaaaccaaacttaccatttgcatctgaaaagctgcttgtcgccttctgatccatggaactgtgtctccttcctaccccatccaacagtgataaacttgctacagaacaattggcaagacaactaataagccacatgaaatgaaacaaaaacagtttcatgctattcttcatgaagttagtcattggcaattactcaggtcctctaacgcctctcaataattgaccagcagtcaatatttgagaaacctatgtttcaggctgggcatggtggctcatcctatagtcccaacactttgggaggctgaggcaggaggatcacttgagtccaggagttcagaccagcctgggcaacatagggagacacccatctctacaaaaagtatacaaaataagcggacatgatggcacacacctgtggtcccagctactcaagagactaaagtaggaggatcattgaacccaggagttcaaggctgcagtgagccctgattgtactactgcactctctagccgggtaacacagcgagacccccatctcaaaacaaacaaacaaaacccatttcatattatagcagcagtgactttgaagaatttgaaatgcccttccttattttggaaagcattttactgcatcttacatattccaagtttctttgatgacacaagtcagcgatctcaccctcaccttaaagtaagaagaatgaaacataaagagtttacaaaatatgtccggaacataaaaccccaaatgagaactgggaataaaattctgattgcaagctctcactggtgatagaggggctgcagtcacaaaacagctcctcacatagacttagagattgagaccctccctaatggtggagccaaagttagaacacaggtcttctgccttccaggctgactggggttctttctagatcgtaaccttctcttatataaactattaggcagagttgctgaaacaacacaacccttctgttcctgaggtaggatccatttgcaagaagcacaataaagatggtcctgaaaacatcacctaatccggacccaatactttcctcctgccattgattctgattctgatgaagcagggctgtttgcattcctataaattatgggtccatatgaccatttcctgtctgctcacatccaagtgctacatacctcaattgctgctgcgtacaaatggtagtgactatcctggtgcaaacccccaggctctatctgcaagtttccacagaaagattaaggaccaaggaatgaagaaagagaacttttcaatggaagacaagaaatgatggggttacagcagggatttgcaaaactacagcctacatcgcttttacaaacaaacgtttactggaacatagatgtgcttatgtatcatgtataactttacacctcaacattagaattgagcagctgcaacacagatcatacagcctgcaaagctgaaatattcatgacctagcccttttcagaacaagtctactgaccccaggatagaggaaaaatttcatcactccatagaatgatttttttttttttgtactgagaaacacatttctgagaccaagatcttaacttggcctacatttcctttgatttactgcattaggatttgtgtgaaaaatcagtgggaaacaccaggcccagagcactttcccatcccaaagtatactgtgtgctgttctctctctctgactgtcctcaaagctggatgccccagagttccaccctggattctagaccttcctgtacagcatctgctccctgagacagtccatctgttcccaaaactgtcagaattcctacatacccactactctcagtccatagctctggcctctcctgagcttcagccttatattgcatactccacatggcaatcacatatggtccttcaacaaatccaaaacagatctcacacccaccccttacagaccagcacttctccatcttccctgttactggcatctttattcccacacctgaggttctggctggagtcctgctcaactttttcttattcaccttacatacgcaagcctatttatttcactttctaaattggtatttctcaaactggcctagggcagaaggggatcatgcacatatattctaaaaaagtttcccagctaattctaaaaaatgtactcccatctcattgtgaatcaagttttttcctgaatgattcctgcttctagccccacacaaaccttcttatctttcatctggattcctgtagcaacctcctacctgatcaccctgcctctcatctctccctctccacacacaaaaacaacaaaaatatgccatcacgagccatctttctattaaaaaatctctttaaacctcttatcatcaaaacttgtaatggctgatcaactataactcaattccatattccctactacaaactcaatcaaatctgttccatttatttcattctacactcaattctgccacttcagcaatgctgaattactcacagttccctgagtaacccacaatgttttatgaaataaccctcccttgaaatggacacttgaaatggacacattcacttgcttggacgttccccacccttatccctcacctacccaataccaattcagctgactactccaaaccctatccctcacctgcccaataccaattcagctgactactccccacccttatccctcacctaccaacaccaattcagctgagactcagctcaagttggcctcctaggggaaataaatcatcctctctagttactcgtttccttcccttatgctaccccagtacctgcacatcatgtcattctgtgctgataccaccaagcccagctaatttttaaattctttgtagatgctgggtctcctacgttgcctaggctagtatcaaactcctgggctcaagcaatcctcctgcctcatcctcaaaagtgctgggattacaggcatgagccactgtgcccagccctccaaaattatttctgacaaatacattatttgtaaataaatgggtagaagttgtctaaatgatttctcagagttgaggagcaagaaggcaggaagttagaccataacagaagttggaacatcttcttccccatcctcttcaatcaggccagctactttgtgacttcaagatggccaaagcttatgcttaataaggtctctcttctcctgcactgcccttcaatacccccacagccttaatgcccagatgacctggctagattttagcaagaaaataatctgattgttcccatggaaatgcagattggatctatcgtagtaacaaaaaccagccttctattccatctttcttcttttcttctccctaaaacttatcccagaaatactaccttgtacagtccctttcactgaaagcccagcctaagactttctagggtttgggtaataactatctaagtgaccttaaaccctcagacctggagaggcatcataggccttttaagatttgggatgggctgaaggaactgggctaatagacatttaatagctggggtttaactttcacagttctttggcctaatgacatggctattagtgcacaaggaaatgtcaaaaatgggaagaaacgtaggtcacaaaatattgcacaaagctatacttactttcacaaaatcatcctgatggatctgctgctccaggattggctcaaaatcttttgtcatcatatcagggtctgttgaccttagagaaacacaaacaaaaatgattttgttttcatgtaacaatttgccattcctaagtacctatggcactgtaagctaaggagctggagttagtctgaacaagcagacagaattcatccaaaatgctttgacttaaaaaaacaacaatgacaaaaaacccaaaaagctttccctagataagtcacctggtgcttatgctcagctattaatgtgtgtacattgaacttaaaagtccacaaagccctcctccactaacttcaacactccttgtccccaagtacctctaaatataaatgtcatcagtggagctggtttactaaactcatctggaatgatggacttaaaggggaaaaacagcaacagaacccaagaagggcttttagaatgtgtccatacgcaactcttagaataagttaaaatacatattgctgacatttttaactctaactggggactagcagcctccccaagttttatgactttgtttcttactcccaaagacttaaaaagttactgaaacaactttttataatgatagactaagaggcaaaacttcagtcaccaaaaaaaaatactctacgttttatatatatatacacacacacatacataattggtattatactggttcaaattggtattatactggttcaaagaaattttttgaaattcaagcagcctaaagctgatgagcctgtaagacatctggaataatgttttaaaaaagccagtgaggcaccagtaacaagctacctgtggcaagaagcaccagctcttggtcaggactccaactcataacagagataccatggctacactcccaacacactccagctgagacagagaaaattgaaaagagagattcaaaactagcatctcagtaaaaactgactgcaacttcaatcaaaacaattaaaaaaacaaaacaaaagacatcagtatatggaagagatatctgcactctcatgtttgttgcagctctgttccaatagctaagatttggaagcaacctaagtgtccatcaatggatgactggataaagaaatgtggtactatacacaatggagtactattcagccataaaaaaagaataagatcctgtcactgcaacaacatagatggaactggagatgattacattaagtgaaataaaccagacacaaaagacaaacatcacatgttctcacttatttgtgcgatctaaaaatcaaaacaattgaaccacggacacagagagtacaaggatggttaccagaggctgggaagggtagtgaggggctggggaagttgggatggttaataggtacaaaaaaaaatagaataaataagacctgctatttatagcacaacaaggtaactacagtcaacagtaattgcacattttaaaataactaaaagatgtaattggattgtttgtaacacaaaggataaacgcttgatgggatggatatcctattcccatgatgtggttattttgcactgcatgcctgtatcagaacatctcatgtagcccataatatatgtacctactatgtactcataaaaattaaaaatttatatttaaaaattaaaacaaaacttactcaacaaacatttcttcagtaatggatatcaagagaatagacctgttattagcacagggattagaaataaatatctttttcttcccagagctgtctcacgagggagataaagaagaccctacagaggataacagcaatgaccaagatctctggaaagcaaaatgcgtctcgcacagggaatgacaagtggcccaaagtccagaaaaagtttttctgacgtgtttcaaaggtggtaataaggacaggaaagagagaccaggaagaaaacacagtgtagaggcacaaagcagaaaaaagagcagttaaaaatcagctgcaactaaaacataaggtttacgtacacacagaacaatggggggatgaggctaaaaaggaatgtggggaacagatagtgaaaggggcttataggcacaatagtgggctctacctttcagacaattgagaagccactaaagggcagaatcacaccattaaatgaagataaatagactggaagagctcagtaaccaggaaacaatgctacaaatgtttggaaagtaaaagcatctatctttcaaatacgaaaaaaaaacaagctgtatatacaagtttgatatttcccaccatgaactgcaagtaaaggtttatgattgtactaaatggatggttaagagcagaggtgccagatttagactgctagggtcaaaccccatttgattacttgtgaccctggtctaattacttaagcactctgtgccttaactgcctcttctgaagaatagaaacaacaacctactgcataaggtcatggtgaagattaaataaatttgcatgaaaagcctttaaaaagtgccaggcacatgatagttaataaatgtaagctgctatcattatcctacattagtaatactctaacttctgtgacataatcaatgttaaggagatcacaactaatgaataatggaagaagatttaaagaatcagccaagtgtaatttgaaacccttgctgttaagaagtgaggatagaaatcagaaactcaactatacactaaagtagagaaagaagcaattgcttaagtctagctctactggcagtcatcacatgtgcaggtaatgacaatgtatttactttaggcctagacttcagggactctaaatttagccaatcaacattcataacagaaaatctaagtagataaacaaagacttcctaaattgagaaacaaaggttgcaactcaagatgagggtctgtaagaggtgatctacaccacataagaatagccagttttaacttttaaaaaaatatattccatttggaacattctgatcactctgattaatagatgcagcagacaaaactcagttttagagaatcttaacatatagataaagccatgttaacaattttttaaataaagaaatatataagcaaaaattaattagcaaaagtgtaactattatggctactgatttgaaaacttccacaatagcaagtaacctatttgaggatgcttgagactcccccctcactggagtcttccacttactgttgtgtgctgagactgcagagtatgacgtctccagaggctgtggccacacacacagctcctgatccagcaagtcctgaacaccaacaatgcggccacttccatcctctgggagaagccttctgccaccaaagaaacttcatttttcacctttcaccaaagtaaacacaagcaaataacccagtctactttcaagaataattgataacatttccagaaatactttttaatgcttttttattacataaaagctttcaaaaatattttttctagatgaaaatccaaactttcattgagaaatatcactactctgtcatctctaacaagaaaaataggtaatgtgacctttttgcaaacaaacacaaaaacaaaaacaataagcctggtctctttaaaattgtccactaaaatagatgctaatagctatgcttttctaagatttctatagtatggggaaaaggcactaaaggagtaactgcctaaaatgtattagtagaagaacataatcaagggaccatatcaaaaccaaccacagaggtttttaaagtacatatagttaggagccaacactaaagattctgatttagttacatgagatgtgggctcaaacttttagaaagctccatgggcaactttcgtgttcattccaattaaaaaccactcttggccgggcgctgaggcaggcggatcacgaggtcaggagatcagaccatcctggctaacacggtgaaaccgcacatctactaaaaatacaaaaaattagccggcgcggtggcgggcgcctgtagtcccagcttctcgggaggctgaggcaggagaatggtggaacccggggaggcggagcttgcagtgagccacgatcacaccactgcactccagcctggtgacagagcgagactccgtctcaaaaaaaaaaaaaaaaaaaccactcttataaacagaattgcatgacaaagagggtaaaaagtacggcacacactcaaaaagtaaggtcagagttctctgacttaggttaaaatagcagcagagttaaagaaggattacgatttaagctatgtctacatggcatatatatgaagcaaaagatgtttatttgggaggatataaattcaataagataaaagaaagaccatgtggggaaagaaatttggaagaagagaaatcaagggtcatacccactgctggcattctacatcagtaacttacttctcttgagacagggtctacttctatcaggcatgttctgaaccaatgagcaccgtcccctgttcagttcggagagagaagcactgaggatccctggaccttgaatatccctgaactccagggtccgaaataatttcagatttcgcatgagaagtgattcccacgagacaagtacaactatcccttgatgaatcattaatctctaagagaaaataaatagcttaatagtgataaatgaccatatttatttaaatgaaatgattcaggggtgaagaagtggtagtcagaatcagaataaccaagaaaagaaaaaacttacctctctgatacacacccatgtatggattatagcagcaacctgacccactctatacagttatggtctaaaattaggaattctgaaacctattttatgttctttttaggagaggcaagattctcaacttagaatgttttcttcaaaaaagatgtaatatcagttattcctttgggaaagttgaaagacaaatgaatggggaaacattttatttttgcatattaggacatctttataaaatcatgagaaaaacaaaagggtatcccactgattagcactatttgaaaatccatttttatatactggagttgaagagaatctgaaatgactttaatattcaccaggtctattcatttataaactggtttatacattcataaaaaaactgaaatcaaagatagaaaagcatttactgttctaaagggaagagaaaatactgggacatgacaacaatttacttcaaaatgatgaccaacatttcaagaccctgatgacctgacataactacttccagtaactttgttcttctggccaggcttttccaggacaatataaaacgtgagaaaagagtgctaaacaagacatctactttggtctggcaaatcaggcttgcttaaatgcataacattacctaagtaggggaaaaaaatgttactgtgcagttatttatattcagatccctttaaggcttatgattgtaagtccctaacttatgttagggtagcaattacaaggaccacaccggtcttattgtcactttaatccaaggagacttctccatcttggcaccccacatatgtatgacatagaaagaataaagatgaatcaatcctaatatacacagaagataatgtcaagtgtcataggaattatataatatataatgtgggataagaaaaggtaagtttatatatgatggaagtgaggaagacaatgattttagtaagttttggtgcaattatattcaagaactgctagaaattacttgaacctctaacatatcatgcaggttttttgttttttgagacggagtttcgctcttattgcccaggctggggtgcaatggcgcgatccggctcaccgcaacatctgcctcccgggttcaagcgattctcctgcctcagcctccggatagctgggattacaggcgcccggcaccatgcccagttaatttttgtatttttagtagagcagggtttcaccatgttggccaggctgttcttgaactcctaacctcaagtgatccaccccctctgcctcccaaagtgctgggattacaggcctgagccaccgtgcctggctgcgttttcatctttaaacatcataaaaacgcctcaaaactagtttctctgaaatttcacacccatcgccttattcccttatcttctcggaggaagacttccctccacttctttccaggctaggaaggaatatcctccatattgccacaggacctaggcctattagtactctttcttggacatctcaacctccaaccttcctgcctccactgattcaaactcttcgcagttcttaaatgtgctaagatccctccacaccaaaggtcaatcgtggattctctcttaatttcctgataactgcttattttcttcccttgctccttcgactatccacctcttggctagacatcacatgcatgattcatataccaggtagatcaccaatacgctgattaggcctaaatgcctagccctgactgaatagcccaaacttaccactaaacccacattttcaacctcctgatagaatcacaagcatgttcacatgcacatcaaatgcgacctggaaagcaaagaacttgctattcttcccccaaatgcagttcccactatttggggacagaccatttctactctatgtccccaagctgaaaaactgctttgctgcctttttgcttactcttcatacggatctattcattgattagttccgtggcttcaatatacagttgaattctttacgatccggtttgtggcctacatccaacaccgactgacacttgctaagtactgggatctgaagattactcagccactgtctccacggagatcatcgtaacgggagagaaagccacgtaaaacaccacgttagatggagaagcacagaggacaccactccacgaaaaagtctcacacgcgagaaaggacccgcaccacagcacccgagcctctataaccgccgccttccatcgtgaattaatactctcgctttcagcgttattatcaaccccctcaagcaatcaagaggctgggttaagtccggctggaggggcagcaggcatccctgggctgcgcgcctcccagcgcccccgatggagcaggtggcaaggctgcaaaaagaatttaaggcttaggaaagaggtggtgcagcccgcactccagtccccggcccgcagcaggcagaggaggcccgggtctccttcacccggacaccgccggcggagaggtccactcccgtgcccctaccctgatggatcgcttacctgaggacccccaaacagaggtgcgtccggcctcgcctccccagcacgcgcagccggctacccagagtcagctcccacagtccgcacccagagtcggctccgaatgcgcacgcgtctctgtccgcggctcccgctctctctccgacggcactaggcctccaagatggaggcgccctccaggggaaaacgctgaagcgctgcaaagaagccagcgactcaatggtgcgtcaactaggcagccgcagcactgggagtgcggcgcgggagtgacgtcaccaggcgagggggcgaggccgggcccgcttctggtcacttacggcggccggccttctttgtaggctggcaccgtagaggtagaggagctacattggccgcgtcccctgtccctctgccctcttgccatctgcccaaacttttgtatttgatctctgttttgatgtcgaaccccaaagcactgtattggggggggcgggggggggggtggaacctgcggacctgagagcagcgcgcgtgcgcagacacgcgctgtgcgccggaagagcacgcccagtccgggctgcgcggaggaagcgctgggtcccggagggcgggggtggcggcgccggaggtcgccatggctaccgagcccgaagccgggagccggtggtgccttcgctcgtggatcgatacttcactcgctggtacaaaccgggtagtgcggagtgatgttgatccctccttggccgcactggcctaatgctgtgtagactatgtgacagatcataagccacgcgcgctctccctggctctccgtccccacgtcagaaggcactgacttctgtgttccgtctagccccagggaatggcatttgcaaagacctggtggcctgaatacttcagggcgcattctggggccggcgattgcagtgcgagctctagggtgttgctcgcgtaagatgagtactctaaacggaggccccaaaggtaggcggagggctaggttgcaacagccttaagtgcctggagggattgaggggctcactctcacagggagtagcgatacataaaatatttaaatgatcagatcgaaactaaggtagaggcagtagggatggcgagaagagggtggttagattagagacatttagaaagaagaagaatctatacatttaccttaagagacgccactgccacttagaagtaggtattctttttgtactgttttgtgtaagcagaaccagtggtggagcatcgttggggactctcctttcttcctttcattcagtgataatggttatactcagttaaaaaatatatattgtagcatattttctgttggccaaacatagggtgaccaacctgtctagttcacccatgactgaggggtttcccagaatgtcggacttgcaccaacatcaggacatcctggaaaccaccaacaaaaaatatatatcataaagaacgggatgctaattgcattttctagcaaaaatactacgtgtactcattttgaagtgagtgtaaagtaagatggagcaagggttaattaccttaatgttgaataaattattctatctgggccagatctctttaaatacttctaggaaacctttaggtatgtctttttgagtaatgaagggatacccgtgatcagcatgcgcatgtatgtgtccagtcttcattatcaactatatgacccaaagaaagtaccacatagtgtagtaaatattgatttcagccaccaacagactcatgtattcttctagatgtcaaaggaaattttgtgaggaccactgtatactacagcactctaaccggtaagcaaattgggaatttaaattatcaaaaatttttttttcctggtattgtagcctggtatggtcttgtggtcttggttgaacaaatgttcactaaacaaacatgcattaattatcttctactgtgttgaaatggtttattataggagtttgtttggcaagaatgagtattccagtgcctggccactctgaacattaaatttgattactcaaacatccaaatggaggaccacatcatcagctgctacttgaagtgccagtctgtgcccaactactgaactgttcagagcccacagaaagggctacggtagagaatgtatggtatctcgtatacacaggcatgccttatttctttgtcttctaccccagtgctcctacctaaagacctctggtactcttccctttcctgggaaagaaattcaatcttgtttttcttttattattgtattctctattctacagttatgccccaatagtagccaaaggaaaaaggggaagatgatagtttgactaaacaaataccagttcatacattcttgttccaataggattatgggaggaaaaattattccaagcaatcacacaggatcaactttttctccttgtagatatgtgtcatcacattggcagaatctcatccagttcttcaaagtggaaaaacaattaaagcatttcctatcagatcagtaccaactgtagcagacttcagaacaaggtctctgggaaattaagcgggtatgttcctgtaattctgtgattatctacttacatcctctatattcatggaatgacagatccaatgaaccttagaatccagtagcatatgcttagcatacttctctagcgtttgaggtgctaattttaggtatactttcacctaaagaaattctcagctcccccaaataggtatctcaggaggtgtagtatctgttatattaggttctgtgctactatccctataatcccaggatggaggagggggaaggcaggcctttgaaaggagaactctaatagcaatataaaagatattttgtcccttctagttgtattaaactagtatgtcgagttctgtaaaatttagtgactaactcttctttaccatatatttccacatgtaaattaaacagaaaaaaaattcccagggagttagaaaaaaaaaaagaaaaacatgggccggtcacaatggctcacgcctataactcagcattttgggagaccaaggtgggtggatcatgaggtcaggagtttgagactagccggccaacggggtgaaaacccatctctataaaaatacaaaaattagccaggcacagtagtggcacctgtaatcccagccactcgggaggctgaggcaggagaatggcttgaacctgggagcggaggttgcagtgagctgagatcgcaccactgcactccagcctgagcggcagagcaaaccaagactccgtctcaaaaaaacaaaaacaaaaacatgaatacgagaaaatatatttgtccttactgtttttccattcctaaagcattgtcaatgtaatactcatgtacccacccccgtacctgcacacaacactcggttatatagaatgctatctctaccctctgtaactctaggaaaatggacagattattaaaagagtatcatgccaaggagaatttagtgacatgttaaaagtcttaacaaacccactggttgggaaagtttctgtggatgatttaagtcgttcatttacgagttcatactaagagtttctgctaattgctctcactattctaggagacccttattcaacccccctttgtaggcctgaagtcccctaataattactgatttattgtgctttacaattatgatttttcctcactcaagaaactagtggacttagaaaagcatgcacctctcttaaacgtagtctacaagttacaataacacttaagacttctgaagtttcaatgataaatctctgtcaaaatagtaacacttaaggcaggtacagttgctcatgcctgtaatcccagcactttgggagccgaggcgggaagatcacttgaggccaggaatttgtgacaaacctaggcaacataacagacctcatttctaccaaaaaaaaaaaatttttttttaattagctgggcatggtggcattgcctatagtcccagttacccaggaggctgaggtaagaggattgcttgagcacaggagtaaggctgcagtgagccatgatggcagcactgcactccagcctggatgacagaacaagacctgtctcaaaaaaaaaaaaaaaaaaaagtaacactcctgttacaagtgaagaacagagaggacctgcatattgaacccactacagtaagttttcactggatctcagaactgccaatcatctcccaaaggaggtgacaaaaaggcatcaaaacatttctgctgttttggcacagacctgctcttttgtgtctgctcttttaacacaagccttccccttccttccaaaagcagaaagtacaatgactctagtattttaaaatgaagaacccacgtgcggaggagtgaagccaatatataatatctgaatgccatctaaaaatgttttgagtggtaaataaaggggtcataaagaatgcatcttaacctgaaatgcctatgtccactacaggaaaaattcatgggagaaaagagggaacacatgaaacatgcctgcactggctctcatgagcctccctgtagatacttgtgagagctccccaggtatatccatctagtggagtacatgaaacaataaccatgccatgacattcaatacatacacatcaaaatgtagtattgactcatgggtcaattatttttattttgctgctaaaacttttgttttccacattttcctcaaagtgcatgtttttgtttttgtttttcttaatagaaaaaatatcccttactaacacactggggaattacaaaggggggggggggaaagaaaatatcccttcttcaaaaagtcttagtgattgaccctggtaaataagttcctttatctataagttctaatattaaaatgaggtagaaatcttaatgaaactaactttatacaatattgtgtcatactgtgtcatgttgaattttatattgtttcttgttgatggattttcccatactttgaaatctttatacctggttatatgtagctttttcatttacagttgataaaatatatttcagtctgtaaattcccatttatcatgtgtcttagcttttttccctagacctaggatggacctggcacacagtaggtacttatattcatataggttctgaaattaatgaatggttttttatactgaagtaactgatttaaaacaccagttccaggaatacatcctgttatacacctagggctacttctcaaaggaaagtggaaatgtccatcaactgattacttcttccgtctcatacacagggggcacagtttctaacagagcttgcacctctctgtaagatttactgctcagaggtgaagaatatactgtgtctaggtgagtaactttttagccaccatttaggagaccaaaggaggtaattttttttcttagaaacaattttttttaactaagtaaacatgctgaaatctaaatttttttaatagttgtgttagaggacgtttgatggaagtgaatgaaaacatcctcctaagccatctattcttcaagaaaaggtaaaagagagagaaaaaatatgatctcatccactaccttttattggtttttttttcatcgtttgacagtactaaatgttctttcctttccagcatctactgaaggctacattgcagttgtgttacccaaatttgaagaaagtaaaagcatacagaagggttactgacacaaaaacaatatgaagaagtcatggtgaaacgcattaatgcccaacagctacgtcatgaggattgacatggaacaaaaagcaaagtgggattcttgttaccggcctaaaccatcagggtactaaaggagaagaaccagtatatgtaaagcatacctaacaccagccatatgcaggggaggcctagtgcttcacttagttttccctctctgtcttcataagagccttggttcccatttgtctacagcctgccagatctggcctgcccatgtactcacacgttctcttgcatctctctaacaactggcatgcaaggcatgtttttctgattaaaaacaacaaagctctttgaagaagatttagaaaatacagaagagttttaagtagccaagtaaaaaaatttacccatcatcccataatccagaagtaaatacatttgacccttgagcaacataggttgaactgcaagggtccacttatgcatggactattttcaactataaacgagtcaaaaattatcattaaccaaacacgaaacccacttatagagcaggttcatatactcaggttccaaaggccaactgcaggacttgagttctcacgtatggatttgggtatatgtggaagttcctggaccaatcccctatgtaaaccaagggataactactacattttaacctacttctgtttgaaatatggtatggttattgcttttgcctcgttttcctaacagtttgaagtttaaaaaaaccaacccacctttcttacccagtcttctataatgtgcctaccaaaaagcctagtcctagccatctgcctcaactcctctcccttttaggttgtagggaa

SEQ ID NO: 5056 - DNA, 18467 bp, Homo sapiens
taaaaatttatatttaaaaattaaaacaagaacttactcaacaaacatttcttcagtaaggatatcaagagaatagacctgttattaggcacagggattagaaataaatatctttttctcccagagctgtctcacgagggagataaaagaagaccctacagaggataacagcaatgacaagatctctggaaagcaaaatgcgtctcagcacagggaatgacaagtggcccaaagtcagaaaaagtttttctgacgtgtttcaaagagtggtaataaggacaggaaagagagaccagaagaaaacacagtgtagaggcacaaagccagaaaaaagagcagttaaaaatcagctgcactaaaacataaggtttacgtacacacaggaacaatggggggatgaggctaaaaaggaagtggggaacagatagtgaaaggggcttataaggcacaatagtgggctctacctttcagaaattgagaagccactaaagggcagaatcagcaccattaaatgaagataaatagactggagagctcagtaaccaggaaacaatgctacaaaatgtttggaaagtaaaagcatctatcttcaaatacgaaaaaaaaacaagctgtatatgacaagtttgatatttcccaccatgaactgaagtaaaggtttatgattgtactaaatggaatggttaagagcagaggtgccagatttagctgctagggtcaaaccccatttgattactgtgtgaccctggtctaattacttaagcacttgtgccttaactgcctcttctgaagaataggaaacaacaacctactgcataaggtcatgtgaagattaaataaatttgcatgaaaagcactttaaaaagtgccaggcacatgatagttataaatgtaagctgctatcattatcctactattagtaatactctaacttctgtgacatatcaatgttaaggagatcacaactaatgaagtaatggaagaagatttaaagaatcagccagtgtaatttgaaacccttgctgttaagaaggtgaggatagaaatcagaaactcaactatcactaaagtagagaaagaagcaattgcttgaagtctagctctactggcagtcatcacattgcaggtaatgacaatgtatttactttagtgcctagacttcagggactctaaatttagcaatcaacattcataacagaaaatctaagtcagataaacaaagacttcctaaattgagaacaaaggttgcaactcaagatgagggtctgataagaggtgatctacaccacataagaataccagttttaacttttaaaaaaatatattctcatttggaacattctgatcactctgattatagatgcagcagacaaaactcagttttagaagaatcttaacatatagataaagccatgtaacaattttttaaataaagaaatatataatgcaaaaattaattagcaaaagtgtaactatatggctactgatttgaaaacttccacaaatagcaagtaacctatttgaggatgcttgaactcccccctcactggagtcttccacttacctgttgtgtgctgagactgcagagtatgagtctccagaggctgtggccacacacacagactcctgatccagcaagtcctgaacaccaaaatgcggccacttccatcctctgggagaaagccttctgccaccaaagaaacttcattttcacctttcaccaaagtaaacacaagcaaattaacccagtctactttcaagaataattgaaacatttccagaaatactttttaatgcttcttttattacataaaagctttcaaaaatatttttctagatgaaaatccaaactttcatttgagaaatatcactactctgtcatctctaaaagaaaaataggtaatgtgacctttttgccaaacaaacacaaaaacaaaaacaataagctggtctctttaaaattgtccactaaaatatgatgctaatagctatgcttttctaagattctatagtatggggaaaaggcactaaaggatgtaactgcctaaaatgtattagtagaagacataatcaagggaccatatcaaaaccaacccacagaggtttttaaagtacatatagttagagccaacactaaagattctgatttagttgacatgagatgtgggctcaaacttttagaagctccatgggcaactttcgtgttcattcccaattaaaaaccactcttggccgggcgctgggcaggcggatcacgaggtcaggagatcaagaccatcctggctaacacggtgaaaccgccatctactaaaaatacaaaaaattagccgggcgcggtggcgggcgcctgtagtcccagctctcgggaggctgaggcaggagaatggtgtgaacccggggaggcggagcttgcagtgagcacgatcacaccactgcactccagcctgggtgacagagcgagactccgtctcaaaaaaaaaaaaaaaaaaccactcttataaacagaatttgcatgacaaagagggtaaaaagtacggacacactcaaaaagtaaggtcagagttctactgacttaggttaaaatagcagcagagttaagaaggattacgatttaagctatgtctaacatggcatatatatgaagcaaaagatgttatttgggaggatataaattcaataagatataaagaaagaccatgtggggaaagaaatttgaagaagagaaatcaagggtcatacccacatgctggcattctacatcagtaacttactttcttgagacagggtctacttctatcaggccatgttctgaaccaatgagcaccgtcccctttcagttcggagagagaagcactgaggattccctggaccttgaatatccctgaactccaggtccgaaataatttcagatttcgcatgatgaagtgattcccacgagacaagtacaacttcccttgatgaatcattaatctctaagagaaaaataaatagcttaatagtgataaatgacatatttatttaaatgaaatgattcagggggtgaagaagtggtagtcagaatcagaataccaagaaaagaaaaaacttacctctctgagtacacacccatgtatggattatagcagcacctgacccactctatacagttatggtctacaaattaggaattctgaaacctattttatgtctttttaggagaggcaagattctcaactttagaatgttttcttcaaaaaagatgtaattcagttattcctttgggaaagttgaaagaacaaatgaatggggaaacattttatttttgatattaggacatctttataaaatcatgaggaaaaacaaaagggtatcccactgattagcctatttgaaaatccatttttatatactggcagttgaagagaatctgaaatgactttaatttcaccaggtctattcatttataaactggttttatacattcataaaaaaactgaaatcaagatagaaaagcatttactgttctaaaggggaagagaaaatactgggacatgacaacaattacttcaaaatgatgaccaacatttcaaggaccctgatgacctgacataactacttccgtaactttgttcttctggccaggcttttcccaggacaatataaaacgtgagaaaagagtctaaacaagacatctactttggtctggcaaaatcaggcttgcttaaatgcataacattactaagtaggggaaaaaaatgttactgtgctagttatttatattcagatccctttaaggctatgattgtaagtccctaacttatgttaggggtagcaattacaaggaccacaccggtctattgtcactttaatccaaggagacttctctcatcttggcaccccacatatgtatgacatgaaagaataaagatgaatcaatcctaatagtacacagaagataatgtcaagtgtcatagaattatataatatataatgtgggataagagaaaggtaagtttatatatgatggaagtgagaagacaatgattttagtaagttttggtgacaattatattcaagaactgctagaaattattgaacctctaacatatcatgcaggtttttttgttttttgagacggagtttcgctcttatgcccaggctggggtgcaatggcgcgatctcggctcaccgcaacatctgcctcccgggtcaagcgattctcctgcctcagcctccggagtagctgggattacaggcgcccggcaccatcccagttaatttttgtatttttagtagagacagggtttcaccatgttggccaggctgttttgaactcctaacctcaagtgatccacccgcctctgcctcccaaagtgctgggattacagcctgagccaccgtgcctggctgcgtttttcatctttaaacatcataaaaacgcctcaaactagtttctctgaaatttcacacccatcagccttattcccttatcttctcggaggaagcttccctccacttctttccaggctaggaaaggaatatcctccatattgccacaggacctggcctattagtactctttcttggacatctgcaacctccaaccttcctgcctccactgatcaaactcttcgcagttcttaaatgtgctaaagatccctccacaccaaaggtcaatcgtgattctctcttaatttcctgataactgcttcattttcttcccttgctccttcgactatcccctcttggctagacatcacatgcatgattacatataccaggtagatcaccaatacgctgttaggcctaaatgcctagccctgactgaattagcccaaacttaccactaaacccacatttcaacctcctgatagaatcacaagcatgtctcacatgcacatcaaatgcgacctggaaacaaagaacttgctattcttcccccaaatgacagttcccactatttggggacagaccattctactctatgtccccaagctgaaaaactgtctttgctgcctttttgcttactcttcataggatctattcattgattagttccgtggctgtcaatatacagttgaattctttacgatccgtttgtggcctacatccaacaccgactgagcacttgctaagtactgggatctgaagattctcagccactgtctccacggagatcatcgttaacgggagagaaagccacgtaaaacacccgttagatggagaagcacagaggacaccacctccacgaaaaagtctcacacgcgagaaagacccgcaccacagcacccgagcctctattaaccgccgccttccatcgtgaattaatacctcgctttcagcgttattatcaaccccctgcaagcaatcaagaggctgggttaagtccgctggaggggcagcaggcatccctgggctgtcgcgcctcccagcgcccccgatggagcagtggcaaggctgcaaaaagaatttaaggctctaggaaagaggtggtgcagcccgcactccgtccccggcccgcagcaggcagaggaggctccgggtctccttcacccggacaccgccggggagaggtccactcccgtgcccctaccctggatggatcgcttacctgaggacccccaaaagaggtgcgtccggcctcgcctccccagccacgcgcagccggctacccagagtcagctccacagtccgcacccagagtcggctccgaattgcgcacgcgtctctgtccgcggctcccgtctctctccgacggcactaggcctccaaggatggaggcgccctccaggggaaaacgctgagcgctgcaaagaagccagcgactcaatgggtgcgtcaactaggcagccgcagcactggagtgcggcgcgggagtgacgtcaccaggcggagggggcgaggccgggcccgcttctggtacttacggcggccggccttctttgtaggcctggcaccgtagaggtagaggagctacattgccgcgtcccctgtccctctgccctcttgcccatctgcccaaacttttgtatttgatcttgttttgatgtcgaaccccaaagcactgtaattggggggggcgggggggggggtggaactgcggacctgagagcagcgcgcgtgcgcacgacacgcgctgtgcgccggaagagcacgccagtccgggctgcgcggaggaagcgctggggtcccggagggcgggggtggcggcgccggggtcgccatggctaccgagcccgaagccgcggagccggtggtgccttcgctcgtggatcatacttcactcgctggtacaaaccgggtaagtgcggagtgatgttgatccctccttggcgcactggcctaatgctgtgtagactatgttgacagatcataagccacgcgcgctctcccggctctccgtccccacgtcagaaggcactggacttctgtgttccgtctagccccagggatggcatttgcaaagacctggtggcctgaaatacttcagggcgcattctggggccggcgatgcagtgcgagctctagggtgttgctcgcagtaagatgagtactctaaacggaggccccaaggtaggcggagggctaggttgcaacagtccttaagtgcctggagggattgaggggctactctcacagggagtagcgatacataaaattatttaaatgatcagatcgaaactaaggtgaggcagtagggatggcgagaagagggtgggttagattagagacatttagaaagaagaaaatctatacatttaccttaagagacgccatctgccacttagaagtaggtattctttttgactgttttgtgtaagcagaaccagtggtgggagcatcgttggggactctcctttcttccttcattcagtgataatggttatactcagtttaaaaaatatatattgtagcatattttctttggccaaacatagggtgaccaacctgtcctagttcacccatgactgaggggtttcccaaatgtcggacttgcaccaacatcaggacagtcctggaaaccaccaacaaaaaatatatacataaagaacgggatgctaattgcattttcctagcaaaaatactacgtgtactcattttaagtgagtgtaaagtaagatggagcaaggagttaattaccttaatgttgaataaattatctatctgggccagatctctttaaatactttctaggaaacctttaggtatgtctttttgataatgaagggatacccgtgatcagcatgcagcatgtatgtgtccagtcttcattatcaatatatgacccaaagaaagtaccacatagtggtagtaaatattgatttcagccaccaacaactcatgtattcttctagatgtcaaaggaaaattttgtgaggaccactgtatactacagactctaaccggtaagcaaattgggaattttaaattatcaaaaatttttttttcctggtatgtagcctggtatggtcttgtggtcttggattgaacaaatgttcactaaacaaacatgcttaattatcttctactgtgttgaaatggtattattataggagtttgtttggcaagaatggtattccagtgcctggccactctgaacatataaatttgattactcaaacatccaaatggggaccacatcatcagctgctacttgaagtggccagtctgtgcccaactactgaactgttagagcccacagaaagggctacggtagagacatgtatggtatctcgtatacacaggcatgcttatttctttgtcttctaccccagtgctacctacctaaagacctctggtactcttcccttcctgggaaagaaattcaatcttgttttctcttttattattgtattctctattctacattatgccccaatagtagccaaaggaaaaagggggaagatgatagtttgactaaacaaatccagttcatacattcttgttccaataggagttatgggaggaaaaattattccaagcaatacacaggatcaactttttctccttgtagaatatgtgtcatcacattggcagaatctcatcagttcttcaaagtggaaaaacaattaaaagcatttcctatcagatcagtaccaactgtgcagacttcagaacaaggtctctgggaaatttaagcgggtatgttcctgtaattctgtgttatctacttacatcctctatattcatggtaatgacagatccaatgaaccttagaatccgtagcatatgcttagcatacttctctagcagtttgaggtgctaattttaggtatactttacctaaagaaattctcagctcccccaaattaggtatctcaggaggtgtagtatctgttaattaggttctgtgctactatccctataatgcccaggatggaggagggggaaggcaggccttgaaaggagaactctaatagcaatataacaagatattttgtcccttctagttgtattaactagtatgtcgagttctgtaaaatttaggtgactaactcttctttaccatatatttcccatgtaaattaaacagaaaaaaaattcccaagggagttagaaaaaaaaaaagaaaaacagggccggtcacaatggctcacgcctataatctcagcattttgggagaccaaggtgggtgatcatgaggtcaggagtttgagactagcctggccaacggggtgaaaacccatctctataaaatacaaaaattagccaggcacagtagtgggcacctgtaatcccagccactcgggaggtgaggcaggagaatggcttgaacctgggaggcggaggttgcagtgagctgagatcgcacactgcactccagcctgagcggcagagcaagaccaagactccgtctcaaaaaaacaaaaaaaaaacatgaatacgagaaaatatatttgctccttactgtttttccattcctaaagcatgtcaatgtaatactcatgtacccaccccctgtacctgcacacaacactcggttatatagatgctatctctaccctctgtaactctaggcaaaatggacagattattaaaagagtatcagccaaggagaatttagtgacatgttaaaatgtcttaacaaacccactggttgggaaagttctgtggatgatttaagtcgttcatttactgagttcatactaagagtttctgctaattgtctcactattctaggagacccttattcaaacccccctttgtaggcctgaagtcccctaaaattactgatttattgtgctttacaattactgatttttcctcactcaagaaactagtggcttagaaaagcatgcacctctcttaaacgatagtctacaagttacaataacacttaagattctgaagtttcaatgataaatctctgtccaaaatagtaacacttaaggcaggtacagtgctcatgcctgtaatcccagcactttgggaagccgaggcgggaagatcacttgaggccagaatttgtgacaaacctaggcaacataacaagacctcatttctaccaaaaaaaaaaaattttttttaattagctgggcatggtggcatgtgcctatagtcccagttacccaggaggctaggtaagaggattgcttgagcacaggagtcaaggctgcagtgagccatgatggcagcacgcactccagcctggatgacagaacaagaccctgtctcaaaaaaaaaaaaaaaaaaaagtacactcctgttacaagtgaagaacagagagggacctgcatattgaacccactacagtaattttcactggatctcagaactgccaatcattctcccaaaggaggtgacaaaaaggcatcaaacatttctgctgttttggcacagacctagctcttttgtgtctgctcttttaacacaaccttccccttccttccaaaagcagaaagtcacaatgactctagtattttaaaatgaagacccacgtgcggaggagtgaagccaatatagtaatatctgaatgccatctaaaaatgtttgagtggtaaataaaggggtcataaagaatagcatcttaacctgaaatgcctatgtccacacaggaaaaattcatgggagaaaagagggcaacacatgaaacatgcctgcactggctctatgagcctccctgtagatacttgtgagagcctccccaggtatatccatctagtggagtaatgaaacaataaccatgccatgacattcaaatacatacacatcaaaatgtagtattgaccatgggtcaattatttttattttgctgcttaaaacttttgttttccacattttcctcaagtgcatgtttttgtttttgtttttcttaactagaaaaaatatcccttactaacacactgggaattacaaaggggggggggggaaagaacaatatcccttcttcaaaaagtcttagtgatgaccctggtaaataagttcctttatctattaagttctaatattaaaatgaggtagaaacttaatgaaactaactttatacaatattgctgtcatactgtgtcatgttgaattttatatgtttcttgttgatggattttcccatacttttgaaatctttatacctggttatatgtagtttttcatttacagttgataaaatatattatcagtctgtaaattcccatttatcatgtgcttagcttttttccctagacctaggatggcacctggcacacagtaggtacttatattcaataggttctgaaattaatgaatggtttttatatactgaagtaactgatttaaaacaccattccaggaatacatcctgttatacacctaagggctacttctcaaaggaaagtggaaatgccatcaactgattacttcttccgtctcattacacagggggcacagtttctaacagagctgcacctctctgtaagatttactgctcagatggtgaagaatatactgtgtctaggtgagtactttttagccaccatttaggagaccaaagggaggtaattttttttcttagaaacaatttttttaactaagtaaacatgctgaaatcttaaatttttttaatagttgtgttagaggactttgatggaagtgaatgaaaacatcctccataagccatctattcttcaagaaaaggtaaagagagagaaaaaatatgatctcatccacataccttttattggtttttttttcatcgttgacagtactaaatgttctttcctttccagccatctactgaaggctacattgcagttgtgtacccaaatttgaagaaagtaaaagcataacagaagggttactgacacaaaaacaatataagaagtcatggtgaaacgcattaatgccacaacagctacgtcatgaggattgacatggacaaaaagcaaagtgggattcttgttacctggcctaaaccatcagggtactaaaggagagaaccagtatatgtaaagcatacctaacagccagccatatgcaggggaggcctagtgctcacttagttttccctctctgtcttcataatgagccttggttcccatttgtctacagcctccagatctggcctgcccatgtactcacactgttctcttgcatctctctaacaactggcagcaaggcatgtttttctgattaaaaacaaacaaagctctttgaagaagatttagaaaatcagaagagttttaagtagccaagtaaaaataatttacccatcatcccataatccagaagaaatacatttgacccttgagcaacataggtttgaactgcaagggtccacttatgcatggctattttcaactataaacgagtcaaaaatatatcattaaccaaacacgaaacccacttaagagcaggttcatatactcaggttccaaagggccaactgcaggacttgagttctcacgttggatttgggtatatgtggaagttcctggaaccaatcccctatgtaaaccaagggataatactacattttaacctacttctgtttgaacatatggtatggttattgcttttgcctcgtttcctaacagtttgaagtttaaaaaaacctaacccacctttcttacccagtcttctatatgtgcctaccaaaaagcctagtcctagcccatctgcctcaactcctctcccttttaggtgtagggaagaggccggagtgtagagtatattatatcttctgtcccccttatgccaacaaatggccttcccctctgaaacaaagtaaaactgcaacactgtgacttcttaaatgagggaatgtgaaaaggctatgaaaaatacaaaggctttcctaggaaatgtgttataatgcagcggaagctaattcttgaaatatgcacattatagttactcagtctcacatactctagttactgcaaagaagttactgagaatatgtcattcaaaggcataggggcctttgaatggaacaaagctttcacatcatttaaagtaaaaaaaaacctccaacaactgtgaatttatagtttaaggtgatttacactgaatttcaaataaaaggactataaaacgtgttatttttctgtaagggtataacatacatgtcaatatcactgtttttaaataaaatatacttttatacagaagaaacattcgatgtattaattccattggttatctatcctcttatgctgttgaagtcataagttccccttcccaacccccacttgctctttctttcactagagaacagtattttttcaggtatcaaaaatattatctaatgaaagtacaagtgggggttggaatttttaagttttaattattacaaaataatacttacttattttgtaaataaaacaacattttggttcataggaaaaactgtaatctgagtgccagcatgactatccccctaaatataccccccagacatgatacatgtgtaagtggataaacacctccatgatggtgctattagctgaaaatataaacaaaccagcaatcctcactttaagtagcacaatgactcttgaaggcgtcataaaactatgacagtaaactagtaaaagaattgtgtataacattttacatgtaacattacctcacatcattctcccatatttctattgtaatttaaaagagtactttggtttcagagaataaaaatcatgcttaatgttttgactgtttaaggaaagattttaaaaaggttattaacagagctgagtgcatcacatttctcccgaaggactacagtgaaaattttcctcaataaaatattgactagctgtggtcattggcattactgtggttcttccggatcttttgtgaatactgattgtggtggctgacccaataaagatcatcagataagcttatattatctactgccatttgataactgacataccctgtagatttcaaaatgaatgtcaaagcattaagatacaaatactacgactgaagtctaacaaaagttggccatactatattataaggagaaaacctataaaccagatccttcaatcatgacccacccacaaaaacaagaaaagctttaaactcctaaattaaaaagactaaagaaagatttttttgttttgttttatagtgaacatttcaaatgtgtgatattcagaatttaaatagatcttggcttccttattctgtctttgtcttccattccatcaatcaatactgagaaagttcaaatatcttttaagtctataagataggcttagaatcccagctaatattcagggcagactgccagctatgctagaactagaaccaaaaacccatctcatactctccaggagttgttccagattctgtggagttccattaccttacttttgggagtaggtgagggacatacacagcacacagacccacccttgctgtacaaaatgcttattagggaacaaacttgctgctggcatggaaatctgggacagggtcatcaaggggatttttgtcacacttggtaaacagagggattgaaagtccacaggtttaaggaaaaccctgcattcacccagactactgtatgtttgctgctgaattagtgatctagatgataaagaaaacagttaaggtaaaatatgccaaagctaagcacaattcaaaatagcttcttgtggattaaattgtccttgagacagttgggatatttggtttgcttttaaagaacattagtgcaatgttctattttaaaaatcacactacaattagaatctacaattaccaagacatttattagttgtcaaaaagctttacaatcagtttcatgatcagaaatagagcaaaatttcaatattgttttctttataaaattgatgaatttctgaaaagataaggatcatttgatttttaaaaatgtcagcttcatcacatgatgttccagagatctgacccaaaagcttctcaagttttactatccatagtgtccttatttgtaactgagacccatccgtattttccatctgaagctggaaagagttaagacaattagtatctggtttcactctgaaaaaaaattacaaaattaagtagtaactattttcttttaaaccattttttaaagtatgagtcaaaatagaaaaactacctcaccttcttcagcagtttataacaaagtgaaagaagttggataagagagccatcatggatcttgtcttcgtaatacacttgtcaacctacaatgacaaaagcatgcaaatgatattctaaaagtagtacttaaaagaccttaccatttatttagttttacatgataaaatttctccatatggaaatctaagggatcttgaaagagatatggatttaggacatgagctgactcaaagccccaggacacaggtgcaggggtagctgcctagatttcatgctatctcatggaaccccagcagaaagagtgggtggaaaattaatcattctactgcaggcgtttaggggcttctcaaaacactccaaatagtggaattaaatcccatcctttgcaattcttgcactctattttgtgggcacaaacccatattctctcagacaaattatgggagaccagctcggaggcacctgtgtcctagttgcagaggtaatgacttcagaattgaagggcagctgtcagtgctatggaattaatgatgtccaaaaaactactttatttggtgaatctgctactcctggggtcagttatgagagtagataataaatgattcttgtagacaaggcatgaaaaaagaaataaattgcccttctgtgggtactaacagtttatttgaagaaaaaggggctttaaccgataaagatagatgtgtgaaagtttttcatatgtctcttttacctttagaaatactttatctgcaaagaagtcttagttactgtctggagctggtggcatagaggaattagcttgttttttccaggagaagcataagcttgtcatcgtctttcagctgaaatgtaatttaacaagtttaacagcccgcaacaaaactccatctttaataccttaaacacatttatacattgatatttacccccaaagtaggttatacataataccaccaccagctccaggtaggtagacatgtgtacctgttttgaaaaagcttgaacactggaagtaagctttaaaccctctgcagcaaaaactggtagaaagagaaaacaccactattttagactgatgtctatggatagttggtaagaaaatacttactaataatttttacgtagaattttaaaaataaagcctagatataaaaagtcttcaggaactcctaaactttttccagtaccaggaatgcacaagggtttaactgttttcagaggagtttccacagaccagatgcagaatccatccctggagaggcttctctacaccagactccaattattctggagggtcacacagacctgtgatattcagccacacaaattatgtctaattacgcaagggacctagagctcatctcaaatatgctcaattataaaaggatgatgaatttcaagcatgaggtcaaaagggttaggaccttcccaattccatctaggcaagacaaaattgtcacccatacatattccataaccagacatttgagagaaccaatccaggtggttggttttgttgccactttttttcagattaattttcactattcaccatgtaccatgaattctatatttaatgagatgaacaggatgatggagaagtagagtgaaaaagaaggttgtacaggtaaacagaagtatttagcatattatgttaaaatggtttgcagactattttagagtgagatgcaggggagtaaagggaggaaggcttagttttaggtggcgtcagtaataatggagagaacaggaaaatctgagagtggtttgtgaatgaaaataataggtcttcataataaattaaagaaactaagaaggaggaggcaataattccagggttaatttttaccctctattcaaaaggcttacaccttgctatcactggataaaatgatctcaaggtcaaatcgtactttgcaaccttcctttaaaagggaaaccagtaagctttacatctagactccaaccaaatgaaatgattcactccccaagtgttccttatcacttcatgttaccactttctattctgcaaattttctctttcttctagcctgcaaaccccttggggacaaaatccatgtctgtctcatacagtatgatggtttaaaactacctgaaagctggtaactcccaggtctctctctccactcctgaactatcctacatcagtcttgtacagtcatccctcagtatccatgggagattggttcccagacctcccaaggataccaaaatctgtagatgcttaagtcccttaaataaaacagtgtagtatttgcaataacctacacacatcatcccataaactttaaatcatctcatctctaaattataatatcaagttaatgtaaatgctaagtaaatcgcagttatactgtattgttttccctcccttggactctaaccttttaaaatgtattttgtttttttttactgttgttatattttattggttttttccttttttttttttttttgagacagggtctcactctgttgtccagagtgaagtgaagggtgtgatcacagctcactacagccttgacctcccaggctcaagcgatcctcctgcctcgctgcctgagtagctaggattacaggtgtgtgccaccatgccccgctagtttttttttttttgttttgtttttttgtagagacaaggtctcactatgttgccccagctggtctcaaaccctggactcaagtgatcctcccagcttggtctcccaaagtgctagggttacaggagtgaccattgtgcccagactgtttttactgttttgaatattttcaatccatagttggttgaattgcagatgcaaaacctgcagatagggagggccaagtgtatatcctatctgacctttgtattaacatgtgcaaaacaaaatgctcgatttccaccctctaaatctagtgttctccctcatgttccctgtctcagaaaatggcactaccactcactctgttggccaagccaaaaaccttcttaaaacataataggatcagctgggcatagtggctcaggcctgtaatcccagcactttggaggctgaggcgggcgaatcacaaggtcaagagatcgagaccatcctggccaacatgggaaaccctgtctctactaaaaatacaaaaattagctgggcgtggtagcgcacacctgtatcccagctactcgggaggctgaggcagaagaatcacttgaacccgggaggcggaggctgagtgagccgagatcgtgccactgcactccagcctgacaacagagcgagactaagtctcaaaaaaaaaaaaaaaaagtccttcccatggcctacagagacatcatattttacccctttcttctggctcacttcactcccatcaataattgcctccttactcttctgatacacccagcctacccctgcacctcggggctttgcacttgttttggctatctaaaatcctctacccacattatccatccaactctcacttcattactgtctctattcaaacactggctccttagagaggcttttctgaccacccctctatcacctctgtattctagtcgtacgtgattttatctccaatacttacatatgtgcactgaatgcttaaattcttattgtctatattctgccattagaactaagctctatgggggcaggagctttgctttgttcacttttctccacagagctctgttctccagatctgacatatagcacaagttcaataaatatttgttgaatgaagtatgcaatttttgttcatcacagtttggagacaattcattgaacattgatttaatgactaagctcacatagaagaaggtaagtagtggatcttttgtagtaaaacacccctacagggcggtatgacagatggacttgggccaaactgaaaaaaaaaataaattcagaatttcaactatcttaagggaa

SEQ ID NO: 5057 - DNA, 84502 bp, Homo sapiens
  misc_feature (4422)..(4440): n is a, c, g, or t
gttgttttgagacagagtctcactctgtcacccaggctggagtgcaatagcaggatctcactcactgtaaccttcacctcctgggttcaagcaattctcttgcctcagcctcccaagttctgggactacaggtgtgtgccaccatgcccagctagtttttgtattttcagtagagacaggtttcaccacggtggccaggctggtctcaaactcgtgaccttaagtgatccatcagttcagcctcccaaagtactaggatacagatgtgagccactaagcccagtctttttcttgttgtttttctgagacagggtctcgctctgtcacccaggctgtaaggtagtggcatgatcaagctcaccgcagccttgacctcccggactcaagtgatcctcccacctcagcctccttagagctgggaccacaggtgtgtgccaccacaccaaacaaatttttaaactttttagtagagtggggttttattgcccagggtggttttgaactcctgggctcaagtgatcttcctgttccgtctcactgtctcagcctcccaagctatatatatataatttttttttttttttaaagacgggtctggcactgtcttccagactggagtgcagtggtgcaattacagctcactgaagcctgacctcctgggctccagtgagcctcctgccttagcctcccaagtagctgggaccacagtgtgcacaaccatgcctgactgatttttaaatttttttgtggagatgggggtctcactaattgcacaggctggtctcaaactcctgggcccaaacaatcctcccaccttggcctcccaagtgctgggattacaggcgtgagccaccacactcagtccaagcttacctttttacatgtttctataacatgtaaagggttggaagcactggtttagggaactgtgtcttatggaaatgtatatttttaaacactggactcacaattggctcagtggaacaatgacattatgagaaaccacagaaatgaagacccccccagggaagcatatatttgcttatttctgagtatgcagagtgaattccagtaagtgaatctctaatagaaatagatctctagccagatgtgggttgcatcctgtaatcccagctactctgaaggctgagggaggctgaggcaggaggattgcttgagccaggcattcaagaccagcctaggaaaaacagtgggactctatctcaaaaaaaaaaaaaaaaggaaaccgatctctaggtctaagagttaatgctttgaagttgcttaaagaaaataaaaagcttatcttttgtagacattcagaaagaagggaagtctatcaaacagtcacactctattattgcaagctagttcatttatttgtctgaaatacatttccccacgttgtccaatgatagaaagaccaaagtagaattaaaatcaaccaaaccaaaacgaacaaaaattcctataaattctatcttgctttattagtaaagacttcagtaatagctcttctgcttctttagagtttagtataaaattacagattttttttttaggtgagaaaatttgttattttagccaagccttaaatttgccatcaatttagatgatgtaaaatttgagttgtttcccctattgttaaaataataggctgggtgcagtggctcatgcctgtaatcccaacactttgggaggctgaggctaggggtcgcttgagttcaggagtttgaggccagcctgggcaacacagtgaagccttatatcacaaaatattaaaaattagccaggcttggtggcacatggctgtagtgccagctctctgaaggctgaggcaggaggatcacttgagcccaggagttggaggctgtagtaaactatgatctaccactgcattccagtctgggtgacagagtgagactctgccgctaaaaacattacaaaagtaaacagattattgtctacccctgcttataatatctaagagacaataagctcatattaaagaaatatttgagaagttcttgaatattctatgtcattaaatgctagctttggttctgatgacaatggaaccatcatatcaaatctggggtgcacaccttcgacatttatcttatgagaccattgttatttaggttctattataggcagtgaaacttaaatacactatgggttgcctcgtgaattcttactacccacagatgttacagtcactgtttttacaattgaagaaacaagtttcagggaggcaagtaatcagctttggaaacagcaaggagacactaagacaataggctggaaagagactgaggccaaatcatagcgaatcctcaatgtcctctgaccagtgatggcagcatcagtgttcaagaaaggttttcctcatagttccatgagggataaattgtgatcatttaaagattattgtgttaatctatgcacaagataagagtacgagtagaaatctgcagtaggtaaaagtgaaaagactttgtgatccattgaatgtgatgtgggagccaagataaatctttttggagtactgctcctttatgtggtaaaaaagatatctaataagacttagtgctcattttgtactttgaaaatatatccattacaataaatatattaacattgaacacttgcagattaagtgccatattttttagtgaatttccatagattgtttcctttggtattaaaaatgctgggcatgggccccactttttggccgaaattcctttggaccaactttaaccagttggcctctcttaattattaacacttcctgttgtctctgacttttctgtttcactgtccttgatagatacttatatttccaaatttatcctacttgtataacctagcccatgcttggcaccaagctacacatttagccaggaacacatggggttatctgattagtgcagatggctgcagatacgaattttggccaggtaataataaggaagtatacctaggcccaaggagaacagacctaaagctttccatgggaaaccgataatatcaacagtgggtcctgtgggttgatggttgcaggagcaggagggcaagcacagaagacagcaatcttgagggtttgtgtaagaggatttgtggtggaaaatcagagtttgagtcttgggtccaacaatttatccactatgtgatttatggtaaattatcaatgttctgatttacaaaagggatataatacctccaatgtaaaattgcttataagtaggggctccataaatgtttcttgaatctgaattttcgattctgaccaattgaccacaaattgaaccaaaatggaccacagcaatcataaacataaaaattaggaagaattccaacagctaaaaatttttaaataaatagcttatgttttaagattaaataatgtcaatatgtctttgttatcaaattaatagtatgagggcttgtttagtaaaaatgctgagaatactttttgatttggaaaaatacatacaaagaataggtgggaataaataagattctgaaaaagaagacagggaaccgatgagagaaaaacgtggtgacaaaatgctctaacaaatattaaaacaaaactgtaatagtgaaataggtgaatgggcacagaaaacagtatattctagaagtagaccctctagtaaagaataatgcaagattaaaaaaggacttcccataaatcatattcaacttatagtttgggatttaacaatttggaaaaaaaagcctaagtaatgtctcatctcataccacatcacttataaaaaaaataaaactggaaatagaaacaatggttattattgagactgatgtaattttgaggagacagtagagattacaaacgtggaggcaagtgctgaaagatctgattaagaaaaaagctggccagaaatggtcacgcctatataatcagcactttgggaggctgaggtggaggattgcttgagcccatgaggttgagaccaagcctagacaacacagtgtggaccccatctctacaaaaaaagaattgcaaaagttaggtgggtgcagtagttgtacgcctgtcatctagctacttgggatgctgaggtgggagggtagtttgagcccaggaggttgagaccagctagacaacacagtgtggacccccatctctacaaaaaaagaaatgcaaaagttaggtggggcagtagttgtacgcctgtcatcctagctacttgggatgctgaggtgggagggtagtttagcccaggaggttgaggctgtaatgagctgtctgtcatcaggcttgggcagcaaagcaaactctttaaaaaaacaaaaacaaaacccctgctctaaccaaaataactacagccagaatacaaagtattagcactactctataattcaaggctcatacaaattgggggggttggnnnnnnnnnnnnnnnnnnntagaccctactagtaaagaataatgcaagattaaaaaaggacttccataaatcatattcaacttataagtttgggatttaacaatttggaaaaaaaagcctaataatgtctcatctcataccacatgcacttataaaaaaaataaaactggaaatagaaacatggttattattgagactgatgtaaattttgaggagacagtagagattacaaacgtggagcaagtgctgaaagatctgattaaagaaaaaagctggccagaaatggtcacgcctatatatcagcgagactctaaaacaataggggtgcagtatgtacgccgtatcctactacttgggagctgaggtgggaggatagtttgagcccaggaggttgagaccaagcctagacaacacagttggacccccatctctacaaaaaaagaaatgcaaaagttaggtgggtgcagtagttgtaccctgtcatcctagctacttgggatgctgaggtgggagggtagtttgagcccaggaggttaggctgtaatgagctgtctgtcatcaggcttgggcagcaaagcaagactctttaaaaaacaaaaacaaaacccctgctctaaccaaaataactacagccagaatgacaaagtattagcctactctataattcaaggctcatacaaattgggggggttgggggagggaaccaacaactctaagcaaattccatgagtttattatattggcacattgaggttctatgtaagtaattttgcaagtttgctgtggtagttacaggtttggatttttaggttaatatcttttatctgaagtgaagatatgcatatctgcagtaaaaagaaaccaacagaaactaaggcaaagaccaaacgatcaactttggtcattagatgcttttctataaatatgtatattattcagtaatacaataaaagtaaaaaaattttggctactttaggaggcaacgtatatatgtcttctggcctgtatgtttactgtaagttgatcaaaggtaaattaaaaattcacacttgagtaaaaggtttcagaagtaccaggaaagtgtgcagcttatttttatttattttaaaaaaattatttttattttccaggaggcccattgtcaccagaagtgtatagtttctaacagatttatacattggaagtgattttgctcctaatttcaacatgcctaatgaaataaataatcaaaacagtctaaaatcttcctcctctctgcctcctgcaaaaaggtaagcacctaaagtaggcaagcactgaataatgactctggtcagcactgacaaattaattgcctctaggaggctgaggcaggaggatcattgaggccaggaggctgagaccaacctagggaacatagtgtagaatcctgtctctacaaataaaaaataagtaaaaaataaaaaattagctgggtgcaatgactatgaatgaaagcaaatacagacctttagaaaatatttttattttcttaacacacagaggtaacaatgacatttcccactagacacagtagttcaagacatatcagaaatggatcacaattcacatgttacaaattcatcaatatgaccagtctcatgttttcccaattatctttgaaaacttattaaaatacacagcatactaaactggtaaattcatttatcatgttaaagagtaattttgattttgatagtgaaaaaccaaggcatagtccattgttgaaatacaataccttatccagcatcactcagtatgaagcattctaccgaaacgtttagtcaaatgacacctgttaaaaatctaattctgattttaactaccatagaggaaataatgtttaacatgccttcttaaactttaaaatatacacgcagaatataacaatgttctttcattaatcttcctcattagaaatatgaaccacttattttctagtgcaacacaatatcctaaaaatttaccaacgtgggtatctgccttactagaataaccccaaatggctacattaaaaaaattgtgaacttttaatttttttggtcacatttactgtcagcgattacttcttgctttgattaaatatgctggttttctgttacctttcctactccctgaatatcaaagttagggtacagcaacaaaactacataaacctttgataaactatggttctctcaaggacagtcattccttttacccgcacagtttagagaagggtatatattaacaaggaaggaactgaagaagaaagggagatttggaaaccaatgtccaatgtatttatgatagtggtcagattactgtcacaactgtccttaaatttgtaggatttaatctattttattttggaaaccagaaaactaagctagttaaaactatttctaaagcaaggtcagctttgagaagagcaggcagataatcttaaagtaaattacacgagctttcaagcatgggtatttgaatctgaagcatttatatatttttgctgcccagaagttttagtttgctggttttcttcttaatttcttagtcatagttaaggttttgggtatgtaacctgtaaactaactaaaaaaatgtactttgaaagtagcattattttaaaataccattattttattaggtataaatgagccacgaatattatatagcaatgaaagaattcttgccactactttcttccaactgaatgcataagatttaactgttttcttaagaaaacagtaaaaaacagtaaaaaattctatctaggaaatagttctatgaaaaaatgttaactcatgtaaatgttaaaaacctttttccttttgtgacttaagatttttaaggcatcttaaaataagttatcatgaaaaacttccagtgattttattgatttaagatatctactgaattcatatccatatttttgttaagattcttctcaatgttaacttgtcaatgtaggttttgagttaatagaaaaccagtatctactatgatctagcaatagtttttgaacatgactaaagatagttgagttttagaaaactaatataacattcttttttcttaaagttctagaaatatgaccgacaatttccattttgaaaatgtaagctatcttataaactcaatagaactcaatactaattttacaaaactgtttttaggaaataaatttcctaatctttgcatgtttcctcacataagtaaatcatataaaatatactgttggcattcattacaaaaaattaatatatcagtgaaaaaatgaaagcatagtttgaacatctgtgctccatttagaacatatattgtagatggaaacttctatcattcatcatttattaaatatttattaaatcagtgagcactgtattaagaatactatagtacgtggtgttaatattaatgaaccacagctattcagtatgtattgttactgaagattatatataccacaattaaaagctatcttttcattctttcattattttcatattttattttcatttctgtacaaatagaagatgacatgattttcttttccaaactatggatttctaggcatttgaataattcttactgaactcaaacacattcattggtaatgatatttctttctgattcaaattgaaatctacctctgtacattaaaaaaatcaatgcttttacaatcttacctaattgagcatcaatattataataaatgagattttaaaacaacttgagcctgtgcatataaggcatttacatatgatgaccttgcatcctatatacaagtaattgcatacttaatatctgtaataaactataaatcataaagtgtctcaagatagtagcaattgaccaggcttgtgtttcacagctgaaaggacagtactgggcattctcatggtcagttctggaagtcctttccaaggggatctgaatgaaagaaaagacattttacaagacataatttaattcatattaacaaaataggcaagacctggtgatttttgccttctagttagaaaataatcatatgtagtcatttgctacaaaataaaacaatatcctaaagacatacaatgaatttagactgaaattattctttgacattccatctttggaatttgagacttttaatacaaggaatccctttatgtattaaaaacatagaagaaactaccattacaagctacataaaacatagagataaatactctctcaggcataattttgtttatgagactcaaattgtaatatgcagatgtgttatgtgtgatcttgataaaactgtaaaagtaaaagtaatgaagaaacctaagaactatgattaggcggaaaaatggcattccagaatactttctacttaaagaaaaaatgccaattaatttctctttctactgaataataaacttggtatttattatgcatttatttctaatactgcttttatgtatattatctcatttaatgttcacagtaaccctgtaaggaggtaccataagtattcctatctatagagaggtaagagagatttatagaggttaaataactgttccagccctccttatcagaacacagtgatgttagcacatcaaatttattgttaattcaatgtaatcccttaaaaatgaaaacaaattcaaaaagtacagacatctgtaatgtttctttttaagttgggttgtgggaacatatttgtttcattactatggtttgtatctcagggcatattacatacacgcttcagtgggcatcaaatacttcatagtaaaaatgggaaaaaatatcccattaggtaaaacagggtattttggataataactaatatcagctaggtaccatattaaaaaactgtcatagaaacatggaaaatatagaaaatgtatgtttccaagtattcaagcacatcagagtaaaatgccaaatgactgaagttggatacctgggcatctgtaatgtgttgattacatctccacagaatttgtatgttgaagtcctagccccgagtacctcagaatgtgacctgtttggaaatcgggtcactgcagatgtaattagttaagataatgccacatgaagatggagttttgctgccacaagccacaggattatcagcagctaggagacagggctggaagagcctttccctaatgccttcagagggagcatggctctgcccatgccttgatttttcagattctggcctccagaactgtgagacaatattctgctgtttaacaatttctattatttaagtcctcagtttgtagtgctctgttactgcagctctagcaaactaacagataccaaaattaaaaacaaaatgaggttacaaaaccatgaatatgctgcccataattacacttggacactaggcatggaatgtatccatacaaatataaggaagtcccctttcccttgctttcctgaaaaatcatcctgaagtcattaggtgggacagagcaaggtaggtgaccagaaatggaggggaaaggtaataggtagtatggagcaggatgttagagtccaagaggtatgaagagggagtccaccagggtgagagtggtccagagtgggtagttagaatccaagtggtgccaggagggctccaccatagaggtggcttactgtggggtagcaggcccaagctgggtgagcagactctatgtggggtgatggcccaatgtgggaagtaggttattcattgttggaaaagggaattacaaatatgaaagggagaaaaatagaattaaacactgagaaatagcttggaactggtgtaaactcagttttcaacacacatagacaggatacattgagatgaagataagtgtgtatgtatttactttgtttatgtattattatatattccctagccctatctactgggggtcatagtaataataatacaccatgtgctcagatctggcttctaaataacatttttcactataaagaacaagggaccttagagaattgcccaattccaggctggggtagtgaaagtgaaagatgagtgttgaaaccttgctgggccagaaagcaaggaaggacttccatatgtgacaaacaggaagtagtatgacagaatttccctcctgtctgatacaactgaagaactggacattaagacattagacattggcaacaaatagcgatccttgaaggatgagaaacaaatgaagcaaaccctatgattacctaccttactgccttgagagtttccaggatttggcacagagagggggaacacaggtggagctggcagacttccttgagttgaactgagaatccaggaacactacaaagcagctacaattgcaggatagagtactagagaggaaggagctgtacaaagagagaactctgaagatatgcaagggtcccactcaagtatctgtagtgtaccaaccagcaaattcacaagaggaaactaccaagaacaaggaaagaaccatccaaaaggatgagaagaagcagtatgtggcactcatacacgtcaggaacacttgcttgttcccaccagccagatttgaaaacgtcataattttcgaaaacagggtagggaacacagatgggtcttgattcactaatggagaataattattcctagacaaatgctattctggtcaggtctaacaagcttaaaatcaagaccagaaaggatcaaactgttccaagtaatttcactgcattccaaaacaaagctcaaaaacatttacagaaacaccaaaatctagcacccaacaaggtaaaattcacatctggtatctaataaaaaataaccaggcaatggctgggtgtggtggctcatgcctgtaatctcagcacttcaggaggccgaggttggggactgcttgagcctaggagttcgagaccagcctgggcaagatagcaagacccctgtcgcccaaaaatcaaaaaacaaaaactaccaagcaaagaagcagggtgatatgacccaaaataagagaacaatcacaagcaaaagcaacccagaaatgaattagcagacaaggatattaaaaagtcactgtaatcatattccacatgttcaaaacattaagcagagacatggaagatataaaacagcccagataaaactttgagaaatgaaaactacaacgttgaaatgaaaaacaccagatggatgtgatggtaggttagacataaaaatgatgcagatttcttatcaaaacaatgtaccaccttaaagtatgaaagagaaaaaagcttaactttgaattctatacatagtgaaaattctttaaaataaaggcaaaacacagatgttttacacttataagaattgaaagaattcatatgaggaggcaaacactacaagacatgatggagaaagtccttcgggtagaaggaaaatgtacaagatggagatacagaacatcacaaacatatgaagagcactgaaaatggcaactatagagtaattagactttttaatatattatttaaagatcattaaaacataactgactgcctaacaaatgtagtaaccatgtagtgtggggggtaataacaggtaaaagcaaaatggatgagatgatagcacacaggccgggaggggaaaaataaaactatactattttaaggatctttaaccttacttgaagtggtatatcactggaaggtaaactataaagacatatactataaaccaaagcagccattttaaataaacaagaattacatctaattagccaacaaaggagattaaatgaaataataaatattcaatgcaaaagaagcacaaaaagaggaaaaagctaacaaagaaagacagaataaacagacaacaaacatttaaatttcacaatttcagaccttaagtgtaaaggtctaaatattccaaaagcagaaactgttgtgctacacgagagcaaggcccgattacagctactatgtacaagaaagccactttaaatacaaagacataaatagcttaaaaggatggaaaatctgtaccatggtgacaaccaaacaaaacagaccaggagtggctctattaatatgaacacgcagaagtcccttatgtgcttgtaagaaaggagataaaatttgtgctgtttattattatctgaggaatagaatatagatatacttaggtataatctaaaatttgaggaattaaatacactctgaatttatactcttataaagatacgtaactctgacactgtctatttgctataattaggacaaggaagtgaaaaatgttttttgaactaacaggcaaaagaccagttctgtattttaactataatgaaagcatttctgaaaactatttcttgatatatctttaaatcaataactcaaaaggcccaggctgagtaccttcagtttttatatttatcctgtgctaaccactccaaaaacatcagggaaattttaaaaatcaaagactattccacatgtataaatcgcacatatcaagacctcaacttaaaataaataacaacccaaaataagagaaagtgaaaattattaacagaatttgtcatgttaaagaataaaggcttcacttttcattgggatacctagggctacagaaatcaattctaagaaactgtaatttacctaatagctaataaactgactaaacatagttatggaaattacatgctcctgatgacttacctctcaagatgaacataatgtcgggaagaacatttttaaccaaaactatagtctttgcagtagtctccgggcccatcaatctggaaaatataattttgcacgaagaaaatacccaataggccacagccactcctaaaaaagatatttaaaagacaaaaaaaaccataaatacctaaaaattacttgaaaaataatttaaactaaactcagaagataaatgaaattcttacaggtccttggtgataattgaaacctttagcagattgtagttgtcattgtctaatgcattgtcataaattccacagtaaaccatatcactgaaaatgattgaaatttaagttaaataaaagatgatcagatattatgtaaaaagcattagaaaatttcaataacaaaggtaagagaaataatcaattattttgtcttctacagaataagtcggcattagtacatcatccatctaaccttaaattagtacatactgagttcacaggacttaatcatgtgttaaaaatgattaacaaatactggttaatataaaaaatgtaaaatattcggtatcttgccttaaagaagttagcctggcactaaatatggcttggtttaaagtcaacttttcctaggcctctaatatattgaagcctatctaataattgaaatatatatagaataattgaattaataaaaattaaagacatggttttattaattatagattggaaaggtgatttttagcttctccataaaattattttaaaattaaaattggcctattatcggattacaaatagcactgaatatacatattgctttattgtaatacatggaacttataacacagttatctatacccatttgttacttttctttttttggagagctggtcacaagagtcagctttaattgtgagtttggtgtgtgtgtgcgtgtgtgtgtgtgtgttttaatacagtgtctcattctgtcaagaggctggagtgcagtggtgccatcatagctcactacagccttgatctcctgggctcaaggatactcctgccttagcctcctgagtagctaggactacaggtgtacacaatctctcccactaattttttttttaacttttatttttgtagagatggcatctccttttgttgccctggcaaaaaaaaaaaattatggttgatgtcaatgtatttggattaaatatgataacattcttatacttatattccaacttactctggatctaaagttttcatgccaaggggaccaagcaatttttttctgcaatctccaaagctttccatgctttttctgtagtaaagagctcaggggcctgtgaatgccaaaaacaaatatacaaatttttaagatcacagaagaattagttcctaccccagaaactattcataagcttgaaaaaaattacttaaaataccatgagggtcagaatttggtgtagatgcctaaacagatctaatcctatgaggctgacttagaaggactgtttttggcgtagaagttaggaaagcctttagaggtgattatttctctgtgtcacctcaagaaagttatcagctccaaaaggaagttgccacagctacactgaaggcagaacacacttttattttaaccctttggagacagggtctcactctgtcaccaggctggggtgcagtggcgagatcagagtcagtgcagcctcaatctcctgggctcaagcgatcatcctgccttagcctcttgagcagtgggactacaggtgtgtaccaccacaaatggctaatttttttttaaatttttgtggagagaagtctcactatgttgcccaggctgatcttgaactcctgagctcaaatgatcctccaactcagcctcccaaagtgttggaattacaggtgtgagccactgaacccagacagcacacattaaatttatgtaactcattcttcagcagattcataatagctttctttaagtacatctgtacccattgtttgcttctggggccataaataaacacagaacttttactccaatagcatggtaaatttatcagagatacagagaaagaagagaaaagcattgttgaccaagaatatgcataattttaatggtccacgctgaaccaaagctacctttgtgtacttttacacttttcatttactataatttatagtagtaggtttggtactctttttgacaacgtgaaaacagctagccggcatagaagaacacataccttctctattttacttccttgtagtttatttttagactaagtatagatttaaaacagcagagagtctaaaattctttgccggacaaactgattgcagcatgcaacaatgaaaacagaatgttaactaaagctatccactttagttcactagttcagggtttccaactagtgtgctgaggcactggttatagcacaggtgtgtaggatacagagaccccagctttcagggtagctgggtggggcctggggctaactgaagtagttggatctagcacagcagcctactccatgtaacctattgtgctatacaaatatcattttcttttcttttctttcaaatatggtggtggggcttcattatgatatccaggctggtctcaaactcctgggctgagtgatcctcctgcctcagtccgccaagtgtgtgagccactgcatctggccacaaataactcttctatgtgtgctctgaatgtgaaaaactctaggaagcacttcattagtcatcatctttactttcggcttttggatactgaatgttacaggttaaaagtgatacgcataatacttgttaattaggaaagactatttaaaactagctagtaagcaatatactactttttagcaatgagtgaatttgaaaacaaatgggaataaggaactaagcaaactctagcacatcattttttaaatgtttttacaaacgaatcacctaccacaaccattgctatggtaaaattaggcctgactgatagtcacaccaaggacttgaagctccataactatctttgtatatgccacgtttgtaaccagatttggatgcttttcatttaaatctgaagggtcttcggaaacatgaaatagctttcaaagttgtcttgtatttttctgttccactcatcatatgagacctttatagcctttctgaaaaatgacataagacatggtagttttaatcattcaaaacaattcacacatctagttcagacaaatagtaatatttagtttatttttatctactacaaggcaataaattatccactttggaaaatgtggccagtctgaattgagatgtgttataaatgtaaaatataagctggatatgaagatgtagcaccacccaaaaagaatgtaaaatagctcatgaataattttatattgttacatgttgaaacaatatcttatatacatacactgagttaaataaaatgtcttttttttttttaagacagcgtctggtattgtccacccaagctggagtgcagtagtatgaacttggtcaccgcaacctccgcttcctgggctcaagccatcctcccacctcagcctctcaagtagtgggactacaggctcacataaccacaccctactaatttttgtatttcttgtagacatggttttcatgttgcccaggatggtctcaaactcctgagctcaagcgatctgcctgccttggcccccaaagtgtggagattacaggcatgagccactgcacctggctgatttaataaaatacttgtaatcaatttcacctgcttctttttactttttaaaatgtgggtactataaaatttaaattatgtatgtggttcacattattttggacagcactattctagaaaaagacatgtaagattgcaaaattgctcacagaaatgcaacttgctcagtcacagtgaggaaaaagacatgacaataaaggcaacagctatgctgctttcttatctcagttcaaagttgcgacaaatatgttcaactagaattgttacaattttcacactagtaaattaatgaattttctttcttcttattttaagggttttccgatattagctgatagaatcaaatgatgattacataggttgagaaatacatagtacatttgaaggttctttgtaaataaaataaccagcttaccatgtctttttctgtgacttcatgataagggaaaatattttttttggataattccagcaaccagcgaacacagatttactcaggcccacaatttccacagcagacccatctctaaaattaaaaaacgtattttattctttaagttggcgtcctttaagtactatttaaagggcattcggtaaacaatttaatgaatcatataacatattatgaaaactattaaaaaatccttactctataggaatgttactatatcatgtaaagattttttcctctcacggttttgccattgtctatcatcctcactaattttaaaaaattctatgatgtagaatgggaattgtggaataaaagaagatggcagtggaaaaggtaggagtaaggaatctgaatattgggataaggtactagagaaaagatagcaacatgaaaaatagggctggagaaagtgagggaaggcagacacattaatttgaaagctcattttaagaaaaataaaagggaagtacaaggatctaatgtaccaaatagatttttaaaaactggtaaagcatgtaaagatggcaacttatttattaattattttttgtagagatggggctcactatgttgcccaagctggtttcaaactcctgggttcaagctatcctcccacctcaactcccaacctcccaaagtgttgagattacagacgtcagctaccacacccagtacacaacattttttggacaattcttactgaagataaaatttagaataaaaggccgagtgcagtggccatttctgtaatcccagcactttgggaggctgaggtgggtggatcatttaaggccaaaatttgagatcagcctggccaacatggtgaaacctcgtcttcactaaaaatacaaaaattacctgtctggtagtgtgcgcctgtagtccccaggtacttgggaggctgagacaggagaatgcttgaatctgggagacagaggctgcagtgagccatgattgtgctactgcactacaggcgggcaacagagtgaggctctctctttcaaaaaaaaaaattagaataagaaaataacttccagcttaatacagtatcagaagctattttaatagacattacttaatgggtacaaagtacttatttgggtgatagtaatattaaaagtgattttaatagcttatgatgatgtatttagctttgaaatgataaaaacttcttaaatgacaaacattaggaaaaaagatttaaaaattagaaaaaaggttcagaaagtgaaagaattgcataaaagacagaacaactggttgttttctagtttgcaaaagatgggcataatgaaatgtttacatcaataagcagttcaggttacgaaatgtcttaaccactgggataatgaatcataaatctttcctttgaggtgcttgtagagaataacccacgagcacttacagaaaagaacagatagtgttacttgataacttatatcaacagattgtgtaaatgtataatggggagatgaagggaagaaggcagggaaattttgattgactaatgtaaagagttcatagttaacagaataaaagattccacaagtaagtgctttcttaaaaagggtataattacacagcattataacatttacactaccttggtgtggctgggattccttgtttctagctctgtcactttctcccattttatccatccatgtgccacaattgaaacgattcctccataaacaaatcctgtttcttcatcaactcctgcagttatattaaaacctaaaaacaaaatgtgtataaaataaaattttataagtattatatatagtatatacaaatatttaaaacatttacaaaattttaaatataataaactaggacaaccactctaaagctcagtttgtggtatcttattattttgtatccagaatatacaagcacaaagttggagatgtgtatatctaccacataggaatttcatttctatatatattctagagaaacccttacttatgtgcactggagatgtgtacaaggatattcactgccacattgcttgcattcacaaaaaataactgccaatagaggaatggataaacactgtagtttattcatacaatgggaaaccctctataccattgaaattaatgaactggatttacatgtatcaaaatggagctaaataatgtatgtacatgacatagagtgtggaataatagataccagagactcagaagggtgagatgagagtgacagtgagaaattacttaatgggtacaatgtacattattttgctgatggttacactaaaagccagacttcacccttacccaatatatccatgcaacaaaactgcccttgtaccccttaaattatataaaaaagataaatctccaaaacaaaatgattgaataaaacaagttgcaaaaggactatatagtaagataacttttttgtaaaagtttaatcatagataatactggtatatctaaatctgtgtataatctcaaaacataaattattgattatagtatatattatagtacactgatatatgctatgtaatatatagcataagtaatttacacatactcaaacacacataactacgaaagttcaaaaacttctggtatgaaaaaggggagaagactcatttttccctgatcttctctcttaagtacaatgaaaatccctgagcataatacagtggactatcataagaggactcaaaagtgtaaagaggaaggcagattggctaggaacctcaagacttgaggaatgtcatagggtgagttccctggttttttttttctttttttaaaattctccatatataccagtctggggagatgtaaacttggaaaagcaacctgcaacctccaacaggtaatgacaaagagttccagaaaaaccaattgactctagccaaaggaaaaggaaagagggaccctacccagacagaaattttgtgacaacatccgccctgtgccagtaaacaccatggatgtcctttctccctggaagtcagtggagactgagtggaagcctggactcctatcccctacctgggggtagcagatggttaaggcagtgctccccttcctcagcagcgtggtacctgcgggcaccacgaggggaatcggggagtatgaacttccacacccaacctggcagtagtaggtggccttggggtggcagcagcagctcagggtgtttcccacccctgctgcatgatgttagcacaaactgggtggggagttagacttccacccccagtggaagcaggtcgttagggacagtgctcccctctcctgacagatgctgtcagcagagactgagtggagagtccggatttccatgccctgcccagcagtgatgggtgcccctcacactcccaactagagatttcagggaagatctgaagaggaggaagctgaaaaccacgctttaaagctgtataggaagtcctgggcaggctctgaccaatctacatgtaaacagatgagcattaacacacccaaaggtttgagaagtaaattacacagtgtggaattcactcaggtttcctgagtggcctcctgatagcccatgaatgaagtagaccagaataacctgctaaatattaaattgttactgaaaccacagcccacaagagtaggccagaagctgcatctaaacttaaataacggctacttggtaaaatgaaagatttcataggatccagtgtcctaaacatccaaaggtctaggaaaacacgaaaaactacttgtcaggccaagaaccaggaaaacgcaacctgaatgagaaaaggcaattaacaggtgacaacactgaggtgactcagatgttgaagtatctgacagaaaagcttaagggaggtatcataaaaatgctccaaagagaatgatctttgtagaaatagaaaattccatcttaaaataaatatggaatctccagggaccttgaaagccaaaacaatctagaaaaagaacaaagttagaagactcatgcttcctcatttcaaaattactacaaagctacactaaccaaaacagtgtggttctgtcataaagacagacacagagcctatggaacagagaacccagaaataaaccctgtatatgcagtcaaattttttttgacagggtgccaagaccattcattggggaagggacagtttatattttttttggcaaatggagcgagtaaactggatattcacatgcaaaaaaaaaaaatggacttggacttaatatcatatgaaaaattaactcaatatggatcaaagacctaaacacaagagttaaaactataaaattctagacaaaaatgtatggcaaaagcttcatgacattgaatttgatgaggcttttttgcatagatacaataggcacaggtaacaaaagtagataaattggacttaatcaaaatcagaaactttgtttatcaaaggatacttttaagatagtgaatagacaacccacaatatgggagaaaaatttgcaaaccatatctaataagtgtttcgtatccagaatatacaaagcaccctgcacccaataacaaaagaactcaattcattccctaaattcaaaggatgtgaatagacatttctcaaagaagatatatgtatgcctgcaagcacatgaagagatgctcaacatcactaagaaatattaaggaaatgcaaatcaaaaccattagataccacctcatagccatttaggatggctatagcaaaaaaaacaaaaaacaaaaacaaacgaacaaaaacaaaaaccaaaacaacaaaacaaaatccaaaaaaacaaacacagaaaaaaacaagtattggtgaggatatagatgaatgaagcctgtttactattagtaagagtgtaaaatggcacagccactgtggaagacagtacgtagttactcaaaaaggtcaacaaacaattatcatatgatccagcaagttctcttctaggagatacccaaaagaattgaaagcagggactcaaactgatatttgtacacccatgttcacgcagcattattcccaatagccaaaaggtggaaaaaacccaaatgtccattgacaaatgatggaaacacaaaatgtggtatatacatacaatggaatattattcagccttaaaaagaaagaaattctcatatgtatgataaggggttaatatccagaatatataagaaacttctacaatcaataaccaaaaaatcaaaaaccaattaaaaaatgggcaaagggcttcaatagacaatctccaaagaagacccataattggcaaacaaacatataaaaagatggttaacacttctaacattagggaaatgcaaatcaaaaccagaatgggatatcacctcacacccattaggatggaactatcaaaagaacagaaaataccaggtgttagcaaagttgcagagaaatttgaatagtgtgggaatgtaaatgttgcagccattatggagaatattatagaagtttctcaaaaaatagaaatagaattaacatacaatctagcattccactttgggtatatatacataaaaatgaagcaggatcctgaagagatatttgcatacacatgttaactgcagcattattctcaagagcaagagatggaagcaataaaatgcccactgacaatgaatgaataaagaaaatgtatgcaacaatggaatattatgcagccttgaaaaagaagggaatcctgtcacatgctatgagatgatgaaccttggcattatgctaagtggaaaaaatcagtcacaaaagaacaaatactgcatatttcactcatatgaagtatctaaagtagtcaaaatcacagggacagaaagcagacaggggttactaaggcctgggaagagtggggatagaggaggaagaactagtgtttcacgagtaagagtttgttttgcaaggtaaaaaagttctagagatctgttccacaacaatgttaatatcttaacactactgaactgtacacttgaaaatggctaaggtaaatttaacgttacatgcttttatcacaaaaaagacaaaaaaaggaataaaattatgacatctgctacaacatggctgacttcaaaagaattatgctaagtatgtacaactcttatgtattgataaaaaataattatctaagtgaaataagccaggtacaaaagggcaaagactgtatgattccgcttatatgaggccctaggataattgaatttatagaggcagaaagtaggatagtggttccaggggctggggaggagataatgaggagttcctgcttcaattaggaatgatgacaaagttctggagatggaagtgatgatggttgcacaacaatgtgattgtacttaaagccactgaattgtacacttaaatggctaaaattgtaacttttatggtaaaatggtaaatatacattatgtctattttacccaataaaaaaaaccaatagtaaaaacaaaacaaaacaaaacaaaaaacagcactccaatatacaattataaaacggacaaaagagattgagctcagtggctcatccctgtaatcccagactttaggaagctgaggcaagaggattgcttgaggtcaggaattcaagacaagcctgggaacatagggagactcccacctctacaaaaaaattaaaaaaagaaattagcctggttcagggtgcacacgtgtagtctcagctacttggcagtctgaggcaggaggactgcttaaacccggaattagaagttgagtgagctatgatgcaccactgccatccagtctcagtgacagagtggaccctgtctctaaaaaataataaagaaagagacaatgtgcaaaatacgtgaaccgactttcagcaaagagggaagatggatggccaatgagcacatgaaaagatattccataccatagccattagggaaatgcaaattaaaaccacaatgtccagcctggccaaaacatggcgaacctcatctctactaaaacaacaacaacaacaacaacaacaacaacaacaacaaatacaaaaattagctagttgtggtggcatgcacctgtagtccagctacttgggaggctgaggtacagaatcgtttgaacccaggaggcagagattgcagtgagctgagattgcgccactgcactcagctgggggacagagcaagactccatctcagacccacccccccaccacacacagtttgagtggtctatgaagctatctgaacagcttaaaagaaaggggtaccaccaaatgctggcagatgtagcaaaactggatctctccagtttgctggcgggaatttattaaaatggtaaaacctctggaaaatagtttggcagtttcttctaaaacaaaacatatacttactatatgaaccatcccattcttggacatttatcccagaaaaaatgaaaacttatgtgtcacacaaaaactgtacatgaatgttcacagtagctttactcgtattagccaaaacatgaaaacaacccaaagtccttcaatggatgaatggtttggatgaatggttaaataaatactggtatatgcataaagggaatactactcagcaataaaaaggaataaactattgataaatgcaacaacttggatgatcttaagggcattatgcacagtgaaaaaatcaatctcagaaggttatatagaacatgtttcattcatataacattctcaaaatgacaaaactatagagttgcagaacagattagtactgccagagagaccagggttgggggtggagtggtcaggtgtgaccataaaagggtacacaagatctttatggtgatggaccagttctgtatcttgattatggcagtggctacatgaagtatacatggggtcaaattgcacggatctacacatacacatatacacacaagtgaatgtaaaacttttaaaagttgaaaacatactaatgtcaatctcctgactctgatgctgtactggtgaagagttcatggcatactatgtatcattttttcaacttcttgtgagtctaatctttcaaattacaaagtttaaaaaacccacatgaacataaaacaatgcatgttttacaaaataatatataataaacacattggaatgactaaggggaatggggaataaaatgaaataaattacattagccttgcattggcggcgatgatagtgtgccatgagatgacgaatatggtgaactcagagaagttagaaaagcacatttattttaataccatatacaaataaacctttctacaaaagtattttgtaagtgcctaggctctcaagatagaccatgagtaaagtctacctctaccattagtagctatgtgactctgggcaagctactctgcttcagttatccagaatctacaaagactcaagcaaatttacaagaaaaaaacaaacaaccccatcaaaaagtgggcaaagacattatgcagccaacagacacatgaaaaaatgctcatcatcactggccatcagagaaatgcaatcaaaaccacaatgagataccatctcacaccagttagaatggcaatcattaaaaagtcggaaacaacaggtgctggagaggatgtggagaaataggaacacttttacactgttgggggactgttaactagttcaaccattgtggaagtcagtgtggcgattcctcagggatctagactagaaataccatttgacccagcaatcccattactgggtatatacccaaaggattataatcatgctgctataaagacacatgcacacgtatgttcattgcagcagtattcacaatagcaagacttggaaccaacccaaatgtccatcaatgatagactggattaagaaaatgtgtcaatatacaccatggaatactatgcagccataaaaaaggatgagttcatgtcctttgtaggacatggatgaagctggaaaccatcattctcagcaaactatcgcaaggacaaaaatccagcaccgcatgttctcactcatagatgggaactgaacaatgagaatacttggacacgggaagggaatatcacatactggggcctgttgtggagtggggggatgggggagggatagcattagagatatacctatgtaaatgatgagttaatgggtgcagcacaccaacatggcacatgtaacatatgtaacaaacctgcacgttgtgcacctgtaccctagaatttaaagtataataataaaaaaaatggaaacaatatcactcattctcaatgttttggggagtgttaaatggtaatatataggtaaagtagttaccacaatgcctagcaatagtaagcatgcagttcatggcgatattatagttataaatgaaaccaccaaaattatctttcaaactggctgacaaaagatataaattttatttttctgctagaaactaaaaacttggtgagatcaggaactatgttaatcttttaatcattatatcgtgaggtttggcacacaaatatttactaagtgaacaattgcaaggttaatttcatcaccttgataaatttgtactattttagttaaagttctgtaccttcgtcctcatgtttcgatctatctggggaccagcattcctttctcggaactgtatgccctgcatggtttttgcattgcttcctgtatgacttcaaacaatggctgatcctgtttgagacataatggtgttacctctgttagaaattacatttttcttattttcccccaaatccgacaactgaataatgtgaaaatatatactttcctttgaagtgagaaataggaattggggtgaggccaggaagaagcagctcctatataccaaataatacagacgagcatacaaatatttaacatcagtgttttgactattcatgtctgtgacataaaataatctgctgatacacaaaaacaaatctatgagcttctacagtttctatcagagtgatctcttcagctaataaacgaacctagcttgtatccagcatctgaattttaaattggcattgctatttttactcatctgcatacacaggtatgggggtaaattatgagctaaagggaaactctcaaatttgaggatccataatgactttgaaaataccccagtgaatgtaaagaattcataagtcattttctttacccatataaataataatgtgatactcaggatgacatttgggaaaatatacaattatatttttaaaaataaggtaagaatgttaaatagaagcaaaatgtttagagtccttacatgtttattatgtttcatttaaagactctgaatataaccaaaactctataatataaaaattctactattaattataaaattataatgctgtgaatatttttggataaactgtgagaaaacaaagttatgtgtaaaatattacctgcctgatagcatgaacctatattcattgtaacagaaatgtcagttgataacagggacaaataaaaaaattttggacaaatgttgagtacttcatgatataaataaatatcatagaacacaaatatatgctaaccctggagtagcttacaaagctactatcccctcccagccccccaatcatatataacaaactattaacataaaggcagatcagaagtggcaaaagtatatattattgtccattcttgattagggaaaaaaaaacactcaaaaatgtctatccattcttactgttcataagataatctttaagctccctggattggtagtcaaggctctccataacctgctcaccctttccataatctcttactaccctgcaggtatcctacacaaaaagccaaacctattgactttttcacaaaacgtattttataagagcctaggctcttacaaaaacactattagtactatgtcccctaaactgtgcttcaatccactatgcaaccctattattcctttccttttttttttttttttttttttttaaagagactgagttttgctatgttgcctaggctggatcatactcctggcctcaagtgatccttctgcctcagcctcctgagaagctgagattacagtgtgtgccatacacctggcttcttttcaactctaatgtctcccaacaactttctccattctccgaaagtcctactcaccttttatggctcatttaggtgaaactttagctactttctacgttctccctgagacctacctactggaccttctctctcttttaagagactacacaacattcctctacaatctattgcaatggccatatttatgtacacatcatcatctcttctaccagttgcaaagttcttcaggcaaagaccaatcacttatagtaccagcaggtgccaaatcaaactgacatttgaataattcgtaagatttggattcttaattacccttatttttacattagaactaaaagtcatttttcagaaaaaaaaaaaaaaacaaaaaaacattttaagaaatatcttaccagtgtgccagcaggcaaaggagcagaatcatctgtaggatacattctggaaactggcacttgagaatgtctagaccatttggaaccattttacagtaatcctggatacactgcgccaccaccacacagcatcccgacaattgtatctggcataaattccttcacccagtagataggaatgagaccatgcctcagggtacccgcaaatgctaaaataatattcctaaaacaaagaattaagtggatcagaaatgaaaacaaacacttaaaaattgaagacaaaaaccagtccttttggtgactatattttgaatgcgttttctctcttgccctatttctttatattttcagtagaaagtagtcatagtatgatagagtaagtactgaattaaagtcaggaaccttgatttagactagaattttatgctaacaatctgtgtgactccctctctgatacagttttttcattgagattggactgggtgatttttaaggtccctcatagctccagattctacttttgaagttatggtatttcaaaatcgaagtaactattaaacaagaacttaattattttaaatagcagaaccaagagtaaaacaaacatataggaaaacaaactggctgggcatagtggctcacaccgtaatctcagcattttgggaggccgaggcgggcggaacacctgaggtcaggagtttgagccagcctggtcaacatggtgaaacgctgtctctactaaaaatacaaaaataagccaggatggtggtgcgtgcctgtagtcccagctactcagaaggcttaggcaagagaattgcctgacccaggaggcagaggttgcagtgagctgagattgtgccagtgtactccagtctgggcaaagagcaagactctatcaaaaaaaaaaagaagaaagaaaagaaagaaggccgggcgtggtgctcaggcctgtaatcctagcactttgggaggctgaggcgggtagatcacgaggtcagggatcgagaccatcctgactaacacggtgaaaccccgtctctactaaaaacacaaaaaatagccgggcgtagtggcaggcacctgtaatcccagctactcaggaggctgaggcaggagacggcgtgaaccagggaggcggagcttgcagtgagcggagattgcgccacggcactccagctggatggcagagcgagactcagtctcaaaaaaaagaaagaaaagaaagaaagaaggaagaaagaaaggaaggaaggaaggagagagggagggagggagggagggaaagagagagagaagaaagagagagagaaagagagagagagagagagaaagaaaacaaactggtagaagctgccttgaaaaacataattcaaccagtttaaaaactggttgaagacagttaattttttaaacattattttactattatataccaaatgaaaattttgtttgtaagacagaaaggcactctgaaacagcatgaaattaagaaataagaaggctgaagtctaaatcctagctttgccatcttgtggccttggaaatgttatttaaaatgtctaggtcttactgctttttggctaaaccaccagaaatttttattaattctatgtctaagcttaatgcccatcttttcaacagtaatgcatgggaaactttttatttacaaagtataaaaatattagtatagacagtgacactttcaataagaaaaggtcagaatactagctctctctatatatacatatatatttgtttttttaagaaccctgttgcccaggctggtcttgaacttgtggactcaagcaatctgcccgcctcaggccccaaagtgctgattacagttgtgagccaccatgcctggccatagtgctagcaatcttaccatctggaacaatcttgtacattttaataaaacgacttctgattcatgattacctctaagagggaggaagtagaaccatctgtggtagaggtatatgtccactaaaacgaatttcctcaattcacaaccaatcttacagttggttgtggccagaactgatgcatgttaagtgtatgagaataggtgtgttcccccagctctctttccctctctgcttgcctcctggagaggccccgaagccatggaaactgacagatcctcaagctggaagaaacctgcttccctgaatcagtaatagaaggctgcttactgagcatgcgtctacgactacaagcaagaaataaattttattttgaaaagccattaagattttaagtgtttataatttatggcagctagcactaccctaacaataccctctgggataatatattattctctgggaatcacctctagatcggggtaggcaaacttttctataaagggccatatactaagtattttaggctttgtgggacatatatgaattcgttgcacatgctttcttcttttaaatgaccctttaaaaagaaaaaggtaaaagctattcggtagggcgcagtggctcacgcctgtaatcccagcactttgggaggatgaggcaggcggtcataaggtcaggatatcgagaccatcctggctaacatggtgaaacccggtctctactaaaatacaaaaaattagccgggtgtggtggcgggcgcctgtagtcccagctactcaggagctgaggcagaagaatggcatgaacccgggaggcggagcttgcagtgagcggagattgcgcactgcactccagcctgagtgacagagcaagactccgtctcaaaaaaaaaaaaaaaggtaaagctattctttgctcataggccatacaaaacaggtgataggccacagtttgctaaccataatctagacagttctatgtaaaattaagcagcacaaatttgtgatattgcatagagggataattgggagcctaaacattaataatgataaaaactaacatttatgaactgtttagctgtggcagatattactctaggcatgtggcagatattactctaggcaccttaactgtatggttcatttgatcctcccaagtacccagtaaggtaatttgtcagttggtagtttggaaccggattagaagctggcagtctggtgtaaagccgaagttcttaaccactatactatgctgatgctgatgttccatttccttcttctaaatcagtaattcaggagcatttagggaagaagcaacagcttcctaaatttctatagctccataatggtaatacaaaaaggtcttactatatacggattaacaaaaatgcaattcatttcagatgcccacctaaaaacttcagttttaaaagatcaaaaataaaattttggcatgtaaagatgcaaacttcagttattttcctgatggcataaaacaaggtatcgtataaatgcccttttgctgaaagttttatcttttagagcagtgcttcaaacttcagccttagactgttgataatcatccagagaccttgtgaaaacacagattttgcccaccaaccctactctctctatgtccaggtttggatttgggaggtttggcatagggccaagaatctgcatttctaacaagctctcaggtgagggtgacactactgatgtgtggaagcattttgagtggcactgctgtagtgctttcctttcgacctccaataagttcattcatatattgtgacattaaaaaaaataccattttacggccgggcacggtggctcacgcctgtaacccagcacttcgggaggccgaggcaggcaaatcacaaggtcgggagttcaagaccagccgaccaacacggtgaaaccccgtctctactagaaatacaaaaattagctgggcgtggtgggggcgcctgtaatctcagctactcaggaggctgaggcagcagaatggcttcaacccgggggcggagtcggaggttgcagtgagccgagactgtgccgctgcactccagcccggacgacgtgcgagactctgtctcaaaaacaaaaaacaaaaaacaaaaacaaaaaaaaccattttagtctagaaaacataaaactggaggttacaaggcttgacaacaaatagagggaaacatcagacttctacaagactcagacaaagaactagcaatgccttcactatggaaggcataaaaagttataacatttttagttttgttgaaataaattagctaatgctaaagataacctgactttaatatgaaggactagaacttagtgacttcaaagattttcacccctttgaaattttatgtcctattaagtgaacatacaaaaataaaataaaaactacctaaagaaaatacagctcccaatgttaagaaaagatggacaagaaggaaagtttgaagagcatgtaaaagacattcagaataaactcgcagtacaacactttagaggctctcctacctggcttctacatagcgtccagaatcagcagtatacctctaagtgcaataaaagtatcccttccccagcagcggaaaatacagaagaaaaatgaggtaagcctaacaaaaaaaacacaacaaagtaatatgttaatcatataatacacacaaacctatgaactccattactatagaacagttactctaaacctggggtaaaggcaggcacctgcaaatcctctaaaaccctctaaaattatttgcaaaatgtatgtcttacttatgttaacttctgtcaaatgagattccattatcttgtcagattcctaaaggaactatgacctaaagaagattaagaaccagagctatagagagatacttatctaaattgaggttgaatacacagataaacttttcttctttctgagagagggtctggctctgttgtccaggcggagtgcagtggcacagtcttgcgtcactgtaacctccacctcccaggctcaagccatctcccacctcagcctcccaagtagctgagactacaggtagacaccaccatgcctggctagttttgtattttttgtagagaatgaggttttgccaggttgcctaggctggtcttgaactctgagctcaagtgatctgcccaacttgctttcccaaagtgctaggattacaggcaggagcactgtacctggccaaactttcttttataaattaaatctaaagagtaaaatcagagatcaatatttaacacataaacactaaatattaattatatatttaaaaagactctaccttgaactaaggacaataaataaacctaaacatgaaattattaccttaatgatacctaattaagtaatggagtcaacatttgagcacttgagtcaacattatcaaatttcccactaatttaaaacacttaaaagtgttatattctgtacacaatatgtacaattttacttgtcacttcaagttactggcacattaaatccttcattctaggtaattggaggttttatatacaagataaaatagatgattaatggtgcaatctaaaattttacttaaagattgagtttggtttcttataaaacgtaaggtcaggaattcgagaccatcctggccaacatggtgaaaccccatctccactaaaatacaaaaaattagccaggcgtggtagtgggtgcctgtaatcccagctgcttgggtggcgaggcaggagaattgcttgaacccaggaagcggaggttgcagtgagccgagatcacgctttgtactccagcctgggcaaaaagagcgaaactctgtctcaaaagaaaaaaaattatgcaaagcataaatataacacatattttggttaggggaaactgaggacaaataaaatatacaagcattcacttataactatcttaaaagcacttaacgctatctgaaaattatcttgtttgtatctgttgaatgcatatatcttcccagtaggaaataagacctatgagtagaaacctcactaccttgttcaccaacaagtatgtattcattgaaaattgtaactgtatataatatatactataaatatttgatgactgaaataaaaaacaaatattaaaatgtagatcgaaaagtgaagaatttgactaagataaaagaaagttttggcaattcctgagtgtacttcacaatttaatttctgtttattgggaattagatgttagtttcttccattaagaaagataagaattagactttttcctacctatgttgtctccaaaatgacggtacaaaatttccccaaatacactgtgattatttatttatgattaatatggtttatatatggttgatatatacatgatattaatttgatgatagtgatgacagcagctaacatatatatagcactctgtgccatacacacttcctgtactctgacccatttaattccttgtatgaaacatgaatacaggtagattcaaaggtgatctgaatcggtatatccaaaaatatatgcggtctgtctttgtgaaaaagtcaaaactataaatctctagcactatgtatggaaatgtttgtattaactttttgacctctaagagtacaaactaatagattccatatcttctaagtgatttctaatttgtcaattattagaacaggctcaaatttttttttttttttgagacagggtctcctctgtcacccaggctgcagtgcagtgtgtgatcatagctcactgcagcctcaaactccttggctcaagggatcctcctgccccagctcctgagtagctaggactacaggtacataccaccatgcctggctaatttttaattttttttttggtaaagatggggtcttgctatgttgttcaggctggtcttgaactccctgccccaacgatcctcctgcctcagccttccaaagtgttgggattacaggtatgaaccattgttttaattgctgttgttgcaatactataaccaaaggaagacatccccaatcagtttaaaatgaccccaaaaaacctatctgcaaatctgaatacagtcctattttttacaagtatggaatagcaaaacactcccttgggatgctaggagcaaatatcacacttctatttgtatttgtttacaacttaattttttagtttttatttgttttatatcgtacctgagaagtatgtcagatgtacagtttatatcagtatatcgtttaaagtgtatattttgaagatgtttaacaacagcagacacaatcaaaaaggttgaaattactattttttgtaatgggttctaaaaagtaggctttaaaccaagttatttacatcaatgtttcctttgcccctatggctaaggtcagtttcatgacatctgcatggattcatgagggaacaacgggtaccaggagatcaaacagtcaaatgaaatctaaaaacacaattatagaacttaaacaacgttttatgaatgtttcatgaacatttttatggaaaggtaattttcattttagttgttgggtatcactaagtctttttatctggtctagtagctgcaaatttaagggtaaaagagggaattacacagataatactatttctttcttctgtaacttgatatttttcagtttagtttggaaagttctaaacttcagtcacctcaaatataagtactttctagaaatatgcttgaaatgtattaaaaagaaaacaaaagcctgtccttagcctattttgcttacttgaatttgttacttgattcaggttttaaatctagttggaataaggatatttattcaaatgttgaaagcatttgattccaattagacacatgatgaaaattattaacatctgttttgttttataatttatagggacccttacatgacctcttgataattacagattgggtttattttttaaaattgggggaaaatatagaaaagagaatagtaaaataaattgatttaaaaaaacacagaatgtcaagagttggaaaaaatagaaacatgaagaatcagtagccataaaaaacacacataaatgcctggtgcacagttataattaaacagtaagcatgttattatttttatgagtgaatatctatgaaatgtactaagtggtaaaataaaatcttgatagcattacaagcttttaaaaaataatcattttcctataacttttcttccgcgaatacttcgatttacatattttaaccttgtacataattccttacctgcagctagagaaacacaacttgctccttttcttttgtgatctcatttaacctataaggtacatccattagggcaggtgaagaattggcagggaagggaattttcctactccacacagttgaactgaacccaatgaaagtgtttcacaaaggttgaaccattctgaacaaagctgtaacaaaagtgattgaatttatacttgtagaaatacaatttttagcagttttattttacttggtttctttccttcaaatgattttctatacaaatctataacaatagtaatattacttaacatttttaaaactttggttaatttcaaaactgctttcatttcacccattattttagctggcttacagtccacagatggtgtaaaacaaatggtagaaatgaaagtttgttcttgtgaaattatgtcctaatcaatttgtggctctcacgagtacacttaaatttgtggtttcattttagggaaattcatcattaaagcaaatttcattcatagtaatagtggaattttttctcctaattgatgaaaaattagaaaattgtacatgtagatttcagaaactttatcaattaactcaataagtcagtgaatacatagaacaatataaaacaatattcttatcaatatgttttattagcttttagaacagattttatatattcaagtttgtttttgtatgctacacagactaaaggatgctaataaatttactatcacctacaagccttttcagttctatgacaattctttatggtttggttttttaagaacatgatgaagtgactctgtatatagtttcaacacagatatgcccatttattcaagctttgttgatataccttgacatctgcttccatgctgtatccagaagagtggtatatgcaccaattaaatagcatcaaagtaacatgggataaggtaacgtgggatctgcttcaggtagaagaacatgcctgcaaccatttaccaacctgtaattaaaataaatttgaaagttaatttggtatgtgacagactaggtgtgtttttagaggtaaatctaaatgtgcaactttatctagtaatctataacccgatttccatttattataactgaaagatgatgaaggaaggaggaaaatggttcagttagaaaacaatgtaaatattatatataacatggtaatatttattattatgtccttgatttttgggacgataatatagctctacttacttcagcaatagttcctgatcgtgaaataagcggttactgacatagtcaatcatccaatctccagatctcaaattattacaaaaaggatgcccaagtcattctttggtcttatttctgccaatacagacattaaacctgaaaattcagaacatgtcatgctgtattattggtagcatcaatttgttcctatatcctctagtccctatttgctagtctctattctagtgatttggggtgaatacgtattagaggcacacacaagggctcccagtccacaacactgcttaatacagttggagataagtatgacaatactggcttgagcaagttacaaaggcatactgaaggggactactgtcacaagagatataaagagcttttcagattcataacttctgggactggtcttattcttttggattttaatgttataatattcaaggtaactggcatggcttccctgcccaaaagcatctcaagaaagaaaagtaataagcctgtatttttcatgttgaaaagtagtgggttcatcagtattcaggctagatttaaggaagtcatgaactggtttcagaaagagcaagaacacctatggagataataagaataaagcatgctttgaaggaattgttaaaatttaacaggaggtacttagaactaagtgaagtatcaaaatgagtatatatatatatattttttttttcttaatccttctagtcttcaattagaagcattagatttcccagattttattatttcaatgatgctaccttaaaaattatattggcatcactgactcatttagactaaatttatttatctatttagaattgcatgaattttactaggtatgtagatgttttgagaaactaaaaactatataaatttaagataaagttctttccctcaaggggccacaatcttctctggggaagaaagcttaaaacataaagatgttgggaaacaagactataaataatattctacatatgccctggcattttcatggacagcagataatgctcggtaaatgtggtctcactgttgaataatggaaggacataaggaaaacagtgttttagaaacagatctatgatgaccaacggaatggaatgatttgtagatgaggtaacaagatttggaaaattggtagttggttttgtatataggacttagtcctagaatagagtgaaaactgtggtaataaaaagatatggtgtacccaacagaacatggaaaagaatccacaaatcataatgactgattggaactgaggatgaaaggagcagatccaaaatggattcctggattccaacatgactagatatccgtattataaggagggaaatacattttgtttaagggaaagacaggtcaacaaagtagtaaatctgatttaatctgaggctcttattagcagcctgctggaaatatgtggcctgctgaaatattaaacaatcagagggaaaagggattggtataaagcagcaaaaaataaacaggtaaggcaattctatttagaaaagataagaagaatcatttcattagaaagataaggagaattgcaaagaaccaaacttaactataagaaagacaaaggctagaaaaagagcacacacaagttggtctttgtagtgaactagaagtagtttaacaactcagagtgaaaatgaagtagataatactcaaatctgataacatacatacatcttttaaaaattaattaaataaataaatttattattttttgagacagtctcactctgtcacccaggctggagggcattggcatgatcatagtcactgcagcctcaaacctctcttgggctcaagtgatcctcctgctgtggcctcccaaacatgagattacaggtggaagccaccatgtctggctcacatacacttctttcttactcatgcacaaaacattttgtattaaaaatgagaatattttagaaaaaaagatcataaatccaaaagtctcaaaaaagtttattgagaaccgcttacgtgcttggttttgcagaaagtataaagctaaaagacaagaagcataaaaaagataaaacttaattcttctttctgaaagtgtgcacctacttagtgtggttttaaggctaacaatttccaattacttagtatgaattaggtgtctctaatgagctgttcacatgtattaattcattaatcctaaccataatccctgtggtaggaccattttgcaggggaaaagtaagccatagagcatttacttcaggttataaaactagtcatgtaacccaggaaatctggttttaaagcctgtttcttaatcacaatgataaagattcaaaaaatcattatactaactatcaaaataaggcaatatatttcaagggccaagtaagaggatagaaaataaatgcaatggtgtctggaggacaaagaaattactgtaaaaagcaatagtaaagaaggttttatgaaagatgcaagaattaaattagtccttaaagataggttagatgggaaagaaataaagagttgaacaaaaggcataagtgaaaactatatgaaccaggaatacagtgtgataaagcaaatttcttaaacatctaagtaaatattaccaactagatgaataaaatgataaatacttaattcctttaactcatcttacaactactgtatgttttactgtaagtttctttacaggataaaacaaatatgcaataaaatatatttccaattagatttaaaaaaagtgaatggattatatttacaacctaatcccacttggggcccaaacaagaatattctgtttttatataataaaccaggtcaagaaacattaatcaaggtccaagtatacataaagagctaacagaccttaaggaaagagatagaactagtatttctaggtaaaatttactgggtaattatttgtgttacatcctgttttcagtgttttatgtgaatgatctcattaatcctcacaaaaccttctaaattagataatattattcaaattttatagaagcagaaattggcacacaaagagttatattacttgccaaaggtcaattaatgagcagaagcagagccataattgcaacccagtaggcatactctgagcctatatctatgtctgtaaagaagacaccagatgaccctaaaaaaaaacacaaagctcagctatccttctatttgcttaccttgaagacctgcatatttaaggctgaccagtttggtatgtcatagcaccctccaccatcttccttttcttctgattcacacggtaaaggatctgatttagctcagccaaagttaatctggaggcaagactaagaattggaaataaagataaccatatattgaagtttcgcttgttgtcaatagaaacaaaagaagaaatctgaattacaatcataaaatgtcttagcagtgtatgttttaggaactcagcattcaaaaaacattatactcatacattttaagtaattattaaaggacaaattgtgaaaaaaaattcattagaagcgacattactcccaaaccaagcaaataatcaagtaccaaattgtattgattgaagtatgctgggaaaatattttggcttctatatcctttatcttataaatctgttttttaacctttctagtttggacttagtgttttccttccttccttcatttatttatgtgttctctctgatttctctcctttatattcccctaagtgagacatcaagaactttttatgctagttttgtatactaaaaatacttatcagaggatgactaaaggaataaaaagtcaaagttaattcctaggaaatcacatgctctctgccttcatatttctctccaagtcccttcctttctctttctaaggttgcactgcccctcagcttgtttattcaagaaaccaggatttttctcagattagatgcctcctgataactgtcagagggaagactatcatggccttgatttccctttgtttgttagcagtaagactgtataactgaccacacctgaatacagctgaaactgtattttctttgcttctataatagatgctcaggtaatttcattttacatgactgccattttatgtgaaccatatcctcttgaatgtgtatctttctttcccatttagttctggctcaatttagaaaatattgtcatctgtgctttgttctctccatatcagcctccctccccagagctagtttgtgatcaagcctgagtcaaatcactcagaagtctcagtatcaactccattctaggacaatattttcaatagccagtggactccttgcctaaaaattacctggggatcttataaaactgcaaattcttggccttgctccaaaataatctgagcaggtctgaggaggaacatgcattttacaacagtccatccaaacacaaagctgcttcatcacagattttttggttaagaatgcaactacttattaagaatagtttgaattaggagttaatatccttaacaataaaaagtcttacaaaaaacaaagaaagccgaacacaatagcaaaatggggtaatacataaaacaacacttcaacaataaatacaaatggccaatgaacaaaataatttagcttaatatttaaattacatgagatttatttttaactattttatatttaccagtttgattagtaacagctaacacttatcaatcctatgtgtcaaaaactattgtgttttactcaagtaatctgtaagaaaggtgctataatttgtctattataaattctcaaagatctctttttttttttctagagacagggtcttgctctttgcccaggctggagagcagtggcacaatcatggctcattgcagcctagacctcctgggtcaactgatgctgatgctgttacctcagcttcctgaacagctgtgaccacaggtgcatgcacaacttccagctaatttttttaaaacgttttgtagagatagggtctcactatgttgccaggctggtcttggactcctgggctcaagcaatcctcccaccttggcctaccaaagtgcgagattataggagtgagccactgcactcagccaggtcttacttcttatagctaataagatctgcaatggaattcaaatccagttagtctggttctatactccatgcccttaaacactagttataataatatatactcagtattgctaatgatggaaactcttggatagagctgaaagattaattattataatctttctggagaaaatttggcagtatgtattaacagcctcaaataatggatatagtctaacccaatggtcctttttggcaccagggactggtttcacagaagacttttttcacagactgggggtgaggggcgtggttttgggatgattcaagtgcattacattattgtgtactttatttctactattattacattgtaatatatactgaaataattatacaatcaccataatgtggaatcagtgggacccctaagcttgttttcctgcaactagacagtccatatgggggtgatggcaaacagtggcagatcatcaggcattagattctcataggcagcagcaatctaaatccctcgcagggacagttcacaatagggttcacgtccctatgagaatctatgcagccactgatctgacaggaggcagagttcaggtggtaatgcgagtgatggggtgcgctgtaaatacagataaagctcacctgccactcacctcctgctgtgcggcctggttcctacaggccatggaccagtaccagtctgtggcccagaggttggggacccctcgtctaacccaaacttccatttctgaaaatatttatactagtactaatgatggcaaactatgagcatttctatgtgccaggcattgtattaagtgttttataagtgttatcctatttaattcttacaaattttccagatgggagactgagatgatgaaagttctaaacaatagatccaagatcatacgacagtaatgaagctaaagttaaacctaggtctaaacctcaaaacctatattcttctgtgtatgcagaaacatctagaaagggaataactaaggattcatgtaaagatgaatgtacaagacataaataatagggaacaattagaagcaatctagatgtccaaaaatggaaattgtttaataaattatggtaaagccataaagtagaataatatgttgacatttttaaaaaatgatgggtaaagggtatgaggtatgcaacttagtctcaaatacttcagagaaattgtgtgtgtggtatacagagatgcatgcatgtgttatgtatgcatgtaggcatgtgtgtatctatatcttagagagaatacacatgcaggtacacacacaaattataaaacaatagggtaaaatgttacaacaggtgatgctgacactgctggtccttggaccgtactttgagtagcaaggatatagggacccttaaaactgcttaattcagtctagtggtaacttacttattaaggtggcaaatcctaccaaacaaggcatacttacgaagcaaaaggaatttttaatataggatctgcattgtaacagctaggctgccagatttaaagtgaggactgaattgtgtcagatgatttcgaagaatccaacagcgacttgtgcatgtggatcaagactaactctgaaaatgttaattaaaaagtgttaatttttaggagtaatttattcaaatttaacaggatatgcaaactattttaaatatagtaaagtcaacagtttgagctcaattaacatacctgaatataataacacttcctggagcaagttttcaaattctatttcttgaatatattcattgggcccttttgtggcaactccagttgtttaacaattttactttcattaagcttgaaaaaaagtacattaaaaaaatccattcacaaatagttctaatgttcttaaaatgctaaacacagtagtaagatgagagtcccaaatcctgaatatgttctctaatttctactgtgatatctggtgttccattgattgaattctcaccttcctataaggtttcgtgtttctctcaatagttctagcttcaagaactacttcttcattttgcctaggaatacataaaaacattttaacaaaatttcatatggaatcatccaaaataggaaggctaaagtggtttcaaatcatttaacttaaagttgaaaacaaattatcagttattttttttagaagtctgaaagtagatgattctacccaaggtgtattttcacatttgtaaaaaaattacagcttagttaacaaagctttttttgaagtagaaacgtatcaaaataatagttagctctagggaacaacttcctaattttgagcagagaaaagcaaatcacttgaaaggctacatttttttaaaacttggaatatttcggatacaaaaaaaaattaaaaacccaagttcacttcctcacttaaactttacaaatacaataaagcctctgtgtacccattcttcactttagaggtaacctcaattcagtttggtgctcactacccctggcattttcactacacatgccgtttccttaaacaacatatattattttccctatttccaagttttattaaaatgaattgagttatatatatttgcaacttgctttttagtggtcaacaatgtattttttagattcattccactgctgcatcagctacagcacatttacttcaaatgccaaataatattctactgtatgatataccaaaatatatctgttctattaaggttgtctctaatttttctctattataaatatgttgtaataaatattcttgtgcatatcttcaaatggaaatatatgaaagtttcccagaatatacctagggatagaactgcagggtcaatggattatataaaatttcaaccttactttaataacttaagctttaagtcattaatctggcaacaggtaacagaaccttttgatctagaattctacctctgtaaatatacactaagaaaattgtttaaaagaaaaaacaattatccttctgtatatttaacacttagtaacactactaaacatactatagaatatttaaaagggcatataacagaacgtacgaacatttaacaaaataaaaatcacaattttgcggactgaagtggaatgttttaagaatgatctgtgaccaaaacaaaacctgagataatattgtacacagtgatgttgtcctataaaactgaatacgtatattagcaaagatcagataaggatagtgaatatcatttgtgaacaattaaagaaacttttaggtattcaggttgataatttttaaaaaccggactatgcatattcagcaactagcaaccaatatagaatatgatgatttttataggaatttcatttggtcaatcaatcaacaaactttgccagctgctgcatgaacaggagcatgctatgtgtaatatgccacatataatagtaagtaagacaataaaatacacctatccagaaaaaaacaagtaatattaaggacatatctcagggatgtattttataatttttgactctctatgctgaggaatacatagagactataattgctacatgttcagaagaatcactgaacaaaggagggcaactttagaccttgaaagatccagacaattcgcatagtatttggggagaagtaaaaaatctatttggctgaaatagtggactgacatagggctaggatggtggatgagaatggatttgaaaagccttaaacataaggttatattattttccattttagttcgcatgtttgtatgttgtttgtgcatatatacacacaaagacatttatacacatatatacatatacactaacacaatatacatattgttctgctagaagagaaataaatgttcattttacacaaattaggaaaaaaatataaacaaaaatatttcacaactcaaaaaatgttaacatttgaaagtatttctgctaggttttgttccatgcagtaaaaatataagttgccaaaaatttctttttttttgagaagggtctcactctatcacccagtagagtgcagtggtgggatctggactcagtgtaaccatgcgtgctgggctcaagcgatcctcccacctcagcttcaggagtagccaagactacaggatgtgccaccatgcccatctaattttttgtactttttttttgatagagacagggtgttacataatgctgagactggtcttgaactcctgagctcaagtgatctgcctgcctcagcctctgaggtgttgggattactggtgtgagccatcatacctggccaagttaccaaaaagtttaattctttttctcaagtacgtccacagtagcactgtgttataatatatatgatatatacagatatataaccataacattacagtataatttaatataataatataatacaaatacagtacaatttttagattgcattaccagggatgcacatttgaggcacttccttgctgtaaaatgagtcttgggattcctgaaagcagttctagatacagccacaacagactgatggatgctagtgagtgtcttgttactgccactatgtcttcatcaacttgatccacatacacctgagaagagaaagaacaactagattagctctcaaactggaaagacttactctgaaattgaacctgagaaacaaatttaattatttcttgcctgaataaaacccttggctccaagctcctgatgaatttactgatagcacacctggctgcaataatgccgctttggaaattaacttcacctgtgttgaaggcaatgcttcaggattccacttagtgtaaaaccgttcttcagaaaccactgaaactggacaaaggtaaaatttagcatggatacatcttaattacaatgaattttttttaataaaatgcccaaagttgttggccatgtaggttttaagaaacaacatataaacaaacctgataggcactaattcatcatagcctcttgtacttccactagcacaacatgccatagaaacaatgtagtacttggaagagcatcatacgctgatctatgctagaagacaacaacaacaaagcaaagtttgctttctttcaaatgcaaagtgctattctatagcataatgaagtaaaaggatattacataaataaattcataaggtaaattaatttgcttttaaacaagtaaaacattctgaaactatgtattataaatcagttataaatctaagacactattttgaagtatatgggtatattgtgaccaagtgtcagagagttaaatatcaaagcatttagcaaaataagtacatgaaaagattaggtgcttaccacaataggacactcattatcatgcgtaatatccataaacaggcatgtgcaatagctggcattaaaggcctcaaacagggctgaacaaaggatccaacaggtctcctccatatcggtaaactaatctgccctcttcatgactattatatgcactcattgccctgcagagcattacagaatattttaacaatcttcattatttatgtccaggaagaggttaatttcttctcataaatgattttcaaaataaagaccacatcaatattataaaaaataaaatgctttaaggatttaaacaaatgtctactagtttaagtgacaaaaaagttttccccatacttaactggagaaatggctcatgtaaggaaaagggaacatatgttgtttactgggatgtagctatacaaaattgattataaaacatctaaacattacatcatatctcccagtagaagagaaaaacaggtttgcatattttcaacaacaaaaaatggttttgttagtgagtcttcagtcatcctactggtctttcaatttgaaatgaggtatcttaccccaaagtagaaatttatacgataaaaatagactgagttatattagaatatgtcatacaaagtatttagaagaacattactgtgttaaaaaattattaagcattgcatatgaagctattaaatcctttaatctacttaacaaaagctaaagttttagagggaaatacactccaacaagcctacctcttattaaggaataatgcccagtctagtaacaaagacattgtccagatcttcacttcctgtgaacagttcactactacatataaattgggttgcaaattcctagcagcatccaacatgtactgtaaaaagacagtgacaaatgtaacaaataaatgtaacagaaagagaaaagcaagataggaggaaggaagagacaaaaggaggcatgatttgacatagaaaaatatgcagcaagatatcaaacatacaaaacacatagaaacaagagaatttatcaagagaagaaaacggttaaaaaggaagattgattttgcaaagatattgagacatgagagaggaaaagaagaagaaaaatgttagtttcaattactaaatgtaaatcataacactacaattctgttaggttttctccctgttttttgttgcttatttatttatttatttatttattgagaccaagtttcgctcttgttgcccaggctgagtgcaatgacatgatgtgagctcaccacaacctccgcctcccaggttcaagaaattctcagcctcagcctcccgagtagctgggattacaggcacgcaccaccacacccagctaatttgtatttttagtagagatggggtttctccatgttggtcaggctggttgcaaactcccaactcagctgatctgcctgcctgagcctaaaagtgttgggattacaggcgtgagccaccgtcctgggcctgcttgcttatttttaaaactttaatcagacttaatttccaggtggttgacaaataattattcataaattccctgctggtgaattacttagctgttggaaagattagattgtctgaccagactgaagccagtttctcctacagatgatgataaataactcttaaaaactttacaccttacaatttccacttgtgtgatttacgtttaacactggtgctatctatctagtgtttattataaacactggtttataataaaaaatcagattggttccaaactgttaaacaaacatttgcacaaagattaataaaatacttgaaactctattagctaacaagtagaatccagattttgtaatttaaaattaagtaaattaagtttgaacattcttttctgccatgtaacatcttagaagcatatttctttttgctattgctaaaagcacaataaaataaagccgtcatttttggaactaaacaatgttctaccagcttaactaatattcactaaatccctccaaatcaatcaatttttcatcataggacttgaaatatatattataatactgctttaatattatagaatagacattttttaggtaagcacacatttccaaagaacacctaagtgacactggtcacagtaaggtatcaaaaatcttataagcagtgccactgtagggtttctaaaaataacaaaaaaacttataagcaggatgaaaattatgagtttaattacaaagattgtattagatagaagtaatactataagtattggcattgttcagaagttattgtaaagagctcaaagagaaatagcaatgtttatgtttacacttataatttttataaataataaaaattaaatcgatgaggctgactggcttcaatatgctataatgttaatgtttattttttatttaatttaattaattaattattttttagacagagtctcactctgtcgccaggctggagtgcagtggtgtgatctcgctcactgcaacctccacctcctgggttcaagtgattctcctgcctcagccgcccgagtactgggactataggcacacaccactataatgtgtaataagctattcaccttcacagtcactctaaaatatattgaaagcaacctaaaaataacaaaaattaacattttatgtattcacatagccaatatgattgcactccatattatcagaaacgtgatcaacttccctaaattaaaatttaaaattagctagttaaatattttatagcccagtattccataacaactgcaaaagatgttagaattatgctaattatgcaatagtgataaatactaccaccaaatcaatgcttgtgccaactagcaaaaggaaacatttacctgcatagtttacttaaggaaagctaggaaggaaactgaatttcttttcttaatgtagataaattgtttttctgtacctcagctacgtgaagagtgttgagtggcagttatcaagacgtactccctggaaataagttgcagttatttcagtgattttttcatgtgtgcccagagataaggacagtcctctggtttattcccatagcgtaattaacactgtctccccagcaaataagttctctccttaggtaaacttctgaacctgttcagaaagagattgctttcaatggttcaagaaataaaatgaaaacaattacttcaaggaaacatggtttttaaattgctttgatcatttctgccataaatgatatattggttaaattatatcaaagtggtatgagataatgttttaaaaaattaataattatttatttctcatagctattcgaaaaaactctagcttacagtctcttctaaaaatttgtcctcaatttcaaaaacccaagcgcatcataagggaaaacagaaatgttaatatcataggccttttaaaaccatagttctacaaaaacatttaaaactccatctccaccctcctacttattttcggcaacaggttgtattgatccatggcatacagcagaatggcttgatttcgtttagaatggctagaaaaaagagggagagatacttacacccaaatttatactcttaaaaaaaagcattaagatttctgaataaatttaatgtcactaatatagactcctagtttcgaaatgttaaaaaataaatatatcaatggctcctgcaacattcttcctggtaatgaaatagctatagaaacacaagacactaagagtaggggggacctaaaaccattaggttctggtttaattgccactgaaattcttaatacctcggccaatgagtgaaaatatctcttatgtcaatgtaattgtaatagcagtggtttcaaactgtctgtaaaaatgcaataatattttgtccaaataaaagcttatgtagacccacaatatgaaaacagtacataaaagttattctgtttgagaagataaaaggtaggaaggcaaaggagggacagaagatgaacttctttttttgttggctccatgttttctttctcaaattgtatgttctctggtacctttatggtgaaatatttaaaaaccaatagactaatggggaagaaaatcgtaaagcagattttattttgaccttgccatgaactattctttccccatccacagagaagtaaaaattacatacccggttcagcaaagtttcgaagaggatcatctcccattacccatcattgtgtgccatcagaaaacaagctttatttggcagatgaatcatagattcttccatgggaagtctatctcttcaaatgggaaagtaaaatacctatgaaaatataattaaatattaatccatacaaagaaactccttggagagaatataaatttgcaatattaaaactaaacttctttctaatgaatagaataaaataagtttgatgctatttataggaaaaaaacttcaatatagtcaaaaatcttcattaggctttttgagtaaatctagcaggatgtgagaaatagggagtaacatgacagcatatctggctaacagtttaaacaatttttaaaacttcataaaattatttaaaaaatcattgaggcagctgggcatggtggctcatgcctgtaatcctagaactttcgaggccgaggcagggggattacctgaggtcaggagtttgagaccagcctggccaacatgggaaaccccgtctctactaaaactacaaaaattagctgggcatggtggtgcacctctgtatcctggctacttgggaggctgaggcaggagaatcgcttgaaccctggaggcggaggttgaatgagctgagatcgtgccactgcactccagcctgggtgacagaacaagactccatctcaagaaaaaaaataaatacataattgaggcattgatgttactttgcaaagatatttttaaaaagactctaagtaaagatatgcaaaggcttttactgcactctagttgcccaacctatgtttatgtcacttacaaagtaaggagccagatgcttgcttaatttgattaatattgaattattactaagtatgcagtcctccagaaacattaaataataactatgaattggtttatactatgacagtttctctaacaaaatatttgcctaacaaaattagttaatattaagcctatgtcaaatcaaaacttctatttcaatttaagaaatgtactgaactcacatgttaaagaaaactttaggttaatttcaaaagttaaatacaattttcagttttcaaccatcaataagaaaaaaacaaaaatgcaacacctggtaactaaaggatgctttctagtgacaggtcctagttttgaccatggccagccagtcgttcataaaacacatttcccaaaaggcaattaactgcctgaaaacattaaattgtgttagatcatcaccatcctcaagacaacaaaaaaatagtagtaagagcaaggaaaagcagcagttcaaaaataagtaaaacctgttcctgatgatagttaatgagcgatgcttctctgaatttaattcctccattcttttatgaaaccaattacagcattcttcattgctgctggccccttgctagagcagatggagaaatgcagatataatatttaatggcttacagattctacatttaaaaactttctaacaaaggtcacagaaaccttaaatatattcacgggatttcaattatggctgatgatgttttccaattgtaaaaatgtttatatacacataagaaacatggcccacacacagaaaaagtgggaaaatgtcatgtgctgaaatagtagaatacagtgaattactttatttcattttctattaagcgtttttaataagtagtatgaaaatctactagccataaaggtttgtaagtaatattattatttcacagaaaaaaacacattacatctcatgtggtatgaaagtcgttagtgcaatgttcatatctacagtacagccaaaccgtcgtattcaggatcttgaataatcgtaaggtgttggtttggatcagacttggttactcgccattttctaaaagaaagaaaagacgataccttaaatgcaaatatctacaaagagattatactgtcactattttctaatttttggcctataattttttcactgaaaataaaacaaatattatttcacaggtatcctcctacctcctccccttctcatcctgctgtgtgcacgtgtgtgccgtgcgtgcacgcgcaaacacacacgaggggtgtgggggagaaagaaacagagacaaaataacataaaagaaagacacaaggattcctatcaattcaatctcagcccccacttttctgctacatcagcattcacttattctattctttttttatttttttatatatatattttattaactttaagttctagggtacatgtgcacaacttgcaggtttgttatacatgtatacatgtccttttttttttttaaacactttaaggactttagtggaacccgttttcctccccggtgcaccaaatattctaacctcaggagttctttttcaagattgctttcaaagtttgcttcctgagtcttattaacaacctgactttctttgaattctctaaaagaagcacacaggtttaatatttttttcccttttcatcaaccatattccttagataataacttaaaaattaaaaaggaataaatggtttttggggaaattttcactctttttctggaacttgtttgtaataaaattaaaactggtacaggattgcctccattgaacttgattttatattaactaattaatttgtgtcggcttattctaaagagactttgaaatgacttataaaaacacgaacaaaaaaacaaaatatgggtttcatagtgtagtggttattcacgttagcctcacaaaacagcataaaatacaaacaattcttaaaatccagtttctaaggttcatctggaagagtaaatatatgaaaactgccccgggcatggtggcttgcacctgtaatcccagcattttgggaggctgaggtgggtggatacctgaggtcaagagatcgagaccagcctgaccaacattgagaaactccatctctactaaaatacagaattagctgggtgtggtggcacatgcctgtaatcccagctactcgggaggcgaggcaggagaatcgcttgaacccaggaagcggaggttgtggtgagtggagattacaccctgcactttagcctaggcgacaagagtgaaactctgtctcaaaaaaaaaaaaaaaaaagacactgccaagaaatgtttgaaaaagagaaaaagctatgccatcagtataaactaataactttagtattgatagaataaaagagacggatcagtggaagagcacagataacagatgtaattttgtatattaccatacactatgaagtattatggtggtacttcaaatcagtataaaagatggattttcaactcaatataattttaaaaatacaaatcaagttaaatatcttctttaataatacacaaaaataaatttcaggtatattaaatattcaaatgtaaaaatacaaattaaagaaaagagaatgttgatggaaggtcttttctaagcatgatatgaaattggaagccatagagattgaaaagtttgactacattgaaaaaaaatgtcaccataaacaagagttaaaagtcaagagcatactaggggatatatttgaggcctgtgtaataatcaataatgtcgatataaaaaagagacaactcaatagaaaaatgagaagaaacattaacaggcaattaatggaagaatataaatagctaatcaaggtgtaaaaatatacttcattaataagcaaagaaatgtaactaaaaggctgggcgcggtggctcacgcctgtaatcccagtactttgggaggccgaggcagcagatcacgaggtcaagagatcgagaccatcctggccaacatggtgaaaccccgtctcactaaaaatacaaaaattagctgggtgtggtggtgcatgcatgtagtttcagctacttggaggctgaggcaggagaatcacttgaacctgggaggcagaggttgcagtgagccaagatacaccactgcactctagcctggtgacagagtgagactcagtctcaaaaaaaaaaaagaatgtaaattaaaataaggtatgttttgcctaactgacaaacatgataaaggttaatgatactaatgttagtgataatattaagttggtataacttgctgtgaaaataaatttattatattgaaatctgtataccctttgactcaataattccatgtttaacaatgtatccttcagattactcacataagcaagtaaacataaggtgtacggggatgtattttctgcagtacagcttagagactggaagtttatccagggaaaggactttgttctgtttaccactgaatcctcatgttagcacacagtagtaggtggttcaatgaatatgcattgaatgaatgaatgaaaaatgaaaaactggaaacaacctatcaaaaaggctaaataaattcaagtactttaaaaatagcatatgctatacagaggttaaaagaaataattagctataataaattcatattgtcaactaaaaaacaagttgttgacaatttatgttcttatttgcatgtgtaaaaaataaaaataaatataaatttatgtacttaccatatatagaattatataaaattatatataaaattgaatttttttcacaaagagtcttaagtacaagaaacaatatgtagtagctgagatgtgggttttgggaagaagaggtcatacattctattttcttacacatttaaactattgggctttttctctttaaatgagcacatattatttcatgtaaataatacaggttattgggggaagggaagatagagccctttagtaaaatgaaacagggagaaaagttaatattaaaaattcctgtattaaggtgtacacaattgcaaaagttgatgcatgaagctgactgagtatcctagagctcaagccatatgacgtctacttcaaaggcactatttctgagtcctactctagttctgttttctgcaagaaaaaaaagtattttaagatcttccccaaatcctcactgctaggttgtcctatatgaaatcagatagactcttaataatcctttctaatttgtctcctacaaaccctactttctcatttacctattttttcctaccctattttgttggggggggggcacattaactgcttgattagtttgtccttaatagaagactcacttcgttaccttttgttatctcgtcaatatctggcttcatatcactagtggttaggtggccttaatagtgcgcaaaatcagctgggagcccctctacgcagttaaggttcttactatagacaacaggagactatcacatctctcaatttcaaaactttttcaagcctttctcagctgaaataacctgttcaacctacttcccattcatacatttaaaactatatactgggttccacaatattctgagcattctatggaactaacagtaagatacatacccaggggaaataattgtgttatgtattattatgacgtgccctttagatgtttctgcaactctcagcttacagaatcacagttttataatatcaacaataacacaaatataatacatgacatatttaataatgacgttacccaaaagagagttttccctttataatattacatttttaaaatcgataggaacattctagtatgtatcctttaccttgtgtaagaagtcttctaattgctcaaccgctttgttgacatctacttggaaaaattcccaaagtttaagctttggaaaatatcctcccaaattatttttcggatggactgaaaaatgtcaatagttaaaaaatacaatatacatatacttatttaaaatcagttaagcaaatactgtttatcatattaaaatacagttctaagtaattttcaaccatatatttaatgtgtgctttagaaattttttctgttttatgtgatactcctctgtacatactgacattcatatggtgatcattttcaatcaaagcaggattcccttttctttgtatttcccttctgcaacatcacaggagaaacgccaaagtgctcttctaagacccaggcaggttttaagtgtggagaattcacaagattataggcacattctggtgttcctggatccatttactattagcagctgaaggaaaaaggagacacaaaggagtatccataattaaattgaaactgtatctatgttaagtttagaggtgaaataaaatataaagattaccactcatttttttctatattggacatcaattttacgatgatactgttacaggaaaattttttctttggttatggtatcctatcattcgcttcagcatactttttttttttctaacttaattctgcttagaaaatccgatgaaacaaaaagcaactctctcataggtaacactttgtatggctcatcctaaagtgttaatgaaatacgttgttttgataagttggataaaagcgggttgagaaagtgctaaaataaatacgctcaaggaatacgaatgtagcttatagttcagatcagaatcaggagtttggcacagtattccaaatatttacaacattgaagataatttgtttggccaggcacggtagctcaaccccagcactttgtgggagtggaggtaggatagcctgaggagttcaagaccagcttgggcaacacagtgaaaccttatatctacctatttaaaaacgataatttgttttaatttaaaataaacgaatgaaagttacatggaatttgtttgatcttaaaatggactaataattatccctgaattcatattgaagagcatgagtgattaatgtgtaaaaataaaaagtagtaacaattactgaatatttaccacataccagaaattgttctaagcgttaaatacactaatttattattcctcacttcctaccacacaaattaggacatactgtttgttcccttaacaaaagagaaactgaagcacagagagttaagtaactcagcccaagtcaacagtcaggaattaacttggccaagtccctcttcagaatatgcaatcttaaccacattgtctgctgctgaaatgaattgtttgtgcttcatttactcagctgagcacccttatataatttagaatcattattatttccagtttcagtcatttatttagtaagtcatttatttacttatatttattcatacccataataagcactcagatgaagaaaggctatgtaaggagcaaagagttgtaataaaagttaaattggtaattctcaaaacttgcattaagtagttcctccgagatcatcaacacaatcactgaaattcaaggtatttttcaaaatgacaaaatgtagtaataattatgtccaaataggattttcacgtataaagaataaatattggggctaggtgcagtggccacgcctgtaatctcagcactttgggaggctgaggagggagtatcacctgagtccaggactggagacagcctgggcaacatagtgagacctcatctctacaaaatttttaaaaaattactgagcatggtggcatgtgcctaaagtcccagctactcaggaggctaaggtgggagggcgcttgaccccaataagtggaggttgcaatgaactgagattgtgccactgcactacagccgggtgacagaatgagaccctgtctcaaaaaaaaaaaaaaaaaagagtaaataccaatgcgctctcattcatccatttatttttgagaaaggtctttctccatcacccaggagtgcagggtgcagtggtgcaatcatagctcactgcagccttgaactctagagctgaagtgatcctctgcctcagcctcccaagtagtcaggacgacaagtgtatgccaacacacacagctaatttaatttttccctttttttgagacagagtcttgctttgtcacccaggctggagtacagtggacagtctcggctcactgtaacctccacctcctgggttcaagtgattctcctgcctcagctctggagtagctgggattacaggcgcccaccaccatgcccggctaatttttgtatttttgtagagatggggtttcaccatgatgcccaggctggtctcaaactcctgacctcaggtgaccatccgccacggcctcccaaagtgctgggattacaggtgtgagccactccacccgtcccaatttttaaaatagcaaaatcctaaaactgtttcttttttcaatattttgaaacaaaatcaactgtaaaatgaaagaattctaaacaataggtagtgaaaatatttttttctaattcacatgaaagaagagtcaaactccaaactatgttttaacacacatcaacattaaaaaataatatggacttctggagtgatacagtaagaaactcaacaaacactgtccctagcaaaacatttaactggtgaaaataattttaaaaacaatcatttagtccctggaaattatcctagggattcagcataagaagaaacatttatttaagataagaacagcaagagtcttggcatttgaccaagaccttttccagggcaaatgggttcccagtgttcttggcctgctacttgtgggaaggatgtcagctctgcaagtaggggctgggtggagaaaaggagatttttctccacctgccgcttggaatagaacttctgcaacacggccgggtgcggtggctcacgctttgggaggccaggcagggtggattgagacgaacctggccaatatggcgggactccaactctactaaaaattaaaaattagccaggcatggtggctcatacctgtaattccaactactcgggaggctgagcacaagaatcgcttgaacccgggaggtggaggctgcagtgagccaagactgcgccactgactccagcctgggcgacagaaggagactccgtctcaaaaaaaaaaagagaaaaaaaaataaaaaaaaagaacttctgcaagacagggccggcagggagaattaaaaacactcatagacgtgcctcttagcatgaaactataaccccaggctgggagttgggaggagagaatgtctcctcttggccacacctaccaggagtggagcacctgtgatacagcttccataacagaggcattgtgtaagataatggagcaggtcttggttcaatcaccaaggactcctgttcttactaagtgtagtagatcttcatatgtttctccatatgctaaatatccgtaggacaatttcaagggatttaagtgattgtcttaaaataattttcaccagttagggttgtttcactacgtaaagatgtgtgaagccttcacataaccattctggaggttgaattctgctagataatacttttttaaagaaaactggctgggcacagtggctcacgcctgtaatcccagcactttgggaggccaggtgggcggatcacttgaggtcgggagttcaagaacagcctgaccaacatgaagaaacccatctctactaaaaatacaaaaattagctgggtgtgttggtgcatgcctgtaatcccagtacttgggaggctgaggcgggagaatcacttgaacctggaaggtggaggttgcggtgagcgagatcgcgccattgcactccagcctgggcaacaagagtgaaactccatctcaaaaaaaataaaataaataaaataaataaataaaagaaaacttgtttcacagaaaggatattacgtttgcaacacttttcaagtaaggctgtggcaaggtttacttcttttacattgcacagaactcccaaatgtctcagaaatacagtctgtggtagagactgctgctgtactcagttttatctccctttctttctttagtaataaaattcccaaggttcaactttacacatagctgacaactcaagactacgctgcaggtctcctttaaggtaggtatggcaagagacaaattcctgtgtgcaatatgaacacagtaatatatatcatatcatacccaaaaagacatgcctgccctttctcatttccactggggagaatgtggtagcaggagctggaatagccatatctgactaagatttgaagcaaagtgttggagactgcagagcaacatgagagaaactagttccctatcaccctgaactaccatcctagtccaggaatgcctatctaatcttttgtaagaaataaatacaatttagcctttagtccctatgtttttctgttatagctgcttatgccatatcctaactcatcaatttataactcataaaatgcccttatgtggtttgataaatctgatttcaataatatttagatctcaaagtgattatcaagactgtcaaattttcctttacaatttttttacattatttgtaagagatgggggtctcattatgttgccaaggctggtttcaaactcctggcctcaatcatcctcccacttcagcctctcaagcagctgggattacaggtgcaagccacagcacctgcttaataatgtcaaattttcaaatgaagaatactgagttcttaggtattatgaagtttcaccgtagaactggaggcttggtttctaggtacatgcagaaacaccaaattttagaatgacctatttctttacctaactttgccattatgattagagatttttatttatattgatgaacagatctatgagcttttaaatatcttcatagtttctatggttacttggagaactgtttttgaaacagcagattgtatcttttaaatgtttgtaccaactagaattcttgttctttacaatgcaaatcagtggtttccaaacttttctacattgtagcatacacacaagataacattttaaggtaaactgggttaaacccaaagctgctgatggccacgctttgtcaggctaggccagccaggctcagctcctctgacaggtgaggggagcaaccatttcctcaaggatcactagcggaaaaatctgatctattttaatagaattatataccactaaggaatcttaggaaccaaacagactaaatttaataagctcttttaacatgtagaagacataatttccaaatacaactttgagagtttactaataagtttctctccaaataatagaagtcattcagttttttcatatagctatagtactatagtaccagagctcctgctaatataggatccatgagttacttgggaaggattaatagagtagtcccctcttatccttaggggtaccttccaagacctcaagtggattgtaaaactatagatagtatgaaaccctatatatatatatattttgatattttgtgttttttatctgataactgagcaggctattaagtaactggtggacaggtagtatttacagcatgatgcactggacaaaaggatgagtcacattccaggtgggatagagcaggatggcatgaggtttgtcatgttacttaaaacagcatgaaaattaaaacttatgaattgctgatttctggatattcaatatttttgaaatgtgattgactgcaggtaactgaaacctcagaaagcaaaatgcgaataaggggggactactgtactgtaagttgaaatatgtgatcattatgttccttcatgatcactctcctgtatttataagcaacagatgcaagatacttatatattgacttaatctcaattaagaatgttttctttgaaaggaaaaatattaattttttaaacggaaggacactaatcatcatttgtgtttttaaaatttatgttagcccctttcctttctctttctttcttctttctcttatttgtgtgtatatgtgtgtgtgcataaattctcatcaaaattaatgaagcagtcaatgaagctcataccagtatgattgtagacaacatcagtaatacaaataacattcattccttttttaatttttccactagctgtccaacatcattccaggtatactttctattggtcttgaaaagtcaggatttaattctaactgattggcaagggagtagcatgacctagaagtccaagagtctgcaatggggtaaaatgaatcatgttgtagcctgcaaagcaaataaagaaagaccactgtaaaaacaaacaaacaaaaccagcctaaaatgaagaaaatataaattaaactttcttaagtaattataaatagcaaggcaagcatgctactggaaaagaggtcaaaacttgggttcaaatcctaactgtaccacaagagactttaagcaagtttatttaaatcttcaagatatgtgtcctcatatacaagacagagataatgagataatatttgaaaaaattcaacacactgcctattagaaaatttatatacttaacatgtagtaaatttatcttctacgagatatcaacacgtgtttctactacttttaatgttccatagtacttgtattctgttttagtatgtcagtgaacttctcattcctttcttcatgtattatccaacttaaaagcagaaaattatattgagatcaggtgcagtggtttgcacctgtaatcccagcactttgggaggccaaggaagaggactacttgagcccaggagttcaagaccagcttgggcaacacagtgagactttttctctacaaaaaatagatcaggccactgcactccagtctgggtgacagagacactgtctaaaaaaaaaaaaaaaaaaaaggccaggcgcagtggctcatgcctgtaatcccagcacttgggaggctgaggcaggtggatcatgaggtcaggagatcgagaccatcctaacaccgtgaaccctgtctctactaaaaatacaaaatattagccaggcgtggtggcaggcgcctgcagtccaagctactcgggaggctgaggcagaagaatggtgtgaacccaggaggcggagcttgcgtgagccgagattgcgccaaaatgaaacacaagtttcattttgctcttggtatttatggagcacatgtcttctacacaaaagatggttaaccaatgtttgttgaattaaaatgatacaaatgataatacattttccttcacttttcaatagcttatttctgatttttatatggtaaatcttagaaatgataagtgtttcattatggagttccttcatttcttaagctgaaccacaaatttgccatttttataggttaaaaatggttaagtatcaaaaatgtaatatgggccaagccagcagctcatgcctataatcccagcactttgggaggccaaggtgggcagatcacgaggcagaagtttgagaccagcctggccaacatggtgaaaccccgtctctactaaaaatacaaaattagtgaggcatggtggcaggtgcctataatcccagctactcaggaggctgaggcagaaaatcgtttgaacccgggaggtggaggttgtagtgagctgagatcgcaccattgcagctacgtgacagggtgatactccgtctcaaaaaaaaaaaatttttttttaatatggttctactacttatattactaaataataagaaacaaaattaaacatagaggcaaaaagatatggttggatttgtgtccctgcccaaatctcattcgaattgtaatccccgatgttggaggagggcctggtgagaggtgtttgatcacagaggtggatttcccccttgttctcatgatagtgaggagttttcacaagatctggttgtttaaaagcatgtagcacctcccactttgttctcttctccttctctggccatgtaagacatgcctgcttcccctttgccttctgccatgactgtaatttcttgaggcctccccagccatgcttcctgtatagcctgcggaactgtgagtcaaacccttttctttataaattacccagtctcaggtagttctttactgcaatgagagaatggactatacacaaaacttttgaaatctatatcacagaggataattacatttatttttttaaatagaaaaagaaagcaagctgacattacctgattcttttgcaaccctaagtctgctttcccatcatcaaaaggtcccaaacacttagctaaaaatgtctgaagagtaacacagtccaagggagcacatgattatcagcaccaacacgtaaaatggggtccacaactatgtaacctccacccttttctcatttctaagggaaaaaacaaaacaaaaacttttcagtcagtgatagaaaaaaatcctcatataatatagtctgactctaactaaaaggttaattgtcccaaataaaatgttttatttctaagcacataaaatcattttaaaagttgcaacaaaacttaatggaaaagctcttttaccctttcacaatctacataattacatgtataatacacaaaatatccaagaatgtggtttaatgaaatataagtatactaaaacctatcagtaataacaagggcacgcaaataacagcaacctataatcaggttgcatgaaattactacattttaagatgttacttaaaataatttacttgatactttagctctgcaatggaccataaaattacctcctagaaatcaaagatattctatttgcatctcaaggaagcactataaaaattgcactgccatggttcatacagtacatttacaagttaggtgacttcaaattacagaacaaattaactttttttctcacaaacaaacacctgacttacccttgaaggaaataatactgaaatgaaccagattgttgcagattagtttacagtatttatcagaatcatcttctctttctgttggattttcccaatccagagacggaatttttctctattaaatgtttctccaggaaatgggtaatttgtatacacggtaacgcttttccctgtaaagttgggcctaatcggaactgtagctcataccctaaataaaaagccatgttaataaactcatcgtaggacttaaattaccacattgaaaaacagatgttttattaaagtattaaaaaaccttgatttttcaattatgtttaaaataactccgcaaacctaatgtgttttggcactactttgtattccaatttagctgaatttcacattttagcaagtatagtaacatcatagagctgtctgctctgtaatgtctctttctccttcccctggaaacgcattctattcacatagcaacttgggatgtgcaaattcttatacaaccccatttaccatgatccccatcctcacccctgaattaagtacccaatggcaggcatctgaggagagaccttctctagatttttctaactgcaacagagaaagctagtttctctatggtgtcagaaagtatgtgatatctgtaaaacttgggagctaccatgggactattatctcaccatactgagaaagctagtctcactgacagaagtcaacctctatagaggcagaattcaggattctaacaggagttctgaggcaactgaacccgactgatatctgctcaagtccagtgatgtgctaataaagatttagcactgactagggtggtgggaacctctgacttggagtgtttgctgactttctggtggaaatatcccgacatgggcaatcttaagctaccaacacgacaacattgaacgtggaagtgggaaggatgtgcacaatcagctcttgtgagccagcaaaagcacctccaacacactactgcctaatccctgtgcttcatggtttagttactaaagctgtcttgtaatcctgagagccaatgcattctacttttgcccaagttaggttatttttaaaaaaacataccttagacttgtgcaatggttacaaatattttgccataagcgaaaacaaataagcacattacagttaaaactgtacttgaaagaaacattttggttggtttaaagcagactttaaaccttctttataattattagatacgaaaatactgactatggtcaagtctattagaaatataatacatataaattttaaaccgaatataactttcaattaataatgggcaataataactgatgaggcaggaaagtttagtccactgagtaaaatctttaatatctaaggaatttctttgagaggaaaaaaactaatattacctatttaatatatattatttataatttataatccttgacttattaaacatccaacaagtaataaaagaggatatactaacagggatattttctgtgaacaaaagatttcagtaaaaacactaagagaatgctctatagtgaaactaagaatttcttctctaagcaactaaatgtatttttctataatacaatttggcattaatatattaagaatgtttatattttttgatctagaattttatatagattttttgagaaaagtatcagtgatgtaaacagagattatgtataagatatttatcacagcctcatttattgaaatgaaataaactgacaacaacctaaatatctatgattggcagtgattaaataaattatggtaaatctacaagctggcatattgtaaagccatataaatcatgttatcaaaagacatttggccaggcacagtagctcacgcctgtaatctcacactctgggaggccgaggcgagaggatcacctgaggtcagaagtttgagaccagcctgccaacatggtgaaaccccatctctactaaacgcaaaaatagctgggtgtggtggtgtgccctgtaatcccaactactcaggaggctggggcagaattgcttcaacccaggaggcagagttgcagtgagctaggatcgcaccactgcactccagcatgggtgacagagcaagactccataaaaaaaaatgtaataaccacttttaatttattctattttgttacattgtacacattttgtagagcttttaaaatatcttctggaaaaaagtatggctgaaacatggcagtaggcaggaggtagagtacatacaccataatactactacaaacgggaaaaaggcaggttacaaaatgtttagatagtataatcctaattaaaaaaaaaacacagaaaaaatgctttttatacattgcataattttataattagggaaaacattttaaaattagagctacaattatgaagggataactaagaaataattacagaaagaattaaaacatgaagtaaaatacttagtgactgagaacataaacatttacatctcacaagaatgactaaatttatctttaggagaaatagtgtcatttgaacaagtacaaacagcagagattagctgtctgggtatatgtgtacaacctgtccccgttaagtttatacaaatactgtttttataattacacaagtattcagagaacttgcagagaaaggttaaaactcatctaaaatctccaaaacagtatttggatcagtgctctaccttcagaaaaaaccccaataattcccaagctaagtcatttatttatataatatatatgtatgatttctcatagattatgtaaattataaaatataaaagttaacttaatgggataagatataatgaaataaataatatttaaataatacattttatttattagtgggtagaaaaaaccttttgctctcactaaaaattaatattgataatatctctcagtgaaaatgtaactaaataaattcattattttaaaaagtcttggttttaatattttgtaataaagtgattcaaagatttcaattctacttattttgggtaaaatcatataatgatgaaagaagcatttctaaaaatatatatcaaaatgctttcactatagcaagggttggcaaagtatatccagcctaatccccatttcgtaaatgaagttttactggaacacagccacatccattcatgtatgtttgcctatggctgtttcctgctacaatgggagttgagtcgctccaatagggagtgcattgcctgaaaagctgaaagatttgcgatctgaacttttgcaggaaaatatgtgccaaactctgctccaagcatcatttccttcaaaaaagcacttaactttctcactcatgtttacatcaaagacttaagttttattttttctgaaaatattttctaagtatcatactatctaatgctacttgttatttctgaaaggacgaatctcaaacactttctaactcatcttttaagttcgatcactcctgtgaggaaaagaactattcttggttactctacctctccttacaaagtaatatagagactgttattaagataatataacccgtaaagctacttaacctagcttaagtaaaagtgcaatgcatggcacatactgcaaacaaatgagggtgtgattgtcaaccccttccagacctacaacctctacttttcttctgagtatgccttttttgtttgtaacttatctgacatacaaactgagagcatattcatatattaacgtaattcaatgttgctaacatataacagacttaaaaaactaaaacggtagagagaaaagaaaagagccctctccctcttcccccctccccctccccctccccacgtctccctatcccccctcccacctccccacggtctccctctcccccctccccctccccaggtctccctctgatgccgagccaaggctggactgtactgccgccatctcggctcactgcacctccctgcctgattctcctgcctcagcctgccgagtgcctgcgattgcaggcgcgcgcgccacgcctgactggttttcgtatttttttggtggagacggggtttcgctgtgttggcgggctggtctccagctcctaaccgcgagtgatccaccagcctcggcctcctgaggtgccggattgcagacggagtctcattcactcagtgctcaatgttgcccaggctggagtgcagtgcgtgatctcggctcactacaacctccacctcccagccgcctgccttggcctcccaaaggccgagactgcagcctctgcccggccgccaccccgtctgggaagtgagaagcgtctctgccggccacccttcgtctgggatgtgaggagcccctctgcccggctgcccagtctgggaatgaggagcacctcttcccggccgccatcccatctaggaagtgaggagcgtctctgcccgccgcccatcgtctgagatgtggggagcgcctttgtcccaccgccccgtctgggatgtgagagcgcctctgcccggctgcgaccccgtccgggaggtgaggggcgcctctgcccggccgccctactgggaagtgaagagcccctctgcccggccagccgccccgtccgggagggaggtggggggtcagccccctgtccggccagccgccccatccgggaggtgaggggcacctctgctggccgcccctactgggaagtgaggagcccctctgcctagccaccaccccgtctgggagtgtacccaacagctcattgagaacgggccatgatgacgacggcggttttgtggaatagaaagggggagaggtggggaaaagatagagaaatcagattgttgctgtgtctgtgtagaaaaagtagacatgggagactctattttgttctgtactaagaaaaattctgccttgggatgcgttgatctatgaccttacccccaaccctgtgctctctgaaacatgtgctgtgttcactcgggttaaatggattaagggtggtgcaagatgtgctttgttaaacagatgcttggaggcacatgctccctaagagtcatcaccactccctaatctcaagtacccagggacacaaacacttggaaggccgcagggtcctttgcctaggaaaaccagagacctctgttcacttgtttatcgctgaccttccctccactattgtcttatgaccctgccaaatccccctctgcgagaaacaccaagaatgatcaataaaaataaataaataaataaataaatacaagaaaagaaaagaaaggaagaaggaaggaaagaaggaaggagggagggagggaggaagggaggaaggaagggaggagggagggagggagggagggagggagggaggaaggaaggaagggatgttatattttcttctgtagcccaatagatatatcagcgcataccccaagggatacatagccactctgtagactctaatgcaaatcactgaaactaaaatttttatatacagtaaatgaaacatcagagagctacagtaggtcagattccatgactcagtttgctaaaattagctgaggtcatagcagtaatggtgtggctatcttattcctcatactaatgctaggatacttaacttgcattagccattctctcttgtaggcaactagcataatgagtgattaaactattattgtaaataaatatgtctatcttttcccctccactcaatttatagaaactcagtcttctaatcaaagaacctttagtctaaatattttctttaaaaaatagtaaaaattataaatttcatcaacctacttaaaaatggaagaatttcagatttgggaagtacttattttgttcattattcttttttttttttggaccgagtctcgctctgttgcccaggctggagtacagtggtgtgatcttggctcactgcacctctgcctcctgggttcaagcgattctcctgccttagcctcctgaatagctgggactcaggtgcatgtcaccacatctggctaatttttgtatttttggtagagatggggtttcacatgttggccaggctggtcttgaactcctgatctcaggtcaactacccgcctcggcctccaaagtgccgggattacaggagtaagccaccgtgctcggcctgattttattcattattctccactaaatgagataggaaataagcgaaaaagctatgatttgtctagaaaagatcattattattcttgtacttgttgaactggaagaatctatagaaatatcagtcttaaaaacgaggggaattccttcttgtagaaaagagagaaggaaagaaatatgagggctttgatgaccaataaatatgaaacagccaaaaactgccagagtttttcctcacatttgattggttaccaagtctctgaacttgaaaataactcatactttgtcctctctttttcttttttctttttttttggtcggagtctcgctctgttgcccgggctggagtgcattggcacgatcttggcttactgaacctccgcatcctggattcaagcaattctcctgcctcagcctcccaagtagctgggattcaggcacccgccagcacgcctggctaatttttatatttttaggagagacagggtttcacatgttggccaggcaggtctcaaactcctgaactcaggtgatccgcctgccttggcctccaaagtgccaagattacaggtgtgagccaccgcgcctggccttgtcctctctttttcaaccaggctgttcaatccttttctttaatcagatgtgtttttaaaatagccttctcaatgctcttgtctccaatgtcccttctctaccactcttccactcatctttcacatttcaaattattttttttttttttttgagacggcatcttgctctgtcacccaggctggagtgcagtggcgaatctcagctcactgcaagctccgcctcctgggttcacgcctttctcctgcctcagcctccgagtagctgggactagaggcgcccgccaccaggcccggctaattttttttgtattttagtagagacggggtttcactatgttagccaggatagtctcgatctcctgacctcgtgatcgcccgcctcggcctcccaaagtgctaggattacaggcgtgagccaccgcacccggcttaaattatcttctaaaacaaaatgatcacaccattactgcaaaaaaaggtggcacattctatttataacatttggatacatttaccggttttaaccagagttataaagtcaaccacatcttcttttttcataaatccttcaatttccctcttcaaataggttagcttttacaatttttctagttttaactagagttctagtaatcaatcagcagtacactgcactaagtttgtaaggtgtccctatcctcacagattttattttattttttatttttttttaagatagagttttgccttgttgcccaggctggagtgcaatggtgtgatctcagctcactgcaacctctgcatccaggttcaagcgattctcctgcctcagcctcccaggtagctgggattataggcatgcgccccacgcctggctaatttttgtatttttagtagagaaggggtttcaccatgttgatcaggtggatggtctcaaaatcctgacctggggtgacccacatgcctcggcctcccaaagtgctggattataggtgtgagccactgcgcccggccctttatttttgttttttaaagacagggttcactctgtcacccaggctggagtgcaatggtgggatcatagctcactacagcctttaatcctgggctcaagagatcctccagcctcaacctcctaggtagctggggaccacaggcaacaccatcatgcccagctaattttgtttcttttttgtggagataaagtcttactatgttgccaggctgaccatgaactcctggcctcaagtggtcctccagcctcagcctcccaaagcatgagattacaagtgtgagtcacctgccctcatcaattctcacagattttaaaccctagttgacactgtaagactaacaagcctttagacactgcttcattattcagcacttaatagtttgtgctcattgtgtaattggaaatcaaaggaagcagacagtgaaaaattagggaaagactcacaaaggaggtgatattctagctgaaagttgaaacttaggcaacacatagactgacataaatgagatttaacagatataaaggaatctgatgggagtacgggtataaggacaggcagagaaaacctgctgagaagggaattaacaggaatgacttgggcaactgtaaagatctatacattaatgatggagaatgagatacaatcttggctaaggaaggtgtagtctcattacagatgtcttagaagtcagacagaggtatttaaatttgattttatacataccacttaataacaagggaagagactgcataagattattctggcatctatattcagccatacagaatagacagcaatcagagatatttggaaagaaactgcaagcttaaaaagagactgcaggaaaagagagaaatcatcaaagaatataaggtttctaccctgggaactataaaaatggagatgccacgaataaacagggaagctgagaaataaaggatcgagaatgggcaggggatatttttggacagctagatttaagcatatccaagttgagctatcctaatactattctattgcataatatcagttgaagccaaggtccagggtgggaatacatggagtgattcatatcaatgccttatattatttagggctttatcacaaaaaattcatgtattattaattttgagtctcaaaacctagaaggtagaagaacagaaattaccactttcatctcaccaataaataaattaatgctcagaatggggccatgcccggtggcttatgcttgtaatcccagtactttcagaggccaaagaggggggttgcttgagtccaggagttcaatatcaacctgggcaacatagtgagacccagtttcacaaaaaaaaaaaaaaaaaaaattagcggggcatagtgatgtatgcctgcagtcccagcacttgggaggctgaggcaggagaactgcttgagcccaggaagttgaggcagcactgagcatgatcatgccacaacactcagcttgggcaacagagtaagaccctgtctcagaaaaagaaaaaggaaaaaaaaaaaaaaaaaaaaagaaatgaatgctcagaattaatgtaacttgcccaagtcagcttgttagcagcagagccaggagaattctggctctagatctacccgtcatcaatgctgaaagcttccaagaagaagaaagctcaaggcttttcctccaaaagtagtcattgcacagaggcaacagttgaggccatgagactgtgtaactaattctttgaaggagaacagaaaagaattcctagcagatacccataattaattaaaaagtgaaaggaagagagcctagtagagacaccaagttgacaagaatatgcaacaggggagggggaaaaaaaaatcaaaaccaaaaagtgcagagtcaggaaagccaaaaatggagtaggtactcagtgattttaaatgccaagttggaaaaaggcgcggatttggcatgaagatatcacattgtatgtgtgaaattttttcaaaaatttaattcttaaaacattagcgaaatttaaaaattcctttgaaatgtttatgatagcaacatccatttggtacattaataagggggactggatttttcatatattacacttctcaatgttgaaaaattacaaaggctaagaaaataaaacatctattaactagccttgtagaaagtaatttgatcttttaaatacagatcaactatatatagttcaacataaccagatgattattgcactttttatttgctaagaaaatattttcagcttttacctactccacatttgaaagtttttgatatacataaacaatagtttactatactttttgctgcaatctattttgtcattcaaaggttcaacaaaggaaaagagacagttatacaaaggcaaaactacatgcataccaaagcaaaattacatatgaagtaatttaccaagttttaatagtaaatgttattagaaaaatatgggcaatcttctgatcatatatttaacttcaatcttaagtgggaattagtacgcgagaaaagagaactattttatccttatcctaacacgagggatataaaatatttttaattaaatcaacattaattagtgatatatggagaacacagcaccatctttgcacaaatcaagtttagacccttggaaataatatttatcttaaagctttaaaacatttaacaggactgccaagaattaaaagtttaaaagacgcaaatgagcaaatcaaaacaacttgctactgaccttgtcaagtctgaagagggtcttttccagtttctccatttcgttcagaagtaaaattcgaatcgtttactgtgtcccattttggcttctagaggatttgaaatctttcataagaattaaaagactccacagtcgaatgagttacccctatgaaacaaaaaggagttaaaatatcgaaaatactattgccttaaactctccagagctgacagcggcacttacatgttcgaagtgtgttttagcctagcagagcaatgaaagagaatgaatcttataactattaagattcgagaaggcaaataatagttgtttcctgcctttgagcacaacgaataagaccgaaataaaaatgctgtattcagattcttacaattaaaaaattaaaaacctagaccattctcagagaaaagcaatacactaggaaagcctgaagtcagggggacattcccagccccaagccacagggctctggagactcgaatggcacttctgcttacaagagattagtctgctcaaagataacaggtgggcaatctcccattcccaaattcgggtcgccagccaccaatggggagatgagaacagagggaagcagtgttgcctctggaatagctgccgtagacagaagatgtacagagcgagctatagatagaagaatgcgtttccccgcgaggccagcggcattcctagcacttacgccgagggagttatactgcggcttctggggcactgcaggacccgcgactctggtgctacggtcggggggaggggaggggagaaacagaaggggaagggctggctgcccagcctcgcacagaagccgcagcccaagagggccgggcgccgtgaagggcaaagggaggggcggcgagcgaccggggcagcgccgagcagctgggtgagaagcaggcagagtctcagcgacttcgcctcgcgcgggttcctgggccacccggtacccaacctggccgtgcgcgcactcgccccaggtgggagcggaccgtaccttggcccacttccgggaggctcgacccgcccgccccgaccgctagtctcgcgagagcgtggcaccgcaccgtctcagtcggctccgggccgggggacctggagcctgctgcggctgaggcgggagcggcgctttctccttgccctggggaaggtgcaccggccaaggcgcggccttccttaacagcctgcgagctcacagttgcacattaaaatcccgcggtaccggctgcgagctagttgagctgcacagtaggatcttttgctgggaagggctgaatggtgaggggcaaacgactggcttctggtgtcttttgtgccaccacgtgttttgtttctttgttttgataatttttattggcctaagttctcagagtcctgatttctaagtgtctaaaataaggggcctggctacaccttgacattccagccaacacgtgtccatcacttctagtgctaacagacaggacacatgtcctgaatgcagacccagtaggtaaggtgtggccagtctgcaaaccatcgagagtgcaacaccactgatacttaacggtgtccgggtgtacctcatgtacactagatagacccggagacgtctgagattaagctgcacttatgttaggccagtaactcagaactttttgcagatgctaaggagatttaatgcctgagggtaaaggaaaacccatcttccagggcttttggagggctctaatggttatgagaaaatggacagaagatttggttaactaagacttgtggcgtgtggaaagattcttgcattctttattgtggaatgactgtaggtccaaagaggatataagttaaaaaaaaaaccccatactgaagtatttgtttatttctgtagatttctgagaatggctagttcaaatggtccgtaactgactttgggaacccacagctcattttctggcccctactatttgcaggcacataaggtgctgggaatgcagcaataaaacagtcactgccctcaaggaactccacattttattggtgggagacagataaattaaataaattatacaggatataatatatccttataataagaaggatatgttatatcctatatataataggaagggggaagtgtggaagagaagcagagagaggtttgcatttctaaatataacgttcagtaaagtgatgccaaactgcggaaagaagaagtctaaggtagagggttacatgtagaggtataggaagtacaaaggccataggcaggagcatacttggtgaaccgaagaagatcaccatagctgagtgaagaagagagtgtaagagattaggacagacagatggggcaggagaagggatcaggagcacagacgggtgacagatcttttaaggctttgtaggccattgcaaggacttgggcttttaaactttggaaaaaagccatggagattttgaacagaggagtgacataatctgattgaccttttaaaaggatcctccgcaactttatgggaaatagttgaataaactgtagagtgtagcaaggaaggaagcaggagaccagttagaaagctattttagttattcaagcaagagaaagtgacttgtgtgtgtttctctgtgtcggggggttgggggtgatgggggggaggtggtatagcaggtggtgtagtgctgaattctggactattttgaagatagaacctacaggattggtggagaaaggagtcaagatgactccaaggtttttggcctgaatgagcagaaagcactgtccaatagaaatattaatgccacataggtcatttaaaattttcaagtagccacattaaaaaaacttttttaaatacaaaattagccaggcatggtggcacatgcctgtagtcccaactactgtggaggctgaggcggagaatcgcttcaacctgggaggtggaagttgcagtgaacccagatcatgtcactgcattcagcctgggtgacagagcgagactgtctcaaaaaaaaaaaaaaaaagaaaagaaaagaagttttgaaaaaggtaatattaattttagcaatataatttacttaatatatccaaggctcatttcaacatataaccaatagaaaaagttactttattttattttactttttgagacaggtctcattgtcacccaggctgaagtgcagtggtgcaatcatggctcactgcagcctcacctcctccctcagccttcctcatccattcccagtagctgggactaccaaatgcattacattggtaaaagtattatttcacaaaacttctatttctgttacttatgttttggtgtactggtcatgtattcttactggaaggattatggttaaaaacaagattgaaagtgattgttctaattgcatgctgtgtaaaatgataattcatgattatgaagtggtgcctggtgttgaatccagctctgccactaactagctgtgaagctttgcatggtactcaacctctttgggccttggttttgcaactataaaatggggatgaaagtagtatctattgttaagtaaatgagggcttaaactgtgcctgatagagactaagtactagcgtacatacaaatgttagcagagtgaggcctgaccatgttgtgaaaacagatcacatttatgtttgtcttcaagttctccctttccatgcccctcccactttcagtctctcctatgactatctcattacactgccctcctgttgatcatgttctccagggctccaaaattagcctttcttgctgtccttcctccagtaaaactctcatttaatgcccagtgttgcaattagatataaggagtaaaagatattgatgacatcaattctttagtagtgatttattctcatacaaatgcttgaattttacaagatttgtaaatccaaacatcttaatcttggaaatttcatattttgaatgaaaatgaagactgctaagtaatggaacatgattaatatgatgtgcctctaagattaattttacaagctacatagtgtcctttttaaaaagaaaagtcacattattgtgctatttgtgaagttcttggaatgccaatgagtttgcgtctagggctacagtggtgccatgtgcagccttcattttaatgcacatttgtcatgtgctgtcctgtgcatgacagtgatctatatatacacaataatctcatgctgtagttgtcagggaaggctcaccttggggaacatctgatggataacctcaactatttggcagtgactctaggctttctaaaacattgaagttaatgcatttggggagtgggaggaggactgtagttggaaagactttctccagggttgtgtgtatgtatgtatgctttctgaaaggaaaagagttatttggttattatttataattaggtcctaatcctgtgaccttgtggatctgaaatggatggggtgccttatatttggtttttatattctttggcattttctgtgcactttatttcagagtgcccattattatcatgtcataattttactttgtaaaatttggatttgtgttttcagaatccttctaaattgaacaacttattctgtacttttgaaatatccagatacagccagtgagaagaaaagggaagcagggaaaagaaatagagttgaagttggagaagtggaagacttgaatgtatgatacagaggtatggaaaatcagagagagattttcttaaagtgagatagaaaacagatttagaggcaaacaaaccttggattcgttttaatcactctgaatcacgattgatcaccctaaaatggagagaacaagacctcacttgcaaatttggcatgaagattagaagaaaaaaaaaagcatttgaagcatctattctagcacttagcacatgatagacttttaataatagttttttaaaaaagaaggggtcacatctagttgtccttgctgggttcaagatggtagtcagacaattagatgaagaggaggttcccagtgcatggcagaggccaaagtttccagaaagtttctactttgtgaagaggggatataagagtgaattcagtgagcaaaatcagagcgtaattgttcagcccaaattagaaaacaaaaaaaaggcagaacctaagaatgaaatgaggattagtcgtatacaataaatatttattagaaaatgtattgagatgtacataaatagtggtaaatatgttgtatttctattcaaaacaaaacttgagctcttagagtttgcataggaaaagtccttaaaaattcctaataattgatataataaattagtcaaaaacaatgtatggaatgctttgatgcatgacaggaggacacgcgagaggctttttttggtggtgatctttccttttttcttaagtagatcttttaaaatgttgtttggccccaatttaaaaacgaaatcatttactcttgcaataaatttagctgcttgttgttggaagcaagcctcccaacatctggccataaactggcccaaaactggccataaataaaatctttgcagcaatgtaacatgtccataatggccataagcccaagctggaaggttgcaggtttacgggaatgagggcagggaacacctggcccgcccgggcggaaaaccgcttaagggcattcttaagccataaacaaaagcctgagcgatctgtgcttaagggcgtcttcctgctgcagttaactagcccaacctattcaattaattcggcccacccttcgtttcccttaagggatactttagttaatttaatatctatagaaacaatgctaagactgatttgctgttaataaatatgtgggtaaatctctgttcggggctctcagctcggaggctgtgagacctctgatttcccactccacacgtctatatttctgtgtgtgtgtctttattcctctagtaccgctgggttaagttctctcctaccgaggtggtctcggcagcttgttaaattgtgagctccagagtttccataaatgagcgctttgggttggcagtatagctgaagaaaaggaccaggaaagggggacttcaagctgatttgctgtatttgttagcatcacctcagtgcagatggcaggaacacacacacacacgacaaaagtggcttaaataagagccactctccatattttctctcacataaaagtgtagaggatgctgggcccggtggctcacgcctgtaacccagcactttggaaggcccaggtgggaaaatcactggaggttaggaatttgagaccagctggcccacatggcaaaactttgtctgtactaaaaatgcaaaaattagccgggcctgctgtgtgtacccctgtattctcagctactcgggaggctgaggcaggagaattccttgaaccaggaggcagaggctgcagtgagccgagatcatgctactgcactccagcctgggcgacagcaggagggcgagactccgtctcgaaaaaaaaaaggctagaggtaagctcttcaaagctgtgaggcagctctgtaaagtcatcaggaacccaggctcctttcagcccatagcttcctccttttgtgttgtggatctcatcttcattgtacaataaggctgccagaactccagctgtcaatccaaattcaggcatcaggatggaagaagagaagaagaagggcgaaccttcttcctttaggataattattgaaaatactgtacatttctgcttgtctcatgtttattaaaacttaatccaatgtacatacaaatgtaacctttatgtaggcagcaatgagtctagctaacacccagttttgttgttcaggaaagaaagaataattttggtggacaactagtagtctctgacacagttgcgtggtattttattttaaaatttaattgttgtcaaagtgacacagtttgcagcagggaatggaaggctct

SEQ ID NO: 5058 - DNA, 100000 bp, Homo sapiens
aaatactcagggcagcatatataatttatagatcccagtgcaaaatacaaaagcagggcctttgtttaaaacttcagaatatctagatggcgaaaacagggcattaaactaagtgctggtccttctaagcaggagtcctgcacactgcagaccccagctatgattcattgtaatgagggtgctcagggtattatcgacatacataggagttagccaatccgaagactgctcgtaagtcacttcctggaataaatgaacacggctgattttagagaataaagacaacgaggatattcccctgcatggaccttctcttctctttttcaggtcataggttgttgaagacaatcacttatcagccatctcctgtcaactggcaattcattttgacttaaatgccaatcaccaggagtttctgccactgaacacctcaataatctccctccagagctggaacatacactgtggtggaatggagatgtgccacccatcacccccttcaaggacttgtcccagcttctggaggtgtagtgctgggcaaccttctgctgtcaccccttttggggacagccctcatgcaatgactaatcaggtggagggagaaagccctggccattggcacacaggacgaccctcatggaccattttactccagggttcctggtgggatcagctggtctctctggctagcactccagctcaatttctcatccacccaatcctgcttcttccctcttcattccacaaggattaattccaagggtaacctgtaataaacatccggaacaccaaactccatctcagagtctgcatcccagataatcaactgcagcacagaccaaagaagcttctagggcttggggaggatttttacttgaaaactgtagttatattcgtaagacttatttcttcccaacccccatctagcttctgcagaatcataaacttatttctaaatcctgaaatccgatataaaatagtggaaacaaggactctgtatgtgatgaattaccctctgggttgaaaacttccatttgataaggatcaacatatccattaaaaacatataacatattttgtggaaattaaaccatgagtttattacaatttttgaggaaaacatttgtttttcaatctatatttggggaataatgtagtccataactatactatttatcaatagggtggaagtatttcattgacacacatttactcaattttcaaagaatgaggatttgaaattagaccatttggtgaataagttgggttgagcatagacatggcttttaggatgagcatacttgttgaacattcttagttttctttatttcaggtgatagatttctctctttgctttagtaaaataagtccattagtaatgcatatcacatttgtggaattataaagacattatttgagctgtgatggccagaatgtcatacagtcttctaggtaaaggcagatcttgaaaacgcctaaaacagaattggttgtgggaagtgacttacacattcattcaggtgcaaaatctaactacttcagggcatacattaatcttttgagaacaggatttgaaacaaataccgagatttggaagacaggcttctaaaatctccacagtcaaaccctctgaaagaaaaacacgaattttcttgcagtacataaggacaagttaatcagctgataaattaatattaactcaactcactaattgaacaatactacataataaatctaattcactgactcattgaattgattaaagttgttcttcacaagacatcaaccacttatagtgttattaataaaagcacttagcattatttctttattgatacatagtatatatttttaaaattacatatttatgggatacatgtatttgttaatgcatagaatgtgtaattatcaagccagggcatttgagggtatctatcaccttcagtattatcatttctatgtgctggtaacatttcaagtcctctcttctagttactttgaaatattaatgtattgttgctaactatagtcaccctaggctgctattaaacattagaacttctttttctacttgtgttcatacccattaaccagcctccctctctcacccacccacccttcccacctctggtatctatgattctattctctatttccaagagattaaatgttttagctccaattgagagaatatgtggtatttgtctttttgttcctgccttatttcacttaacagaatgactctagttccatccacattgctgcaaatgacatggttccattcttttttttatggctgaaagtattgcatggtacatatatgtacatcatataaaaaattatttcatccattgatggaccttaggttgatgccatatttttgctattgtgaatagtgctatgataaacgtaagagtgcggtatccctttgatatactgatgaaagaaatatatgtttcttttcctttgggtaaataccagttagtgagattgctggtttgtatggtacatctttttttttttttttaagacagagtttattctgttatccaggctggagtgcagtggcatgacctcggctcactgcagcctctgttctcaggttcaagcaattctcctgcctcagcctgccgagtagctaggattacagattacggcatgtgccacgatgtctggctaatttttatatttttaatagggatggggtttcaccaactggccaggctggtctcggactcctgacctcaggtgatttgtctgcctcagcctcccaagagctcagattacaggcgtgagccaccgcgcccagccgtaaggacttctatttttaggttgtttttttagaaatctctataccaggctggtcatggtggctcacgcctgtaatcccacactttgggaggccaaggcaggtgaatcacctgaggtcaggagtttgagaccagcctggcaacatggtgaaacctcatctctactaaaaatacaaaaattagctgggcatggtggtggtgcctataatcccagctacttgggaggctgaggcaggagaatcgcttgaatccaggaggggaggtcgcagtgggccgagatcatgccactgcactccagcctgggaaacagagtgagatccatctcaaaaaaaaaaaaaaaaaaaaaaaaagaaatctccatactattttccataggttctattaatttacattcccactaacagtatgtaaaagttccctcttttctgcattttcctaggatccgttatttattctcattttaataatagccattctaaccaggggaaggtgattctcattgtggtgatatctcactgtggttttgatttgagtttcctggatggttagtgatttgagcatttctcatatatttgttggacatttgtatgtcctcttttaagaaatgcctgtcatgtcatttccccactttttaatggaattatgtgggtcttttactattcagttgttgcgttcctcgtatattctaggtattagtcccttgttggatgaatactttgagaatattttccccattcaacaggttgtctcttcactctgttgactgcttcctttgctgtgcagaagcttttagtttaatatagtcccatttgtctatttaaattgcctgtccttgaagtcttagccatcatctttgccgagaccaagtccctgaaattattttatttatgtacctcatctcctctaaggagattaaaaaatagaaaatgagcaggtggaaactttgaggtgatggacatgtttatgcatagaatgtggtgatggtttcataggtgatatttgtctccaaacacaaagcatacacataaatatgtataactttctatatgccagtcatacctcagtagagtggttaaacaaatagatccagaaaaaccttagagttccttatttttgtacttatcctaaaattgaagaggaagtagatttattttatttattggttagagaaaatatagaccttggcttctcaggtaccaaaacatcagacgcatcagctgtgatggaccacaaaagacaaccgtcaaagagcttcttatttaagaactcagcagaagtaatttcctacgtgtaaattattccctttttgaagactgaagcctgaatctgagattctaaaggaaaaacaagaccaactttttaaaaagttaactcagtgtaagtatgacacataaaagtgttcaattaataacgatctaatcaccacccagccaaacaaaattttttttttttttttttgagatggagtctcgctgtgtcgcccaggttggagtgtagggctcgatctcggctcactgcaagctccgcctcccaggttcacgccattctcctgcctcggctcccgagtagctgggactacaggcgcccgccaccatgcccggctaatattttgtattttagtagagacggggtttcgccgtgttagccaggatggtctcgatctcctgacctcatatctgcccgcctcggcctcccaaagtgctgggattacaggcatgagccaccatgcccagcacaaaaagtattttaagtatcgtagaagattcatgtgtatttcccctaattaccaacacttccatctccccaaagttatgaactgttctggtgttgcactcctttgttcagctgtaaatttttgaattttatataaatgggatcataaataatcttttgggccaggtttctttggataaatatcatgtctgtgaaactcatgagttcttcatgtagtcaattgctttcattgctgagaagtattttaatacctcataatttgttttccttctgctgctgatgagtatttggatttctcgtttgggctgttaggaattatgtttctaggaacatccttgacaacatctcttggtcacatgtgtacacatttggagtgctacagacagatcgcagagtgtgcagtttgagtcaagctgtcaaattgttttccgaagatggtttttcaatgtacttacatggcagtacctgagattcctgttgcttcattggcactgggttggtattctcagtctgttacattttacacattcagtggtgtctagtggtatctcatggtgcttttaatttgcatttccctggtaactaataagagtgagcacttttccagttattggccatttggatattctcttttgtgaaatacccattaaatctcttgtccatttctctaattgggctttctgtgtttttcttaatgagttttaagattctttaagtttatggtactggttctcagactttagcctgcatcagaatcacacttaggcgctcgcttcagtagcacatatactaaaattgtaatgatacagagattagcatggcccctaaaaaaagtcaccctatggcttgttaaaacacacattcctggcccccaccaccagagttctgattcagtagatctgcggtgaggcacaaaaaggtgcatttctaacgagttcccagggatgcggtatgctgctggtccagggaccacactttgagaatcattatttaatagtgattcagcgtaacagcggtagatgtttcttgttagttttggacaaagtcaccttaaaaaccaaaccaaaagcaaaaacctcaaccatttaatactgctcaagcctgaggcataagctaatacctttcttcctagaatggtgcaaatggacttgcttaaatagcaactgcttcaaactgtctaaacccactgaaatctacccgttagaatacttggtacacctaatttgccaagagaaccgttgatgatagaaggtatcctttgatactgtatttttcgatctcaggaaaactcactggcttcatcagcaagaacatgagtcaggaatcccttgaagcacagaaatacagatctctgaaggagatgaaaactatcatttatttcaattgaatttagtttcattaaaaaattctatgatacattaaaacagaaacaggacgtttatatgactgtctttaacctcaaaagtccaaataacatatagacattttgaatatagctatcgttttaacaaacctcattatgatcactgttgcatttcagtcacctaaaatacgaaccatgactattaataaacatttactgtgtgtggtttttggactgaacattaaccatacgtgtatttctaagtactaggagttgaacagctactacgtcaatgtattttggcagttagctgtgtgtggtgtgtgctttttaaggcttcactcaataaacatcggttgctctctgctgatgagcaaaaaacttgctatacgaaggacaaatatattatacaaacaaatgcacacgtgtgcatgtctatatacatatatgcaatttcagggaggtacaccttattctgagaggtcatgagactccacttcaaaccataatagtaaaacctttagaaactgaactcaacatattacagccaccatcatcaggaaaaattaaagactcatagttcaataaagtacaaaaggtcccaggaagtattgtggtttgttgattcattcaacagaaagccaaatgacaatgctattagtggtcaggagtaaactaacctggacaggctcatgaaaatgacccctggatgcatcctgagaacgtactgcataattatagtcaatgcttgcaataatttcagtttgtctcatcacgttagcagagcctattcatgcaatttagaaaggatttcaatacgcccaaaccaaaaggcttacagtcaacagagggttagccttccataaatgagaaatccaaaaagaataatgccacgtatttcaggaatgtcggttagaggtttggccttcttgggaaggtcacaatgctgagtctaaaactgcaacagttaccgtgtccaagtcatgcaactctaaagaggatggacggtcacatttgtgtccttcagtatcaaagcacctttaagggcttccatttgagaaagtagtattttctcttccttctcttttagaacatatgataaaatattgccctttatcctttaaccatgtatccatttttttttttgatggggagtaaggggtacacactcccactacaatgtcacaaactttttctttttgttgttcctattggttgtaactgtactatttctaacaagaagccttcaggggaaataatggatcctagttatgtcaaagaaaacaatgagcaaaatggcaacttcacagtcttcaagtaaatagaatccctgatataaatggaaattaaatgtaattttgggggcaataaaaacaacaacaaaaacctgtgacaactttgtcctactctttaaaaatgagctttgactctgtagtctcttaaggcacaaaacctgatagacggcattaactggtggcctgcacctctgatttggattttaaaaaacaactattgacatttaaataaaataaaccattttgttagagctggagatccttggataagttgggagaaatattcaaatgactagcatcttgtatgtataaatatttgttgccaaagtaaaaaaaagtacaatgtggttacatagtccaaaaactagtggaaaatgccttcggaacggacttgacattttggttggatcacagtgctgtctcgaaaatagttaaggtcgagggctgtccattggaagtgtttgtaacatgtggtcagtgtgaccaatatgtggataatttcttttgaagtatacctagaaaaaaaaaggtaagcataaaaagaatgtttcaaaattttaaagtctcctccctgaaacaatgcactctgtgtctacttcttcatgtgaagcaaatcatatccctcactgaggcacaatttaagaaagggatgaatctactgtacagagaaattagccccactaaaaccctcagcagggctgggcgaatgccaaacaacctgtagatccattttagttccgatcactctgattcatagatatgtttatctctgtattaaattgataagcggaatcattttactgactcaaaacctggagataattaaaaacagggtgacaaagaggctgggaaatctagcgtctgcatgagggtttctcatttcacacgtaaaatgagcacaatagatttggatgttaatatcaagttgtaatccctatatttataaactctgattgacaagcattgaaatgctggcatatacgtatgaaacatcccggctttaatttgtgcggcaaagcagttatagggcctatagaaatgtggtctgtggatagtggccacaataatgaaaagagaagcaaaagctttaacaatgactcaaccaagcaacttctctaaatgtaagatgataccaaataataggacagttctttgccaagcctttgagttcctgaatctaccaatttctagctgaactagaagagatacaggttttctgataaacgtataatcagacataaaggaaatgaaatgctgtcaagtttctctgttccacaatcatcagtttttagtactgtatcgtatcttggttccttgacagatgcgcataacaaaatgaaataatgtcaagactgtgagctcttatctcaaaacgtgtttgggtgaaaaaggacttcaaatgtaatttttttccccaaagaagaatgtgaaaagttttgtttgaatctttaaaacagaaaatgtagcaacttctgaggctgacacgtgtcacctgggtctcttagtcatacgattctggatctattttataaaccttgctctgaatatattggtgggtgctgtcaacaaagttatcactggagataatggattcacgtacaaaaaagaaagtgctgagacacctgcctacatattaagtgtactttcttttctctcacttcttgcacacttgttactccagaaatatcattacatataacacacaattactaaaatgtcacttaaggagaaaataaattgtccaataatgctggaatgccaccagagaaatctgaggctatttccattataatgcaagtgttcaaaagtaagacttttcaggggaaatttcatatcatctccctctcccacttttttaagctagccatattttgtgtggttataatttatgtactccaaaaaggctattctgtagtgaaactaaaaacagccaaaagaacaaaagacattcacatcactttctactgcttgatagccttccccaaataggctgcttccttcttgtaaccctcttgatgtatttttttaaatatatataaagaaagtgttgttattagcaacttaaacccaaatggtcttagcttcatggtctgaaatacttagtcaaaaacaaacttccttgtatatattctttgatttgacctttctttttctcttctgctaccaggttttataacacctatgggtaacagcacaggtgagatgaaacatcttttttacagtgcaggtgatgaaggggttgagattactgaactacttttagcaaagccctcatgttgtaagctatgtctgggataacaggtccagtctcagctctctcctggattcactgctgattctggaaaaattacctaacactctctctaccagctgcctcatctgtaacatgagataacaatagcttacgtcacaggactgattaatggctacaaactacaggttgaaaacctgctgcattagtgttgggtgtcatgtgaatgctgctcagagaagtggcccctaagcacacagaacgtggaggtatcgcccagctgaaggatgaagacaaagcatttaggaatccctctggtgcatcttttatctttacagaatccaaagctgtggctgagacaatttcaactgaatgaatatggtaacctgggaggcagaaagtagaactgaaagatcatagaagatggagtatgaacacttttgaactggtggctttgaaacttactcaggctgggcgtggtggctcacacctgtaatctcagcagtttgggaggccaagcaggtggatcacttgaggtcaggagtttgagaccagcctggccaacatggtgaaacccatctctacgaaaaatacaaaaattagccaggcatggtggtgcacgcttgtagtcccagcactcgggaggctgaggcaggagaatcacttgaacccaggaggcagagattgcagtgagcgagactgcaacactacactccagcctgggtgacagagtgagagactgtctcaaaacaaaaaaaaaaaaaaaaaaagttactcagattcttgtactttagcattttcatgtgtcaaaagggataataacagcaggtcagaaggactgtgaagcttaagggagacaatgccataagcgtcacgtttgcggcaagaagagtatcaggtcagtgagtatgggaaaccttgtccctcttttcttcttctcttgagtttgctccattatagttcctctaatgtaggatgaaactaagttcaatttaaactctaactcatcagtaaagccaccgtaacagagctagattttactaaaatcacagagcaatacaagctcccgcacgtggacaaaggagagcaactgggctttgattgacatgcattcctaagataccatctgatgtgttgaattcaggctcaagaccctgtcagttcattttactgatgtgtatggccctaattcaatcacagtaactctcaaggcctcaagttcatcattttaaagccagtctaattttggtgtacataattggcatgcatattgtcaaagagtaatgagacttagaaaggacttctgcttttaatataatggagtaatgaatttcctctccttttctttcagaaaccactctgaacatcaaagatattcattaataaaaaataagctaaatcttgtgaaatcaggagagcctgaatggtaaaatatcatgaagggctgccatatgcaactggaccaatggggctgtggcaaggctgagaagatgtctatgaagagcaagcctcaacaatcatggaattctccagttaattggaggagcgctaaggtatgtcaataaagaatcaattagaaaatctttgactgacctatgtacattggtgaggtcctgacagaagacagattgcaattgccaattctgtaagctaaggaggaagaaaggcaaaacatgcactctcaatttcacatacacaacacacccacacacacccacaccacacacccccacaccccccacacacccccacacacaccatacacacacacccacacacacacacacccccacacccccacacacacccccacacaacccacatacgcccaccccccacacacacccacacccacacacccatacacacacccaccccccacacacacccacaccccacacacaccctcccacccccacacacatacccccacccacacccatacacacccacatcccctgacacccacacacacacccacacacccacacaccatacacatacacactcacatccctccctgcatcccccccaccacacacgcagcctctcgggtcataaagtacttctacattaagcacagaaaattccctttagccagaaacaaggcctagccacaactatcctgtaactatctggtctaggaagagttcgttttagtcataggtgagagtaggaataataaaaattattattataattttaagagtagtacagggcctggagatttacaaataagaaatgaagtaagataaacacatgacaaatgttgagcacatagagtttataatataattcattcaaagaaaatgcagcagaatgatcaggctgtgcataacagagatacaaaatacaggaaaacatggcagagcaacagaagatgctgaaacatgagttgacagtggtaaaagtgaagtggaaaagaaaagtgaaaatatcaaagaaatgggctaggtgcaatggctacacctgtaatcccagcactttgggaggctgaggtgggaggatcacttgagggccaggattcgaggccagcctggccaacataatgaaaacttgtatcatataatgaacataatgaaacttgtaaaactacaagaattagccaattgtgatggcgcacacctgtaatcccagctactgggaggctgaagcatgagaattgcttgaaccgggagttggagggtgcagtgagccaagacacgccactgcactccagtttgtggaatagacggagactctgtctcaaaaaagggaaaaaaaaaataaaaaaataagtggcatttctactgaaggcagcacaaagattagccaatgctaaaaaacagtgtgagacacaggataggattgagcaaacaaacaaaataactaaaagttataaagaactaaaaaggattaaggagaaaatagctttacaaaatagacaaaggacataaacatatacatgatagatatttgtaaagaagagaatataatcaaataaaaaaattcaaggaataattcaagtaaacttccagaaaaaaaagaaaacttgaatcaaagtctgaaagactgccaataatgtcctaggaaaactaatgaccctttcagcatacaagaaaaaagatctggctggcatagtggcacacatctgtaatcccagcactttgggaggccaaggtgggatgatggttaagcccaggagttcaagaccagcatggaaaacacagtgagaccttgtctctatggggggaaaaaaattagccaggtatggtggcatgtgcctctagttccagctttaagggaggctgaaagggagcattgcttgagcctgggaggttaaggctccagtgagctatgattgtgccactcactccagcctggacaacagagcaagaccctgtctcaaaaaaaaaaaagaaaaagaaagaagaaagaaaaaaggctgagttgtgtcaaacatggtcatagatgtctccatatgaacagcaacacgagaagaccttagagcaaaggctgcaacatactaagtgaaagaaggtgtgaccaataattttatatccacaactttttaaaatttttatttttatgttaaattccaggataaatgtgcagaacgtgcaggtttgtcacataggtaaatgtgtgccatggtacagccaccactttaaatcagaggggtaacaaagatttcagacatgcaataagtcagggattctaaattcaaggaacctttccctttgagatggtatagagcattgttttgcaactttttttttttaaatgccacccacaataatgggtggcacatttcactgtacacagggacttggtacgcatccatacctatatctgtatctatactgaaaagcatttcaaaaaatattaccattactatgaaaatacatgttatttttcttctattccattgtattctattttacatcttaaaacacactagcatgatggaccaaattgattccacagcaccactagtgggttgtagcctgaggtttaaaagcactgaaggataaactttagctaactaaaagatggagaaagtatcatttaaagaaaagcaaataacagaggcttaagtatatttggggtttgaaggcaaatagaagaaaaactaagcaaaatttggtggtaggatggagacagaagtgtatttatattgttattgtttataatgggagtcaagaaacagcatttagaggaaacaaaaggaacacatgcaaaacaatattcaaagaacaaaaattatctactacaaattaaaaggtaaaaaggaatactaaaaactgaaagcatacatgacagaactaagacaaaacatacttataatctcaataaatgtaaatgtactaaaatatctattaaaaacaaaggctaagattaaacctcagagtaaaacctaaccacgccatataaggagacacacctttggatattcaaagacaatcccatatatagcagacaaagaaagcaagtaaaagcacgcgacccagtctagttttgaaccagtgtggatttaggaccaaaaccattcatgaatcaaagaaaggtgtgttaaaatggcaggaaatataattcatagtggaaacccagttatgaacatctgtggactgaaaaccatagcatcaaagttaccaaaacaaaaatgacagtactacaaagagaaatatgtacagtgtgaaactaattcacctctagatccaagtcacaaaaatagaccaatataaataaggattaataagaatgtaattaacaaagtagaactaattaaccttattaaactctataccttaaacagataacaccatcttttcaatgcccaaagaactctagaaaaactaggacacaaagaaaattccaaatggatagaaaggatatggatgacatcaatgaaaatgaaactgatgcgtaaaacagaaaagaaatgaacagaaaaaacaaaccgcaccaccaaaaagttttaaaaacttccctcttcaataatttctgggccagagaaaattaaatccaaaattgcagaatgtataaataaaaaataaactatgagtgaaagcactacatatcaaaccaacagaatacgaaaattcacagcgctaaaatactaaggaagaaagaatggacacaatgcattcaagaagaagcaacgagaaaaaccaaaaaacaaaggtaataaagataaaagagaaactgatcaactgggaaacagaatataaactagtaaataaatctgataagtcattcccaggaaaaaaacaaaaatagctaacttaattggaagttaattgggaaaagtgaaaagtcagagtggaaaagtataaatactaggtagccattaaaaaatgaggtaactggccggtcaggtggctcacgcctgtaatcccagcactttgggaggccaaggtgggtgggttacctgagtcagaagttcaagaccagcctggccaacatggtaaaaacccatctctactaaaaatacaaaaaattagccaggcatggtggtgggcgcctgtaatcccagctactcaggaggctgaggaggagaatcacttgatggagactgcagtgagctgagattgcaccatagaggtccagcctggcaacaggagtgaaactgctttaaaaaaaatacatatatatatatatatatatatataatatatatatatatatatatagagagagagagagagagagagagagagagagagagagaaaagagagagagagagagagagagaacgctaataaaaaatacacatataaaataaaatgggtaactatatgtattgatataatatggaatataatattaagtgaaaaaccgtaaagaaagctattatttgtgctcaaaaaccagaaaagctatatatgcacagatgcttgtttatgccagaatacatcaacaaagtggagaagaaggtgccagggctgaaacctggcagaggaactcgtgatgaagggcaggtgtggcagagtgacttactttttacttattaaagttttttgcaaactatcaatgctttgaattttgtaacatgagcatatatcatttggtaagctgattcttaaaataatttgtaattatttagtctataaagctacaaaactttggatacttcttttgctttattgggagctaagagttcagtctacagtcttaaaaaagtactgagcttttataaccatagctagaattcgcttatatttgtaaaacaccttatattctttgactcacttaaacataactatctcatttaatacatgttaacagtgaagaaaccggagcagtactgcaatcctggctgacaggtgaggcctctgaggctcacaggccttgggtgacttctgtaaggccattggctctaagtgtctcctccacctattcaaacaggccccaggctcctaggatccaggatgtcagacttcttgtctatctatccatccatccatccatccatccatccatccatccatccatattttttgagacggagtcttgctctgccgcccaggctagagtgcagtcgtgtgacgtaggccactgcaacctccatctcctgggttcaagtgattctccagcctcagcctcccgagtagcgagattacaagcatgcgccaccatgcctggctaatttttttatttttagtagagacaggtttcaccatgttggccaggctggtctcgaactcctgacttcaagtgatatacccgcctcacttcctaaagtgctgggattacaggtgtgaaccaccacacctggccaggatttcataattttgagttgtatctggcaatttcatgagtgcataaaatggcacctctgttactcactggaacctcaaattaggtcggcttcatcagggaagacaatgattgaatttaccctgtgttagggctgatttgcatccccctaaattcctatgttgaagtcctaacccccaagtacatcagatgtgactgtatttggagaaagtctttaaaggtgtaattaagttaaaatgaggcctttaggtgggccctgatccaatatgactggtgtccttagagaaagaggtgatcaggacacagaatacacagagaaaagaccccgtgaacagaccccgtgaacatatagccatctgcaagccaggagagaggcctcagaggaaagcagctctgctgacaccctgatctcagactccagcacgaagtgtgagaacataatctgctgtgggttaagccagctagtctgtgctactttgctatgcagcctgagcaaaccagtgcacccttcagctttatgtacctgaaatgtaattatgtaattaaatttactttaaaatattaaaatactgagtcatctgcaaaggtcagtcaaaagagagctcagctttgcctgcaccagcattttcaggaaagcaactccgtggtcaagaatacgtgattggaagtaccttttcccagatgttgagttttccttccaacaaatgaattctaatctgtagagcgaaaagcttgttgatttagactaatcctcatggtgttacagttgtgaatgatgcttgatatttgatgcttgcacatttaaaaggttgacaatctgacagcttgttctcctaagggaccaagtgtatgcagaaatgtcaagaaaatattcaacttggatgagaatcaagctgttatttccttatgtctttctgtagaggaggtgacctgagccagtggttaggcaggactaaatccaggaaggaaattctgccactgtgtgaatttgggcgactagctgcatcttggatacaaatgagacaaggagcagcgttttcaggcttgacacagaacgctacttaggggaagacacggcctcccccagcaatctaccttctgttctccacggaccagctctgtgtccacatgaaacacatgacccaacatcctcatcaatacagtaagacttacagactgctgtgaggattaatagaatcatacatgtaagaactatgtaaacaatgtaaaataaattataaagaactatacaacgtaagttacgattaatattgttgaattagatggaagattactggaccagtaattgaatttcaattctatgaccaatgtccctttctatatgtatgttatacttgcattaaacattatttaaaaaaagattcctaattctgtctctgctataaattagtcagggcccacttacttttggggccttagtttcctcatctgtaaaacaaaggtgaactatattatcttatgttagtggaacatgctaaaattctatgacctatttcttattactccatgccttgataatatataaatattttttaaataggtattttgatatatagatagggacacatctctttgatgtgaaatcctgaggtaccaaagaacaaaaagggtttttgaggttcctggctcttttgtgactagatatacagggaatcccaaatgattgatcgggttttatgagggaagctttggctgggagacagctagaagataaaagtattctgtaaatttcaagtataaaagaaatacagtgcttcaagtcagcttccctctttattcatacacaatgtgattcttatgaaaattcagaacacagattttgtcgatcctaaagccaggcttgaatccggactctgcctataattctgctagctatgagtcatgggcaatttccttccctctctatgcctcagcctcttaaacaggcataatgagaaggcacagtgcacatctgacacatatcatcatcatcatcattgccatcagggctcaccacacaatcaaatctctgctctgctctattctttggcttatattgtcaatgactaggggcatgttaatgtatttgctagtgcccagcgtaatactgtgcacacaaaggcatttatagaatcgtttgaggataaatgcaggattcaaagaaatatcctacagacagtggcaaggatagttcccacttctgtggagaatgagatgaaataggagctgaaggcaacctaggttttatttggataatctttaatacagaaataccattagatatgggaacatattttctttttcttttttcttttgagacgcagtttcgctctgttgccaggctggagtgcagtggcgccatctcagctcacgcaacctccgcctcccaggttcaagctattctcctgcctcagtctccctgagtagctggactacagatgtgtgccaccacgcccagctaatttttgtatttttagtagagatggatttaccatgttggccaggatggtctttatctcttgaccttgtgatccacccgcctcggcctccaaacaaagtgctggggttacaggtgtgagccatcacgcctggtctttttttttttttttttttttgagatggtgtctcgctctgtcgcccaggctggagtgcagtgtcatgatcttgctcactgcaacctccacctcccaggttcaagtgattttcctgcctcagtctcccgagtactgggattacaggcaatcgccactacacccagctgatttttatatttttagtagaaatgggtttcaccatgttggcccctattttcttattctgttgtctgtaatagatatttaaaatttacacacaaacaagcaattttattctacctacagtgatgaaaacctgaaaaatacagaaacaatgaaggaaaattatacccatattatactgcctatggatgaacagttttgatggggcctcaccatgtactgctagaagtctccttccaccctaagccaagaacattggatgttcttccctccctccatcaatacaactctcacctcacagaattttaaggaagaattacaggtaccatgtgacatctggctaagtcccttaaatcaaactgcagttatcacatctgtagaatagatacttccacatcaccattgttggaaagagatcacgtagcctgcgtgtctttaatgcttataaacatacttcaaggattattcaggctatagctataacatattataaattcttgattgtcctgatggcaattacatctttttttttttttttttgagacggagtttcgctcttatgcccaggctggagtgcagtggcgtgatcttggcccaccgcaacctccgcctcctcggtcaagtgattcttctgcctagcctcctgagtagctggggttacaggcatgtgctaccactccagctaatttttgtatttttagtagagacggggtttctccgtgttggtcaggctggtccagactcccaacctcaggtgatctgcctgcttggcctcccaaagtgctgggattacaggatgaaccaccactcccagcctgacaactgcctcttatagaaggtggaggaagcatatggctatatgggcctaattctaaacaacaaagaatgaggggaaaacccaggtcaacagtgaggtattatgtaacagttttctttacaaataataaaacagaaaccaaaagcaatctaggtaatctaggtagaacattttctaggtagatcattctagaacaataaacaatatcccacacttttgcccaaactcttaaatctcctgtatgtacctcaacagcatttgcctatcaataagatgaaatgcaatgggtttgcagaatatgagtactatgtgctctatgcctttttctatgagatctgaacccacagagtctaaatgtgtaaaaagtctggtctaacacctctccgcttcttggcacacggcatgcacacatgtgtgcacacactcgaccccccaacccctacccgcttctccaactctttgcagaccttacttcaacccgggacgtgccgttaagacccactcatgaagtttgtctctgcaggcttataattgaaaagggtacacagtgcttgttaccatacccatgggccaaattgtgcggagggagccgctgagacaaactttaattacaactccttggagcacgtcacctgttttgctgtttcagtgagggcagcggcttctgccttgcccagttgttgcacctcttgtaaaataggctctctttattttgcagcaaaacatacggctcatcatattctttcgtcttcctgaatctaaaacctgttaatcagcagaaagaaacccattgaaacacaatgtttgcagtaacatattataacagagacaatatttcggaaaggggcaggagagggagagaattgtttgggtggtaggcctggatagtatttaaatggtttgattaccctgttttacgaagcaacaaaggcctaacctgaccttttattactataatgttataggaaaggaagaaaatgaagttctagactattattctgggcactcagcagtcctgtggcattttatattctgccaaagcattttgggttcttatcattacttagtgcttttaactctcagactctcagccttgagggtatttatacatatgatcagagttgggaaacttcttgatttaagaaagtcaaattaaattatctaaaaggtagggtaatgtcataaaaatcagatgggagagacctgacagtaaattaatgccgagccagtttcatagactctaagcaatggaaaagaagtaaatgcttctggaattttttaaggttctagaacatgtcagctgccaagaggggctaaactctggatggtgaggttaggtgcattctgaaatcggctctgggtgtactttattattccgagagagaaaggctagccaaaaagctgttacctaagcagctttagcataattgctctctgcacagaagaaatctctaaaatccaattttctctttggataagactaaagaaccaattaagaaattgagctccaaatcctgtgatcacagcccacatggcacacggggcagcccagtctgcattgctgagggctgatatctgttttcccaatcacctttctttgcttctttctctttcttgagctgcttgcctttagctgctttattgctcattaatatgtccactggaaattgaaagagggaggaaggggctctaactctgcatttctacttattagtggctttggttaatggtttcagagggaagaaagagctgaacaattggcccaaatgacgtacctaggaaaacagttctgaggttaagtggcacttgttcttcagttaggccatatttagagtaaatttatcttaagagaatatgctgaacctccagcaggacacaggttgtttttctacatgtagacattgcagttaattccgtcccatggtattaatcggacacatttattaagcctcataaagggcattttcctgttaatcttttgtttatactgtgaatcactgctaagggcagctttctcaaaagagttcaagaataattgaatctgcacatccacataacaattaaaatgtcctataatttggcatgccaatttagataccccaatgtgtaattttacttaagcatagcattacagaacataaccactcctcctgacgaggaagaaaaaatctgcaatttaaaaatacaggtctctctaatgctaaagactaagtaaataagtaaccaaattacttgctaaaatgatgaagttttagtctgcaaaagcaacaagtaaactttaaaaattattcccacagagttgagagtgagtgagttctctgtaaagactttacataatgttaatggaaaggaagtcctactactatttggtccttgtccaaattcctactaaatttatcacatttgagtgactagtaaatctttccagattccctctcattgtctgaaaacacatgatgccactgagaccaggagttctcaaaattgaccagaatctaaaaaggcagagccagaaaaaaaaaataatgttctcaaaaagcattattattattagattaataataaaaatgacagaagatcatttggtcaaaatactttaagccttataaatatcaacaacttagcaactgcatttatttgttaggagagtttttgagtttaggggtgatagaaccatgaccttaataatttacagaacttaaaattttaacttctataaggtttcacacttaaaaaatataaaataaaaccgcctctttaatatttttttgatatgcattaaaacaaaatataggccaggttcagtggctccgcctataatcctagcactttgggaggccaaggcaggtggatcacttgaggccaggagttgaaaccagcctggccaacatgacaaaaccccacctttactaaaaatacaaaaattagcgggcatggtggtgtgcaactgtagtcccagctacccaggaggctaaggcacgagaatcattgaacccaggaggtggaggatgcagtgagccaagatcatgccactgcactccagcctggcaacagagtgagactctgtgtccaaaaaaaaaaaaaaaaaaaccccaaaatcccaaataccccccaaatatagtatcttataatgaactggattattatagctgcagatgaatctgcagatttgagacaaggcatccttggcatataaatatgacctaacaaagagtatggctacctaaaaatcaatgaaagcaccccataactaaaatatcagtttgtgaacttgaaaaggaaataaaatgggttgaacatgctctgcttttacagtcatcccagaaaactcccaaaatagaaggataaggtaatttccttccttccatccattcatccaatattgagtgaatgtctatttcaaagtatcattttaggaatgggagattcaaagatgagcaagaaacagtctatcaagatgtgacagccagagataaagatggaagtgcaaataagttaaacaacttagcctaggctgcaaaatcggaagatggcagagctgggatttgaacccgggtgtaaacctgtcttctttcctctcatgtgagttcccagaggtacattattatttactttcagtttctttgttttcagaagtaaatatgggcaatgagaactgtaaacagttaattttctaagacaccttttcatttggatataactgcatattttaagaaaaatatgcctgtaagcataaaaaagttcacctattcacttccactacaatttgagtcctattacacccaggactcaaaattatttactgtgtgcctggatatactcacagaaaaagaagacaaattttttgttgttgttgttgaaatagagtctcacctgttacccagactggagtgcagtggtgtggtctcggttcactgcaacctccacctcctgactcaagcctcagcctcccaagtagctgggactacaggtgcacgccgccaaagcctggtaatttttgtttctttgtagagatggggtttcgctatgttgcccatgctggttttaaaccctgagctcaaagcgatcctcccaccttggcttcccaaagtgctgggattacaggcatggcccccacatatggcccaagaaaacaaacttcattaaagtttcaggattaataatgagcagtgacactctgccaaaacacattggaggaaaatggaagtgaaccttcatgaattcctgatttattcagcacacatttattgcacacttactgcattcatgtcattatgctagatgcttggaagaggcaaagatgggtaagtcccagcccctgcttttaggaagcccatactcaaaaaaaaaaaaaaaaaaaagacagaagaaaacactcaagtgactagaatgccagaaaaaaggaaaacaagcgggagtttagcagcagcagaagtcacctctggccaaaatttctgaggagggcttcagggaggagaaaatagcaaactgggccttgaggaatggacagacttagacacgtgaaatggtggtggaggtgaggggtgggaggaccgtggtcattccagatgccgagaggtcgacagctcacctatcacttcctcaagggcagggttatgtgcttgctcttgttcactgttcatctccatggcctggcattgcacataacgtgtgagcaggcaccccatgcacactgcctaaagttaaatacaaaggaagggaaattcagggcacaattgggtgactgaccagtggtgcgtctggtaagaccacagagtgagatccagcagagaaagagtctagctggccctggaaaaagatatggaaggaggtatagggatgctaggattcaggctatagccttggaggaccacatcctcaagttgatggctatagacaagagagagaaaaagcaaaaaggagacacagcaggaagagggcagaggcttgactcacaaattaaatattggaaaagagaaaataaggaacaatctatgctacaagggccaagttaggatgcacatgaaaaaatgctaagaatagaactttaccccttagcctttatgcatgttgagtatacttaggaaatgcctgggaccagaagtgtttcagtttcagatacttttgaattttgcaatgtttgcattatacatacttacagattcagcatattaatccgaaaatccaaaatctgaaatgccccaatgagcgtctcctacaagcttcacatagagctcaaaaagtttcagatttaggagcatttcagatttcagattaggggactcaatcgtatttactgatttgaccaaagattctagatcttttacaacaaaataaagtgactctgattttctttttgtacagaaaaaagggcataatcttgaatttgtatcttcatatcttctgtgctacatgaaaacagtcctgaaatctcctgcttggtcctcacctttcctctacccaagtaaactgtaaactaagccatgcattgatgttggtcccgtggccccaggatctctccagcatgcaaacctcaaatcacttgctgctctctagaaggtcaaggaaaaacacattatactggatgcattagtcagttactcagttacataagctcaatgaagatgtgtttatcaggcctaatatctgcagatattccaggtagctgtcctagatataaaaattaagtgaacaaactgcaaacaatttaatccatttaattggcaggatgccatcgctgatagtggggtgatctcaggaaaggggaagggcagggcagggtgaaggataaagcctgaccataggaaaagaaaagctcggacagctttcactatggcagcaagcaatacagagaaaccccacttagcaacaggcagagtagggtgggagggtttccatttcagaagtcgtttctgggccaccatgatgaaaggggtgtcggagagtcatctgacgttggagattggttccctcactggtaaaatgggtgcctgtgaccttctctgggacaagatactatggcatgtggcaaagattacttaaaatcctgcctcaggcttgaaacagtaaatgattcttctcacctggggaagatgaagggtaggtcccagtgaccactcagccacttccccaaagctctgcaattgtgtgtatttattctcccagtgtgttcatttttattttttgagatggatctcactctgtcgcccaggctggagtgcagtggcgcgatccggctcactgcaacctccgcctcccgggttcaaaagcgtctcctgcctcagcctcccgatagctgggattacaggcacacggcaccacgcccagctaatttttctgtatttttagtaggacagggtttcaccatgttggccaggctggtctcaaacttctgacctctcaggtgatctcccttctcggcctcccaaagtgctgggattacaggcatgagccaccgcgcccagccccatttgtgctttctaccttcacattagttctttgtccccctgaacactttaattaaatgtccagcatatttttcaagaagtaatttttcctcttctgaaatgttctaattgtggccgttgcggtttcttaaagagaagttccatgaagatgaaacatagaatttaaataaaactcaggtagctttgagttgtgtttctccagctggttctgctagaacgatttctagtttgttttctcgaggaaacgctactaaaaagagatttgggtttagaaagaaagatatacattatacaccctaagattgcctacaaagaaaagagctacaatctgaatttctcaggcctggttttgcttcctgtaattcactcccgaagaattctctaactgcagattcgcttattcctcgttcactcaactaccagggagaatccagagcgttgtaaggacgggtgtgcagggactggaggaaaaggtgtgctattggctgaaaggaaaacaggtcacaagtaaccagctaatcctaaaaactacaggaggaagctgtctttaatgtggagatagtggtgcgtattagaaaaaagaggatttctatttgtctgtcttgctctactgttttgtggcaactgagcaaatgaagattaaattagctgcattaagactacaccatgtttaataaagttaaaactgggagaacatcttcataaaataaattctaagcttaacacattgatggcgcttaatgaaccaaaactgggtaaatccctttgggagtcaacacataaacaaagctattaattaggtcgcagttgtttcccaacaagcttttttttgatttacttacagtaaacaaaactatatctatccgtctttgtggagaagtattcacaatgcaacaaaacgtaattattacaccttaagcacttgcaattacaggactgcatgatgcaatagtgttggttatgtccttcattaacatctgtcacttccccagccactccctgagctgccttttggagtgctgagctttgcagctgattcacttgtctctatgttttcacagcttcagaataacagaacagaacatgtgttttctggaacggtatctctaaagcaaacaaggggaaaaacaaacaaacaaaaaaaacaaaacacctccaaaatcaaagatctgaggaagaatgtatttatggtgttcccccgaattgaaagctggctgatgatcagaagctctagaatacagagatgctttcagctaggggttgagggaacatagaggccagttcccaatctcaagctacaaatgcatgtctcctgggttccctgaggctgaatcctgccactgcctgttaagaaaaattgaaaatagttctcacaaagaattcagagcttgtaataagactccttacttaaatttatactcctggtaggacctcctgtgatgccactgatgacctcgtggccagggagccctaaatgaagctctcccaatatcattggagagatcgccatagatggagacactaatggagttgggatgagaaggaaagctccatgttgaaatgcaaggtcatctcaacagttacatcctccaaggaatgcttgcctttccctcctccaagtttacttcttccgggtcttcctcattcatccagaagtcaggtcccaaacagagaaaccaggactgactacccctgtcttccctcaaatctcacttcaatccatcacagtccagttgctttactttgctatttactccaaatctatccattgcccatcttcactgctcacaccatagtctaagccgccattgtgcatggtgtagagagggcagaccgcaacagtgaatgctgcgtttgatgaactgaaggacaataactaaaggactgtggttttactgcaaaggaaagagagagaacagagggaggaaaggctagaaaggtagggagggccaactgtaaattgctttgtagaaccatgttcagagtttagataaagacattactcaaggagaaaaaaattaaggttctcaaaatctacctagagggactggtatataaagcaataaataatgggcacacttcaataatggtaacagcgctgatggatcaagaagatgcttgtgaacagacatttatgtggtcagaagctgattgatcagatttaggagtgaccaactgacttgtcgccaagttctgtccttgcttgctgtctctctaactaatcagaccttctaagttgacagccttccaagcattagataataaaaggagtagctatcaccaatgcggtaacagcaaatcccacaagaagtctatatgatacatttagactacaggcgcctgccaccacatccaggtaatcttgtattattagtagagacagggtttccccacgttggccaggctggtctcgaactcctgcctcaagtaatctgcctgcctcggcctcctaaagtgctgagattacaggcatgagccacgtgcctggccttgcttcctaaaattatcactgtttcccttcattttctaagccctccaatcttatgtaacaaatttcctatgttaaatcctttctgttggaatcatttgtttttctggtaggccctctctgaaaataatttgtgatggatcttctcatctcttcccctgtgacacgttcttgtgaacgtcccaacagcatagaagttctgcaaccttacccaacaagccccttgcatatataaaaacctaaatctttcattaaggggatcaagcatgctgaaacaactgtgacaggacaatgactgtgatcttctattggatactactccgtagtatgacagttagcatcacaactgaatcttagatttggaatattttcatggtaaacttttaacatatgatttttgcatatattatatgcaaagagatacattggatatattgttagtagcactgagggtgtagttaagctatgaattactgctgggaagagagccaaaattaacagaaaattaacttactaggggttttatcaagttttacaaggaaggaataaactgaaaaagtgaacataattgggagcaacaggattccgcaggtgaaggactcaccattatcttgtcgctgtcaataatggtgttcaatctggtgcaatggttagcacggtgcagtgggcaaatttctcccggatttttttttgtattaaccatcagttctgcaatcaaagaagttaagtttaatttcgtaaagatgcaaaaagtagactaagacttaaaaagctctacttcacaatagagatttaaaaaaaaaagatcatatctatttatgttttaaaaatcatgttaaaatgttttaggacaatcttattctttaaaaacaagtataaaatctatgtagtaatttactaattttcataaaacaacgaaaaatgtcttccctccaattgcttaaagctgattattgggagtggattttaggaatctagctctcctgggatactgataatatctctgacactggaaaacacgtttgggtttcttctttttttttcagaatgaattatccatgttaaaatgttatgtctggggcaaacagagcacttagaaatatttctcagaatattccatgtttcccatttacacacttaaaatgtggactcaaggttacatggacctcagcttataccttggatccacatttgccgtcgcttcatcaataatcaatatctgatttttcctagaattgccctggcaaggcacaccagttgtctttgtccaacactaaaattggatcctgatctgctaattcagtatccattttaccaggaagatcttcaatggtttctttaagttgtactgtagatgtacaaagaagaatgactgctatcattcaagccgctatggaagtagtcaagctcatagacattagaaccttcaagtcccttctctcgagagatataacttaagtggacacaacatgaggctgaattacctctagttaatgttcaatgagaaagatggtagagtcaacacaaacggaaatattctgacttaagagaacaaacaatggaacccaagatgctcctttatcacatcagcaaacacagtctgttcatgcagggtcacgtgttaatactgcctgggccaatttcttaagaaaaacacagtatgatcaataaaagtattctgtaggtaaaatacagaaagataaaaaaattcccttctttttagttaaaagattacagaaatttagagagacaataagagtgaggttgccaaggggctggaggattaactgtaaatggacacaaggaaatttcttggggtaaagagatgttttaaaactggattcctgcaatgactgcacaactctataaatttaccaaaacactgaatcacttctaaggggagcattttctgctatgcaaattagacctcaatagagttttggaaaaaaatcatatcagtgtcccccagcacctgaactcccttaccaataaccaacagacagccaacaagaacccctcttccaggtagggaaggaagtttctcaaaaaatgaagctatgctcccaatatagagtctgaagaaaaggtgaaaggatctttctggttgagtcaagttcccaaagcacattttggagacgagtgagtataactcaagggaaaatttaaaaagaaaatactgcaggaagtatggtcctccaaagatatcatcttataggcactttaccattttggaagttttttaatcaactggaaaagttaaaaaaatacaaatgcaaacaatgggaaactgtgctcatttgttaggaaatcaggagcttattcttgggctggtcctttcccaagtttaagccctatggctataaagtaggtcagtacattttctacagtctaataaatgttttgcagtgaataaaactcacaaaaaaacaggacacaatataacatcttgccccagacgacggggatagatatgttgatattaatgtatctttataaaattgtagctataagatgatttgatactacattggtggtggttcagttcactgatgtttgttttggagaaattttatagaacaagagccaaatcaggtgacatttgagagctatagaggaaccaagagtcaatacatctccaattaagagacagcaagcagatagatgagtgatggccaataagcaggtgtacagaactacaatgcccaaaacaaaaagccaagagtaaacgggtaacattgtcatgtaccttaaacacggaagcacactctatgaatgtgatcttgagttgtactcatgatggaagtccaactccaagaaacaggaatttgagttaagattaaatatggtattgatatttggcattagcatgcaaggtaggaaattaaatccgaagtgtaagatttggctcgtggtgcaaaatgttaccctgaaaattataggatgaatatgtcagcttagtcaaaccctctccattacaaagaagaggacttgctgagtaatcttttatgaaacatactcacagacctataccccatgtgatggaactgatcaaaagtagatttagcaaagtttttattagcttttccttctgagttgattttgataatactggtaagtgcaaaaggtcttttctaagaccggcagccagatttgaagaaataatctcacacttgcccttattaaggggccaacccatcattcttctgggttttgaccctccttgaggttatccacattacttgatgaagaatagggttgtgaggtgaagaataatgaacacatttcccagataacaggtcttctgagactctgtcatcatgattgaatcggggatggttatgagaatgatatgaattatggccaagtacagtggctcatgcctgtaatcccagcactttgggaggctggggcaggagatcatctgaggtcaggagttcgagaccagcctggccaacatggtgaaatcccatctcactaataatacaaaaaaaattagctgggcatggtggcgggcacttgtaatcccattaggggctgaggcaggagaattgcttgaaccagggaggcggaggttgcaataagccaagatcggccactgcactctagcctgagtgacagagtaagactctgtctcaattaaaaaaaaaagaatgaatgtgaaggccctctgtagtgttatcatacattcaagttatggttaagtattagcctgagaaaaagacaatggaggcagtggaacacagtgactaagagtgacaactggggaaatgaaaatatattaaacaatggtattacattactcttcaatttcttcagtgaggtaaatactgtattatgtcatgtagttgaatgttcttgttcttaggaggtacacatacatatttaagatgaactgcaacttcatggaaatgtctgcaacttactttcaagggctataagagaggagcaaatgtagcaaaataccgtattaacaaatggtgaatcttggagaagggtatgtgtatttcataatactattcatttgactgttctgtgatttggacattttaaaataaaaaaatgggccttgaagacacacagcatgggtatgagtcctgcctggctctgccaactgggcaagttctgaactttctctatcttagcttcctaattaacttgtaaataagaccatactaagattatttgaagatgtttatctcctaaaattgttggagtataaaatcagtcagtatgtgtagcattacaatagtgcttggtaccaagtaagagatcaatagataatatctattctttttgtttttttgctccttcctggacaatgaaatactgcctattcttttttttttttttttttttttgaggtggattcttgctctgtcacccaggttggagtgcagtggtgcgatctcagctcactcaatctctgcctcccaggttcaagcgattctcctgcctcagcctcccgagtagctgggatacaggtgcataccaccacacctggctaattttgtttttgtatttttagtatagatgggtttcaccatattggccaggatggtctcgatctcctgacctcgtgatccacccgcctcggctcccaaagtgctgggattacaggcgtgagccactacgcccagccgcctatttttaatatgcagtcagctagttcttttcatgcactgctgtagttttcttcactgcatttaccagtactaatattatattacatatgcattttcttattttctatcttccatacaagaatttgtgcctaagagggtagggattttatctctcttgatgactgctatagctccagagtctacaatgctatgtaaaaacctccccacacataatctgttgaatgtatgaagtcacaaggatacctcttttgtgacatgtctattcttataaattacaaagtaaatccacaaagaaatagaatttaatacaattttcttactaaatgtcattgtaaaagaaacagtccttataaaattaattggcccaagatatcataacattatactttaaaatatagaaaacttaatgttttctacatttaaaaaggttgtaatttcaggaaaacaaaatcaaatcatactatttgaaactatacatttcaacacaatgtatcaggttattttgaagcttagaaaaaataggaaactacaggaaaagtgaaataatgaactgaactttctaagacagcccatttctatcatcataaatgttttcaaagctcaaagagactcatgtggatgtcagattctgtttccatgtttctttgaactttctgactttcataaaggaagtctctgatgccagagactgaaatgtgataaacagcaactcaacagagggaacaacctttaacaagaacacagctaagtgtgaacgaagcgagcggaagcccattcgggcaatacaggcctgggaaaaatggaggtgcaaggtgtggggaatagaaggcccagagatgtggacactgctgatgtgcagatttctgtcttatggtgtcctgaatacaagacatcctgtattctaacagcaattctatcaatgttgaacatgattagataatttctccactattcaacatgatataacctagtcttaattgtagatcccagtattaaagtcgttttttaattaaagaaataacgtgctgctgattcattttcttagttgtacctactgtgtgatcttttgactttttctcataaacgacttccatctttaatcattacttacgttatatttacagagttgctttatttaggggcccgaagtggcactaattctagtaaactttcttccatttacagctgacatttttcagtatttacgataactttcagcattagaaaagaaaccccaaaaaacgagcaggtgtggtggctcacgcctgtaatcccagcactctgggaggccgagacaggcagatcactgaggtcaggagtttgagaccagtgtggccaacatggcaaaaccctgtctctactaaaaaacaaaaattagccaggcatggtggggcttgcctttaatcctagctacctgggaggctgagcaggagaatcacttgaacccaggaggtagagtttgcagtgagctgagattgcaccactcactccagcctgggcgacagagcaagactctgtctaaaaaaataaataaataaataaaataggccaggcgcggtggctcacgcctgtaatcccagcactttgggaggctgaagcaggtgatcacgaggtcaggagtttgagaccagcctggccaacatggtgaaaccccgtctctacaaaaatacaaaaagagtagccggcatggtggcaggcacctgtaatcacagctactcgggggctgaggcaggagaatcgcttggacccgggaggcggaggttgcagtgagccgagactggccaccgcattccaacctggatgacagagtgagactctgtctcaaataaataaataaataataaaaataaataaataaaaaaataaccaagatgacacaaccacatccataggactgttccctccagatgcccgaacttcttttgcatgtcaggtattaccctttccaagggatcatggtaagaagaaataaaaaaaacttccaagaaataaaaggcatctttcctttttatgtggtaaaccaccttttaagtggttaaagaggaaaaaactgacagtgctgtcctaatctcaagcaaccctctgagtttgggttcccatttccagtttggcctcatttataaaccaagtgacttgttttttgtctgctttaaagggggtttccaaatgacaccaggtttcctactaaagagcagatgagttatccagttctgaactggatatcaatgaaagatgaaaaccatggagacagcgagagacagaatgtgacagagaagtccagagaaacttgaatggcaccagagtcgtggtgtgaatcccttgtgtggtatctctcaagataaacacacacacataacttcacgtttacaacaccaggaagtaagatttggaattctctacgagaagaccctcagactccacggaccccagggaagaattcctgacctatcagaatgcccccagcctccatcaacttgtagtcatgaaattgttgtgaaaaactcacaatgcttcatttgttaggagtgctcagcctttcccctgacctctagaaggtaaaaagaatacaagcacccagaaggaaatttggaaaatccaggaaaacttagagaaaagaaaacactctcctccagtctttgtctcattacccccaaacgagcaatgtaatgctctggtgtctttcttaggtcaggtgtcagaatataagaatgattaaaaacagctgaatcacactggaaatacaatgttgtaccctaatttttagtaactcttccaaatcattccagaaaaacctacaatgccataaagaagtagttcccagagaaagacaatgatgggataattttcacttctgagggggacctaccacgtcttccacctcatcatttctagaattcttgaaggctactaaattttattttaattttggctataacaaatgaaataagtatgagttacagcaagttccatgatggtttttgataggatcatctcccaattaacatttcttcactgttcaagagaaatgtgtttctaaaaagtacttttgctctctgagaatctgtgacaaggaatctcagctctgaaacaaatagaaaaacactttatgagtaattcttgttcttttagggtgtgtccaatttcactattaaacctgtcctgagagtttaggggcacaggattgccttatctttcttacatttgacagttaactgtacccacctcttctctcctagaatttcactgtacagagatcacaaatttaaatgaaatcagaggtcaattgcttatcaagtatcaggaggtgaagtaatgacctaatttagaaaaagaaaatccccacagttgctggaaagcagggtgggtgtgtaagactcggcaatgacatgccttcagaaacaagaattactggcaggaaactgtcaggcctccagtctacttgctcacagtcaaaacccatctataaattaaagatttcagagctatccctgaagggcaacaatgacaaatgcaccaattcaaaacaacaacaataacaatggagggaaataatctctgtcactcaggctggagtgcagtggtgcaatcatggctcactgcagcctcgactccagggctcacaagatcctcccacctcaactccctgagtagctgggactacaggtgcagccaccacatctggctaattctttttttttttttatttttagtagagacaaagtccacctgttgtccaggctccacacttctttgaaatgaagagatcaaacatattaatacatacttttaaatgcttacttttttttaacttttaatatttattatttattttgggatggagtttcctcttgttgcctaggctggagtgccagtggcacaatgttggctcaccacaacctccgcccccaggttcaagcaattctcctgcctcagcctcctgagtagctggggctacagatgcgcccaccacgtctggctaattttggtatttttagtagacacagggtttcaccaagttggccggctggtctggaactcctgacctcgtgatccatccgcctcagcctcccaaagtgctgggttacaggcatgagccaccgggcctggccaatttttatttttatttatttatttatttatttgagacggagtcttgctctgtcgcctagatgggagtgcagtggcacgatctcggctcatgcaaccttggcctcccaggttcaagcaattctcttgtctcagcctcctgagtagctggactacaggcgcacaccaccatacccagctaatctctgtatttttagtagaaatggggttcaccatgttggtcaggctggtctcaaacttctgacctccagtgattcacccacctcagattccaaagtgctgggattacaggcatcaaccgctgcacccagccttaaatgcttacttttaaaagcaaaagactaaactaggtcctgtgagggattaccagttttatgatatggtttcgccatcaagtagactggcacaaatttgcagaactagactgaacacagaaaatcagtgttaaatacacaaaccaacagcaccttaatagtcaaagtccttttttcatgcaagggtgagaaatttcaagaagtggcccaacaggaaccacataaataatagaaaaatcctctagaaatcacatattagtataaaaccttagcagaggctgcagggttctgttatctgcattaaaattaacgtttgccaataaataattattatcccattccaactgtataatttacctttataaacatttcttataaaacttaaagcatttcataaatatgatctatcttttagttaatgaaaaacactatggtcttcccttactagaaattccctaagaacagagcagtaaaataaatggtgcaagtaacttagtcactaataggatctcaactcataaatacaacttctagtttaacgcattctaaagacaaataaaacaacaccaaactgttttggacaacaggaagaaaattaaaatgaaaccagggaaattttatttttggttttcatcatcatcagtatacacattatagcatatcacatcctcaatgatctcctgggtggtgaacaaagttagttaaaccgctaagctcctcttatttcctgcaatgctgtaaaggtacatatacacatactgaggctaacagactaaagatattacattttatcaattacctcttgtaaggcattccacagttcctcatccgtgtgctcataaagggatccaggtttttcctcattgttccagtgaacaaaacaggttcctaagtgcccaaatagtcacggtcattaccacagactcttttttcattttattccaatgctaacatcaacatagaattaagataccaaaaaataaaattcatgataataattatagcgttacaaatgccgtttacaaaacaacatatctattaatgttccactgtacaaagcgtgctccaaaatacctccagaccactgaacactaacaaaactgttgcaatgtgctatcttaagaagaaaatgaaaacacaggcctgatgtttaaaactgttttcctcatattattagcttaacatgaaatataagatataattattcgagggtctacatgaatagagctatagaaattaactatcaatcatgtatactggaaaataccgacagcatgattaaagtttgtgcttcaaagccaaattattaagcttttccaatttgcactaaagaataaattaggattattttctccgttggcaaaacagtttccaagattaagaatctctcaccgggcgcagtggctcacgcatgtaatcttagtattttggaggtcgaggcgggtggatcacctgaggtcaggagttctagaccagcccgaccaacatatgaaaccctgtctctactaaaaatacaaaaattagctgggcatggtggcacatgcctgtatcccagctacttaggaggctgaggcaagagaatcgcttgaatccaggaggtggaggttcagtgagccgagatcgtgccattgcactccagcctgggcaacaagagcaaaactccatccaaaaaaaaaaaaaaaaaatctctccaatgtcagaatgggacatccttttttttttttttttttttggccaaaggagatctaaacaactggggccagaggcacctctacttatgaaagattgcctctgattttgcatcagtgaatccccacattatctcatctgtgcatcaaggttactgggtcacagaacctcattattaactaagaaagcagggttacctgaaaaccactgtgaggaggtcataataaaattacatcaatttaaatagctgttcctattcatctgcttcaggagatcccacaattaaatcactcttggaatatcagcctcttcctggatttcaagagagactttgaacataagcttaggtaggctgtgtgaaagttttcttctggtagctgggtgcggtgggggcacctgtagtcccagctacttgggaggctgaggcaggagaatcacttggacctgggggcagaggttgcagtgagccaagattccgtcactgcactccagcctgggccacagagcagtctccatcttaaaaaaaaaacaacaaaaaaacaaaaacacaaacttttcttctggaagctctaataagccaggccataaggatataggagccccatcaactgctttcaaggatagggcagaacaaggggatgcacagatgtgggaacaagagaaggtgagactcttccacaggtacggagaaatgctcaagggaaccactggcctcaaatctcacctggctttggggcaggactgtcctcctcacttcccaaaagcctgagaagagagataaaggtggtagacttcttttttctcagccataaagaaaaatgatacccagggaggctctcatccctttccctatcgtctccgtttaaggctggtgaggaagaaatggatgtagaaggcagacagggtgccaccaaaaacatagtcctcagcaaaatgcaaaaatggaaacgacggtaaaatgggcactttgtgtgtataaactgataaagtggccaatatccttccaaaagcactgaaaagtcactggtcacatgatgttctgaattaccaaatggaactgaaaaattccaagagtcacaggtaaggtctgtcttaaaatacccaactgaagaccaaaacctgaacaaccatctaaacaatggtgggaatttcttgtgggggaataaccatcattctggttatttcagattaaaagataaaaacttgacttactcttgtaattatcaactctaaaattccaacctctgcaggcagaacatttcagagtagagattttggtaaacatacaatcttcatgtaaaatgtaaaagatttagtagcctaagtacatatttttgatggtatatattttaaaatgtcatttagtacgagttttaacctccattgttagcaaaccaatgttctgttcaacgtattattttaaatgaagcaccagatcaaacctgtttttcatagggtttaaaggtcatactttttaaaaatctttgcgccatactgagtagtaattttgtctcattactcacataagacaagctgatattaaacatgtgaccaggctgggtgtggtggccatgcctgtaatcccagcactttgggaggccgaggcaggtggttcactggtggtcagaattcaagaccagcctggccaacatggtgaaatcccatctctactaaaaatacaaaaagtaccaggcagggtggggtgcgcctgtaattccagctactcgggaggctgagacaggagaatacttgaacccaggaggtggaggttgaagtgagccaagatagcaccactgcactgcagccgggagacagagcaagactgtctcaaaacaacagcaacaacagcaaaaaaaaaacccacccgtgacctaaaaatggccgctctgaatcaaagcatttagtgcagtaaattgataatccccagcaggactgcaagactgaaaattacagtcttcctagagctttcatataaacttctggagacaagcctctcattatctcaagaagaaactctatccaccaaccttcagacacttaaacgacctgggaccaagacaaaaatcgcatggggagttacaaaccagcaggacaaagcacatactttaccctaatcttgtcccaaaccaggaaacttcgctctcttaaaatatacactgccagtagctagccacaactgctgctgcctgatgtcctcagagctatgtgtgcatttcaaacctgaagaccttgattcagggcagctcatctccctgtgtcaagaatcagggaatcacctaagtcactttaaatcttggtttcccttcttttttaaaaaaaccctgtagcctctgaatgactgatcatcatccattttcagaagaaaagaacattgttcaccaacaaaggaaaaagaattaagtcgtgtaaagtcttctttagatacaaaaaggtcaccagctccagggagcagttcatggccttaatgaagacttcagtgtgcagaaacaaaggactgactgcattaggccagaaccaattgtatttctttactagtaactgcatacctacctcttttccctttgaattttgtttcaaaaagaagaaaaaaaaaaaaaaaggaaagaaaatcaggtaataaaaaaagaagtctaaagagacacactctggttaaccttttcaacttactgaagaaaattcagggagtagaaaaccaagatagcagaagtctgagcagtgggctgcttaaaaactacttagcttttgctttgtagaaaaacaaaaaagtccatcaaatatgaaaaatgaatctgtttaatcctaacaaagatatagctgttgatgtatgccaaccgttagggtgctatcataaatgttgaatttgcatgagttactctttagttgaaaacatttatttgtgccagtaggattggaggagtaaataatcctcctaaaaaaagttttgaaatccatttttccagatccttcagttaagcaaactcttgtcgagttatagtatcaccttggtgttctccttgggaagtgcacttaactaccctgtgtcataacacaaaggaagcatacatttcggctaactattctgtttagggaaattatttaggaagactttcactgttcgcttcttcctgaaattttgaatacaaattgaggggtactttcttaaaattcagtattttttttttttgagacagagtctccctctgtcgccaggctggagtgcagggcacaatctcagctcatggcaacctctgcctctggggttcaagcgattctcctgcttcgcctcccgagcagctgggactacagatgcgcaccaccacgtccggctaatttttgtattttagtagagacggggttttaccatgttggccataatggtcttgatctcttgacctcgtgtccaccctccttggcctcccaaagtgctgggattacaggcgtgagccaccgtgcccggccagtatttgtttcttaaagtgactccaggactggcccctgactatgtatgtcatcattttgtgccccagttctttcccaggtccttgctgcttaatcctaaccacgaatttgagttgcaatggtgtggtcaagagtgacagaggaccctgaaccataaatgaaagggataagccaggagagagagaacacagaaactcgtgctccacacaaccccaggaagccatgcaggctagactgcccaaacatggccattcgaagaaacagcgcttggttctgcttttgctgtgtttgctccaaacttcctagattccctacatcagtgtgtggtgacacaagccatttggctttccactacttctgaggaagaggggtgtatgctttctgcactgcagaccagtaaccttcatgcaactcaagtctccagccttctccaccctctgcagccagcgaggcctcggaagaaaaagggcttgagctcccacaaggtaaggcttggaggatcttctgacgctcactagcccacgacacatagtgaatacactctgtttccaaaatgattttcttttagtgcttagtgtcacttaaggtttggaaaaaataaaaataaaaataaaaataaatcacaaatgattcagtctttcaaaatgactaactgtccaaatgacagataaagttcaaagaaaagataccttttgactttgctgtattttgctctctttggttatggcttctgggaaccttttgtaagttgggtagacagaaaaacaacagtactttgggaggctgaggcaggcggatcacaaggtcaggagatcgagaccatccggccaacatggtgaaactctgtctctactaaaaatacaaagattagctgggtgtggtggacgcacctgtaatcccagctactcgggaggcagaggcaggagaatcgcttgaacccaggggcagatattgcagtgagctgagatggcgtcactgcagtccagcctggcaacagagcaaactccgtctcaaaaaaaaaaaaaaaaaaaaaaaaagaaaagaaaaagaaaaagaaaagaaaacaatgagtaaaatgtctgatgagatatcatgctgtccaacaaatacttactgaaaaaaattgagttggatagttctgagttctgattctactacttattagctgttcatctccagtaagttattaatctccctgagccttagtttccttcctggagaatggggctaacttgacaaccctgcagggctgcagtgacaatcactgtgtcatgaggctccttgcacggtgctgccagcagcaggagcccggccaagcagggcagcacagtgaggcacgctgttcttcaaatggcagtgcaaccaatggatcatgaaatcacttttgtgactcatgaccatccttatgtcttttaatgaaccagaatagaatggatataatagaaaatatcagggcgcagaagcatggagtaattcgtgttgtgagacttttgtttctgtgcgtgtgtgtgcacctgcacgagcccacactaatcatgttgcaaagcagagttctgatcggggactgcgccagccaacatgggtttaaagtcctaggagagggttcaggaactcaggatctggcattgagattcgccgtaaattccatttgatcctgactctgctgtttacttgttaagtgggttaagctctctgtgcctcagtttgaaatgtgtcaaatgaggatgacacagaattgctgtgaggacgaagtgggagatggcaaggaagaagataaccatgttaaggattctgcaaatgttaggaattctcactacttgtgtaactttctgggacgcaacaatcactaaagcactggatctaagagggacaagcccctgttctcaccagggctgagaaccagtgtcggctgcctgctcgcgaaatgcaaagcattagaggggtacgagagtggtgaggaatgccgctaagaccggggtgggggaaagccagaaaacaaagtgatgcctcaccttttgttccttgtgagaaaaacattagatttctctcttaggcttttattgtcacatttttttttgtttgttgctgcttcactatttaaatttacataaacaatttggttaaggaattcaccaaggatcacaaaaatagaaacagaagttaatgagccaagtccttctagatagcgagtagcaataatgccctaaaggcctgcaccccaatccttaattagaaatagttctattgagcattcctcagaacccagagtagggccacaaacatgttctcatctagtaaaacttcacaacaaatctgtaagttagtaattactaggtttggtttaaggatgaggaaactgagcttggaggctaagtgacttcattgaggtcacacttctatcaggcagtgctggaataaaatgtgggtcgtgttgacgcttagaagatgctctgaaagattctatcccaggcagtctgtgaatgatttcctgggtcgcattaagtattgcacagtccctctagactatgtttcttttttcaaccaacattgagccttggagacaaagccatacaaagttaaaaaggaaagtctctcgtttacaatgcttggagatcaggatctacatggatacaaagcttagcagtgttttgtaacatgctccctggactacatacatagagcatttgctcaaaagtagggtggaaacttatggactgaaccaaaacctggtgatgtcaaggtatatttagtctttgctcagatgtgcttccaaacattactggcagagccaagaatcatctaatgttacttctttatttagagttcttttagtacacaagcacacaactatttcttattaagaattcattcaaagtaatgcagggcacgtcctagaacctttcatccaaggatataaaagcactttacagacatgcccattatctctgcaagtaaacctcatttggcccatttttgagatgggcataaccaaaatataaaacttgagatttatactctcattttctactgtaagcactaagtcatgcttctaatagccagagggaattaacgtgctaaacatttcttcccattttatcctgaaagggatacttttttttctttaaataaaaataaaaattgtggtacaatacacatagcataaaatttactgcttttgccatttcaagtcaacatttcagtggtcttaaggacattcacattgttttgcagccatcaccaccatcattcacaagacgcttttcatctgacaaaactgaagtcctatgtgaaataatgtaactccaaccccccaccttccctcagcccctggtgacgacgcttctcctttgtgtctctgtgaattgactagtctaggtatctcatattaggggaaccatctagtgtctgtccttttgtgactgcttatttcacttagcataatgtctttagggtatatctgcattatagactgtcaggattccttccattttaaagctgaataatttcccattgtatggatagaccacgttttattcatcgctcatctggcgatggacacgagctatttccaccttttgggtactgtgatgatcatggagtacaaaactctgagatcccgcttttaattctttctggaagtggaactgctggatcacgtagctctcattttttgaggaatctctacagtgttttccaaagtggctgcaccattttacttcccaccaacagtgcacagggttccaatttcttcacatcctccaaattacttaagcgtattccaattgttttagaggtcagtgctaggatagccataactgtacttggtctaagataaaatcacattctccttcccttccggtggcacgttctctatgcttcctactaaacaggcatgaagagttgtttatatccacatgcccagaaagctcattactgcctgggttttgctctttctcctctctgtgtttctcttctccagaatatgtgtttgtgtgtgtgtgtgtgtgtgtggtgtgtgtgtgtgtgtgtgttcctcagctcccctcaatgactatagagtgttaaaaaaaaaaaaacccacattaaaagaaaacaaacaaaaaacccagccatgtctggagttgaatattggaggtgttaaagtgaaggacaggatggaactgtgaggtccgatggaagccatgaggcccacagctgcagaccccatgccggtggggacaaggtctatgttgctcatgactatacactggagaatagtaattactcaatgaatactttctgaatttatgttaaatatgaaccaaagaatgacaggagctcttattgtacaaataatccaatctctagaacactccttgagagtcattctgcaaaggagaagaaaagaaaatagaatcagagtccgggaaaggatggccaatttaccctccaccatcagagcaaacactcactgggtctgtgtgaaatacaccacacactctcaaatggtgatcgtaaggaagatgaagcagaagtgcagagagatggaattccgtctctcatttcttccttgctattctttaacaacctcctggttaaaatcattcaccaagagctagatttaaaagtcaccacaaagccaactataagttttttaactctcacagcccacagtttcacaaaagcccttcatggaggtaatcacctttgagaaggtagctttagttcctacagcaaaatccaacattaagacacttaaaatccacatctccccatagaaacctccccagtgctaaacaacaatgcatcattttgttctttatggttatcagtggataaaactgtggcatcttagtacgaaatctatctgcgtaagttattaaatatcacacacacacacacacacacacacacagaagagagaaatgaacaaagctggatatctgatgaaaatacctgttgaaaatatctgctcaaaaaacatgctctattgggtgaaaaaaaaaacaatcctttcatccaattaaaaaaagcataagagtaaaagcaattaaacatagtagctcttataaaaggggcaggtaaggacgctatacttgcatacctgaggtatgattgacatcttcttccttaaatcgtgaagtccaatttcattgtcaagatcttatcaatccaaattttaccttcgggttctgacaatctaaaaagggctagatgagggaactttttccagctccggttcttcccacaatgccaacctacagagagatcaggcggcaggattaaaaaaaaaaaaaaatcacaggatgcagcaaaactaggagaaaacttcggtttttgaagaagaattaaggacattctatattgagtgtagtctaagagtttcccacctcagcactgatgaccttctgagctggatacttcttcattttggaagctgccccaggcttgtgggaggttcgctagcatccctggaccctactgcatagataccaggagcacactccaaaatgataccaccaaaaatgtcactgacaaacgtcctctggggcaaaactgcccctggtgagatccactgttctaaaaaagagttgaaaataacagaatctgtttactggcattgaaagtcaacagtctcctaagtggcccatgaaaaggcaacttttaaattagctttgcttgcagatctgagtaatctgaatttctgagataatttcacagggatattaattcaagacagagggtcagaagtgacataaacgagtattcatttttctagagttctattatttaagataacatttctttggtagagaaacttccaaatattaaatatctgcctatattttgtctcaaaatgttcaaaattctgaagtgaagattgcaatgtcttaaaagacagtagtaaccagtagccaaaaacacataatgagatcaacaacaacgcaagtaacatttgctatttacgtaaggcctttctctgcacagttcaaaaggcatgctgcaaactaattaatacttacaattgccccttgagaacatttgtgtcaagtatcactcctctattaaagccaagacagagagaaatgaagtgcacgccaatacgatcaaagaatcaataaaatgctggtaaaaaggtgggggcaatacgtctatttgtaaaaactggctttcacatgtgtgcatataaatctgtatgcagaaactggcctctgaccaatgaccttgcacaactgcaaatttcctggtgggaacttcccaagaaatgacatccccttatttagaaatctggagtcaacgaaggacataaaacatgccttcaatcatttgtccttatttaataaattttaaaactcactgcaaaactttactgggcactgggtatgtgttggaatgtgacatattacctcatttgaacacctccatatctgtaaagtcaataatggcatttcacaaggaattttatctttaaagagatacatgtacaaaatataaaaatgtaaatgtttaaaagtggctttagctaattttattaactttggagtcatattctaccttatggtaaatccagtttatactttataggtgggccattttctgcacataggtacatccgggtgtgtgtgtggtgtatatatatatatatatatatatatatatatatatatacacacacacacaccaattaatttctgagataatttcacagggatattaattcaagacagaggtgtcacaagtgacataacaggtattcatttttccagacttctatcatttaagatgacacattctttggtagagaacttccaaatattaaatacctgactatattttgtctctctcacacacatacacacacaccacgtgtatgtgtgtatgtgtgtgtgtgtgtgtgtggggcttatgtgtgtttctcagtaatcagcacgtatctagacatagacaaatgctgtgtttttgagaatgtgtggacactcatttatcagctctatgggaaactgatccatctgtgcaaacctggacatttgtaggccattatagtagatggccaggatggaccccctcaaaggtagggaacactgagggctgcctacaacataagactaggcactccaaactcaggtgaggatataatcagcaaaaggcaaccaaagaaacctggctctggttagttctcttcaaagtcatcaaaattacagtctccaagtctttcatagtcaccaatgggtttcaccaaatcctctggagaatatcactaatatcagtaagtttacttcataacacgaaagagacacttagttttattttaattgctttacaattgacccttttttttccccaactgggccaagagtggtctctttggccaaacattagacatttgtacttggactctcttcatatatgaaactcaacatgattaatacccaacagcccccctccaaacagctctgcttctaactcctccattttaatctaataaattcttccccaagttcacaggctcaaacacccatctcccaggttttctcaactccaagcactaaaaatattacttgttctgtttctgactcaataccctcactttaatttctgcagccattacctcagtgcaaggctgcattaactttgaaaaacaaaaactcttttgctagttataatcagtgcaagtgaattcgaaaaataataaatgctggccacaaccccagcaatctgacagaatccttgtcacatgttaatacctttctttctgaacttgagtgtgagttatctgtgttcctaaagatataatctcatatatttagcaaaatgagaatatgcacagaatattataatctattatttaataaaagtatttacttcatagctacataatattacagtatatatgattatttattcaacaaatcccctatttgtggagtttaggctccaatattttgctattgtaaataataccatgttaaatatccttgaagctaatctttgcaagcaaccttaattggtttcttaaaataaattcttagatgtggaattgctgggaacaggtatgaacattttcaaaggaggctgttaagtgatgccaaactaccctccagaatatgataccaatttctactcccacctgtatccctgcaaattcactaaccagggtattaaactttgttttaatcaacattagtttgattctacaaagtggaatcacttgccccatcactcttgccagcagtacataaaatcaattggcttcaggccttcagcgtcttccccgtgcaccatttctcagattaaacttccgaagtacagctctctgcctggcactccacactgggaaactcctctacaaaacagtcccaactaacctttccatccttagctccatgagcaggattgatttgcggggtggctgtgaggactaagtgtgcacatgtgtgttattcacctggtagttcagcccttgtatgctcagagatgcctaattcttcatatcaaatcacggcatcgagccttggatatgccatcgtgcctttcacatgcatttcgacctgctgaaatcctaaccaccttccaagtctgtttcaaatgtgtaattgccttaaaatcctccacttgtcccctcgtgtggatttccccacacttaatggctgtcgtaacatcttttctaaacagccataaaatctgcgaattcctctatcttacggagcaggcatttatatactactttgtttcttctactaggcgataggtgtgtgggcagggcctatattggaattagctttgtattatttgtatcacctgtggtgtcctcaaaaaaaaccagaaatcccccagagagttaagcatttaactcaggcttgaaacatttagggaaatctattgccatattgttcaggtatacaataagctaggtgttttacacctcttacttgtttaagttataaaactctaatggctaggccctatcacttgcattttgcaaaagagaaaatcgaggcttagtaagattgattaaactgttgaaatgactgagcccctaagtgatgaatgggactgaaacccaagtctgcctgcctcttgcccattctgccgatggcctcccaatacttggatagcctggctctgtattcccttggtgtagctagaagggagacagcggggagagtgtggttgtctttaaaggcactggcctgccatactggtcctattgtcatacatttaatcatgctgtggacatgcgtgagtataagaaggtggctaggacaagaagctgactactgtggccaagacagtacctgtattagggtggattacagctgttgacaggaagaactggcaccccagaagaggctgggagagaagcctgcagctacgttggacatggggcaactgggaaacagccagacagacctagtgtactgtggggcagtgagacccattttgatcccatcagtagtgacggaactcaaatacatcgctgtgctgagctggtatgaggacagagactgctattcatggaggctgtatggtgggatgaaaactgtgatagaagacagagatgaccggaaaggtgcaaagaatgcataaatggggaatcacacagaattaaattgtaatgtaaattcataatttgcagatataaaagtaaaaaaacaaaaaacctgtagggtggcacttggcccaggactatccagatctcatgtttagtcacaagaggggctggggcaatccacgagctccacttcaagttgtcaaggaagtttcttggaaatcacagattattagtcatccaaaattgcttaccggagagcaaggctttaatgcaggggcaggagtgggggtggttcttgtcccagtgcaattttaatcaaagggtggggtgggcctgacagtctgcatttctaacatgtttccaagcagaggcaggtgatctgatcccagcccctgagatgagcaagcaggcagggcaagtgggacaatctggctgtgaaggaggggtttctcagcaaacattaatgtaaaaaaggagagaatataagaaactaatattttgcacactatagcaaggtctagtacacatctgtaaaaaggtattatccaagtaatagtttgagcaaggaaaaaaaaataacaaaccaaaatcaatctacctctagagctgaaaaatctttaaaatggcccagtactctctaaaatgattaaatcaaccacaaaaccatctaaatgaaaatgcagccagtgtttggaatctaaccaggaaggctagggtggtatatacctcatttggttcattcttttttacttgctatttcttctgtgaattagaaacctacttagcgcctatactttttcctatttgttataatgtccaggaaatctgagcagatgaagcaattgaaagagatgaagccctgtttctgctgtgtggacacattcctacatctccactggaaacaatgccctctccatcagctccaacagcaaagggactgcctgagatcctggggctgcaggcaggtgtgaggagacgaaccctgaatatacacacaaaaagtggaaccaactcaccacgatgttgccgaatacacaaatgaagctaaaggtgacactgtgagtgaaccaggacacaaatcaaaagcaagtggggctcagcgcagtggctcatgcctgtaatcccagcactttgggaggtcgaggcggtggattgcttgaggtcggggttcaagaccagcctgaccaacatggtgaaaccccggaccactaaaaatacaaaaattagccaggcatggcagcgggtgcctgtaatcgcagctactgggaggctgaggcaggagaatcgcttgaacctgggaggcagaatgagccaagattgcgcactgcactccagcctagatgacacagcgagactctgtctcaaaagccaagtggttgtagtataattcagtcttcaaattcaatttaccctcccacatttcagatctcaggtaatcctagatttgggggggttttaagatggaacgatatcaatgtggggatataggttgttttctaagtgtacaacagaggtttgtagataattcatattttatggctacaagagaaatttacaactggccaaactaacagaatgatgttgatcaggtaggacctaataacacattgtctgagagaagcaaacatccccctggccccatcaggaacagaatctgagaaaccttgctttcagcaaagctacagctgatgctgcctgcagagtggtctccaccttcttcacactcacaaggatgcgggtagataatgaggaatcagcttttgctggttccctgggtatcttctgggcatgaagcgtatatttatttttcatggcacaagggtatcattcattcaattgtgactatagcccattaatgggtctgtggtgggaagagctgaaaagagcagttccgaaagtatctaacactgacaccagagaacgggctgttgcgggagctgtcgtgtgtgttttgttaccgatttctttgtattgcatatccctcactctcacaggcacccaccatgtgccctgcagcatgccattttctggggtacagagacgaatataaaatgctccctgactttaagaggctcagggtactgtgagatctgacccagaattataaatcatgccatcgtgctatcttctttaaaaaaaaattgtggtaaatacacaaaaggtactttatgtacttttcaaattgtggtaaagtaacataaaattgatattgtaatcacttgaaaatgttcagttcaattatattaaatacattcatgttgttgggcaccgtcaccatcatccatctctaaaactccatttatcttgtaaaactgaaactctgtaccattaaacactaatgcccattcccctacccctgccgcccaccatcctactttctgtctcatgactaactactccaggtacccacatgtaagtggaaccttatagcaccgtccttaggttctggcctaattcactcagcataatgtcctcagggctcatccatgtcagaatcacacattcagcatgtgtcagaatcaccttctttttaagtctggataatattccattatgcgtgcgatcacattttgtttttccattcctcagtcaatggacacttgggctgcttccacctactgtcactgcaaataatgctgttatgaacacgggtgggccacagatgttacattaaagaatcggccaggcatggtggctcatgcctgtaatcccaggcatgatttgggaggttaaggtgggggatcactttagctcaggagttcgagaccagccatggccaacatggcaaaacctggtcttactaaaaattcaaaaatgagttgggtatggtggtgcacacctataatcccagctacggggaggttgaagcaggaaaatcgcttgaacctgggaggtggaggttgcagtgtgccgggatgtgacattgcactccagcctgggcgacagagcaagactctgtctcgaaaaaagaatcttaagatgatgtggagaatatagtttcaaagaggcagagatgcttgaactgactgaaaaggtgcacactaagagcaaggcagacaggtgcttggggagaaggagggcaccctgagtgcagggatgtgtgtccatattgggagttgtgaggagaggggtgggaaggggaagagattctatgtcttgtttgttctggtttagttccttcaagaggctgtcctagtcctagccaagggcccaggacacatgtgaaagggacattgctggcagacttagatacctgcaaaaccagctcacaaactccacacagcctcccaagtccctccttgttttcctttcactgactttgagtgagttctggtgcctttactgcctccagcttgggggtctgatttctgagcactgatggggtcatggatctgggtcttcccttgggggctgagagccagacaggtcctgtcagggtgggcctgggctcattaaggttgcagcagctgctcacccaggcaaggagctggccacgtaaggatcagtctgtgatcaaactgtttcagaaagaaagagtttgcagtgaaagggatggggagggaaacaaagcacaggttaaaggaaggcaagaaagactaaggaaagggcctgataatgtttggcgtgtccccacccaaatctcatcttaaattcccacatgttgtgggagggacccggtgggagtaattgaatcatgggggcaggtctttcctgtggtgttctcatgatagtgaataagtatatgagatctgatggttttataaggggaagtttccctgcacaaactctctctttgcctgcgccatccatataagatgtgacttgctcctccttgcctgccatcatgagtctgaggcctcccatccatgtggaactttaagtccattaaacctctctttcttctgtaaattgcctagtctgggtatacctttatcagcagtgtgaaaacagactaatacaggaccaaaggatggaggagagaaaggctggaacagaagctgcagcaatggaggggaagagaaggacttgagaaatgcacaaagtaaaaatcgacagaattagacataggagtgttggtgacacaaagccagagttgcttcctggaaaaatccatgagtaattaggtatcaaacagagtatcctgggtcacgttaactccagccctgaggcccggggcccaccaaccacagtaaagcagttcacagcaggaagaagttggtatccacattccacggttagtttccaagacaggttaacctacgtatcactgatcccttcacacatccacaaggaagacaacaagcagacatagcactaaatcttctgaaattggaagaggcaagatgctttaaacaaaccttttcttgtgatttaatgagtgctgtcagatgttcagtaccagaggcccacctggactgtacatgaagttcacattgtcaaagattatcacccttcatggggccaggctggtggtgggcgtttctgatattcccaaggtgcttctttttcaggtctgtgtattcaatgaccctttctactgagatcatctgaaagaaatatgacatcccaggggttaggaatggagggtgtcatttatggatgttaagagactgtcaatgaaatgttctctttcatacatagttggttaaggagagaagcaggagacagacgaggatgttgatgactacaaatttggttcatcattgtgtaacaccttcacttacaaccacttccttcaacattagttaaaagaatgagagaaatgaatgcttagattttatttatccacttctcacatctgtataaaggcaagaaaattttgtaaaggaaaggaatacttagagccaccaatcaagaatctttgctggctgggcgcggtggctcatgcctataatcccagcactttgggaggccggggcaggggatcacctaaggtcaggtgtttgacaccagcctggtcaacatggtgaaaccccatttcactaaaaatacaaaaattagccgggcgtggtgctgcatgcctgtaatcccagctactcagaggctgaggcaggaaaatcgcttgaacccgggaggtggaggttgcagtgagccaagatgcactattgcactccagcctggggtacaagagcaaaactctgtcccctcacccctacccccaaaaaagaatcttttgctatagaaggatcacctgatataggtcagttaaactggatgtcgtgaaacctcactgtaataattactcaacttttgctctatgagaagaatgaaaagattttatgtttattgcttttctctctttaggggaaggtgcaaatatttaaaacattgattaagcctcctataccaccataaactaataccctttgactagcacattccaagaggaggcttctgtaccaagaaggcacaccagcaaagttaaggccttcctcccttctgttcttcacatagagagtaaacgctagaactgggagaggaggagacctattaattaaatgtaaacaacctcaaatactgaagtcttcttttaacaggaatgaggaattacccgttaagaaacaaaattaacaggcttctaagaaattagcttatatcctctctagaatttcagaacctccctcctacaggacatttattacatctgaaaaagcttgtgatgaatataaaacctgctgacagagcaacctaagactcagaaaaagatgtatatattttattttacattaactttaaacagatggaggaggatcttaaaaaaaatctgttaccaaagatgtaaaaataacagttttaatatttcacatagaatggcttttataccatttaatggcaaggagattgaaaaggcaaagaacgtgaaggtaatattaccatattctcaacttcagcactttgtcgaacacaccactgaaacatccccatagcgtgagggcataggacagtgccaaaccaacctgcccggcatccagagctacgtaaggggaagaagggaataaagtcagtctcacttcaaacctaagcctggctccttctgccacttccaagaggaacccttcataatgttgaaacaattcacatttaatgacattaatagctatattttaccatttgttgcttgagatcaagatacaatggggaaaacaacactgtatatttagaaaatttttagatgattttatgaattccaacaggatcgacatagatttaattaacagtatacaaacgcaagaaataatgtcattattcagacattcattattatggtttcaaagcccatacattattccactttctacgtgcaatgcaaccacagctggaaaccactaaaaacaaagaataggttgtaagtgccaatgcttttgagactaaaatactactctccttgttccattataagtattgtaatgcactgttgttactggggtggtgaactcatgccctgcttgtctggtaccatgtggcattgaagataatactctcctgctgagaatttttctcaacctcatgcaccagcaactacaaacaatagattcaagtagttggaaggctaacaccctaagttggacaaaatcttcagaataaattggttttctcttcacaactaccagacactaacaggaatgttcagaactcaactgcgcatatctcaacccattcaaagaaagataaacccatcaagacccaaatgatccttaaatgagtcacactgctgaatcctacccaacctgacacatcgtaaatgatttaaacacttcattaggaccaaacagtatgtagtagtagacaaggtggcaagagtttaataaagtaaacacagctataaattgtaatcataccatacatagttattcacatctgtacttacttttgccagaatcagggacccaaaggcaacgatgatgacaaacatggcacagatggcatcagacggacggcgaaccagcgggacgttgtcaaaaacaagaaccaagcctctgaatttgaaacggtaataagcatgatgaataagtagatgaatgtgcgagtgtgttttgctcagttgactacagaagatttttacgtggagtagggcaccaaagttgcacacccaaggaacctttagttccagaaagctaagtgatacaggcaatatacgatacacatacacaatggtaccgtggcttctgtgaggatgcatgcgaatatgaaacccagaaatatgatcctaataaagaactgagaaagtagtctcataaggacatctcgtacagtgctgagaaatacttatgtgaagtgcatccatgtgaagtccacccacacacatggttgactggtccagttctccaacagcagagtgcactcccaatttacttctcccaccttccatacttaccagaaggcccacacacactgactatgcttaggggctatataaaaatgacctcactaacaggatttgcatgtggttttttgtttgttgtttgctacttcttttttccttttagcatgtggtttttaaagtgccatttaatcagcagataaaataaagattggaatgacggatctgaattttgtagatttggtggaaattctgaatttccatattgaaaaaatcttcactgatgcaaggggtcagcaaactacagcacgtgagcagcacctatttttgtaaataaagttttattgaaacatagtcacagccatttgccaatgattgacatctgcttttgtgctacaatggcaaaggtgattcatcacaacagagacaataaggcacacaatgcctaaaacacttactaggtggccttttgcagaaaacgtttgctgacaggccacaggccatgcatggtgagagaaagaccccacaagccagtcagggggcacaaagaggaacgtgcagcagcgattccgagaggagtccaagcccagaagaaggggatggggaaggaacgaagatgcgcaaaaaaagcaggatgtggggctgggccctgaggtgcctgccaacaagtcatctgaccagggaggttaagccagaaaaagcagcagatcctgtcctttgaaaccattccagaaatagacagacctgaatgtaaatcctggtgtgcatcaaacagttcctgacaccttcttctgctttgtatgcccggatggtccagagcccctggagagaagatgacaagtgggaaacactggactccgagctggggaaacagacagagaaaacagctcagtgaggctgggtgcgaaaaacctgcggcctcccaagctccatggtcacgtatccaccaaacagcacacgcaggctcctaggaggcttcatgtttcaaggaaaaataaatgttcccaatagcctgaggggacctgccactggaatctcaagctcctgctcaaaccacacctcacataaggggcctggaaataacgtcctatttttgaccacattcaaatctagttataattctttccttcctaactcagcctccaggtcttcctcctctccatattcttccctgacatctctttgggcagaaatgatattttctgatttttgagccagtaggattttaaaaaacaattctctgttaagagtactcaccaactgaattacaattagccatctatgtgtctgtccccaccttaaattgctaatttctcaaggtcagctatagccattgcaccctggtaactggatggtacctggcacaggacaggtactagtaagtgagctgaacagacagactgtcacttccctgcatcctggggaatcttctgtgccactcatgctggaagaatcctttgtgatctccatggacctgggtgctgcaatgcccttggccgtgcccaaggaacctgcccagccaagatgtctctgaatggtcttaacattggctccggaaccggacggatgtttttatgactgccccactgcaaacttgtcctgatctctggaggctctatggcatgtgccattgcttttttcagaatctgactgtggtctcagtgggttcttctctctacagaattttaagaagtgaattcttttttgtgtgacttcttttttctttgggagtgtatatcccatgaggttccctgaccagctgctcctccttgagccattgtgtttttgttgtgtggtgtaggtttttttttttttttttaagagggagttgccgccctgccccgacctgccccgttcaagcgattctcctgcctcagccccctaagtagctgggattacagatgtccacaccacggccggctaatttttgaatttttagtagagacatggttttgccatcttggccagctggtcttgaactcctgacttcaggtgatctgcccacctcggcctcccaaagtgctggattacaagtgtgagccaccgcacctggcctgttgggttttttagaaacaggatttcacttgtcaccgaggctgggtgcagtggtgtgatcatagctcactgccaccttgaattccaagctcaagggatcctcccacctcaggctcccaagtagctgggactagacatgcacaccacctgcctggataatttttgagtttttcatagagatgagggtcctcctcctgccttggcctccaaagtgctgggattacaggcaggtgtgagccaccatttccagcaggccactgtgtttcagcacaccatttgatgactaccaggacatacctccctcctgcatagcagcggacatgaggctagctacttttgggcagggaggaattcctgagagtttcaattgtctaccatgaatgagccatactggggcaggtgcatattggggacacgtgacctagcacaatgtctttagcattttttctgggataaatgatttgtgctttgcaattagcaaacactgactttgctacctgtgagctccagagaagaccctgttagtaaaacatggggtgtccgggagaagttaagataacttttatttatttatttttttctgagacagggtctcactctgtcacccaggcttgagtgcatggcatgatcttggctcactgcagcctcaacctcccaggctcaagtgatcctcccacctagcctcctgagtagctggaactacaggtgtgccaccacactcagctaatttttatatattttgtagacactgggtttcgtcacattgctcaggctggtctcgaactcctgggctccagaatcaggctgcctcagccacccaaagtgctaggattacaggtgtgagccaccgtgcgtgccaatctatcttacaggcgatggctacatatgttttataaaatgatgagggggtagggtggggtaaggggcggagggagtggaaaatttaagagaaaaattctaactcattttctgggcggactcttagtacagcatccccatgccgatctgtgctacagctgactcaatactggtggcccactgtacacacagacactacacatttgggggtgctggggtaccagtgtgccaagaatggaggttccacatatatcagagtccagagtccacagttccgtaagtgaaggaggaggcgccaggtatgagacactggggttctgagaaagtgggaagccctgggttggggaaaggcgatggagctgcaggttactgactgtccacccatccttggggctctttcctgactgatactctgactgggggcactaacttttaggggccctctcctgtgatagtgctttaagaaaccaaccttccctgagcatagattctccaccagaatgtgatctggcacttcccttatgtctaatcaggcagagagcctcccacgagtccacagggttctctctattctctatctctggcatcacaatgtctctactaaaaatacaaaaattagccaggtgtggtggcgggcgcctgtagtccaactactcaggaagctgagacgggagaattgcttgaactcgggaggtggaagttgcggaagccaagattacggccactgcactccagcctgggtgacagagcgagactatgtctcaaaaaacaaaaacaagaaaacaaaaagagtactcttcaacacacagagtaaccttttactcttatttgtgtcagctctctataacctgtaactttgcactgggaaggtggcaggtgacataccgcaagaggactgagctggtgcttctgtgagaaaggctggatgttctgcacaggtctttctgcacgcctcagatgttctagcctgcaccctggaacttggtcaatctggaaacaggtgatattgggaataacacaagagaattccaggccccattaccctacaaagagtttggctccagtagttcagagaaatcactagaaccatgctcttacctccagagcaagggagtgttggactgaacgcgtccatcatataaagaatgccactgagaaggaaggagatgtggcagtcaggggacagagtcctggaatgaaattcttcaacatagctattgtcatttgctttcctcataggagatccaagtcgccactgttttatctccaactgggtttcagggcagggtcaacttggaaattaggtaccatcccagttttggaacacccgggaatatcatgaagatcaagctacaactttaattcacaccaaattaccaaggtatagcaggaatttgtaacctttgaaaagatatcctttctctttcacaccccacttagggctgagagggctgccagtgagggtgagctgggggtctgcaaagacaactaactagtaccgagggagagcgtatgtcaagcctcagctctaagtactagtcagcagtttccagctgacacaacctgccgtttcacaagatcaatagctgtgtttccacaacacagagaactctttaggatacactctacagagattttctgtcttctctgaaagaacatgaaaaggaactgcatgcaaagatctggtctaccagtcttgctgcggggtatgacgctgtgtaggacctctcagggttattacggttttaattctcaaggctatagcgccctggtagttcccgtatgttcaaggtttccaagcagtctcaggcaaccctcataagtatttatccttgacagagggaaaaacagacttgaggcattaagaacactgcccaaagctgggtcgatggctcacgcctgtaatcccagcactttgggaggctgaggcgggtggatcatctgagtcaggagttcgagaccagcctgatcaatatggtgaatccctgtctctactaaaaatacaaaattagccaggtgtggtggcgggtgcctgcagtcctagctattcaggaagctgagacggagaatttcttgaactcgggaggtggaagttgcagtgacccaagatcacggccactgcctctagcctgggcaacagagtgagactatgtctcaaaaaaacaaaaacaagaaaacaaaaaaacactgcccaaggttaagtaaagtaagccacgcaagtggtagacttgggcatggaccatatctgttttatttccaaggctgtgcttttaatctgagccacagtatcagagagagaaataatcagagttaaaggttctcatgcatcctgagggcatttttctccagactttgtagccacgctttaaaaatcccctaatcttacttagctaatatccaacagccttccctattccgtgccggttattaaccaccttgcattgaacaaagtccctgggaatctaggatgaacgaaatgggacacatgggttcacactcatggcagacattgctagtggatcacaatatctttacaacagaaattggatacggcttcacatttcaggcattgccaaatgagtggaggtggctaggaaatgcagccaaatgccattccggtttttatgtacttctctatgactgactgttgataggtgactcttgcaaacataaaatgatcaactgcagattagtttttgttttttgttttgtttgttttgctttttcagtttcactcttgttgcccaggctggagtgcaatggtgcaatctggctcacctcaacctctgcctcctgggttcaagtgattctcctgcctcagcctgccaaggcaatggcacaatctcagctcactgcaacctccacctcctgggttcaagcgattctcattctcagcctcccaagtagctgggattacaggcatgcaccatcacgcccagctaattttgatttttagcagagatggggtttctccatgttggtcaggctggtctcgaactcttgacctaagtgatccacccacctcggcctcccaaagtgccaggattacaggtgtgagccaatgcgccggcccagatttgttattaagattcattaaatgccggctatgactccaggggcagtgagcagtccaacagaggctttggaaatccttgagggcacaaggatgaagctggattatgccccctgccacggcagtcaggcatcctgctttcagctggtgactccagcagtggtctcaaaaccacgatccactgctgctgagaagaaacagtggaattgtgacttatggcagagacccacaccctggacgaataacagtaaatagttccaaccaaccagcccccgtggttggtgatctagcgcatggagaaagaatcctgcatatttaactcattgttacagccaatcagggtacggaacacccaaatatgcctcaggggccatgataaggttgtcagaatctccacatgaaaatgtttcaagctttaaggtacatgctgaaattcaagagagaaaatcctacactgcttcccaaaagccttcctaagtcccccttttctccacatccacatggatcggatgtggctgttgacaagacagtctacgtcaagatgttccttctggaacggctgcttccttcaacataccacagatcccttaaaacaagactctcgaataacttcatttcatgagcgggcccaaaccataaaatcctgcacagccttgctgtccacacacaacactggctagggccagtcatctgcacaaggaggtctcccagcaattatactctaccttccctagcaagtcctattggccaagtgttactccatgtggactccactgctcggcctgcccactgaaaaccttacaagactagacctcatggagcttagctggttttcttgatgactgaaaagtttttctacaacttttatggactgtcacccttctacttcatgcagacacttaggataaatgcctcttagagttcactgttggccagggcagcagtacacacctgtagttccagcactttgggaggctgaggcaggtggatcacttgggtcaggagttcaagaccagcctggccaacatggtgaaaccccatctctactaataatagaaaatagtgaggtgtggtggtgcacacttgtaatcccagctacttgggaggctgaggctgagaatcacttgaacccaggaggtggaggctgcagtaagctgagattgcgccactgcatccagcctgggtgacagcaagactccatctcaaaataaataaataaataaataaatgttattgttaaaagagaaacatatatatgtcacaaccaaaaactgctttgtcctaataaactctatttaccactcagtagaagatactgaaaatgatgggactcaatgcttctcttctagggtggcttccagagagctgagttggcattcagcttttctgatacaaatatcttccttcttattttttggctattatccttataccttttattaaaaagtaaagcaattctactctcctttgagtttgtgtttaacaatgatgaaatatgttaatttgtgcatgcataatgagatgaacctggattatttcatctctgcgattacatgtggaatagagtgattaatcataaaatgtctcctcatgattccaaaactaggaaattgaagagagcaacagactatatgttttctaaactatatatctccttgtgatctaaggggattattttcagtgtccatatatatataaacagccgagggggaaaaacctcaaactgtgacattagaacaagcaccgctggtaacaaatggaaactgaaaataacaatgcttatcttttcaaaacgtttaaaactgcaacttcctagccatttgtgagtttgcaaaagtcataaatttaccaaatacattgcttctgacacctcttttccttctccatccttctcatttccttgtcacttttagtatcttcggggaaagatgctaaaatacctaattattttccttctatattagtttcaccatgatcaaatattttatttctaagaaaatgtttaattaagtgccggctttgtgtaagaaagtatgtcataaacaagacacggagagtcctgtcttcacagtgctgacattcctgtagaatattactccccatatggccttcactcctccttattccaaatgcaaagttgcacgttgcaggctatcaattccacatgctctaagggcacaatgattcataatggccaatacgttcaattacctaatgttagagaaattctggaagcagagtctgccgaatttcagggggtctctgtaatttatggcataaatggaaactagctacatgtctataccaacccgagtttccatactcacttgtagattccaggcgcttcacatctttgacgtttccaaaaaatatcgccgaagaaaaatgaaaatgattccaaggggaaccaaggtattgcgatccaaggaatcacggccacagccacagagaccacaccaaccacttgtagcatgtctgaaatagcagaagtagatgcaggttttccttatcaagtattcttttcaaaaatctttcatgagttgttgttaggattacactcctttctctgaaagacttattgtagtaccaggactgcttttccatacaaaggaataacaaaagtataggtggtcctgatgatatctattcatgcctgccatgtgccaaacactatgatataaacttatccattaggtttttttttccttttcttttttttttttttgagatggagtcttgctctgtcacccaggctggagtgaagtgtgccatctcctctcactgcagcctcccactcccgtgttcaagtgattctcctgcctcagttcctgagtagctgggactacaggtgcatgtcaccatgcctaatttttgtatttttagtgagatggtgtttcaccatattggccaggctggtctcgaactcccgatctcaagtgatctcccacctctgcctcccaaagtgctggaattatgagcgtgagccaccacaccaggcccccttagttcttttgaaacactcaccagcctcatgagtcaggcattattactttccctatttatggatgagaaaactgagatttagagtaggacttgaatcccaaactatcatgagtcagtgatgttatgcgggaaatgagcaagcaggcatcatagacaaggaacccagaagcctcagcatgcacgggataaggaagtgactaattgcaaattcagtgctcagaaaaaaaggaaataattaaatcttcacctttggaagtggggagtcatctctcttggtatctatcctttgctaactttactgaatgctgattgtgtatctggctgtatattaaatacacatgtatcaactcactaaatctcacaatatccctatgaagtagtattactacaccattttacagatggagacactaggcacagggagaaaaaagtaacttgatcaagaacacacagcaccagtcacagagctgagagcatgcattgtcagccactacattttagcttgtccccagcatacggctagctttttatggtcaggataaaatccctgaatttttctttaatttttcccctaaacacacttacataaaaattagagttcattaacatgcccaataaagaatagataagagaaatgtaattaaatttacatgttttaaaagacctgagacttttttctttttattacaatatattgaattttatatgtcagaaatttttgtcttctatttctcttacatttagtagcactgaggaagaggtttgaaacaagaaaacaagtcaaaatgtctaacagggttttttttttagctttaacacttggattgcattaaattttccacgattaggagagtatttcaaacgtctatttcagaggcacatgaaacaatagcaaatgacatgtatgagcacgtgcaaggcactgtgctaacgggtctgtgaagttcacttacccatcacctcacccagcaaggtgacattatctttggaaattaccttggttaaaaggtgaaatataaaaacaaaagcaagaagcataaaaacccaagacactggatgatctcatttcagtattcatctttattaggaaacgtgtgatatcacggtctatggcttcgggaatatgagtgcaactcaagttagtccctacctactctgaaaccacaacgcttgcttcttagaaggatagaacagtgggggacgtgcagattcacgttatacatgctctgaggcctccaagttcactgtcttacataaaagtacatgacttcagcagaaagtacagagtgctatagaatataaggagaggccagttgtggtggctcacacctgtaatcccagcactttgggaggcagggcgggtggatcacctgaggtcaggagttggagaccagcctggccaacatggtgaaacctatctctactgagaaaaaaaaaaatagccgggtgtggtgccgcatatttgtaaccccagtactcgagaggctgagggaggacaactgcctgaacctgggagctggaggttgcagtgatcgagatggtgccactgcactccagcctggacgagaaagtgagactacatctcaaaaaacaaacaaacaaacaaacaaaaagaaatataaggaggaatacatgcacactttgtagaggttctaaggaagacttacaactgattttcacaggcaggtttaacagacaaccagaaagtacgcataaataatcacttgcgggtcgcaatcacagtttgcttgctgcgggaacacaggcagtctgtgtgtgtcttctcagcaccaccacctgcatcttgacccaccagcccagcatctggctactaggccacccacaattttctgtacctagctgacagccaaagaaaggtacaattgcctgccctcccaaaaaccaagaagaggcaacatgtcataagccttgcttatatccaaacctagtacatatgtatttcgcatccattatctaacttcactctcatatctaaataggagggttatcatctccatttacacaggaggaaactgagtctcagagaggttcagtaacttcctcaagacagaaaattcagtcatactgaccttacacctgttctcttaatcactgcaagatacatatcctacacacgattcatattttttaaagcatttaataccgaaatatatctgtatttttatatttttgttttctgaattttctagtttttaaggttattgtgtgtgtgtgtgtgtggtgtgtgtgtgtgtgtgtggttatatctggtctctcagtgaggtgaccaatcccagctccagctaattaggaaataacagacttctcagctcaaaaagaagagctgatctttaaaaagcttaaaatatttgctaatagaacatggcaacacatattgatttaagaattattgtttactctaaaagtcttacaaaaagatgagttctagacccagaaaacaaaatgacttaagaaaaaagaagaaccacattttaataaatatataaaacctcaggacacaaaatgaaggttgaatcatttcatattcaatatctatatttgaatggtagtgaaaaatataaaatttcccccggcgactcttctagaattaattttgtatccgaacattacagaatggaacatattcttttaacagcataattttaactacaatgcctgtttggcatttaaccaccaaactgctttgagtcctgagaaatttttaggtatctatccactatttactttaaacttcattttgtgggattctgtcctgctagtctttgtgaagcttgtgccaacgaacatgttttctataaacagcagtaaaatgtattcctattttctgcaaataaaaatgccatccatccttctggctcattctattcctatttgaactctccctctctctgtcaaccttctattaggtacaagatgaaatatgtatttatcatgaggtcacttaatcagtagatggtattttcatgatttgtttatggtattaaaactaaaatcaggatcattaaggttgctaacacctcacagaaagtggaaagcttttaattctctgtaagccactgaagaattgtgttctaagctgtgataagtacaaatcatccagattgcttaaacgattactgacttcgcagaagacaaatcttaggtgtaataaacaaagcagggttacttcttggtgagagactatggcaagattttcttctgatttagagagaaaaaaattgccactagtttttgatcagtaaggtgtttactgatagggtggcagaagaaattcttctactttttattttgggaacacatgagactaaaacaaaaaacaaacaaacaacaaacaaacaaaaactggcagggtgcggtggctcacgcctataatcctaacactttgggaggtcaaggcaggagattgcctgagctcaacaccagcctgggcaacatggcgaaaccccgtctctactaaaacacaaaaacttagctgggcgtggtggtgcatgcctgcaatcccagctacttgggaggctaggcttgcagtgagccgagatcatgccactgcactccagactgggtgacagagcaagacctgtctcaaaaaaaaataaaacctacttctcaatgaaatgactaacataacaggttgtgtcctggctaatacaggatttcttctggagccactaaaattatgaacagggtatacaaacgacaggaatattaagaaataaaaatgtaattctgtcaaatcattatcattaccttcaatacaggatgaatagaagcaaaagggacaatatggaagacacttaaatgtaagctcctaagccaaatactgacagcatcagcactaagtcagcagatgtaaattatgtgctactgtagcactcacctgcctcagggagttcagaggtcaactctggttcccaggtcccacctggggagactctactttacatctgttttttttgttacctcatccaacccagtgaatgcctttaaatcgaactttatggagtgttggtatgtcttctgtgtatgacaagatctaaacaaacattctcaagcttttctaaacttgtccttcccttgggatacattaatcactcctttcatccctcattgctaatctgatcttttgacatccagcgctggtacctgtgttggacttcggttagtgctaatcctgagtcccagctaactccaatgaagagtgaatggtgtaaggcattagagcaatgggtgcacctctcccttcctttgtggtcagcatatctcactgacagatggtttcctttgtcattttttccatgttaatgtttattatgaaattcaaggctgaagtccgtctatatgctacttaaaaatacacatcttagaaaaggcatataaaagtggaaataaaagataagttttaaccacttatcttaataactgatataacaagcacataaaaatcgacagagaaaatttgaaacatgattaataaacttgacttaatgatgacctaaaggctacaatactatagccaataacgcataaacacacttttcaagtgcatctttattatgccataaagcaagtatcatcaaactcaagagacagatattatacagaatatattctgacataagtggatttaacatgaaatcaagtaattagaaatgtaactagaaatgttaggaattcagcaatatatttctatataacaccgtttcaaataaattacaataaaattagaaacttttcaaataaaagaaaatgaaaacctataatattaaaatttcaggactgcaactaatgctgtttacaagtaaaattattccttcaacttttttttaaagacaggttaaaagtaaaggatctaaaaatataccttacaaagatagaaaatgagtagcatattaaattaaaatctgagaaaaatggaaattagaaaaaaggagaaatgattaaatagaaaactaatttgaaggagaaaaatcaacaaacccaaagcctcattataaaaaaaactgatgaaatcaataaacttcaaaaagactaatcaagaaaaaaagagaggaaattatcattatcatgaattaacagggaataacagaagagatactacaggcattaaaaagatatataataaacaccgttccaataaattaaaaattttgatgcaaaaggcaaatttctgaaaaatgatgggcaaagactgacataataaaaaacctaaatctgaataattctattattaatttaagaatatgaattcatgacacaaaaatttcccatagaaaaaacaaagatgggtccaagatgattttgcagaagttttatcaaattcttctagagaattggaatccagcattatctgatataaaaaccaaagaaaggaaaattataaaccaaactgtgttaagaacactaagtcgggcccggtgactcacacctgtaatcccagcactttgggaggccaaggagggcggatccaaggtcaggagtttgagaccagcctggccaacatggtgaaaccccgtctctactaaaatacaaaatttagctaggcgtggtcgcgggcacctgtaatcccagctacttgggaggctgggcaggagaaacacttgcaaccggaagctgagatcacgccactgcactccagcttgggtaaaaagcaaacaacaacaaaaaagaacactaaataacatactaaatacactgaatctaaaacataaaaaataattatactttataaactgtttacaccagtaatacaagcctgatttagatctgacaattaatcaatcaatgctatttatcaggttaacgaaacaggaagaaccacagatcatataaatagtggcaagaaaacaccagggcttgaacccaggagatgaaagttgcatgagccgaaatcatgccactgcactccagcctaggtgacagtgagactctgtcaaaaaagaaaaaaaaaaagaagccaatcccaagaggtgggatcatggcagacgagaggcaggactgattgcagctctgactcggactaacagagcagtgtgcagaggcttgcatgtgaactttactctggatcgacttcaagaacaaaccagcaatcccaagaggagccacagaccctttgaagaagtggactgctactgcaggacctaggagacaccccaaatactctgcagcaagacccaccaaggagagtctgagctcagacatgcctagccctgcccccacctgatggtccttccctcgcaccgtggtagtggaagacaaagggcatataatccagggagtcctagggtcctgtgcctgctagttcctcttcatgctaccacagctaatgctctctgcaaagtgccaccttccaaaggaggccaaccagtacaaaaatagagcattaaaccaaagctaagaaccgtcacagggtcattgcaccccccgaccacctccaccggaacaggtgctggtatccatggctgagagaccaaagagatctctgtgaggttcacatcacaggactctctgcagacaaccgccagtgccaacgggaaccaggcagactcactgggtggctagacccagaagagagacaataatcaccgcgttcggctcacaggaagccgtatccacaccaaaagggagagagtactatatcaagggaacccctgtgggacaaaagaatctgaacaacagccttcagctcaagaccttccctctgacaggcctacccaaatgagaaaaggaactagaaaacccactctgataatgtgacaaaataaggtctttaccagcctcacaaaatcacactagttcaccagcaatggatccaaactgagaagaatccctgatttacctgaaaaagaatttaggaggttagttattaagctaatcaggggggcccagagaaaggcaaagcacaatgcaaggaaatccaacaaataatacaagacataaaggggaaatagtcaaagaaacagatagcttaaaaaaaatcaaaaattcgagagacattggacaacttacagaaatgcaaaatgctctggaaagtctcagcaatagaactgaataagtagaagaagaagaagaaacaagtagtagaagaaagaactcaaagacaaggtcttctaattaacccatccaacaaatacaaatggaaaaagaataagaaaatatgaacaaaacctccaagaagtcgggattatgttaaacgaccaagcctaagaataatcagtgttcctgaggaagaagagaatctaaaagcttggaaaacatatttgggcaaataatcgaggaaaacttcttcagccttgctgagacctagacatccaaatacaagaagcacaaagaacacctgggaaattcattgaaaaaatcatcacctaggtgcactgtcatcaggttacccaaaggtaagaccaaagaaagaatctaagagctgtgagacagaagcaccaggtaacctataaaggaaaacctatcagattaacagagatttctcagcagaaaccctataagctagaagggattggggccctatcttcagcctcccaaacaaaacaatgatcagccaagaattttgcatccagtgaaactaagctccacatatgaagaaagatacagtttttttcaaacaaacaaatgctaagagaattcactactaccaaacaccactgtaagaaactgctaaaaggagctctaaatcttgaaacaaatcctggaaacgcacaaaacagaaactctttaaagcataaatcatacaggacctataaaacaaaaatacaagtaaaaagcaaaaacaaacaaaaaaaacacaaagtacacagacaacaaacagcgcgatgaaacaacagtacctcacatctcaacactaatattgaatgtaaattgcctaaatgctccactaaaagatacagaagtgcagaatggataaaaactcaccaaccaatctgctgccttctggaactcacctaacacataagcactcacagaaacttaaaggggtggaaaaaggatttcatgcaatcgacatgaaacacagcaggggcagctattcttatatcagacaaaacaaactttaaacaacagcagttaaaagagacaaagagggacattatctaacagtaaaaggccttgtccaaaggaaaatatcacagtcctaaacatatatgcacccaacactacagctctcaaatttataaacaattactaatagaattaagaaataagagagacagcaacacaataacagtgggggactcaatacttcactgacagcactagacagatcattaagacaaaaagtcaacaaagaaacatggatttaaactataccttggaacaaatggacttaacatacataaatagaacatttcatcaacaactgcagaatacacattctattcgacagtgcatggaactttttccaagatagacatatgattcaactccaaaaggaatcttcaaaaccatgcaaatacatggaaattaaataactgctcctgaatgagcattgggtcaaaaatgaaatcaagatggaaattaaaaaatatttaaactgaatgacaataatgacacaacctatcaaaacctctgggatacagcaaaggcagtctaagaggaaagttcatagccttaaacacctgcattgaaaaagctgaaagagcacaaacgacattccaaggtcacacctcaaggaactagagaaacaagaacaaaccaaacccaaaccagcagaagaaaggaaataactaagatcagagcagaactaaatgaaatgaaacaacaacacaaaacacaaaagataaataaaacaaaaagctggttttttgaaaaggtaaataaaattgtaggccattagcaagattaaccaagaaaagaagagagaaaaattaactgacaccactgaatacaaaagatcattcaaggctactatgaacatctttacacacataaactagaaaacctgaagagatggataaattcctggaaaaatacaaccctcctagcttaaatcaggaagaattgataccctgaacagaccaataacaagcagcaagactgaaatggtaatttaaaaattaccacaaaaaaaagtccaagaccagacagattcacagcagaattttaccagacattcaaagagaattggtaccaatcctttggacactattccataagacagagaaagaaggaaccctcccaattcattctataaagccagcatcaccataataccaaaacgaggaaaggacataaccaaaagaacactgcaaaccgatatccttgatgaacatagatgctaaaatccttaacaaaatattgttaactgaatccaacaacatatcaaaaagataagccaccatgatcaagtgggtttctaccagggatgtagagatggtttaacatatgcaagtcaataaatgtgatacaccacataacaaaattaaaaccaaaaaatcacataatcatctcaatagatgcagaaaaagcattcgaaaaatccagcatccctttaagattaaaactctcagcaaaatcggcatacaagagacatactcaatgtaataaaagccatctatgacaaacccacagccaacataatactgaatggggaaagttgaaagcatttcctcggagaactggaacaagacaaggatgcccactcttaccactctcttcaacatagtactggaagtcctggccagatcaatcagacaaaagaaagaaataaaggcatccaaattggtaaagaggaagtcaaactgtcgtttaccttggaaagcctaaagaccctccagaaagctcctagaactgataaaataattgagcaaagtttccagatataagattatgtacacaaatcagtagctcttctatacgccaacaggaaccaagtagagaatcaaatcagaactaaaccccttttacaatagctgcaaaaattaaaataaaataaaatacttaggaaatacctaaccaaggaatcaaaagacctctacaaggaaaactacaaaacactgctggaagaatcatagacaacacaaataaatggaaatacatctcatgctcatggatggatagaatcatattgtgaaaatgaccatactgccaaaagcaatctacaaattcaatgcaattcccatcaaataccaccatcattctgcacagaattaaaaaaaaaaattctaaaattcacatggaaccaaaaagagcccgcagagccaaagcaagactaatcaaacagaacaaatctggaggcatcaactacttgatttcaaactgtactataaggccatagtcaccaaaacagcatggtactggttaaaaataggcacacagaccaatggaacagaatagagaacccaaatacttaaccgccaatgatatttgacaaagcaaacaaaatcataaagtggggaaaggacacccttttcaacaaaggtgctgggataactggctagccacatgtaggagaatgaaactggatccttatctctgacttatacaaaaatcaactcaagatggatcagagacttaaatctaagacctggaaactataaaattctagaagataacattggaaaaacccttctagacattggtttaggcaaggatttatgactaagaacccaaaagcaaatgcaataaaaacaaagataaatagtagggacttaataaactaaggagcttttgcaccgcaaaaggcacattcagcagagtgaagagacaacacacgagtgggagtaaatcttcacaatctatacacatttgacaaaggagtaatatccagagtcacaatgaattagaacaaatcagtaagaaaaaaacaatctcatcagaaagtggacttaggcatgaagagaaaattctggaaagaagatatacaatgctcactatcactaatgactagggaatgcaaatcaaaaacacaatgtgataccaccttactcctgcaagaatggccataataaaaaatcagaaaacagtagatgttggcatggatgcagtgatcagggaactcttctacactctggtgggaatgtaaactagtacagtcgctatggaaaatagtgtggaaattccttaaagactaaaagtagatctaccatttgatccagcaatcccactactggctatctacccagaggaaataaatcattatttggaaaagatacttgcacacacatgtttatagcagcacgattcaaattgcaaaatcatggaaccaacccaaatgcccatcaatcaatgagtggataaagaaacgtgagattatctatctatctatctatctatctatctatctatctatctatctatctatcgatggaatactcctcaaccatagaaaggaatgaactgacagcatttgcagtgacctggagagactggagactattattctgagtgaagtaactcaggaatggaaaaccaaacattgtagttctcactgatacatgggagctaagctatgaggatgcaaaggcataagaatgatacaaggactttgggggtttagggggaagagtgggaggagggcgagggataaaacactacaaattggtgcagtgtacactgcttgggtgatgggtgcaccaaaatctctcaaatcaccactaagagcttagtcatgtaaccaaataccacctgtacctcagtaacttatggaaaactaacaataaataaataagacactgaaatagatacagatttttttaaacagaacacaaaaatcaataccataaaggaaaagattgataagtatgtttatgaaaacacaatattacagggctaaaagataagcattagtacagaaggaaggtatctgcaattcagaatacataaagaattctacaatcagtaagaaaaacaaaacaaaaacccagagtactcaatagaaaaattgttaagacactaaataggtgcttacccaaatgatattcaattggtcaataaacataaaaagatgaaaagataagagcaaaacaaatgaaaattctataaacaaaaattgaatatcaaaaaaacaacattagccaggtacagtggctcatgcctataatcccagcactgaggtttgcttgaggagggagaggattgcttgagcctaggagtttgagaccagccaggacaacacagcgagatcccatcctatgaaagaaaaaaaaaaacatattcaatgggctggcagcagattgggataagagaaaaatcaatgaccctaaagacagagcaatacaaattatccaaatgaaagacaaaaataaaaagactgaaagactggaatgcaacaccctagatcttggagctacaccaaacagtctaacaactatcattttcagtcccagaagttaaggagttaaaagagaaagaaaagaaaagtgtataaaacataaagtactcataattttccaaaattaaataaaaataccaacccatatattgagctcattaatcccaagaaggatactaaacacatatagtcaaacagcaaaaactcaaagagaaattgttttaaaaagcagccatgaagagtcataatgtatagtgcaacaagcataatatgatggtttctcatcagaaacaatgaagggagaagacaatgatgtgatatatgtacagtccaaaaaaaggaaaaaaaaagaaaactgtcaacctagaatcttctatctgttgaaaagacattaaaaacaaagttgaaataaagacatgctcagatgggcaaaagctaggagaaggtcctagcagaccagcctgaaaggaagttcttcaggcttaaggaaaatgataccagatggaactcagacttcagaaagaaataaagagcactggaaaggacaaatatgtgaataaatataaacacaattttctataatatgtatgcacatacatgcatacatatgtataaatttctttaaagaccattggttatttaaagcaaaatggacccaatatatcatgaagtttatagcatatgagaagtaaacaatatgacaacataagcccaaagaatagcagaaataaattatataatagaagattattctattgtttgcaaatttggtaggaaattatttgaaaatagattgcaataacttaaatggatatgtaaactctagagcaaccactaaaaacaataacataaagagtagagtaaaaatgtgatagaaaaaataaaataagaacatatattctattcactgcaaagaaggaaagaacatatgagactaacagaagacaaataccaagatggtagacttaaaaccaaccgttctataattacattaaatgtacatggatgaaactccacataaaatgacagagaatttcactgagcatttaaaaagccagacctaattagatgctgcttacaacaaagactgtaaatacgagagagagagagataccaagcaaaaacaccccactcttagtaaatgacagaacagtggcaaaaattcagtaaagatactgaagatccagatattataagccaacttgacctgtcattttagaactctatactccacagctacagaatatacattctttttttttttttttttttttttcaaatgcacaggggaccgttaccaaagtaaagtaaatactgggccattaaagaagtccaatacatttcaaaggttagaaatattacagaatatgttatcgaattacaacaaggctattagaaatcagtagcagtaaggttttttaaaaaaaaaaaatccctaaatctttagaaataagttatatactccataataactcactactaaaatattacttcagaaagtcaactcatggccaggtacagtggctcacgcctataatcccagcacttttagaggctgaggtgggaggccacttgaggccaggagtttcagaccaacctgggcaacatggtgaaactccatctctactaaaatacaaaaattagctgggtgtggtgatgtgcgcctgtaatcccagctattcaacagctgaggcacaagaatcgcttgaacctgggaggtggaggttgcagtgagccgagattgcacactgcactccagcctgggcgacagagtgagatactgtctaaaaaaaaaaaaaaaaaagcaactcataaatattctgaactgtagataatgaaaacacaacatatcaaaatcattggagcagctaagcaatacttagaggaagtataactttaaatgcatatattatgaaacaaatgaaaccaacagattaatgttcaatcttaaaaagctaaagaaaaagataaattaaatcaattaacttaaaaaatataagaaattaatgaaatagaaaatctaccaactacagagaaaattcaaaatcaaacatgaattcactggaaaaaaaatcaaaattgataaactccaagctaaacgattgacagaaacaaattatcagtgtcaggaataaaagaagaaatttcactatagattaaaagacattaaatggacaaatgtgagattatgaacagtttcatgcaaaaagttctccaggaagacgaaataagcaaatgtattaaaaaccacaatttgcaaaacaggaaatattcacaatgcctaatattaaacatatacaaatacacttatgtatattaaaaactaaaaaatcaacagatttttaaaaacacgttttaaaaagctggcaggagatctgaaccagtatttcagaaataagacacttgaatggccaattagcctgtatggaaaaagctcaatattaatcatcaaggaatgcaaatggatcatctatactctactaaaaagaataaaaacaaaaagattgatcatataaatgttggcgaggatgtggagcaactagaatgctcatatattgccactgggtgtgtaaatagtacaaccattataaaaatccttgtcatagtttgatttttggtttttaaagtgaatttacgaacccagcaattccactcctatgcattttatctgagatgaatgaaaacatatgagtgtacccataaacacttctataagaacattcattgctaaaaactggcaacaattcaatacccatcaatcagagagtagacaaataaatgttgatgtcatcatacaatgaaatatcatcagaaaaagaaaacaaagaaatgaaccactgaaacatacacagaactcaaaaacatgggaacaaaagaatccagccacagaaaaattattggttccatttatacgtagttcaagaacggaaaactaattgatgttgacagaaatctggaagaggtgtagaggtgtgaaaattgactcagaggagcaaaggagacttcctgaggagatggaaatgctctacatcttgttttagaggtggatattggaatgtacacaattagtaaaattcaacctaaaaaaaactgtcgattttatgtatataaactatacctcaataaaaatagatagggtaaaaaaaatatgacactagaattcattcccatccctttggccatgttcaggcagaggttgggcagtgtatcaatacacaacctaacgctaagagatgatctcctcaggtgcattgagggtgggaaagggcaaatgtgagaataatggtaaccagcccatgtgccctagaacaaaaatggctcctgatccatgtttgatactgtcccataggtggctggccctttgctgcgatgcacaagcggcactatcggcttcatgatcaacgcaaatgagagagaacactaagtcaatgaacccagggaaagggctgaaagaaaaaagtgagtcacaaaactcacaagtagaacagattacacttacccatgccccacatcagaggaagtgatacatccatatagaaaatagtgactgcaagattttaataaaactcaggcaattctccagtccaaacctttttttgttcatcttatcaagaaaactcagtaggtatacagaaaaaatgaatgtaatcaatcaagaatagcatagagagaatttaaaggtcctcaattaagaaacatttggccattttcctctcctgggtaatagctgtccattttatcattactaaggagcaaaatgacaagaagagaaagcaccacgaatggccactattgttttgcaatggacatctccaatatgccagaatggaaagttctatggtctgctgaataccaccagacttgataaaatgagactcttaatttttttctttaggtcttaattagcttcttgttaaactacaaacatttcattggaacacacatgctgggaaaaattggaacactggttgccagcctgggaagcctggagggtccccagtgattaactgtcaccacactaatggtgacagtactgctttctacatggctatcacactggaaaaaacccaaccattgcatctttcattaaaaaagaaaaggtaaagaattgttagagtgggcctgtgtgaatcctatcatcctgatctcagaaatccaggggtcagagttggcaaatatttccagtaactcatgtcatcaactgccctgtctattaacaaggaatccactttaatgtggcagttggcatgaatcattatctctagggctggcattttcacagatagtccatccttgtaaatgcagtgactaaaactcttttgttgactttgaaagcatgagacgccgtgattcagttaaaatggatgagtttacttttgaaagactcagtaaaacagagattttcaaatgacggcaaggcgacctaactaacgatctcttttgtccaatggggatttgaggtaggagttgggggaaggggtgaacaaacctcagaaatctcaaaatgacaaagtcattgtcagtgtgctttctacacactttccctgacatctctacacaatgaaatgtaagggtcagggtactgagacaagtcaaggcagttccactcttttgcttctataaaagcgagtgacccacctattatactcaagtcttaggatggctttgttctccacatccagatgcagcagcttttctcctgcccctcatcctgccctcccacccccctagggaagaaatgactgaggacacctcttcacattttctttttcttgggcatttcacttcataaagctgcagtcaatgtgttttgttgtgggaggagggactggcacattcagtggtggtctccactgctgcctgcattggtggccaagtagcctcaggactagtcctttgtgttccatgaaaggatatgaaaagtcagttattaagctcagtcaagctgctgatttttttttttttttagatgaggggtgtgtagggaagaaggttttgcaattccgtgtgcctcaatatattacagtattttgctgagtgcagctgtgtgaagttagcacactcggagcactcccaaatttaaacagaaaaaattaaaatgcctaaatcaacctctgcatcttatcttcatttttcatttgtttttttctagtaggaagacttcttagggcaaagattttagctagcagaagtctagataactcagactctacactcaatgttatcagggccaaggaagtttcagcaatattatgaaaattacgttattatgagatatttagtgctactggtttattctgaaaacaactgattttgatactgtggttccagaagagaaaatagccttaaagccttcagggataataaacctaatatctggaatacaaactcatgtcctaatactatgggtctggtaactgtctgacaattaccttaatgcagcataatgtcattgtcaggctattctcccacttaaaaatatacgtagtatttaaaaagtaccttttatttagtgagcttagtgttatgctaagaatgttattgaaatgacttcattttatcctcacaataaccctcatggataggtagaattttctccattttacagagacgtagcatgtggctttgtgaggaaagagaggtaagcggtagagctaggagtcaaacttaagaaggatgattccaagcctctcccattcatcctacactacacttgaaattttttattattattttttggttcttttgagtctgggtcggctctgttgctcaggctggagtgcagtagcacaactgtggttcactgcaacctcgaactctgggctcaagtgatcttccggactcagcctccagagtagctgggactacaggcacgcccactacacctagctaattgttttatttttttgtagagacagggtctcaccataatgctaggctggtctcaaactcctgggttcaagagttctttccaggtcggcctcccaaattgctggactacaaccataagacaccatctctggcaaagtcttttattatttttatagagaaggggtctcactatgtcgcccaggctggttttgaactcctgaccttgagcaatcctctcactcggcctcccaaagttctgggattacaggcatggaccaccacacctggcccctacattatctttgaagttatttacttacaagtgatatctagtcacaccttttttttttttagatcgatctcgccctgtctggagtgcaatggcacaatcttggttcactgcaaccactgtctcctgattcaagcaattctccctgcctcagccccccaagtagctggtattacaagggcccgccacacgcccagctaatttttgtatttttagtagagatggggtttcaccatgttggccaggcggtctcaaactcctgacctcaagtgatccacccaccttggcctcccaaagtgctgggatacaggtgtgaactaccacactggcccagtcacatctaatcttattcacagtagcacactaacactcacacctttaaaacctgaagctgggccgggcgcagtggctcacgcctgtaatccagcactttgggaggctgaggtgggtggatcacgaggtcaggagttcgagaccagccggccaatacggtgaaaccctgtctctactaaaaatacaaaaattagcctggcgtggtagcagcacctgtagtcccagctacttgggaggctgaggcaggagaatggcatgaacctgggagcagtgcttgcagtgagctgagatcacgccactgcactccagcctgggcgacagagcgagctccgtctcaaaaacaaaaaaacagaaaacaaaaacaaaacctgaagcttttcctagagaccaagagcacttgcaaagggaattttcatggctctgatatcctgaggtagaatcacccaaacagaccacataaatgatgctggcttccttttaattttggaattgagaacagctccattttgcaagcaactataatttgacaggattggcaagatatctgacagctttaacagttgtctagtaaagcattcacggaggtgtgcaaacctaactggccttctactgggacacagcctgtgaatgacacatgcctgaggggatcgactatcctgcagtgtgggccccctattcagagcaagggctttcattagccacacaaggcattctgacctggatgtcctaaagagaaactttccaaaccagtatcctttcttgttttcctgatgctggtacaaccccatctttctgacagctcccattcctctccatatccttccacccaaatgtctaaactctacattcctgtgcttagaaacaagccttcttgtgatctggcccctctgcatctctccatctgatctcctctaatgcttgtctcaaacctcctgatgcagctattccacactgcagtgtccctgtagatatcctaactcctgcacttcctgccatatgtgcctccttctcccctacatggctcaggaataaccagaagccttaccagcttccccaagcagggcaacagacaaagccctttgctgctgtgatgtaacttgtatttggccagcatggaaataagggatacacaatacaaaatccttaaagttggtttgaggtttttttggtttgggtttttttgttgttgttgttgagatggagtctctctctctgcccaggctggagtgcagtggtatgatcttgactcactgcaacctccacctcccatgtcaagcaattctttcagcctcccaagtagctgggattacaggtgtgcaccaccactcccgctaatttttgggtttttagtaaagatggggcttcgccacattggtcaggctagtctggactcttgacctcaagtgatctgccctcctcagcctcccaaagtgctgagattacaggcagaaaaaacatgtccgggtctgatgttggagattttcatggtctttcttatgtatatatccacacataatacatcatctatgaattttaagacacatgtgaagctattagcacacaatctattttcctccaattctcatctccaccccatttattctcatccacacataatttgttaaaattttttaaagtgaagatttctttcccaaggcttcgacttgtcaaacaaatctttctttggcattcctgtttcatcagtttatatgataagtattgccatcacaaaattacagtaacaggataagtagcatgaatacgttgaggaagaatcacaactgactctgaggaagcataataggccaaggattggggcagagaatggggtccgccagaggcagcccagtggcaggcatgtctacaggtggagtggagggtgctgtgaatccagaaggtggtgaaaacaaacaagtggatagaacacagtcctcaacctttttggcaccagggactggtttcgcggaggacaatttttcatggatggcgatggaggtagtttcaggatgattcaagcccattacatttattgtgtacttatttctattattatgtggtaatatataatgaaataattatacaactcaccataatgtaaatcagtgggatccctgagcttgttttcctgcaactagatggtcccatctgggggtgatggagacaatgacagatgatcaggcattagattctcataaggtagatgcaagctagatcctagcatgcacatttcacaatgttcacagggttcgtgctcctatgagaatctaatgccgcgacgatctgacaggaggcagaggtcaggcggtaacgtgagtgatggggagcaagctttgtttcttgtccaccgctcacctcctgctgtgtggccaggttcctaacaggccacacagacagtactggtctgtggcccaggggttggggaccactggattagtcaacaagagtagttgtcacttcttcatcctccctagagcactaattagcaagaaaattaaagaataaatttaacattacccctggaggttcaaggacaagttagaagttaataccttaactttcagtttcactcaatgtgcataaagctccattagtgctgctattggtttcactaactccatccacaattctccgaaaacagaaaacctcatacaacaaagccaaacctgaaacacaatcaggtttccaccggcagaagtatggtgactaagcctagtggcctcagcactgctggacactgaattgcaatgggtaagtgaagagttccaaagccaagggaagcctcccaacagcatagcttggaatggatgatctgctgtccaaccccaagatgctgatgcagatgatgatgataacagcaagatagagagacatccactgccacaaagacctttttcaggtgaccgcaaagagcagggagaactctaaaacgacccttttcaggaagcaaccaggcacaactcagaggacaaccaccacgtgtgccagggtaagccggttaccggcctcgctgattttcagtaaagcccatcaactgggaataagtctctaaaggagagagatgcatgtgcacacatcacacatccttgtttaaccttacaatacaagatgagctgccacttagctgctcaaagaccttagaggggttcagctctctataggtcaactatgaattccatacacaagtttacaaggctggctaaaatgtagactccgactgcctagagccctacataaatcatctattacagccacaaatgttattttcctcaatttacagttaagatgggcatcaagctactttaattggaagattacatatcaacggtttaattgcttttgaggggtatgtgcgtgtgtgtgcgtatatatgtgcgcgtatatatatatacatatatcgcacacacacgtatattttaaccaaaaagtaactaaggcaggtctcaatcgattagagtttatttagccacagatgagaatgtggcaggggcatctgtgatgcttttttctagaggggttttgtaaacttcagtatttaaagaagagcaagcagaagggaaaaaaaaataaaaaaagaaaaagggagggagggtagacagtgagatggtcaccttcttgtgagaccctgattagcccagtatatctacattttacatgtgaaaagagggagtagaagaaaatgtggattgtgcatgtctcacactcagtcgatctgtattttatattaagataaaggagggagtacaggaaataggcagtgacacaggatagtagggttgtgaaatcatggctatctgtttgggaacaaaagaagatggtactggtgactctgttcccaagcttaactttccctttggcatagggagtctggacctgagattctatttctctttcacacatgaaataaggcacccagactttgttgtctaaatcaaatacatggggctgtgggggagttcagatcctttacagacagtttttaagagtatcaggctgggcgtggtggctcatgcctgtaatcccagcacattgggaggctgatatgggggaccacctgaggtcaggagttcaagaccagcctggccaacatggtgaaaccccatctcactaaaaataaaaaaattagccaggcatagtggcagtcacctgtaatcccagctacccggaggctgaggcaggacaatcacttggaacagggaggcagaagctacagtgagccgagatgcaccattgcactccagcttcggtgacaagagtgaaactcctctcaaaaaaacaaaacaaacaaaactagagtattcaaagtataaattgtgacagaaacattccatttaattaaacctgaggtgtttttatttcacaaaaatatttatgctgtgtactgtatatgtttatagtattaaatttaactctttagtatacttatgtaactttctataaagaatgcacttccagtgaatatattagtacaatgtacaatcaccagttgttacaaagttttaatgtaaagttattttttacagtaactatagaaatgtgcctttgcttttgccacagttaattgtttttccttgtttaacagtattaccacagagctatatatatcacaacctgaacaaaggtgcatcagaatactgagataaagatataggctgggcatggtggctcactcctgtaatcccagcactttgggaggtgaggtgagtggatcacctgaggtcaggagttcgagaccagcctggccaacatggtgaaccctgtatctaccaaatatctaccaaaaaataaaattagccaggcgtggtagtacacactgttgtcccagccactgtggaggagtctgagatgggagaattgcttgaagctgggaggcaagtttgcagcgagcagagatcacaccactgcactccagcctgggcgacagagcgagacccatctcaaaaaaaagaaagaaagaaaagaaaatctagtgtcctctctctcctgagcttcagatgctcatatctaaaaaacagtcacagtttctctggtacctgggtttgagaccaggttatcataaaaccaggaataaagttatttaaatgagtagtctccacagctgggaatcttctgaccactcaaaatgtctaaaagaattttggggaaaggaaactaagtttgtctaccttaattctaaagacacagggggtaagaaaaaaaggctagtaccacaatttctgaaaggttttatctaaaatatcataggctcatattaaatgagcattatatgactttctatagggagatggtgggcaccagatgacaaataatctattattagagacttagtgatagatatggtttggtgtgtccccacccaaatctcatcttgaactgtatgtagctcccataatccctacatgtttgggagggacccagggggaggtaactgaatcatggggttgggtttttcccgtggtattccgtgatagtgaataagtcacatgagatctgatgattttataaacagcagttcccttgaaatgttctcttgcctgccgccatgtaagacatgcctttgctcctccttcaccttccaccagtgaggcctccccagccacatggaactgtgagtccgttaaatctattttctttttttttttttattttattttgagacagagtgtgtcgtccaggctggagtgcagtggtgcaattttgctcactacaacccaagttcaagtgattctcctgcctcagcctcccaggtagctgggacacaggtaccctgctcatgcttggcatctctctgcctgaggaaatgccactttgttccctctggagacctggcacctgttcctcctccatacaatgtgcccctccctcaacctgccccctatcttctttgcacggctgtttccttatttttcaaactcaacgtcacctcctccttgacatgctggtccagtcattagcaaacactttcctttgctgaacacactagacctatactaattagattatttatgtttattggtctgtttattgtcgacctcctgcactagaatgccaatcctagaagctgatacccagttaactgctccatgctctagatcctggaaaagtacttggctacaggaggtgtccaagaaatactgattgactcaacgactatgagtgaagtttaaatgaatggggcaagtgaaatatgctcagagcagtgctcagcctggtgttatatgatcccttcttttacaggacctagagattgttttattacagaatggagtggtaaagaaaagcatcactatgcgaaagagagactttcgctggtccttaaaggatgaagaattagaagggtacatttgaggtgagccacaggtgtgcaaacacacacacacacacacacacacacacacaggtgccaaagtctggcatgcacatagtttctttccaaaagttaaagagagattagatttaaggaccaaaaatttgaattttgctctttgtatgtcctttgtagccacaaatcaaaggcaagcaaagaaaacaaatctatttagatatttattctaacatatggctgcactgtgagaagagggtttagtcctcactccagcattaggtgttgcatggccagtcttggaggaagccataattgaactaaagtgaaagagctaggattggaaatttgtctcgtgctgagaccttaaccattctctctacagtatcccttctattgtaagtcttatcacacagcatggtaactgctttctatctgtcctcccaatagagtaaactcatagaagaagggaattcaatttcacttagccccatatctcaagcccaacatggggcctagtacacccaagatactcaataaatgcttctcaggtggataagataaagcctctatcttttccacctctgcatactcagcatatagtaggagctcaataaaagctggtgggaaaaaaaaataaaaaggaagacatgtaataagaatgacacgtattggcaggcgtgatggcgcacgcctgtaatcccagcacttttggaggccgagacgggcagatccttgaggtcaggagttccagaccagtctggccaacatcgtgaaaccccatctctactaaaatacaaaaattagacaggcgtggtggtgggtgcctgtaatctcagctactcgggaggcgaggcaggagaattgcttgaacccaggaggcggaggttgcagtgagccaagatcgccccctgcactccagcctgggtgatagagcaagactctgtctcaaaaaaaaaaaaaaaaaatggatatattgaaaagaattacaaattattttcacaagtcacatatttgtaatagaaatgtttccttttgggagaaactttgagatattcccagatacatccagttgtaaatatagtcacaaacaccatatctccccatcaaatactacaaataaatttgcactattaaaattgttgaaactactgattccaaatcattaatattaaatttctaattaaaatgctaataagatattataatacaaatattacaggtagggtacctattaatccaattattgttttaagaaaatggaaaagagattcatgatgctggcattggtgctgatattaggaagtaatcaagcacttctggccagcgcagtgcctcatgtctgtaatcccagcactttgggaggctgaggcagcaggatcattggggtcagaaattagagaccagcctgggcaaaatggtgaaaccccatctctactaaaatacaaaacttagctggccatggtggtgcacacttgtagtcccagctactcgggaggctaggtatgagaattgcttgagcccgggaggtggaggctgcagtgagctgagactgcgccatgcactccagcctgggcttcagagcaagaccctgtttcagaaaaaaaaaaagaaagaaaaaaaaaaaaaaccacagaaaaaaaggaagtaatcaagcactttaaaatgtgaatgttgatatcatctctatgtttttgtttgttgatttacgcaaacatactatgttttgaatgccaattcctattcaaagaacataagttccagatgaagatctttatgctatttgtatttcaatttttatgaaaacaagatattcacttttaacctgtgaagagccattctatgttcataaatgcttggctttagaaatattgtagatgttcaaagctgttacaagttttgaaaaagcagacagaaaaacatgtttgaacaactctttataagccagatgtgcactgccagccttggctaaatatctgattagcccatggcaaccttgaggtaacttgcagactgttcatttgtattctatagttatttatttccagtgatatatttatatcttatgatatattcaaaaacttcccttaatctggctttccttccaaaaggcctaatcaaaaacctcacctttctttattcactactgtgcacacctgagccaatctgagttccaaagtgacacattaccctcgctgcccctctgggttcttcccttaatacaggacagcaaatgacacccacttttaagttaccagtgtcactgttccatctgcaatgagtgccaacatctaactatataaaaacaaatgaaaactcacaaatacaatattttattgaagtccaaaaatcaaagttaggttaattgcctctatctggccagcaatctggtcacatgtaaaccagaatttccttatctcagcgatttcatcgggagagtaataaatctgtgcatggtttcagacttgcttctacagagcctacattctagacaccaagccacagcagagggttctcctctcagatctacccctccagtctttggcaaactcaattggaaacattcagttctgacccaatggtccacagttccagactcctacttacaaaaccaataaaacgtcaccatcatacagaaaacgtaatcaaacatgaatgctctggattaaaaaggtcacatgggccaggtgcagtggctcatgcctgtaatcccaccactttgggaggccgaggtgggtggtcacctgaggttaggagttcgagaccagcctgagcaacatggcaaaaccctgtctctacaaaaatacaaaaattagcttagagtggtggtggtcatctgtaatcacagctactcaggagctgaggcatgaaaatcgtttgaacctggggggcaaaggttgcagtgagctgagatcgcccattgcactccagcctgggtaacagagtgagaccatctcaaaaaaaaaaaaagaaagtacatggataaatgcaactacattatttatttctatagctatttgattttaaatctcagcttagtaagaataacaactcgacagtcttagtctgaatgttctggtaagtgtagaatttcactccctttttatgaagatacctaacttttctgtggattttaatcttcattctatttgtactatacatcctgccaaagttctttctggctcaagaataccatccgtagttggttctgagatacgtagttcccctgtcgatcagtcagctagataacaccaagggtaacatcttgacaagaaatttccagtttttttaaactcaattgtttcagtcaatctcagctgctgggttgagaggcctcactttctgtgagtttctctgggcttaggaggaactgctagtcactgtgattatacctattgaacctaacgagagccatcaaaacccagggcccgtgatgtcagcagcatgttattacccatagaacctgatgacagccacaaaacccagggccccagtgtccgaagcatgtttgctaaggatgttaaacacaaagtcatccaggaaatttcctactatctgaattttgaaggggctaaataaaccctgtagaagaattgatgcggtagacgaggcctaaaattcaactcatttcagatgcccatgcaatggagaaggctactatccacacagataacatcaggcttctgtatggctcaccccactggctctagaaataaattttaaaaatgtatcacagaactgagcaaagtagacaaaatttcctttgcaaaacaaaacacctccctccttcccccctaaaagacaacgactttaagcaaagccatgaggtgaacaaagctaactgtcattttgaccttgcttgctttaattcaggagactacttagaaatgtaccgagcaacccccttcattcggctcagcagcagagctaataggcttctaattaatttccagaagattgctgttataactaacaggtttaaacatttggttgattggggaaaatgaattgaatataatgtatttgatttggaaaattgttttcattctatgtgcttaccataatagtgtttattttaagtttacatgattccattagagtcccagaacagcactgggctgttttcatccttacagagaggcctaggcaacttaaaaaaaaaaaaaaatttacatttagatttttgttggcctttatttgagggcaggttaaatgatttttttgggtgggtggctttaataaaaattttcacttcctaatatagcaacaggcccaatacttcaaaatgatcctggcgatacctcagtcaaaagcccactcatcgaatgcaaatcccgggagaaaggctcggcacacaaagtaagatgaaccagttactgcattgtttaccactttcacttgattcttcctgacaaccatttaaacaatgaatgttgggaaatgtccctcaagaatcaacaacaatggcagggaccagagcttttatatttagctaatactatttttaaaagagaaaatatttcttcctgaagggattatgggaagccttattaaagacacctgcaaacaaacaagtgacaatagatctttatcataattgataactaagttatcctttagataaaactctttcttggagacaataacattaggatttaaccttcgctgtagattcaagaaatcagctattggggccagtaggattccacaacattaagtttaccaagattatgtgagtggataatacaaacgcccttgtctctctggttaaatagaagtacaacgagactagaattttccctcctatgcttctaagaaatgttttatattgacatcaagtagcatccatccctctccctccatagtgagacaaagcacataagggatactaattacgaccgctcactctgctaagcacatagtggccagccagcttcggaaactcaacctttgcctagcttcctgttgcaaagaaacagaaatttcacaaaatcttcttgaagtaattaacaatccctgtcaaaacgtgtacagacaataactgcattctatgtaaacggggcaactgttttagtgatggcttctgagggataaataataagctaaacccaggagggcacattttaaaaatgtttgcaaaagaaaaaaaaaaatcagagtccttgtttgcagtaaaaataatccacctgtgagtctcagcttacttcacctccataaaagtggatgccttcgcccatgggctatactgtttgcagtcacatgctcatttgctgccttctgtgtgacaaacaggaattcctataagcatttcaagcctatgactgatttttcttacaagctaattttccaaattaagtaattttgcttcctttataactgtggctccagaggagattaaagcatctgagcattgagaaaaaagcaggggtagggggatcacaggatcaagccaaattgcagaccccaactgtagtatttctatttaatggctttaaattcagctaatgattacactattctaagttggcacttagaaaaagtcacagaggttcaaatttcataaagtgttagcacagcagctgagattttggaatatgtatagcttttaatagatgcatttccaaaataaaccttgggaaaaaaaaagtgccccagcttgaaccactgacaagtagacaaaattaaacaatggaaaaaataaaataaaaccaaaccacatgagcaacagtactgaataaggagatgagagtgacccaatattattttttagagcctcaagttcacaaacaaaagaaaagttttacagaagtatttctgtaggattgttggtttttttttttttaaagacagcttaagacttagagcaacaacgtgtgaaaacaaaaaagacattttctgagttgactttgatcctgtactcaaattgcttagatatccttgcctttaaaggctttgtatccgcaataactgctctctattgtccttttaataaagtattattttcaccttattattactaatcttttctttgtaagtaaccacactggttctatccaaaaaaaaaaaaaaagtgcctaagtatttgccctttgtggtaa

SEQ ID NO: 5059 - DNA, 52705 bp, Homo sapiens
tttggattcctggcacgaaattgcctggcttccttgagtttgacttggatccctgtgtttcccagctcttcagtgtccatccagcagaaactaacagggcgcctgctgtacccaggcatctgctggggctggggacgcatagagaggacagggtccctccttcacagctcataggctttcaggggcaattccagcacatagtggcggtgttctgaaggaggaggctctgggagcttatgagccccacaatcttcctttgaatgtgagggaaggcttcctggaggaggtggcatctagctgaaatgagtgggactttgccaggtgtgtggggaaggtggtccaagaaaggggaacgcatgttcaaaggcccagaggcaggaggcagtaaagggccctttccatcctggcagctgcagccttaccccactggaccctttcagggttcttcatgagactgggttttttttagagaagggtctcactctgtcagccaggctggagtgcagtggtgtgatcacagttcattgcagctcaatttcctgagctcaagcgatcctcccacctcagcctctcaagtagctgggaccacagtatgcaccaccacactaggcttttttttttttttttttttttcttgagacggagtctcctctgtcacccaggctggagtgcagtgacgcaatctcgactcactgcaagctccgcctccaggttcacgccattctcctgcctcagcctcccgagtagctgggactacaggcgcccgcaccatgcccagctaattttttgtatttttagtagagacggggtttcaccgtgttagccagatgatcttgatcgcctgacctcgtgatccacctgcctcagcctcccaaagtgctgggatacaggtatgagccacggcacccggcctttgttttttctttcctttttttttttttttaatttttagtagagacaaggtctcaccatgtcacccaggctgatcgcaaactcctgggctaagcaattctcccaccttggcttcccaaagtatcaggattataggtgtgagccaccacaccagctgacattgggcatttatggtacaaaacctccctcaggtacaacggctccaaaaggccagtttccagcattgaattcatcgtggacttacccatgtgtggttctggcaccctgccggggctggaggcctgttcttggccttggtcctttagaataggagtaaatttggcaacaaggaggacacccaggatacattgttaagttaaaaaaaaagagattctaaaatagaatgttgtatggttctatttttgttaaaagttatgttctctaagtctttttaaaaagtttgaacgtcacagccaagaagggtctaaagagacatgacagctcagtggtgtgtgagtcctggatggatcctggaacagaaaatggatatcaggggaaaaactgaggaaatctggctcatatttgttgtgtgtagataccagcattatccaggttttaaaaaggagaaaatcctggccgggtgggtggctcacgccagtaatcccaacactttgagaggccaaggtgggaggatggcttgagccagtagtttgagaccagcctgggcaacatagcgagaccccttctctacaaaaaaaaatacaaaaataggctagacatggtgttgcccacctgtagtcccagctacttgagaggctgagtgggaggatcacttgagcctgggaggttgaggctgcagtgagccgtgattgtgccactcacttcagcctgggcaacacagtgagacctcatctctaaaagaagaagaaaaaaaaaggaatcctgcaatgtgtgacaacatgaataaactctgaggaaataatgctaagtgaagtaaccagggacaggacaaataccgcatgattccacctatagaaggaatctgaaatagtcaaatcagcagaagcagagaggagaagggtggttgtcaggggctggggaataggggaaacggcttgctgatcgttgctgtgtaaagtttgagtcctgccagccgaatacatcctagagatggctgtacagcagagcgccgtcagtgttggacacttacaatctgttaaaagggtaggaccctattaagtgttctcgccatataataaaaagtgtaaacactaaggaaatcaatggacttttagttaataatatctcagtctggttcgttaattgtaataaatgtaccatgctaacataaatattaataatggaggaaacccggtgggtgtgaggtatatgggagttttctggactcttgcagtttttcagcaatctaaaactgttccaaaataaagtttagacagacaacaccatgtttctttagagagtgggattacatgtgagtcttccccctttggcttatctgtgttttctagttttctacagtaaacatgtattatttgtataatatattaacgacagaacagaacattactagaccatgctgactgcaccagccctggtggcagagagttccaagcatggcagccgcctcactgtgaatgccgtaaggccccaggtgctgtccagggcactggcctgggaaggggctccttcttttgatatgcagaggccccaagtcagtccagaggagacaagaatccattcaccgcccttggctatgatgatgttttcagcattgcacttaaaaaaaaatcttccactttatttattttaattttttgagatggagtcttgctctgttgcccaggctggagtgtggtggtgtatctcggctcagtgcaacctctgcttcccaggttcaagcgattctcttgcctcagcctccgagtagctggaattgcaggcgcctgtcagcatgcccgggtaatttttttgtatttttatagagacggggtttcaccatgttggccaggctggtcttgagctcctgaccttaggtgatcacccgcctcagccttccaaagtgctgggattacaggcgtgagccaccacaccaggcccaaaatcctccactttaaagaaaatatcatttggtaatcagaaaaaggtgacattttgtcatgtgtatgaaaaaaattatgcatttaatacctgttcattgtagaaaaattggaaagtaataaaactcaaagagaaattaaaagcactggaatctactgctcaggagaactgctttttcattcttggagtttatcctcccagacttttaaaattcaccaatacatggtataagtacatataagcatagatgactttttataaaaactgggtcacacaatggatatgacttgatcattgcttttacctcccagcaatatcttctgatcagttttctatgttaaataaatatacatcaccttgtcagtttagatgactgtactggactccagtatactgtcaaactatacttgattatcctgtattgctggatacgtggggctttctccctaccctccagattttaaattattgacaagtatttatggaggcctgctgtgagccaggagctgtcctgagccctggaaacccagcgtggctgtacagacctggcccagctgtcagggggcacctctaaggaaaccgggaggcaaaatcgtagctcccttgcagggaggttgtgaaggctgagtgaggacatctgtgcacctgggcacagtgtgagtgtgaaaccagtgtcagcccttattactgtcaataccatgaaggggggcgggggcactaagggtggcaggactcaatatctaggctctggggggtgccagagcctgccgtgcagggtcttctctctccctccaccctgactgtgctctgtccccccagggctggaatccacttcatccacgtgaagcccccccagctgcccgcaggccataccccgaagcccttctgatggtgcacggctggcccggctctttctacgagttttataagatcatcccactcctactgaccccaagaaccatggcctgagcgatgagcacgtttttgaagtcatctgcccttcatccctggctatggcttctcagaggcatcctccaagaagggtacggggctgctagaggtccataactgccccgtcctcgccaagggtgggcccggtgttcccaccaggctctccttccgcggggtgagcagggagttggcccgaggaagctgggaaaggaggggcctgagaggccggcccagacacaccgccctccggggctggagatgccacccctatatttgggctccaggattcttcttgcctctgtgagcttttctgacctccacctgggggtaggcgggcctgagaaattcatagaacaccagagggcccaaggagcaatctgcctgtgactccgtgactccatgccttccccatcactgccagggttcaactcggtggccaccgccaggatcttttacaagctgatgtgcggctgggcttccaggaattctacattcaaggaggggactgggggtccctgatctgcctaatatggcccagctggtgcccaggtgaggtcactgttggggtggtgtgtgtgtgtgttgtgtgtgtgtgtgtgtgtgtcctctaagaagtggacctgtgtgcagggtgggccaaggccccccaggggagaggagggagtgtgacctgtcactcagcagtgcctgaggcacgttgattggatcctcctgtctgtaacccagggttgcggctctgggtcaggttcccaggcagagaggcctgtgataggaggggaaggtcaggcattagacctctctgctggaccaagctctgggcagccctgagcagaactccccagaaactgtatttttcccccaacctcccttctccaactccatggcctccccagtggggccagtgctgaaagaggctggctctgtgctcgctcctcagcctgaggcctgttcctccgccatctctcctctctccctgtccttgacaccagcccagcccaccccggcccctctctctgccttcagccacgtgaaaggcctgcacttgaacatggcttggttttaagcaacttctctaccctgaccctcctcctgggacagcgtttcgggaggtttctggcctcactgagagggatgtggagctgctgtaccccgtcaaggagaaggtattctacacctgatgagggagagcggctacatgcacatccagtgcaccaagcctgacaccgtaggtggtgtgctcaggggtcctcgcccactgccggctccactggggcagggagacacccgcgggtaacctcaccaccccaccccaatgctgcccacagaaggaagcctcttgtaaggacctccagctctttagatctttaaactgcattttcccatagaatcaagaggatggaccctcagcaattcccaggccaatttagcaactctgtttagccgactcagtattcatagtggctttcaccctgatctcccacccctgagtctatatcctacactgagaagcagagggatggagggggtaggtaggaggaatcctgggagtgggcagctctggggctgcaggggagaggggagagggtccctggggccttggggaagaggttcccaggcagtgagggagggcccagcaaccatgtctccaccagggtcctgttaaaggacaatactttttcaaaaaggtaaatttataaaggaaccgtaaaattttaaaaagaaacaattcaaagacaaataagaacactgaaattaatttgctacagacacaaaacttgtcaacatccacagagtaatatcaattaaatctccatgggacaaattcatttgcctctatgaacaagagtcattcgcattaccctcagttctttacaattcacaaactgtaaaatagctcaatgacaaggaaagatgggacccctgtagcatcacgtcagtccgaaggtctgctaggtaactccctagatcttgtccagaagacacccaggaattgtcttgccatctcaaagttcttcatagttttcatggcaaacccatgcccacacacacgaggcagctataatcataataatggcactttataaaagtcagcatttttctctgattataaaatacatttgtcaaaaagcttaaaaatgcaaaaagtacaaaacattaaagacaatctcatataacccttctccctccccacatcccctctccttcaaaagaacttgtgaacattttggtgagaatttcacaagtgaagtacgtccatatcaccaacatggccccaacactccagatgcccctcgggttctctcccaggtaccacgctctgacttctgactgagatggttttgattgtgcctgttaagtcctatgaatagaatcacagagtatatacccttgagtctggcttcttttgctcaaattatgtttgtgagattcatttatgccattgtcccagctttatttatttattttttctcagacccagtctggctctgttgcccagggtagagtgcagtggtgtgatctcagctcactgaacctccgcctcccaggttcaagcaattctcctgcctcagcctcccaagtagctgggatacaggcacctgccaccatgcctggctaatgttttgtatttttagtagagacggggttttccatgttggccaggctggtctcgaactcctgacctcaggtgatccacccgcctcggcctccaaagtgctgggattacaggtgtgagccaccgcacccagcctgtcccactgtcccagcttttttttttttttttttgagacagagtcttgctctgttgcccaggctagagtgcagtgtacgatctcggctcactgcaacctccacctcccgggttcaagcaatttgcctgcctcagctcccaagtagctgggattacaggcatgcaccaccatgccctgctaatttttttgtattttaatagagatggggtttcaccatgtcagccaggatagtctcgaactccttaccgcagggatccacctttctcaccctcccaaagtgctgggattacaggcatgagccaatgcccccacctgttccagccatttttaatgactgtacagtattttggcttatgagtatatcaatattgtaactgatcccctattttagacttttttaggtggcttctcatttttcatgaatcagagacatagactgaaaaaccccgcctttttaaaaacagcacttctcattgggaccccaccaatgcagaggcgtaggcccttcagtttgaaggaagctgagcaggcagtgtgccaggccctggagacagtgggaaggtatcgtccctgtttatcagatgaggatgccgaggcagagttaagaagcgaggcatgtgagcacccaggagttaaggcaggcctgtgctcgaacgtggcttcctcacacagccccgccctctgcggccagtgccacacatcacacctgaagctccagctctctgtccccaggcctgagtctctcccttgctccccgctccccgccaggctctgctctgaatgctctcctgtgggtctggctgcctatattctagagaagttttccacctggaccaatacggattccgatacctggaggatggaggcctggaaaggtgaggccctggtttgcccctgcagtatgaccctggtcccagcagccaacctcctcaccctcttcatccccttgtctggttgctcgcatggggcactcagcaaattctattgttggctttcttacaaatcctcaccctgtgaccacgtagctgcattttttgggtgaggtggcctggtgggttgttcccagcctcacagtgcaggtcaagactaggatgcaggctcacctgcttgtgctccttttgctgaacaggcccctctgggattagggagcccacagggcagcaggcaccacattattgtcaagagcacctgggctttcctcctgattccctggagagcctggcatcagggtcacgtgactgcgtgttccaggaggtggtcgcagaaagacaggaggctgttaatctctcagagccttagaggctgtatcctctaatgcctgactcccagctctgtggcctgactcaggcttcaccaaggtcagctctgacccacctttccagggcccatccctttattccttcagtgacacacaggaccagacagtgctgggatgggaaagacagtaaaatgagactgaatcctgccttgggggtagggactctgtcttggcatgctgtagccccatcacctagaacaatgccgggtgaacagtgggagagcccagtacaagatgttgaatgaatgcgcaaaggactgtgagagtccagtggaaggaggattctttgtcaagcggcagagaggggaaatgaccaggagaatgtatctgatttgggccttggaggataataggagtttgctggatggaggagagaaacttaggcaaagagaaaagcaataaaaatgcaggaaagggtgcttggaaagggtggcttgtccagaggctgaagcaggtacactggggccaatcaaaagcaaactcattcctgcaggcaggtcctcacctcctccaagagcctcagcaggccttcgtctgggatctgtttcccctgccctacattcagcaggacacaggggttgatggacttctgcaagaccaccttggcagggggtctggcctgctccttgcacacggatacctggacaagatgtgaggccccaccagactatcccactaggccactcctgcagctctggccccggttacagggagcaccaaatccctgagcaggaggtagacaggatcagatctgtgttctagaagaacaggaatacactagggtggaaatggtggtcgtggtcgttttcaagctgcgggcaggccgaaagggagatggaagcacttggccaacttgcagaaatccagttcacagaggtgattgtatactggaactagttttcattgaccagttttcattttgccaccaaaatcacattgaaaggctgttccctttatctctgtccctgctccctgctgctgttgctagagattcagggttgagtgaggaaggtagggttgggagggcgtgctctggggaaagtggaaggtggggtggggctgtggagtatgcatcctggacccaagctggctaggtttggattctccacttaataagaaaatggagataatagtacctatgtcccataggctgttgagaggaaaacatgaattaaagaaggtaaggagcttagaacatgctgcctggtatgtggtcaccacagtagctggtgcccgagcagtttcacggtgcaggggttgaggggagggaggagaggtcagtggcaggagagagggacaggtgtgtagaggcaaggtgggtggggggaggaccttggggtgataagagacactcaactaaatccatgcgctccagtctagtgccctgggcgcagcctgcctgtgacacgaggtaccacacacgttgcatgaggtctgaggagggaagccgcatgggcagggcctggcattttaggactttctggctgccctttgtcacacaactgcatgtggcactgagagtggggcttttgttctgcgttcccaggaagttctccctggacgacctgctgaccaacgtcatgctctacggacaacaggcaccatcatctcctcccagcgcttctacaaggagaacctgggacagggcggatgacccagaagcatgagcggtgagcctggctgagccgagaacaggggcctctgaggtggaggcagggggacggccagtcttgggctccacgaagggcacttggtggtgggataagatagccttgcctgcaggtgccccaggggcccttggatgggaacactaaaggtcgaggtgttggagaaagccctcatggagggaccaggtgcctggctcccgggcggccctcagtaccgtccccagtctaggatgctggtctggagtggcactgatggttctgggatttccaagtctccatggaaaccctcaaaggtggggatttagaggctgtcccatgcccctgcctgggtggcctcccagaaaagagaaggccctcagtgaggggagagcggttgagaccctggatttgtcctttctttatggctccttgtgggtgggccagctgatctcacccccaggcgctttaacccccgctgtgcaggacggaggggcgcagggccacagcctcacccctccgtcggctctttcactccaggatgaaggtctatgtgcccactggcttctctgccttcccttttgagctattgcaccgcctgaaaagtgggtgaggttcaagtacccaaagctcatctcctattcctacatggttgtgggggccactttgcggcctttgaggagccggagctgctcgcccaggacatccgcaagtcctgtcggtgctggagcggcaatgacccacccctctccccccgcctgccacctcccccacaagtgccctccaggcttttcttggggaagataccccttttctgaggaatgagtttgctccgtcccctgcccatgctgggagcccacgctcaccccctcacccctccaagctcactcccaacccccaactccgtgtggtaagcaacatggctttgatgataaacgactttactctaaagcggctggaactcagtgacatgagcgtgcgctgaccccacatggggccccctgtgcagcagagctggccggcccctccttgctggcagaggcacgggaggcctgctggggatgaggcactggccagggctatgctgcaccagaccaatggcaccgcccccacccctcccagcgcagggcagcttggagcagaggcagcactggccaccactgcgggggcaagtcagcgtcaagaagtccctgagtgagaaggcccagataagcccaggccccccaggccagcggacaggcacagcagggcctacagaggtgccaaggccccaggccagttgtgctaggagcctggacctgctttccacacccccatcccgcccctactgcacaggcttgtgccttggtgccccctggaggcgcagggaggaggcttctcaggcagaagtcttaagttgcatcccattccccagaatccccggagggagaagagggatgggctgcccctccttcctgccagagccacagctcaagggcaggggatggccctgcacccagcccaggtaccccttcctctgtgccgaccatgctgtcctttgctccgaggaggccctgagcactgcccacccccacaccttggagggagcagacggaggggtgagtactgcacagagcctgcctggaggtgcagactcatgcactcagccctgaagagggagagaggctggatcttaactgtggtccaatgggcatattatgagtggtccttgtccctcctgctatggggtaaccctgacccagctagcgtccctgacaacatgatacaaaaacacaaactctagcgggatacagagatgtgtgcacagctggcaggagcactggccacctcccaactgttccccatagcttactcctggatgtagcctggagggactgctgggctggggagggatggccatggagcagggagctggatgccagcgggacctcagacctggactgcagcatctcttggttatcggttgtgtgtgtgctcagaagggaggaggccttccccttgttacatctcttctccatatattctcccggactcatcagtttggggggcgaaaagtccaccacatggtctggcgacaaaccactggggatgtcaccccagctgcagagctggaagcttgtgccggagggaaactgggtgagcaagggaggggcgaggcctgcctgtgctctcctcaccactgctgggacagaaaagatgggcacctgatagctcagctgggcagtcccaacgcattcccactcagccagggcctgagccccaggccattctggttgtgtcttttcagagcagtgagacctaaaacaatgggaagaagtcatgaacttgggagtcaggccgcttcacctgtcttctcaccccacagctcccctgagcctggcccagccagcagctcacccagcctcaggcctcctggggggcagcgccacactgcccgtggcgctctgcgccaagcactgtccagggatagtcccgctgatgtttggatggcaccataggtctgctgctgctgctgctgcggagacagtgctgtcctctccgagccaagccgttcagaatccgaggcacgtagggctgtcagcaaatggatttgtgcttggctggacaggcatgagcttccacactgcatccctcccctcctgcccttctcccaacaggaccagacagtggccataaaggacatatgaagaaacaccgacatccatttaggacattaagacgaaaatatgacacctgcagaatttcctagcagccagggcaaaagagaaagcacagttaacagttctcatgatcacagaaggaagcacaagagagcagttctcagaggaaactaaactcctagccctggatcctaggaggatttctcactttgtagaagaaacaagtctacctatatggggggcttagaacgctgccctgggacccctgggatgctcaacatatctgtgtgagtctattttgagtctcatttcctcccaatcccaggctccagccactgaccccaggcacagagcctgccatactcctcctgagaccctggctgtgagggcttgacatcatccacctgtcctgctgttccctgcttggccagcatagccacaggtgtgtcgctgggtaatgagtccttctgagccctcccttgtttggaacttgtccaaggacagacaccgataagagagcctgacacctggaggcagccaccagaaagaaccctgcagatgaggtcggctctgtcctggccacggctgtcggaaggctggtgactacagctctggaaccctggggctctgctttcccttcccagccccacctaggagcaggaccctggaggctgtgtgcagagagaactaggaaggcaaggagccctggtctctctaccatggggtcttcctctgaagcaggtgcaatgttcatttcttgaattcaagggaagtctgcctgacaccctcttggagcctagtggaggacctcgcacaggcaggtgcacgctgatgacaaacctttgtcaaaccctagcgccttaccatgtgccttcactaaagcccaaactcaccaggcattaaatatgcagagaaggaaagagagcagggaactgaaaccaaggggatggccatgaatcgagacaagactctatctcctcaacagtttcaaatatgcaggttaaatacccagggggaccaggattccttctctgccattaattcacaaacttgcctgccatggatcttagcaagagatgatcaaagatttgccggggcccatctggttgggactgttacaacaaagcaaaaaaaagggcgacaagctcagaggctgaggggcacagcttactgtgaacgggggggcatgtgggcctctgcctcacttcctttgtcacttgcaggctcttctgtctgcagtaacagcaaaaacttgcgatgataaacaaaactgatctctgtgaacgaacaccctccaacacacagactattaacacccggaataatagtaccagctggcaccaagctccccagcagccgagagaggatggggtgggggagtgcagggatgaggggaggaagggaagctacacatggacccaaccacccacgcctttcccatggagaagcagaatctggagaaggctgctgctgtgtgatacagacaagggtgggcggggttgacagcgagcccgtcccaccatctgttcctcccgggcttgaccgggcagtggggtcgggggcctttactttgtagttcagagggctgaggtgttgaagcatccaaagcaggtgtgagccaggcagaccaggatggtgagcagcagcaccagaaggtgaacagagtggcgggggccttcatacctggtgatagagggtggctagccttgggtgggcagggaggggccaccacctaccctcaccctgctgaggaaggggccgcacctggtgggaaactgcccgtgacttctccctcaggcagaaaataaaggcaaggcctaaccccccaccccacccctcaactccagcagcaaggatggtgtcttcacagccaggaacacacagagggcccactgaatgactggcatcatccctggtcagatttcaggcactggggtgccaagtcaaggcaattcttcagcctccttgctggtccgttccctccagtctccagtgccctgggctaggaggatggaccctcccacacccccagtctgaccggggcagacgtgtctttcccccaggatgtcagttttctctcctccacgtccccacctcttccatgccaggaggtacaaggagctggcccaaccaccagcctcaaagggcaaatctggatcagcttccccatttcctctggttcatccctgcacagctgataaaggcactatcttctctccagggatgtatgggacaattgaccggccttcacaagggttacacctgcactcgggctagcttaggagccaggctgtcaacacccacccaaccagcccctcaccctgggtatcatgttttgattggacacctaaccagtcctcctctgggcaccacattctgactagacatgtaaccaaccctcattctgggtaccacgttcgatgggacacctaaccagccctcactctgggcaccacattctgactggatgccatgctgtgctgtgaaagcaatgagggatctgactggctggtggggatgcagggctgggaggccaaggctggccccaggtcagaagggctgctcacccaggcgcaggaaggaaaagaagtagagcagaagaggcacaggatgggggctgccaaggcctggttcacagcggcaaagtggatcccctctccagcttggctgggaggtagacgaagtagaggttgtgccggtccaccatgtgcttggcaggatgtagatgaggcctgcaggggatggggctgtgagctggagacctcgcagggcccacagacacctctgtcctcttcctctccggggcggctattttggcaaggagccagggctgggctgctgctctactgcctgaacacaaaatgaggcatcctgcacctctggctactagtttttttcactttctctctcctacccacttcctcacttatctgtgaccccaaggtgtagggatcggtcagggtggtgggagaaaatttaagataaagttataggaaatagacacaaacctcttggaaagccgagaggtttgcatagcttcagtaaagggtttggctgaaggcagctgattctcttaaaagcttagggtgcagatacataggaatgtgggggagtttacctaaatagctgtttactcatgtggtcctaagaccaacctttgatcatccactggtgcatgattgctcgtattcagggggtcggcaatgttaattaccctctagtggtgtttactcgagacctttgtctttagtctgtactaaataaatgcgaacttcgcctggcattgaggactacactgcagactaggctgcagagccccttagccgcactgacaggcaaaatatctgtcagtgtatgtctgtcgtctgtttttttgagacagagtctctgttgcccaggctggagtgcagtggtgcgatctcgctcactgcaagctccgcctcctgggttcatgccattcttctgcctcagcctctcaagtgctgggactacgggcgcctgacaccatgcccggctaattttttatatttttagtagagaagggtttcaccatgttaaccaggatggtctcgatctcctgacctcgtgatccgcccaccttgcctcccaaagtgctgggattacaggcgagagccaccgcacccggcagtgtatgtcttcatccgtcgctgggtcagggtctgtgggacagaccctgcaccaagggagtcacagtgttgtgatcctgtccccacagaacactaacattccagaatcatcttggaaagaggctgtttacagttggatgcctggcctcaattcctccccagcccttcccatgctgagcccctgtatgcagtgctcccacacccctggccttctcccacccggctgatccctgccctcatcacagtcacagagaatgaggcccaagggtcttaccccaggggtggcacaggagcacacaggggaccacagaaagtgggtgctgccttttctattatgccaggttcttttgtttttttattttttatttttttgagatggagtctcgctcattggtcaggctggagtgcactggtgcaatcttggtcactgcaacctctgcctcctgagttcaagtgattctcctacctcagcctcccgagtagtgggattacaggcgcctgccaccatgcccagttaatttttgtatttttagtagggacaggtttcatcatattggccaggttgttcttgaacttttgacctcaggtgatgcactgcctagcctcccaaagtgctgggattacaggcataagccatcgtgcccagccccaggttctttttaaaaaataaattttgttttgaaagtgtaaatactgtagatttttaaaactacacaagaagtatacagggaaaactaaaacaacttttccccctaaaactcagctatcactgccagcatctcttgggttttttgtttccttctagagcctttcattaatctgccagttgcagatgtttatttcagtggccaggaccttggtctttaaacagtcctgagttcaaaggctggttctccgcttactaacaacatacgaagttattttgtgtgaagggggaatagaaacaggaactgcctgtaggatgaggtgagaaatgtggtaatccacgtggaggcaggcatctgccagagtgaagcagcacgagagctttgattgtgactctggcactgtcttacttgctgctaaagaaatcaccatgaacgacatagtcagtgggcagagaacctcagaccagaaatactaagagaggtccagctgagggccagtgggaggaattcatttaaaaatgaatgaggccgggtgctgtggctctgcctataatcccagcactttgggaggctgaggcgggtggatcacctgaggtcaggagtcaagaccaggctggccaacatggtgaaaccccatctctactaaaaatacaaaaagttagcaggcatggtggcgggcacctgtaatcccagctactcaggaggctgagatgggaggatgcttgagcccaggaggtgggggttgcagtaagccaagatcatgccactccagcctgggcacagcatgagaccctgtctcaaaacaaaaaaagaaagaaatgagtgaaatctggtgtcactgagtctttagcagcttgtggctcttgtggctgtggttttgggaactccattgtgccctgtgatagctgtccccgagaggtttggtgcaatcagccgtccatgtacccatgtaccctggacaggctccagggccactcaccaaatggcgcgatgatgggacaagtgatgctgtaggcacgatgacagtgaagacacacagcatccatgcatacatggctccaaactcgtactggaagcctggttctgggaggaggaggtggtgaggagctcatggacttgttccacctcaaacaccttttgtgctctctaagtggtgatgggagagcagggtggaggaggactttggaaatagggatgcgtggctccccgcctcccaaggtccttcccatccctcccagcctgccctgcttcatcagtgcacccagccctcccgaggcatggtgatgcgtgtttgctcgtgctcccttcgttcacccaacaggcatgtgagcccctggagggaagaggtggtcagggaagaggtgtagagtactccagcccttctagcaggggatcctgggccagcttagttcatgcctctgtgaaatcggatactagcagtgcccagctcataagggggctgagaatgaaatgaaggaatgcagcactctcccactttcctcgcacagtgcccaccatggcagaggagaataaaagagaaagccacacctccagttcagggaatcctggaataaatgccacaagccgaaaatgcctttgacatctgggtttggctaagaatttatgcaaatgggtgcctacagaaaaagagtctgttggtttgagtgtatgtatgtatgtgtgcgatcaaaccgtttcaaatgccaaagtcccaagctctctccccagcctgtgagctagagaggaggctggaggaggccacgcctgcctggacccgggtttggaagcacttagcccagtgcctgcactagtgggtagtcaggtaaatgctacccactagtggggtagtgggggtgagaggccctcgggtcagtgaagggggacatgggagggagtcagagcacagccctgggcccaggggatggcacctgcttgacattcctgcggtcagcagccgtctggccatgatcatgcggaaggtatagaggatgagacctggcagccgcagcagctccatgcattgccgatgaaggccgaggcgatgacatagttcacaaagaaggcaccctggtcaggcagaagacgcacctggggaaaccagggcccaggtctgtgagctgagagccgctcttggaggagaggaggggcccctaggctgggcaggagcagaaagcccctgggagggctgtatactctccgttcattcagcacatatttgggaaacacatctgtgtgccaagcacctttctaggcacgagaatagaacaaagcccctgcgccactctcttgaagttcacattctagctgggggcacaacaagcagacaaacaaatattccatctgctggggacggtgagcactagaggaaaacaagcagggagggttcctatgtcatacaggggttggaggagcctttctaacgaggtgatattgtgaagaggtgaaggagcaagtcatccccaaacctgggaagacaggattccagggaaaggaacaacatacaagacacctgaggatgtcctcgtctgctgcacatccaggggctggacacagtgggcgaggggaggcagaagacaaggctgaaaggggctgggggccagcccaggacagggatctgttccaatggggtcagggagactacacagatggccactgtgtcatccccatggggatgagggcggttgtgatggaggtggtgagatatgaagggattctggatctactttaagagagttgtcaggattttctggtaggctgggtatggcatgggagggatagaaaggaaaaaggtgaactttgaggttttttgccaaaacaagtagaaaaacaatatggaatggggaaattgtagagtagcagatttgagggtaaaagtcgagagtttggttttgggcaggtaacatcgtggtacccagtaaaactccagctagagtttgaggtgggcagttgggttaccagcctggggtgcaggctagaggcataaatgtggatgttgtccgcataagttaattcaggagcagtacatggcatggaagccgtgggttcagctgaagtcacctagagaggcagtgtggacccagactgggggctgagccttcaggcagccaaaatctagagttggggagatgggagagaacccacaaggagggtgacaagaggatgctgcgagatgagagacccaaggccgagcttcgaggagaaggctcggataaatgtgtcagatgtcgctgatagatcataagatgaggattgagctggcactggacttgtcaatctgaaagtcactgtcaacctagactattgctggctgtatgtattgtgtctgtcacagtcatcagctcccaactcatcagcttactcagcaagaactcatttaaataactcgccccatccttacaggtaagcacattcttttaggaaagtcaatgccaagccctggacctatattaagacctaatgtatagtctgtaggggctggggttgaatcccagctcgttccttaaccagctggataaacttgggcaagttattcaacgtctccaaacctcagtctctcatctgtaaaatggagagaataatagtatcttcctcatagctcattgtaaagatacatgagaaaaagatgcataaagcatttagcatagtgccttcttaaacaatagctattactataagtggcatggtataagtttaaaatactaacaaggatacatcagtaataaatttaatttattctggcaaaaataatccccagagcccagaggcatcctggctgccatctttaattatattctcctttccccactccctggcaccactgagacccagcaattccttctccccatgtgctctgtgctcagtaagtttcaatgaatgagacagctgctaattgagttctggcctaaaaattaaccacatttctgcaagcatagcacaaagtgggtcagctcccacagtgtctaccagaacctggcagggtggaggtgaggccccaagccctgctgtctggggaggaagatgcctgtcagaagcataggctacgaccgcccccacccatcccactgcagccccagcccctgtgggatttcacccagggccatggctccagaactcaacttggcaatactcactccaacctgatggggcctccgaggaagttttgtcaaagagccaccggaagaaaaaatctagactgaaaaacaaggaaccccctaagagtttatttccagcattccatattgtcactacacatgctttcatttcttttgctctaaaaacaggccaaagctcgagattgacttttgttctcaacgatgccactactacggcatgacctgtcacagtctgctttaacagaaacttccttccttgagataaataagccatgatgaggccttccctaagtggaaggtccttgataagtttcattttcttttctttttgtagagatggggtttcgccagactgcccaggctggaactcctgggctcaagcaattgcccacctcggcctcccaaaatgctaggattacaggcgtgagccactgtgcctggccaaaaattttcaagctggttttttttttttttttttttgagacagagtctcacgcctgtaacccagcactttgggaggccgaggcgggtggatcacctgaggtcaggagctcaagaacagctgaccaatatggtgtttttttcttttttaaagaagaacaatcaatcatattgccagaaaatcaatgacccagccctactgcacgccgagtggttgcgacaggcttagatattgttagggtttgcttctgctgccaaaccgtttgcattctcctggggacagtgctctcctgatgtgctcttattctgaatttagagcagaaggtggtggcatatacctggtgagacccagggaggcaggatcagcaccatgaagatcaagaatatgtagactttggtcatcatgatctggttttccccgacctgcaggaagtcaaaggtgagcactcgcagtcccccaaatgctctatgtgccccagtgaggcccctgccatgtgcccactgcctgagcagctggggggttagggtgtggacagggagcggtcagagatatccttcttaggggcagggcctcggggctcccgggcactcactggtccagtgagactccagcagtgtagagtagtagacaatggaggggagcagggccgagaggaccagagcaggagggtggggaagaactggctgatgatcgggttctaggagaaaggtcacagcagagagagtcacaggggccgtgggccacgcggctctgaggccatgacctattgtatggtcgctcagtggactcccagggtaggagtttgtcatctctgaccccagaaccaaactgtgccaggtacagagttggtagtccataaatgttggctgaataatcagtaacagcacttatatttgtacagctcctcacagcacagcaaagaaagcaatttcacatacgagtaaacccacttatctgactaaccagattaaataaccttctctgctccctatacaaaaccaatgatgatgccatggcaagactgaacaccgaaggcctggagtcctggccggcgggcggggggggggtgccctgcctgctcagctcccactgtccagctgcagcatatcagggctccactgtggtgtccacaatcctgctgtttgttactgggattacatgagctgattgacttattactgtactgattagatgaacataaaaatagagagaaattttctttgaaaactaagttggctacttggaaagacttaataaaagtcaatttctaaaaaaaaaaacaaaacgctgttaattagatagagtaaattaacgataaaagatcaagggatatgcgatctaggaagtttctatattcagatggctcggcaaatatctaaattcttcctttactttaaagaaaccaacactggaatcacaaacaatgaaataagggtgtggttgatgtaaagtagacaaaggggagctctcatcagcaatccatcttcaaaagaataggcctgtccttctattaaaagattggcaaaggaatgcatattataatacctgctttaaatcttaagcaaagctgctgaatttatacttaggtagtttaaactatctatggagtcagataagagcttcaaccacacatcagctcattgattatcatgacacagcctcacgccctgtataatagtgcaggtgttttaactccagttcttggatgaaaaatgaggttcagaattcatcagatagggaatggcaaagtgaagacaaggaggcccacctgcccgtgtgctttcccagggaatgattaaccaaatgcaaagtgaaatttaaaaagaaaaatatctagggagatggtttggcaaagctaatcatgagaaaccaatagctttttgagtagatccagttgagtgagtgtttggctgttatctcattgattcatctaagatttttgaaaatcgtcattacctatacagaatagtttttttttgtttttttttttttttttgagatggagtttgctcttgtcgcccaggctggagtgcagtggtgcaatctcggcttactgcaacctccacccccggttcaagcgattctcctgcctcagcctcctgactatctgggattataagcgcccacaacacgcccagctaatttttgtattttcagtagagatggggttgtgccatgttggccagctagtctcgaactcctgacctcaggtgatccgcccaccttggcctcccaaaatgctggattacaggcgtgagctaccgtgcccggccccaaaatagttttataacaaggtcattagcaccaaaatgtaaaagaaataatttgtgatcctgccaccccaatcaacgaagcttttttcttccttcctggcccctccccgtagtgtccatgatagacatgcctcactggtacatccctcttctgtcaggagccctgcatgggtgccacaaaatctatacaattttgaatggatgcttatagtctaccaacctgaatataccacattcaactcaaatgatccctaccattcagtattagatagtctattaaaatatatatgtatgcatgtgtgtgtatatatacatataatgtgtggtgtgtgtgtgtgtgtgtgtgtgtgtgtgtgtgtgtatggcattactataaggactttgaataaatgtggccatgcctgctcagggcttaaaagcaaggatgtgagctgagcaacatgcccactggtttagttccccgcacacaccccactcctgtccccactccttccccacccacaagccctcttctcaccagctatcctgggaggggccttgcagaacagttactcacattcacgcatggatgggtttggtgacattaaacttgtccatggtggacaggatgatggagggtgggtcaggaaaaatagccccaggaagagggtgaagttgatgcccagccactgtagccaccgcggaggccctggatagagaggttcttcctgcagcgggagaggggatacaggtctcgagcttgtctcccagtgctcgtggcttaggtgggtcagaaggtcagatttaggcagaccaaggactagcctgggggcaagttctctgcactgaccttcaactacagaaagaccaaatcttagtccccaagagctcagagggaacaattattctctcagatgtggctccccagctaaagtcgggggccagaacctacccaaagagatggcatgagcacccaagcaggccaaacaaggctcagcatggcatttattttttctttttctgtttttttttttttggagacagagtcttgctcgtcacccaggctagagtgcagtggtgtgatctcggctcactgcaacctctgcctcccagttcaagcaattctcctgctcagcctcccatgtagctgggactataggcgtgtaccaccaacccagctaatttttttgtatttttagtagagacagggtttcaccatgttacccagggtgtcttgaaatcctgagctcaggcaatccgcctgcctcagcctctcgaagtgctgggattcaggtgtgagcaccacgcccggccccagcgtggcatttcttagacacatctgcaatgcttgtgactaacgacacattcttcccaacggggctgtagctggggtacaggaaggaggaagcagggacaaaggagtgaaggcatagcttgcacctgccctggcctctcatcccaaagaacgacccacaaagcaatcctgagtttaggaagccttgtgaaccaaagagcaaaactgtcagggcagaactagaaccgagcagaggggagcacttcaagctcattctgtgcaaggagctgagcagggctggacaggcagctgcgctggggcttgcgctgggtgcccttaccctcagcacacactggaggctcaccagggcccccatggacacagctcagctccccagcacggccccaggtgacactggacctaagtaaggctgcacaagctgcatgcggctactgagcattttaaatgggctggtgtgaattgagaggtgctagaagtgtaaaatacacaccagatattgaagactagtgtgaaaaagagaatgtaaaacatctcacatttttcaaaaattgcatgttgaaataacgtttggatatattgggcgagatacattattaaaattaatttcaactgtttctttttactttttagcatggctattaggaaatttaaaattagatgcagaactggcattatatttctgcgggtagcacttgaatgctagggaggaacactggagggaagggctgggcagataccccagtgggccacaccgagcacatcacagcatcacagcccacagaattgcagatgtgtggagattccattgactgccaggtcacacctgtgctccaggtgatgggcagctcccaccaggaaccaggcctctctcccacctctccttggtctaggagcttaccagcagatgtcctcagggtcacagcaaaggtgactgtccacttggaggtatagagctccctgctatgggaggacggctgggctcacctttgcactgaaggctctgacacttgcaggcattgaaatctttcaggatgctgaaggaaatgtagcaacagccaggcccaggctactcaggttaccaagcacacatgtggcagtggggactgagtaggagtgggaggcagtggcataggacctttgctttgttgtgattaggtattatgagtaacgctatgtaagaggtgccacgctagcacagtgtgtggagaattttgttaatcctcgcaaccaccagcaacaaagggagtacgattcccattttacagataaggaactgagggcaacacactgctcttccatagggccatccccctccaccctgcctgttaagctgagctctgatcagtgctactgccaggccagtggctcaacttttcattctgtcactttttcccaggcccaagtgtagcaatagaccacgttacacattgcctgttcccaagcttccctctcagggctcccacctcgaccctcaccatctcaacaggtcacagcttttcctcctttaactcccgtaaggagcccagcagcccctctactcctgcctcagatgccttcccctttcctccgccccagtgtctgcaaggaggcaggaagtcctgtgtgagtccattcctagtgtcacaatcctggggcagtggctggacacctttccacacccctctcccgacccaccctgtgctgctctaaggcgagatgacactgagaccacaggcatgagagcctagagtcccatgccaagggccctgtgaaaagccactccccagggtcaagctccccactgcagtgagcgccccagcgtgcccaggggtcttccccacagctttgcatttgtgggaaggtggggagccacagacagaaggactgtggcccagagcagatgtctgaaaggagggtgcctccatctcccctggggcaaggctgcacatgaagccaacaggatgggtccagggcagcagggaagagcccggcagtggggccagccacatcagctcgagggggtcagccagaatcacccactccgtggctgctgcccacaccccaccgcctgttacacaaacatgggctgggctggctgaaagtgagtgtgggtagctgaggaggagaaggaaacaccacagataaatcccagggatggtgggtcagcagtaccatctccctcgagagggacagtgagttatctggaggggaacagggagtcagccaagaaggggtctgatgtgcctacactcactaggtggccatggacttctcctggaaggtgacgaaggccattccaggggctggtcctggacgtggcgttcttcctctgtgatcctctccagcagcctgtcctcatccgtgtgtagtaagagatggcgtcttcctgccacaagacacatcccattgggatgagtggccccatgctggtatctggggcaccccgatgccaatgcctctgctcccagccgggggtgggacccttacccactcacagcccagcacttcacagcagcaaaactggccacagggctggggttgatgagggtccgctggcctgtcttcacctgcaggtttgtgtaataggtcaggtcttctcagtcttctttctgtaggggtgggagcgggggcacaaacctcagatttagaatctgtggcagggacccccatacccacagttcaaccatcgaacgccaggggagaaggagggtccagggcctcccgcctcccttcctagctgggagatgcgaggccagcaaggaaggaggggcatcttgcaaggcccgcccaccactcacttctccttgcacaggtagatcagtttggcccgttgtagcacagctgcacatcaaccacctcacacgtgggatacgcgtccctgtggccaggagagaaggaggcaaaagacaccgttggaaaagaaaacaccccaagcaggagacgtgccacggatccaagggaaaggatggcagagtgatctcgctgctggtttctgtgccagcggaacctctcttctctttgtcttttatcctccaaaagggggaaattttgaaatttaatacaagagggcttttgttttgttttgttttgtttagagacagggtctcactctgtcacccaggcgctgtacagtggcgcaatcatggctcactgcagcctcaaccttctgggctcaatcaatctcccacctcagcctcctgagtagctggggctacaggcacatgccaccaggctgatttttttttttgtagagacggggtctcgctatgttgcccaggctgatttcgaacttctggcctcagcactcctcctgtctcaccctcccaaagtgctgggattgtaggcgtgagtcactgcacccgctagccttttttagtagtatgaagctaactgcctggaactgacaagtttatacccattggcttggaatcagctggcacttctcctggggaaaaatgaacacatcactatcccctcaaagacccaaaggaacagatttattgtttgtgctaggtcagtatctaccttgagccatcctgaaatcctattcaggtagccttttttaaggtcacagacctttcagagggtctaatgaagcaaaggaccctcagaccagaaaatatctacacacatattaacaaccagcaaggccagtgcggtggctcatgcctgtaatcccagcacttcgggaggctgagccgggtggatcacttaggtcaggagtttgcgaccagcctggccaatgtggtgaaacgctgtctctactaaaaatcaaaaattagccaggtgtggtggcacacacctgtaatccagctacttgggaggctggggacgagaatcacttgaacctgggaggcagaggttgcagtgagcaagattgccccactgcatccagcctgggcaacagagtgagactccgtctcaaaaaaaaaaaaaaaaaaaaaaaaacagcaaaatacatactcactattgaccaggtattgttacatatatttatttatttaatcccatcataacctgtgaggttttgtccccattttacagatgagtaaactgaggccgacagagtaagtggcttgtgcccaagatcacacagctagtgagtgtctgagccaggaggtgaataaggcaacctggctccaaggtcaatgctcatggccaccatgcaataccccctcaccataccgcaaaattatacatacaattccaggggattccagaaccatgtaaatccccacctaccactgccaggcactgttctaggtgctggtaacagggcctggatgtgcttacattttagtgaagagacagcccataggtatatcaatcatgaaattaaacagtaggacaatttctggtctcataagagctgtgaggaagaaaactgcaatttaagcatccctgcttgaaaggcaaattcaacatcaatccccacggactgcaacagcattcactaaaaaggcctcttaaaataggggaagcatgagtcatgcaatgtttgtatgagaatgaggagactttttttttctctttaaagtttacattaagtggaattactgtttccaggtgttgcctagcaggcaactttgaggagttgctcaaggaaatacagaaaaatgattctggtattgagtatttacatattagtaaatatttcaaaatacttagagtttctgaagaagtttttcaaattttaaacattcagtttacgatccttctagcaatttgcttagcaagtgctttcttcacaaatagtgcaaagttaaagtgcagccactcctagtccatgcaacaaattagtggctgctgtattgataaggaatgaagagaggccggcatggtggctcacgcctgtaatcccagcactttgggagggcaaggcaggaggatcactgagcccagcaattcgagaccagcctgggcaacatagcaagactctatctccataaaaatttaaaaattagctgggtgtggtgccatgtgtctgcagtcccagctacttgggaggctgggcaggaagatgccttaagtccaggagttgaggccgcagtaagctattattgcactactaactctagcctgggcaacagagcaagaccctgtctctaaaaaaataggattacaaaaaaggaatgaagaaagaataaaatgtcagctcctcagcccagccttcaggtcctccagcatgggtcctgggagccttcccggactgcttgccctgcccccctgcaccccaccgccacctttctgatgctctgggcctttccccgcatccctggctgcacacgtaatctcctcacaggaaaactttcctccagcctccatctgcaggaattggtggtgcagatactcaaagggagccgctgaaaggaggttctaccagggagagcctggactcagacacagtgctcactcaacagacaccgctcagtgggtggacaaacgaacaaacgcagagatggccccgaggtccttccacctgtagaccctagccctgtgggtccatacaaatgctcagctcacgtctctcttattctgcaaagtgatgctaagaaccccggggtcaacaattttttcccccgtatgctctcaagacgtttatcgcacctacaccctggtctgtgctctggacactgtgcacaggctgcttgaagaggatagccaccagggcgctattcactgcacagcaccagcagggctggcacacaggagccactcctacacgtgtggcagggccaggtccttctcagatctcacctggatacccaagcgagagacgaaggcgctcacctaaggtgctcgccctgcgggtggggctgtgttggtcctacgtggaggggctcagctcccctcccaccccacctgcttaccggaagtggctctccacagtctccttctggcatctctggggagtcctgtgatgaacagggtccgcctcacctgtccgggaaatacgcagggagagaagtcacccacaagccagtgtgccggtatgctcaggtttcctacccaacccagcctctggaaagtaaacaacaggaaatcagaaggctccagttttctccttctgtggcgggggagcccccaaagcatgtcatttacacagcgtcttcttccaggctgtacaaagaaccacttccaaagcaactctatgagccttctttgcatggcaggagactgagaaagaggggagtgactcaaatgcggtcacacagcagatcagaggaggacccaggcctggaaccaagcccagaagctcccctcccctgtgaagctgtgggcggcaaagagaaagggctgctctcaaccaaatttctttacttagcaccagtaactgtccaaatcttgaaacaatccaccaggaaactttttttttaaagatggtgccaagtgtgagcaagaataagcaagcggggctcctgaggcctcccagagctcattgcagtcagggcctgtggcagagcctgggaggcccttccactccgatcccacctgagtccctcccagcacatgtccctaagtcccgcctcactcaccaggttctctctttgtacttaatggactgagtgtggtgccgcatgaaacccacagtgaggaagaggtaatgacagcaaagatggtgtgcagccaaaggaggtcattgctgagagggaaaccacctgcatcagggctgggatcccaggcagggagctgggggtgcagagctggggcctggttaccctagtgggcactgaactgaggaccaacagcttcactgcaagagatgcctcccacagaggtttgtggccagcacccctcagcccacagtgaatacttcagaggggtccccatccctgtcctacaaatgaactccagatccacaggaccctccgtgtttcttaaaaccctggcaaaacagttctgcctgtggcatgttcatgcccacagctcaacaacacactagctgcaaggggccttcgataccagccggccccctttggagtacctctggcctgccccgggctcctgacctgcctttccttgatctcacccatcagcacctatccccacgggctccatactcactcagtctgtagtttgctattgttgtcctcccaaaactatacgggtctttgtctgcagagaagcacagatattagttccagggtcatgtggggaagcaggagggggcgtaaccaatcagccttggtttgtgagctctggggaggaggagcatgtctggaccagcaggaagacaacgtctgactggtcttccagagctacaccatcaaggcctctgcttgaaaccaaaatgctccctgataacttctcaccttccattgcaggtaaaggcataatgtgaattcattttgttttgagaaaactaaaaactcctatgttgttacaaaaccaacgttgggaaccactgggtatcctaagtggattcatggggcattttggaaggtggattcttgcagttgcccttagatataatgccacaccctgatttaattaagtatcatggatatcttctgggtccattaattgtgacctcctaatttgggtgaggcaggaaagtataaaagactctctgatagcccctgattctgtaaatcttggggggctttttccctatttaaatagaaccagacattgatattggggccccagttttagcctaggtttgtccagatctttaatcagatagaaatgttcagagtcaccctgagaccatcttacatctgagtggggcatgactcctggggttctggtctaccacagtgagccctttccctaggactgccctctgccccattacaacatagacaagggtgaggagggtcattacccagcaagtcccctggaggttgacaggcaggatgacacacagggacaaaaagctgaccaccaccaacaggaagagatgtgcctctggaaggacaggtagtggatggcgtcctccccacaccattccaggatctgtcatcactggccaagacacagaggaatcttaatgagcagtggaacaggcctcggggcttgcatgaagtgtctcatatcatcctcaccacactcttatgagatggttcgatcgctatcccacatttttgttcacatatgaggaaataaaggcacaggaaatttgcataactttcaggtctcacatgatataaattccagagcccgtcttagcccctgtaccatactcgaggtaaagaataccagcactccatctgatgttgctagaaacatttgtgcccaagttacgtgtgtgggaaggtacgtaaatacagtcatctcacagccctgtcctgcttctaagaaatcacattcagataaagttagggctgggcgcagtggctcacacctgtaatcccagcactttgggaggctgggcaggtggatcacctgaggtcaggagttcgagaccagcctggccaacacggtgaaacttctctactaaaaaatactaaaaaaaaaaaaaaattagccaagtgtggtggcacatgccttaatcccagcaactcaggaggctgaggcaggagaattgcttgaacctgggaggtggaggtgcagtgagtcgagatcccactactgcaacttcagcctgggtgacacagtgagactccactcaaaaaagaaaaaaaaaaaaagaataaagttgggaatatgcccaggccccaggccccacctgtttcctgtctccccctcaggtggagacctgaggtggagccaagagtcccagtcctcctaccaccctggcctcctccctgtgtccccagagatggggaggtgacttgctccacctttcccacccttggagtgctacacttggaggctctgggtccactggggactcagaaaatccaggttcacacaagccagacttctgtgctacagagggagaaggggcagggcactctgcctttcccactccctgaaggcgctacttctaggctgggaaagcagtgctttgggaagagccaggggggcaagggctgcatcataaaaaggcagatgtgaaagatgtcagcgtgggctttcagtcagaccacagtgtaatccagcgcagcggcctccacctgagggcaggtcatggagctacccgcctctgacctcgagcaaggaaactgcccactgcctacctcatcggcttagcagggctcaagagataataagcatcaaacacctagtcctgtacgtggtatcagcagatgctcgaaatatgcctgttcatatgagtcctgattactatttatctagaggacaaagctttgcattaactacattgttctcatttctaaataaactaactcgcctcctgcttcctcctgttccgaccagagttgactgtctcccatggggctctgtctcctgccagttcccctgggaacaaccctaccaaaccgaacatttacaacatgctctcacatgtattcattcctttgaattaggcgagcatatgttatcctcagcctccttttacagttgggaaaactgaggcccagaacatttatccttataaccaccatatttcattatataaccaccacatttcatcaattctaagatatattttcatatttcttttcttttcttttcttttttttttttttttttgagacagttttgcctttcactcaggctggagttgcagtggggtgatcttggctcactgcgacctccgccttcggtttcaagcgattctcctgcctcagcctcccgagtagctgggattacaggcacccgccccaagcctggctaatttttgtatttttagtagagacggagtttcaccatgttggccaggtggtcttgaactcctgacctcgtgatctgcctgcctcagcctcccaaagcgttgggattcaggcgtcagccaccgcagccggccatatttcaactcctctgaaatgaggtgtacactacgttatagttgatggtagcttagctgacaacattttcttgttcttagtgctatataaaaaacatgcacctgggccgggcgcggtggctcatgcctataatcccagcactttgggaggcaaggcaggcagatcacctgaggtcgggagttggagatccacgtgaccaacatggagaaacctgtctctactaaaaatacaaaaatattagctgggcatggtggcgcatgcctgtaatccagctactctggaggctgaggcaggagaattgcttgaacccgggaggcggaggctgcgggagccgagatcgtgccattgcactccagcctgggcgacaagagcgaaactcggtctgaaaaaaaaaaaaacatgcatcttacaacaataacttcttagattcaatggaatatggcagcggtgagaaccaagactcacatcagtccccgccccccccgcctcctggctccctacaccaatgagaggtaactaactggctcttaatcacctttaataatcttttagctttctctccatggccccattgaaaaaaagaaaacttgtaaccaaatgaattgaatgtattatatttcttccttttcactaattcaaagacatgcaaacctgcctaggagagcgtccattgacatctaatggtgttaaatattaagttgaataattaaagcaaaaaaatagctttaattagtttgtgcatattatgagagatgaacatatgatttccactgaatatgttgaaataaataaagttcatcctatcttcaagaactcttgggatccagctcaatttgggaagccccaggctccagcagggctgtgtgccctccagcatggaggctccaatcctacaggcctccttcctctgcccctgacccaggggctgcctggtcaccttgattctcagccctcacatactgctttggacattaactaaaagtatctaagagacaccatcttaagatcaagcatcttggctcttgcctcttgactgccaaacacccaaaaaaaccagcccaaaggccccccagcagctgcccccgggtgtactcatgcagacggaagatggcagtcagccagggacagcatccctggaaacggagagaacagggttagcttccaacatttgtgtctttgagaggcagatgtaaccattgtctttgacattaaaaaccatttaacctcctgttgtataaaaaacagtgcttttatcccatattcagcaagcatagcccagtacttcacaatatacaccacatgcctggaactcttgctaaaatctcctgacacttcgtggtcaaatcacaaaacttagatcaaaagctgatgaaagctcagggcagctctggcaaagtgatgtgggctgctgtttgattgtttacaatcactgaccaagaggtgaggcaaagagaggaaacaagcctaatggattggacggtccgctggagtgggtgttagggggaaaggtgtctgcaggttttattgtccttcacatctcttaaacttaatacccctaaagctgggcgttatccagctaggaaagacaaatatttgttcaataattcattcaacaatgactaaacactactatgcatcaggcgctgggaaacagggctggagagggcagggctcctgcccacatcggctcataatccagccagcaagtccataattaactgtcatacaaagccataggtgtaaggagagaagtgctggggaagcccaagggattccgtaccccttcctgcctgcaaattcatcagtctcaaggtcccgggtcatccagctgccatccctcctgtggtatttcccaagttcagtgccttcgtcgatgcagaaaagcactttctccagcacttgccgctcaagatccgccctgtccctccccaaaaccatgactgccagtccccaccccctggccatgaccacaactgggcctagataccaaccagctcattttcaaagtcttgttgacctgaggaggaagtcgatgacaactctgaaatctggactcgctagagacacaaaaagaaaaaaaatgacagataattcttagaaaaaaaaaaagccaaacaagtcaaaaagatcacatccagtattttgctgcctcttggactcagaaccaaagctaccagccctcgatggctgggacaaaatataactcactctgtgaagatagagacaaggacaatgaccattcccaggcatggtataaaactctatgttatacgggtgaatagcaaggggtcaacacccagaaaccacaccactgtgactcgtctagctaaactgcttcaaagtgttgcctatttatagcatatttccctatattatcaaataaaacttggaataatactacattttatcaaatctaagataccactggttgtaatttgcacaattattttataaacactaaagaaaaaatgctgccaaataaactatgaccacccatcaataacaagatgcttccaatttcagagatgagaaaatgtcaaaacatatgttttagagtggacaaatgatggactttatattgtggcattttaatcagatcctttcttgcgagtacccccataaaaacacccatgcgctataaatctgaggtgtttgcaatacgtatatgtgactgcttttcttcttttttttttttttttttttgagacagagtctggctctgtcacccaagctggaagtgcagtgggtgatcttggctcactgcaagctctgccacccgggttcaagcaattctctgcctcagtctccgagtagctgggcttacaggcacccgccaccatgcctggctaatttttgtatttttaaagagatggggtttcatcatcttggccaggctggtcttgaactcctgacctcatgatccaccccgcctcggcctcccaaagtgctgggattataggtgtgagccaacatgcctggctgtactccttttctctagtctcctattcctggttctactgcccccctactaaagacaaaacaatgacgaaacttaactttaaaagcctttgcagagacactgtcccttttgaccttcaccggacctcatggggaagagaggacagaaggagaccgaccctattaagtttggggccttgacaaggtcgcacagccagggatacagcagggccctctgatccccaggtggtcttttcaaccgagtacatggccccacttccagctgaatgtgccgtaaaggcatcagatgtcccaaaagttctctccaacagtccaaggtcatcatcacctcaggctttagcaaatcccagagcagggacacggggaaggatggtgcattttcaggtacacctcctcttcccagttcaaaggaccctgcgcacaggccacatgtcaggaggcgcccgagagtggagggtctgccagagcccctctgggctctgggtggcagctggggccagtccctgagttttcatcactcacttcctattaccactctgacacaagatcctgggtgcaaacagccagctggagctggaacgtcaggttgtgcagtccagaattcactgtcacccttcaggcgacatgaacagagaatcctggagccccacgcaaactggaaggacctgaagcctggccgagggagcctgtgctttgtaacagactcatccaacccggcgctgacctggcaggagggtggggcagttccctgatggctctgctgcccttgatctcactcagccctggccccaagctaattaatttcaaagatgatcacttaaaaatactcaggtgagaaagaaaatgggcatcctcttcagaggatgacgaaagccctcagtatctaaagaaccagtctgaagccaacaaggttcatagccttggcccaacagaagccctgagggagctagcatctgagcctgggtttttgtttttgttttttgttttgtgagcacaatgagggtagcaggctgacctcatgggtctgtggtgaagagcaaagagaacagctattggtacaggccagtagatacacttaatgaacacaatctcatagcagtgtcatgtgtgggtcctgcccacatgagggcttcataagcccctagcccattccagggacacacacacacacactatacacacattatgcacacacgcacatatacacactcacgcacatatacacactcacacgtacgcacaccatgctcacagcctaggcgatatgtctttacctgtctgcttctgacaccagggcaatgcgccatagtcccagaatcttcttcttataatagaaaacaccaagattaagaactaaaaacgaaaagaaaccaagtaaaagcatattggatggcttctcattagaagacacagcggtctcggggtaaagcccacctgcccgcactcagcagggctagaaggaaaacacccaggcccagaagggcactgaagtgcccaaggccatgcagctcagtagcccggatgctttgctcaccccctcaccaggctcctgtcacctgtgcccacgccaccaaggctgccagcgctgacgccaagctgcctggagcctgcctagttctgcacgtcagccctgtctcttgctctcaaggcagcggtacaccacaaggcccagtctcgggccctgctctgccttcagtggccccgagcaggagggtaggtctggccccagagcagccccaggaaccagcatccttcttcactttacagaaaattttttctttcggctcactgcaacttcccctcccgggttcaagcaattcttgtgcctcagccccagagtagctgggactacaggtgcccgccaccacacccagctaatttttgtattttagagagacagggtttcaccatattggtcaggctggtctcgaactcctgacctcaggtgatcacctgcctcagcctcccaaagtgctgggattacaggcgtgagccaccatgctggccagaaatttcattttaaattacagaaccaaggtagcagagcctcctcaggctgagccagaaacgtcagttttttcctctgagtttgattcccctgaaggcaggccccgcaggccctgcaatccccagcagagagcatgcatgcaggcagcaaggcaccacgagaacctgtgctcgggctggttggcctccgtaagctgggacacctcagcaagcttgtgtccaatggcaacctcagggctgactaagccgcttagctctagacatctgtacactctagactgtcctcactccccacagtcaccttggcaggctccatgccatgttcctgcctctcttccctccctagacagggtcccttctttgaggttcagggaggtagagaaatacatcttagtaagcacatccctgcctgctctatcagaaacgggggttttgaaggtaggctttgttttcctaaaggaaatccagaagacctaaccccagaggcactgagttctcgtggaattttcttcaggtgaatcaggaagttggtgaatattttcaaaggcaggtgagtcatgttgtaggaaaaccacgaaacctgctcagcaggtcctgccctctctgtccacagcggctgccgccctggcctgtgcagtgcagacacttcccaaaacccatgctctccagggccctctggctcttatgtgtcccccctcccccacccccaaacttactgcaataaaaatccacccctggccgggcaccatggctcactcctgtaatcccagactttgggaggccaaggctggtgaatcgcttgagctcaggagtttgagaccagcctaggaacatggtgtgaaatcccatctctaccaaaaatacaaaaataacccagacacggtggcagtgcttgtagtcccagctatgcaggaggctgaggtgggaggattgcttgagcccaggagaggaagtcgcagtgaattgtgattatgccactgtacttcagcctgggtgacagtgagacttgtctcaaaaaaaaaaaaaaaaaaaaaaaaaaaaaaaaaaaattcaccttcagcagcaaatagagggtgactctcttctcagccaacactgttgcaacaatacccacccagcccagcagggtccctgcccaggtccccctctctgtactcctcaccttggccaaactctccccacctgaagacccaaggccaccctcctctaatcccaccaattctgaaatccacccccacaccctgcccactcctccttgctaccctaagccaccctccccatgttccccacccgagcctagttccagctccaagcagtccaaggatgtttactccatcagagccatctgcccccttcactcgatggtctctgccacatgttaggagacagtatcaagaggcactggccagcccatggcattgtgaaaagaaggggcactttaaccccaataaatctcagccagccaacgttgagtctgctaaggaagaacaatgccatggggcatctttgtgaacaaggagatctacgttaaagaaagccacctgctgaaggtacgctctaagaatcagcttctaattcttttttttgttttttttttttttgagacagcgtctcgctcttgttgcacaggctggagtgcagtggcgtgatctcggtcattgcaactctgcctcccaggttcaagcaattctcctgcctcggcctccagagtagcgggattacaggcgccgaccaccacacccggctaattttttgtatttttagtagagacaggtttcaccatgttagccaggctggtctcgaactcctgacctcaggcaatctactcgcctagcctcccaaagtgctgagattacaggcatgagccaccgtacctggcccagcttctgatctttaaaaaccccagggatgccagaggggaacaggaggtgacacttgggaactgcagctctctattctagtccgtactctccagtcacatgtctcaaccccttgagatgacccttcccagggccttaaagatacgacaggctgagagctctgcaatcacggtagtaatcacaggcatgctatatgagtattctggccttatccaaattccaaaattctctgagataggaattatgactccatttccggagcagaaaggggaggtgcacagaagctaagtaacacgcctaagtcacgagctggtaagcagcagagttgagatttaaacccagctatgtctgacttctcatctaagttcccagaaggccctgggtggggcatttaaacaaataactgaggcagtgggacacgactatgagggctctcaccaggaagcagctgacgtctatgagcaggacagtggggatgccaccaaggtgaccccctggagcacggtgctgtttttggccgagttgtagcaataggagtcgttggccggtccccgagtcccagctgctccctgatggacactgccttggactgccacagctcaggaacggggagtccatcatcgcgcctgtcttccctggagcacaggacaacaggacaagcagacgttcagggctcaaatttcttgcaggttcccaccagtgctggcagagccaaaggcggcgtttcccagggactgatcgggcagtaagccagcagcaaggagtccgggagagccagcattggacctctgcgtgcctggcagtgtccacagagaatggctgcattgtgggacaatccaggggatcagatggtcagagtggatggctcatccagaacacagtgggcagatccccaggggggcgacatggagcaaaggagggacagagttgctgcagctgctgtcttaagaagtccaaagttcctctagcctcgaggactcgtgttgggaaagtcactcctgcagaagccactggggatctagagtacaggcagaggagagggagaaaggcacacaaaggcaggaagaggaaaaaccgggataaacaaccagggaagaagggaacatccaagtattcacgatggtccatccacagccacagacaacacctcactcccactgctcacagaatgtcagagctgggacctcagagtgggtccatctgctatacttggaaaccaagcctcagaggtttaataacttgccccaaagtaaggttaaggagctggtcagggcagaattgaatcccaaacccaatatcctgactctcaatgccacttctctttttactttgccacagaggagaaagtaaagggggtggtctagggtaggacggggagggagtcaggagtcccagggcctcctcagggacctctgggtcccctagcttgcgctttcacacacacatacccctcctgggtaccatcagtctaactgcaaggcccagctttccaaagcaaacactgctccaggctgggttgttgacctttccttcctgaggctcctgcgcccctggtgaagctaatagaaatctccagtgtctgtcccctgacaccagaggaccggagttagtgtccaagttctcatgctgtggctgaagggccagaacacatattcagcctggattgcttaagatcctacctgcccaaatctggtaaatctagaattcccaggggatttttctctaagtctggtgcttctagctgttacagggacaaagatcttgagaacaagaagaaaagaatagagaacccaaacagatgtttggataccagtagtgctggtgaggtgtgtatgttgggaacccctaggcctagagtgctggggacaatcacacatggacacctacctacctacctactacctacacacacacacacacacacacacacacacacacgaagcacaggaagcatgaatagtggaaagcccaagaacatgggagcatcccacagacagccaagtcactttctcaacctctaagagacttggcaatggctggaggtagtgggggttgtgatgccagagtcatggggctctgactctgaacagagtgtcacaagagtgacctctggaacacagatgttcttggcttcctttaaaatcccccagtggcaccacccaatggaacacaccagcccaacacttcaaggccacacctacccctcctccttcctgtccccacacttaccagacactaggggaaggaaggacttggatgggcccgttggagaggtcctcagttggagctgtctctggcaaaggcaaaagcagcccagccacctcccaagctgccaagggccaggcgtcgggcctaacactcatgtcctgcaggctttcctgaccagcgagtcctggggtaccaaactgtagactttcctgaaggatcacaacaccaagcatcacatgggagccacccttttccagtgtaggggtctggatggaaaccctcagcacacacctgtgtatgcatgctgcccatatggacctttaggttctgcccagtgggcccctcctgccttgatctctccccaaactcccagaactggttctccatccatcagtgctctctgtgcgaccctactcctccttcctcggccagcaccacctgtggccccagcctctctctctttgccaatggctcaaggacctgctgggtctaggggagcagccctctcccacagaaacctggaggttgtgggctcacggtagggccccaagcaaaggacttcacctgggccccaaggccaatgctactggggaggctccccagggttccccaagagctagaatcaggaaaagggacacagcagcatgaacaaggaaggcttgaaatgtgaagtggaaagaaaaaacatccccataaatgctcacagagagagcattgtccctggaaaggggagggtgctgtggtggtgctggggtggcataccctcgccagtgctgcagagaggagagaggcctctgcggagggaaacacctcggctcctcttccccctccctccagccccagtcatgcctctaagttacttgtctcttgcaaataggcttcccagggtggtttgacaaagtttgatatgaactcagggaggtggctagcaatactatcagcctgagacagaggtaaggtcaggtggccagtcctgtctgccctctccgtgagcacccaggttagggtagagctctggggacccacaatctctctcagacctttcagccagtcccagcctgtccctgcccattagacacataaagtccagatccccctgaaacagctcgtccctctggctctccatgggacagctcctctgcattttcacaaacaggcacgctctggcaggcagctgggaacacagacaccatgggacagtgctgccaggctgaggagaaggcaggggaggggagcacccagctggcagctgtatagaggaggccaaaccagcagctaggcacttggttgaagtggcactgcctggctgagaacccctggcaatattcagtcatcctagatgttgtgaatgcctagcacttacctgtgccttccagaaattctccattcatccccttattccactcaatatgccgagggtaggaaagccaagaattactgctgaggcccaagagccagagtggcagcaggtgacttcacgctcccaacccaaagttcaacccatgtgcaggcaagcgtctattgtggccagtgggagagggctaaatccaacagctggtctaaatttgccaaagtaaacacctatgctaatccactgccagtctccattggcagcaaggactggcctggtggtcaactgacaagctctagaaataccagcagaatgttgcaggaagtatatggatattgttcgttctgcaagaaggcccgtacaaattcagggtaattttatcatcaccaaatctttcaatcctgtatgacaatagcgaaactacaagcagctccaggccttctgcctcaggagctaactctggttttcagatgcagaataaggttgcaaagtaaagtacaaacttctccttatggcaacaccaacaggacccagtaacctggacaactgtttacctctaccctggagcacaaaggaaatgaccagcccctggctgaaaccagaggcagtgtggctcagggattatgtgagcaggctctggattaaggtctcagcaccacgcagttcagacaagcagcctaaccactctgtgccttggcttcttcgccaggaaatgcgagtgatgactttctctcacggagctgttgggaggcacagatccaaacaacacctgtaaagcacttagcccaggacccggccctagcaagcaattagaagcttctgcctttattttaagtcgcccctccagctaatgggaaacacaagggcaggatcccactgacgtcttctctgttagagcccaacgaacagctaggagagacctttgcccccacactaacaaaggagaggggcgtgtgaagggaaaaggagcctcggcttccgttcatatcccccttaaggcacagcagacttgaggatgacctgagaggtgtcaagggagggtcagtgggtccgcacgctgtccacccctgcccttgaagaggacaccacctgcctggggctgaatgaccaaggccctccagggcctcaggtagctagtcttatcaggtgctggaacctttgcggatttggttcttagcagagctcgcctcaccctttccgcccccgcccttccccccagtccccgagtcccagcctccctcctcaggactccgccaaggctgcaggaagtggtcacccaggaacagcccgggggtggcctctgccttcctggcgtcaggagagtcggacgcttggccctttcccagcccgcctcgtatagggtccgaggagcccatagctgcactcctagttaggtgggaggtcggacccgccgacaaatcccaaagagaggggtggggaagaaggagataccagccctgaaagcgaaagccggagaggaaagtcctgaaaagccgccaggaattcccaaggagcgcagggctggatggaggcgctgcccggaccctctcctcccacccaatcccgcgtcgtcaccccctgcttgggtcgggggctctggggtctgcgtaggctgggagccgttccggaaccggacacctggcggcacgtcccgggaaaggcggagggtgcattgcccctcctcacgccccctgtcccctgtactgcggcggcggcgtgtctggcgggacccagcagcgcggggcgtgttccgaccacttaaagttacaaagtgaaactccggcgcctcctgcacatgcgcagagctgcggccacccctttccaatttggagtcttggcccgcggcggcgcaagcctgtacgcagctgactgcgcctccccggtggccctcggcggtcctctgccccggcctggcctcctggtcgccgctcagccccgcgctcctcccggaggtctgcaagccccggaccggccagctcacgtccaggctccaagaaggatccgccggggcgcaccctcttccgtcccccggcacgagcccagtctctggacgcctcgggagaactgggccaagcacagggtggtcgcggcgcagggagagcatctgcaaacgttgtccctgtagtgctttgaatttccccgaagagctcttagacccgccccgggagagtggggtgcgggggtggtagcatggggagctcagcaggattcagcccgcacctcggctccgggtatcgggaaccgcgcggagcgccctgcaagaggccacggctcccccgccgctgtagaaggcggaccgtgaaagcccggagggtctccgttcgggcaaaaatgtgggggcgggtcgcagcattccaacgccccctggggctagtccattactgctcgagccagggccgccaagggcacctctccagcccaggtccgagagcgcggcatgcctcccggccgggagccaaatgtttccaggagccggtggcctccacaaccggaccgcaagctcgcgagggcagggccggcccgccgcgcagggactgctgggcgctgcgcgggaagcgaggctgggttcggggaggaccgcgcgccctggaatcaaggagcaaaccaacccgtccgcaggcccctgtttccctatctgtgaaatgagggttggaccaaagcttcctctcaggtcccttccagcacccctctctgagctctgagcagcctcaccccacatgcatgcctttgcaggttctccgacctcccttccatttctgagctttatctttttctgtaacggcataaaaatatcctccttatggccgggcgcggtggctcatgctgtaataccagcactttgggaggccgaggtgggcggatcaccttaggtctggagttcgaaccagcctgacccgcatggagaaaccccgtctctactaaaaatacaaaattagccgggttggtggcacatgcctgtaatcccagctactagggagtctgaggcaggagaatcgcttgacctgggaggcggaggttgcggtgagctgagatttcaccattgaactccagcctgggcaaaagagcgaaactctgtctcaaaaaaaaaaaaaaaaaaaaaaaaattcctccttacctcctgtccctgattctagcgccagtctgtggctgtccaggagtggggtggggagggtctcttctgcctctctcagttcttttctgtcccatctgtctttccccttctctccccaaagctctgccactagttattttccagggtttttcctctatgccccccgccagtatcatctctgccctgtccctccatagctgcgcctggccatcccccctccctgctctcttacctccacatctgcggtctgcagagtcctgggtgtggcccctggactccccgttggctccttagactgtcccgtccaatctttcttccactccccactcccgcacctgcctgtcctccttccttcctcaataatggtgcccccacctgtctggtctgtgccatgggtccaggcaagtgcaaggttccggtttggtaattagaatgctggagccactgacaaagatttcagagagagaaaggatttctaatttgttcttgagtaggttaaggttatttcaaaatcaagagaaggccttgatggatcgattgtgagttgagatagccacagcctttgttatgtcagttgtgtgaagtgcttgtaaaatcctattttattttttaatttttaattaattatttacttattgagacacagtctcactctgcgcccaggctgtagtacagtggtgtgatctcagctcactgcaacctccacctcctggctcaagcgattctcctgcctcagcctcccaagtagctgggattataggcatgtgccaccaccccggctaattttgtacttttagtagagacggggtttctctatgttggtcaggctggtccaaactcccaacctcaggtgatcctcaggattatagacgtgagccaccgcgcccagctgacagctcttacagctataaattccagatcctctgaagctttattttcttctctaagtatgatgataattttgatcacagattttattttgatgcaagtaggattggaataaagcccagcactatgcccaggaaagtcaaagtgtcaagaacaaaaaaatttcagtattggccgggcgggtggctcatgcctgtaatcccagcactttgggaggccgaggtgggcggatcacaaggtaggagatagagaccatcctggctaacatggtgaaaccccatctctactaaaaatacaaaaaattagccgggcgtggtggcgggcacctgtagtcccagctactcgggaggctaaggcagagaatggcgtgaacccatgaggcggagcttgcagtaagcggagatcgcgccactgcaccctgccactgtactccagcctgggcgactccgtctcaaaaaaaaaaaaaaagaaatttcgtatcaattctgggagggcaggtaccatagattctagaatcagaatgcattttattttttttattttatttttgagacagaatctcactctattgcccaggctggagtgcagtagtgtatctcagcttactgcaacctccgcctcttgggtttaagcgattctcatgcctcagcctccgagtggctggaattacaggcgcacaccaccatgcccagctaatttttgtatttttagtgaaatgcactctcaccatgttggccaggctggtcttgaactcctggcctcaagtgatcccccacctcggcctcccaaagtgctgggattacagaagtgagccatcgtgctggccctgaagcattttaatcctagtttcatgtattacctaaccaagatctttaccaagtcttggccactcaagctccttccttagttttacaatcaggttgacctaatcgctgtagaactttctgcccttcctcaatttgcagagctttgattaaaatggaaaattacagccgggcacagtggctgtgcctgtaatcccagccctttgggagactgaggctgccgaatgacttgaggtcaggagtccagaccagcctgggcaacatggcaaaaccccatctctactaaaaatacaaaaaattagccaggtgcagtggctcacgcctgtaatcccagcactttgggaggccgaggcaggcggacacgaggtcaggaggttgagaccatcctggttaacacagtgaaaccctgtctctactaaaaatacaaaaaattagccaggcatggtggcaggcacctgtagtcccagctactcgggagctgaggcaggagaatggtgtgaacccgggaggcagagcttgcagtgagccaacatagcgcatctgtactccagcctgggcgacagagctgtctcaataataataataataaaaatacaaaaattagcttggcgtggtggtacatgcctgtaatcccagttactcaagatgctgaggctgagaatcgcttgaacctggaaggcagaggctgcagtgagccgagattgggccactgcatcccgcctgggtgacagagtgagactctgtctcaaaaataattaattaattaaaataaatagaaaattacaaaattatagaataaaatgtgttttattcatgttttacaaagtctttatatctggattggggatgcacaacccacacttaaccccaggtcttaggtccagagtggtgtggaggactttagcccagatccagtgacaggacaagtaaacaatgacacattgggcttttgccctcaggttacagtatctccacatgtaagtgcttagaatatagtgcagtgaataatagaatagagaaaactgagcaagggctctccagtggccaaagattctcattcctgagaagaaaaattaggtgaggtaacttgtcagaggaagcaaattcagggctcactagagagcacaagcatttgtccatcagcagttcagtcatcgccagctctcctggtaccctcgaacacttcgaaacacacacaagtcaagtccctcgatggctacactaggcgcctatggctggagcctcttggcacgagcgcaccatccgaggcacagctgcacttctgcaccctcatgttgggcaggtgaccacctggggcctggtcctgcctccctccttgatgctgacgatcatgggcagcgagcagtctccgaggcgatgcactgtcgaggccccagaaacggccacttgaaggccagggccccgggggctgccggcaggtgcccacacactcataagccaggaagcccgggggctccagccccagttctcggcccacttcatcccctgcaggtcaatgtacatctcctggcggcagcaggggtgccctcggtcattggtgcttcagggtcacagtcgccctgagctctgtgtgggcaagagagcagggtcagcggtcagctgggagggctgaggtcagagggcgtctgggatggagattatgatccacctctcaacttcaaaaagctggatgtttgtgatataggatggacagctaaaataacttgaaaattaataaccgatatttactgaggatctcctaagagtcagaggaagattgtatacattgtctcattcattcccacagcactctgaaaagttgtccatttcaaaataatgtaattgcctgtctctttattccggcttaccagtttgaccctcagcacctacccatgtccccaaggtccagggtgtgcagctccagctggggctccccaagcccggctggcgcccctgcgaggcaaagcggaccagcttgtgggcgccggacgccagcgggcccagatgctcccctgcaccgacacctgtagcagcagcggctgccggggccggctcagctgctgccagaagtcacggcctcggtcacgtcgaaggccttccagccgctctcgtggacggacaccagcctgaacatgacacagagacccagcgccgcttgagggcggggactgggacgggccccgaggacccgcaccgccccccgcgtccccgcccccaagccgggcctagcagcgccctccccctacccgcgcgcccccgcgacccccacctggagtcgatgagggaggtgcggttggagccgtcgtccggacgcgcagccactcgacggtcacccgggcccgggcgctgcgcggggacagccgccctgcctgtgcagcgcggccttggggaccggctcctggaagagccgcagcacggcctgcacagctcgctgttgggcggcagccgctgctccatgccgaacaccagcaggtgtgtgctggctccaacgccaggaacctgccggccacctctggggacaagagcagggtcagcagggcctccccgactccaggggagctctgaggatggcagggccactgagctggcagccaggccaggaacaccggccctgttctatttctggggcaaacccagtttacaaatcttccttggatctggccttgtttagtaacaatttccatccagcaggcaggggcgcctgtgggaccctggctagcagtttgcctcagctgagatgctgggagcagaatcctcacccaggtgcctggcattgggttagctctgggcactgaggagctagggaggcgagaggctgcaggaggattcaggccggctcaggaggattcaggcccg

SEQ ID NO: 5060 - DNA, 37705 bp, Homo sapiens
atgtgacccacgctgaggctaagggaatctaagggaaacggatcacaatgacattaggatcagagctgctgacgtcattcctttcataggattcagaagtcaagactcaggaatggctatatactcagcaatttgggaactcaatatcattacataaagaaccagaaaccaagtgttaaattggcatctatttcttttccataatcgatgtgaagttctctaacagcctagcaggttcatgataattttaaaagataataaacatggctgggtatggcggctaatgcctataatccagcactttgacaggccgaggcaggaggatcccttgagcttaggagttccagattagccgggcaacacagcaagaccccgtctctacaaaaaacataatttttaaaaaagagaatcaaattgactgaattactcgtgaggcaggtaaggtatgaagtaacttctgtgcatcatctcattaatcctcacagtgaccagggagattctgttattcctcccagttcaccaacgaggaagtgacacttcagggactactgctcagggaccacagctagtgaaggcagacccatccaaagcgtgtctgcctgcccagagccctagctcacctaacaatggtcgacttggctgggcgtggtattcatgcctgtcattccagctactgctcagggaccacagctagtgaaggcagacccagatccaatgcatgtctgcctgcccagagccatagctcacctaacagtgattgacttggcgggcatagttgttcatgcctataattccagcactttgggagactgaggcaggaggactgttgagtcagagccagttcaacaccagcctgggcaacatagtgagaccccatctctttaaaaaaaaaaaaaaaaaaaaaaagaccagaccaactaatccacctggtttattatttttttagagggagtctcactctgtcgcccaggctggagtgcagtgatgagctcacttgacatgtatgagctttgacatcccaggctcaagcaatcctcccacctcagcctcccaagttgctggactgagtacaggcacaccccaccacacccaactaattgtagttttttttgtagagatgagtctcactatgttgcccaggatggtcctgaactcctgggctcaagtgaccctcctgcctggcctcccaaagggctggattacgagtgtgagccactatgcctggcctttgatgtccttcctttggtgagtaacactttgctgcagcctgccccagctgcagatctcagaattgtcccaggttcccagggtcacggagattgtcacaaatcaataataaaggcagtgaatgctgaagtgagtctttggatatgtcatcttaacatggtcaggcttggcaaaaatccctgaggaaacaaacaggtggtttacttgcctggtgtgggcacggggaatagtctgacttttcatttactatcaatcttgatatggtcttagttacataaaaatacaggaatacaggccaggtgtactgctcatgcctgtaatcccaacacttcgggaggccaaggcgggtggatcacctgaggtcagagtccgagaccagcctggccaacgtggcaaaacctcgtctctactaaaaacacaaagatagccaggcgtggtggcgcatgcctctagtcccagctacctgggaggctgaggcaggagatcgcttgaatctgggaggtggaggttgtggtgagccaagatcacgccactgcactccagctgggcgacacagtgagactccctctcaaaaagaaaaaaaaggaaaaaaaaaaccacgatacattctgattggcaaaattcaaacaacataaaattctaccagtaccactctcctcccctcaactgttctgttttggagtgtatccttttagaacttgttctatgcatctacctataatatgcacacctgtccatatgtaaatgtgttttacattccgtgtcatactctgtattatctgtaatcgacttatttacgcaacaatatatcttgaacttaccatgtcaatatgtttgagctacttttttcctttaactgctgtaggctatttttttttgagacagagtcccactctccactctgttgcccaggctggagtacaatggtgtaatgctggctcactgcaacctctgcccccgggtttaagcaattctcctgcctctcagcctcccaagtagctgggattacaggcaccgcaaccacacccggctaattttttgtatttttaatagagacgggattttgccatgttgccaggctggtctcgaactcctgacctcaggtgatccaccctcctcggcctcccaaagtgtgggattacagttgtgagccaccatgcccagcctctattttgtagtatgaatgtaccacgttcatttagctcttcccctatggactgttaaattatttgaatttttccctgttacaaagctgctgcaatgggtatccctgtaggactgtctgtccatgtgtctaaaaatttctctagataaatacctgtgagtgaaatggacaaatgatgtgcgtgcactattaacgttcacacagctctttcagtttattcacatcaggaactcataaatacctgttttcggctgggcgcagtgctcatgcctataatcccagcactttgggaggctgaggtgggcggatcacaaggtcaggatttgagaccagcctgaacaacatggtgaaaccccgtctctaataaaaatacaaaaattagccaggcacggtagctcatgcctgtaatcccagcatgttgggaggctgaggtgggcggacatgaggttaggagatcaagatcatcctggctaatacggtgaaaccctgtctctactaaaataacaaaaaaattagccgggcgtggtgacgggcgcctgtagtcccagctactcgggagctgaggcaggagaatggtgtgaacccgggaggcggaccttgcaatgagcggagatcacccactacactcccgcctgggcgacagatcgagacttcgtctcaaacaaacaaacaaaaacaaaaattagccaggcatggtggcgcatgcctgtaatcccagctactcaggaggctgagcaagagaattgcttgaacccaggaggtggaggttgcagtgaggcaagatcgcgccactgattccggcctgggcaacagagacactatctcaaaaacaaaaaacaaaacaaaacaaaactgttttccagctcaaacccttcttaaaagcgggtctatcatttgtttccatttgtcccatgtgatagaaaaaacagcatgccattattttaacttgccttttctctgattactagagagctaaacaccttactgactgactgcgatcttcttcagtgaattcctgtgctcctttaacgtcttgtttctacaacctgtgcccatcttcctaccaggtaggcttttaaaaaatagttttaggcttaaatatttaaaaaacaattattagcctgctatactgatttatctttcctttacactcattttaaaattcaaactacattcctaggaaaaagaatatgaatttcaaaacttgatgcatcaaagtaacaacccctttttcaaatacgctggctcagaagcactgtcttagggcatactctgcaaaacgaaggggctgtaggtgcagtgaacgcttgagtcacttccaaggctcacgctggaggtccagaagcctgggagctttagaatgggtacagccacttactggcgacgctctgtcctcagtctaatacaaaggagtaaaatggggtctgggactatctgggaaaagaaaaccctaagtggccttcttagtggaaaattctctccttatttaatgatctctacatataaaattatatatacattatataataatctacattatataatctctacattattaatcctaaagttttatggaaagaatttatgggaaaagagaaaaattggaaaaaggctaataacatattaaaaatggctttgagtacatgaaattgctgtggtatagatgaagttattcacatggtgtatcacatatccacaagtttctttttgaatcaccatgtttactggtagaggtgatatgataaccttttagtaagcttttttttttaagccaagcactaccctaaactctttatgataattatcaaatattcaatccctttgtagtctgctcccaagggactgtacagttttttgaatcttactagtattttgtcgtatatgattgctacaataaatgggctactgactgaagcaggagatgaatgaaatagtacttgtactgaaacatgatacaatcaaagatttaggatttttctaaaagatggtgcaggtaaaaagcctatccaccactgaaggcaatggaagggtataggcgtctgtgtgctgtgagagagcctccacttcggagtcacagatggccaaaagccatcagtagggctgaggaccttagaagtcctttacttctacttggatgtctgtggtgatgagacccactatacggaggccctacttatgtcgctggattctggggagtgtctgtctaaagctgacaggtgctgccagttcctatccatttctcccttattccctgccctcaaatctaaaaatagtaacataaggataagccaggaaatgatgaaagcaggtatgatgatgaagttcaagtgggttggccactgtaagcacacctgccccaagtgacaagcacaagttcaagatgggctgccactgtgagcacacctgccccaagtgacaagcacaagttcaagatgggctggccacttgagcacacctgccccaagtgacaagcacggtaaaaatgaataacactttcactgaagctggcgtgtggattagagggctgtagctagtgagaatatggttacttagcatgagtaatttaggtactttagtaatccaagtccccatcctaggatctaagagctctgagtgcagaggccagatccctgtgactcactgggttacagagacaagagatggttccccagaatctcctcttcagcagttcaaggattcagttttcatatcttaaaactcccatgtcaaaaacgtatgaaaacttatcttctcatatttagaccaaagactttgtaactgctaatcaacatcggagttaataaggttaagtcagattcagccaaatgaaggaacagactagaagacaaggttctctgttattgggctaaacggggcagtaaattgtggcttgtacctcgcttcttagatctgcttctgaataagcagtttattgacagttatcaccacattggcagaggttttgcaaaaatgaaggctcaatctttcagtaaacgctttcttaatttttaatctgacatagaaagttgaagaagtatctaaaaaatagaaggtttgaggaatagtggttcttcctagagaccataaagagccacacacaaatgatagtgaaaaacgggtttcaatttccattgaaaatactctaagatacacagtttgagaattatatttttctaattgtaacattttgaatttcatttcaatgctgctgtctaagacaagtatgagaaattaatcctaggtctccacaccttaagatacactgtgtaaggcaggcatggtggctcacgcctgtaatcccagcactttgggaggccgaggcaggaggatccctgaggtcacaagttcgacgtcagcctggccaacatggtgaaaccccacctctactaaaatacaaaaatcacccgggcatggtggcagacgcctgtaatcccagctactgcggaggcgaggcaagagaatcccttgaacccgagaggcggaggttgcagtgggccgagatcgcgccttgcactccagcctgggtgacagaacaagacaaaaaaaaaaaaagatacactgggtaatactaacccattattccttgtggcgttacgaggtcggaccaatccttgatatcctcaaattcaccttaatgaggctgacacctttcagcttatcgactggcaactcctttaggtattctgacggctaaagaagaacatttttggcacagctccagccttgagagcgtctgaaatgagctgcgaccttccagcaggatcttcccttgtttttcccgaaatggcctggactttactatttcattacactgctgtagatggaaataaaaaaaaaaacaggtaactatcaacatccttgtactgagacacgcttagttgtaacagaaataaagagctacggagagggccgggcgcggtgctcacgcctgtaatcccagcacattgggaggccgaggcgggcggatcacctgaggtcagagttccagatcagcctggccaacatggtgaaacaaaaacaacaacaaagagctaaggagaacagaagctaattccaaagacgcttattcggccctctgtgcataatacaaaaaccagcggctgtactggaagaagtcctccatcggaaggaggttaaggttccgctgtgcgacgggagggaaacgagaacattcgacaggctcaagaaccacatcacctcagcctcctgtccccggataagctttatcgtagcgaagcccagactcttcccaggtgctgggagcgcgggatgcggctcctcgagcggttgtttctctcgttgctcctgggcactggcctcagatggtgccttgcgggctgcttcccaggagcgcgcttctgttccaccacctctccggaaggaaacaccacttcactgggctccgccgcagcgcccggacccagcgcctcgcgtcaaggtcccaagcctggacacctgcagcaacggtcgcacgacaaacctcgcgggtctcaccagcgccgccatgttcctgagacccgggctgcgtcacgaaagcgcgccgtcggcggctagtgacgtcacggcccgtgcgcccttcgtggactgggctgtacggtgcgcgtgacggctgcgtgcggcgggaatcatgctgctcgcagagctctgcacttcgtattcaaagtgggaaaccgcttccagacggcgcgttctatcgggacgtcctggggatgaaggtgcaggccggggccgacaggggctggcgcgcaggctggaaccggcgcccgagccggccctggcggagggaggggaaaatgggtgtgtcgtaacctaagccggagggtgtccgaccttaggccctgcgcggtgttcagcttcaggagcgtgcgagttgccgttggggatcataggccttggagaagggcctaacacgattagtccccgcgtgtgcccacgcacgtcctttcatttaagccactcgtaaacgtttattgagccccgccctgtggagcttaccgtctaccggaaaagacggtaaataaaatgttatataatgctttctattaatatttgtgttttccggtttggagcctttgatgtagataaaatcagcgtattcagattctgcttctagcaaggctggtctgaatagtccgtttcggatactcagtctctgaatattgctccaactctcaacccatctgcttttcaacagcacccagaagcggtctgtctcgggtctgaggagctgttatttgcaggattcagttggttggggaactgggttttggggacctccttgataagccagggaggtagggaacacaccactaaggaagacttgaaaggtgcaagagccggtttagtgtatagacggtgcaatagacggggatctgaattcgtcaggtcatttttaaatatctgctattttcagggtactacgttgagttttggcaacaaaggtgcaaatgaccctatatatatcctccattagagctcatggcctgggttggggtgggagttggaactggattttacgtagatgatggtaatggaagtcagaatttgatagtgaaaaaccaccaaactttcgaagcagaaaccacagagctgtcccttgttagtatttcctcgtcgatcaaaaggttgttgcaagattaaacacgtgccggcgcggtggcccacgcctgtaatctcagcactttgggaggcaaggcgggtggatcactggaggtcaggagttggacaccagcctggccaacatggtgaaacctgtctctactaaaaatacaaaaattagccgggcatggtggcacacgcctgtaatcccgctactcgggaggctgaggcaagagaatcgcctgtatctgggaggcggaggttgcagtggccgagatcgcaccattgtgttccagcctggatgacgaaagcaaaactccgtctcaaaaaaaaaaaaaaaaaaagattcaacaccttattatatgtatagtatttaacatatcggtaaagtagattatataagtgttagccactattataaaaatacaaaagaaggagcggttttccacctgggtgatgaggaaataattcatgtagaccttgtattcgagttgactttttttttttttttttttttgaggtggagtcttgctctgtcgccaggctggagtgcagtggcgcgatccggctcactgtaagctcagcctcccgggttcacaccattctcctgcctcagcctcccgatagctgggaccacaggcgcgtaccacaacacccggctaatttttaaaaatatttttagtgagacggggtttcaccgtgttagccaggattcgagttgacgtctaaagataggatatcccaggtagatgagaggaggagctacatagtaaaactgaagagccagtgcggagatggcactgtttgcgaagccgctggttttatgtgcctttagttgaggttgcttagttgaagttaagagatgggatatcaggatggacaggtcggcattgcttctaatagtatcttgaatgctatgtaaagaatttggattttatgctgcagtaagatgggagctcacttatgttcttaaacaggtggtgatgggatcagtgctttgtgctttaggcatgtgcttttttggtgttattaaggaagatatcaataaggatttttttattttttattttttattttttttatgttgagacggagttcgctctttcgcccaggctggagtgcagtggcgcaatctcggctcactgcaagctccgctcctgggttcacaccattctcctgcctcagcctcccgagtagctggtactacaggcgccgccaccacgccctgcttattttttgtatttttagtagagatggggttttactgtgttagcaggatggtctcgatctcctgacctcatgatccacccacctcggcctcccaaagtgctggattacaggcgtgagccaccgcgcccggccaataaggatgatttttaatagtctgagcgagcgttgggaacttcaactggcaggagccgtgggaatcaaaaaggagggctaaagctaaacgttgagagcccgctgtgtgcagggttctgtgagatgctttcataacatccattcccacacatgttaggagactgagactcagattctaatttgctcagagttacacaactactaaagacagaattccaaatcagacttttttttttttttgagtttgagttttgctcttgtcaccaggctggagtgtaatggtgcaatctcagctcattgcaacctctgcctcccgtgttcaagaattctcctacctcagcctcctgagtagctgggattacaagcgcccaccaccatgcctgctaattttgtattttttatatttttagtagagatggggtttcactgtgttggctaggctgtctcgaactcccgacctcaggtgatctgcccacctcagcctcccaaagtgctgggattcaggcgtgagccacgatgcccatctttttttttttttttttttttttttttaatttgagtggaattttgctcttgtcacccaggctgtagtgcaggggcacgatctcggctcactgcacctccatctcatggtccaagtgattctcctgcctcaacctcctgagtagctgggatcacagcacacgccaccacgcctggctaatttttgtatttttagttgagacggggtttcactagtttgccaggttgatcttgaactcctgacctcaggcagtccacccaccttgatctcccaagtgctggtattataggcgtgagtcactgtgcccggcccaaatcagacttctttaatgcgaaggccacactttttcccactgcatagcactgcttaccaatctaaatagatttcacaatgatttggtagcctgacccttggtgtcaagctgttcgtccttccactgcttctatcctggagaagtgtaaagctcatttgcttttgttcttttacaagtaaagcttataaatgataattttgtgttttgacattttagtctgtgctaaagacgctgtgagcagtactagcaacacttacaatttattctaaatctcacaccaggttctgcggcatgaggaatttgaagaaggctgcaagctgcctgtaatgggtatgataccttgtttcttaaaatctcctttaggctctgactaacccggataacagaagacagtttctcaaagtgagtataaagcagtggaattaattaaggggcagtaaattagggaggcaacttcaggagcgtcgggaacacatactgtttctctgcacctcatgagtataaagcagtggaattaattaagaaggcagtaaattagggaggcaacttcggagcgtcgggaacacatttctctgcactctcatacaacacctgtgggacacaaagggatctccagctctctaacaccagccggctgtcctgttatttaattgattctgactctacctgagttaatgtcagatcctgcaagttaagggctcagtcccagaagattttccgccacgtcggcgccggtcacagtctggatcttcaggatttccgatgaccaactacaagtcagggctccgctcctgcttccttgggtttgatagtctgctacagtggctcatggaactaagggaaacctggaaacacttacttacatttactggtttatcataaagagtacgagtcagaaatggctgacagaggagatacacagggcagggcatggggagtgggtggcagagcttccatgctctttgggcaggctccaatccagcacctccctacgttcagcatcccagaagctcatgagtctcttgttcaagcctaatagagcccagtctccatccctttccttcccagaggttggtggatggactgaaagttcagtcctctaatcatttgtctttctggtgaccagccccatcctgagtcatgtagaggccccactctaagtcacttcattagcataaactcaggtgtgactgaaagggctcattatgaatataacaaaagatattcctatcaggaaattccagaggttttgggagcttgagacaggaaccagggacaatgaccagatatgtttcatattatgccacaaatgcaaatagtacatgctctagatgaagcagcggctttccagtatctttttttttttgagacagaattcactttgtcacccaggtgggagtgcggggtcattatcctggctcactgcaacctctgtttctgagttcaagcaattctcctccctcagcctccctagtacgtgggactatgggcatggccaccatgcccagctaatttttgtatttttagtagagacggggtttcaccatgttggcaggctggtctcgaactcctgacctcaggtgatcctcccgcctcggcctcccaaagtgctggattacaggcctgagccaccacgcccgtccatctcttaagcttagtaccgtgacaagtggaacagtccaaggcctattaggaatttcatgcttgttgattgatagtcaaggaaataaaggtcagttggagaactgtctttaggattctgttccttgctttacagaaaaggtgaacaatctttccttcaggtagatgctggatagtctttggagcttgtagtagggtcccatgagcctgcccacagctgctttctgtaccatctgaggtcatctcatccttaagagaacttttagaccagacaggaatgctcatctctctgtgcccagtagttctctgggggtggcctgaggctacttgtctgtagtcactgagttcatttacttttattttctaggccttatgatgggaaatgagtaaaacaatggtgggatttgggcctgaggatgatcattttgtcgcagaactgacttcaattatggcgtcggagactacaagcttggcaatgactttatggtaaataccgttttttctagcagagttttggctgggggtaggtggctggttgtaaatttgagtagagtgccaaggtgtgtgtgagtgaagagataacatttgagcagagactcaaaagaggtcagggagttagcacgtggatatctgggggatgcgcgttccaggcagagaatattctggcaagagccgtcagtaacatctggcgtgttcgaggaggtgtaaggaagccagtgtggctggaatagagaacgaaggggagcgtggtaagagatggggtcggcagtgccatggggtaagactgcagggggcctctaggccgtaagtcaccgagtgaaatgagccattggcggactttgagcaaagggaaaacaggctggctgcagtctgggggtggactataggatgcgttttggaaagtttactttggctcagagtgggtaatggatttacaagactggaggcagagaggccattataataaaccgagcagaaacaaggctggtcttctcaaagcacacgtgtacatttctaggcactttgattaaattaaggaaaccttgatagtttgcttatttttgttttgtttgttaaaaaagcaagaacaggcaccttaaataggttgctagctggcagacccaggtaacatcaagatttctgtggctagactttagaattagaagacgttatctttggtgttaaatgaatcagacttcactggcatttcatttctgtcctattattcacaaaggtctgaatgtttgtgggataaaacattgaaaaccttttttaaatcactagaagaaaatgttggatgccagttaaatcttaggtgattttacctaaggcagtaggcaataggggttgggctcattgtcttgttctgtaaaatatctgttgtgatatgtacttggatgtactgttgtttgttgtagggaatcacgctcgcttctagccaggctgcagcaacgccaggaagctggagtggccactgacggaagttgcagaaggtgtttttgaaacgaggccccgggaggatataagttctatttgcagaatcgcagtctgcctcagtcaggtattataccagaaccagtaaaagcctctgtctaaaggcatctttggtgaaaggagagtgaggctgcctgtcttttttttgtagagtctgtgttcacgtgacgtgtcttccccagccagtgttttacctgttatcggagagactacattctcatatcagaacttaaatacatagcagtagggatctagactagttctgttctactggtaatgtagtgatttatgattctttcatctgtaataacagaaaacccaactactttgaacagttatagaatcttttagctcacagagcaggcttctataggtgggaaagatttcaaggttagatgattcaccagctccccacattttctcttctacgttctgttgttctctgcgggtacctctcctagaactagtcccctcaaggttgcagagagctgccaggagcaggtggggccacatgctcccacaatcccatctggtaggagagggatgctgacttctttttgctttttttttttgagactctgtcagtccggctggagtgtacggcatgatctctgctcactgcaacctctgcctcccgggttcaagcaattctccttcctcgcctcccaagtagctgggattataggcgcccgccaccacgctcagctttttttttttttttttagtatttttattaacttttaaaaattatttgttttttgagacggagtcttgctcttcgcccaggctagagtgcagtgctgcaatctcggctcacttgcaacctccgcctcccagttcaagtgattctcctgcctcagcctctccagtagctgagattacaggcacatgccacccgcccagctcatttttgtatttttagtagagacagggtttcactatattgtccaggctgtcttgaacttctgacctcacttgatccgcctgcctcagcctcccaaagtgctggggtgaaggcgtgaaccaccgtgcccggccctttttgctttctttttaggagcagaagaaaaacttcctagaatcttccagcaaacttcctgttcagatttgatatactgtgcctgctcctaaacaatcactggcaagagaaataggatcacccccaaaccatttagccatgcctcctctggaccgaggtcagtttcccagacttgagcgtgggtactcagggatggcatggaagtgaggagccccacgctgactgccacacagaacaagaaggaaactttgcagggtttgttttgttgacgcagaggcagcctcatcagtgtttcattttgtatttaatgcctgcaaattcagctacctctctgacaaaacaaaagcaaaaacggggaaaatgctggcgaatggcaagggcacttgtgcgactcccttacttggtgaacgtatgcctgcaagtgggcctgagaagggagtcctggaattctccttcttcactggtcggcctcctgtccccgatgcccccatgctgagtctgtagaagttcagtgctccttgtttatcatccggtgctcagcaaaagaaagatccgtctgttccaggtgggaggctagacttggctgtgtgggactcgtggagagatggtgtttctctgcctcacggtgatttaaagggtgttgatggtgtttttttgttgataggtgattgatcctttgctgatttaaaacttaacgcttgcagctagctccaccatccattttttctctccagccttagtgtatttcagtgcttaaaataatagagagccccatggtgctaagaagcttttgttctttggatggaaatccccttgggcatttctggttgacaatgtggtcagaccttctgtccggctggattcatctttcctttgaattacccacttctgtgcagcttcacccacgcgttaacttccttcctgcgtcccttcaggctccaagtcaactgggatttgttgattttgaagtaaatggaagaaaaaaatggagcctgccaggcggaggcacttgtgagaaacagcgtcttaatcccaatttgctgttctagcaaacaggactaaggcagtaaagccaaagaaaaatgtactgaatttacgtagtcagatggagacgtggaacagctctttagaaagtcactttacaatgtgaaaagttccagtaacagtaggtgtttcaatatgacttttattctttttacaaaataatcaagtttttccttagacaagcagagaagctgaaaaaaaacacacacacccatgtacccagagagaacactgctgacattttagagtatatctttccaatcttttgtcaaaaatacgtatatataataagtgtatacatttctgtatatccttttttaggagttccatcgtattattacattgtagaagagaaacaattctctattgttggatatttatgtcgttcctagtgttttattgttctagcaacactggtgaatgtctttgtcgtaaaagcccttcatacatccacaattacctttgagtggctgaaaatggacttgttctttcaaaagcaatgagcactttttaaagcttttggtcattccatcaaactattgcccagaaatgtactgatttacacttgtattacatgattgtgttttcccctctacactaacacagttaacactgccaacttttaacattatttgcacattattaacaaaggattttatgtgaattctaatttctttgttgtttgggggcgtcgggttgaattttttttttttttttgagacagagtctcgctctgtcgcccaggctagagtgcagtggccgctctgggctcactgcaagctccgcctcccgggttcacgccattctcctgcctcagcccctgagtagctgggaccacaggcgcccgccagcacgcccggctaattttttgtatttttgtagagacggggtttcaccgtgttagccaggatggtctctatctcctgacctcatgatctgccacctcagcctcccaaagtgctgggattacaggcgtgagccaccgcgcccggcctgatattttttcgtatgttatttgaccattctaattccttgttttgtggattattgctttggccttttgcctatttttctagcatgttcattcttttcctattgatatttacaggtgattacatattaaggactttttgtccaatatattgcagttgttccccctactgtgttgtatacctagttttgattgtaattccttttcttggttgttgtctaggagttttccattttgtgtatttatgtagcagaagttttttcttcatagtttttctatctttggtgtcaggtttaaagaaaatcttcctctactccaaaattgtataaataatcatctgtatctagtattttcatggttcattctctaaacttatttttttaacccatcaggaatgtattttgtcatttatttcgaaatgtaagtttttcttaccaaatgattagccagtcttcttagcgccgtccattgaataataggcttttcatactgtctttgtttttttttttttttttttttcgagatagggtctcacttcacccaggctggagtgcagtagtgcagtcttggctcactgcagcctcaacctcccgggtcaagcgatcctcctgcttccatctctgaagtggctgggaatacacacatgagccaccagcctgtctaatcttttttttttttttttttttttttgagacagagttttgctcttgtctccaggctagagtgcaacggcgccatctcggctcactgcaacctccgcctcccaggttcagcaattctcctgtctcagcctcccgagtagctgggattacaggcgtgcgccaccacgccagctaattttttttattttttatttttagtagagacagggttttgccatgttggccaggtggtctcaaactcctgacctcaggtaatccacttgccttggcctcccaaagtgctgggatacaggcatcagccaccacacccagccaatttttttaaagttttcatacaggcaaggtccagtgttttacctgcattggtcttgaattcctaggctcacgcaatcctcctacctcagttcccaaagtgctggcattacaggcatgggccgctgcacccagcttcatactggcttaaatccctttcttatcataaactgaatttgtaagtatacatgcgcatgttttggtctttctatttattctattaaattgatctgtctattcctgctttattacccaacagatcctgtattaaagtaactctagcagtgtctgatcttcaaaagtccttgaactactggtgtaatctactggaatgaaaatttatgaaaaagatgaagaaaagcaaagggctttgctgggctatgctgataccaggtgagcaatcttggagaagaataacctgttactttgaatttggcttgtaaacgagcttataaatggcttataacctttataaatgaagttaacatgaaggttgttcccatagttcttcacagtgattcaatatttatatagataaacagaagaaaataagtgataaccttacacccagatattaccttgtttatatttggggatatatctcttcagaagtggaattgcttatccaagagattgaatggatttaatgcaagatctttttcatcttctttttctaataacccgcgtttgagcacgatttagtccttgcactttgaccctgcaattctactcctaggaattatttacagatgtgctcaacatacatcggcacaaagaagtgtgtgcaaggttatctgctgcgcattgtctgtaatcacaatgtgtaagaatttcagtgtcctatagattagagacatattcagtaatttacggctcattcatggaatggattactatgtcgctagcaaaaagattgaggaaatctttatgtattgacatggtaacattaagtggagaaaaacaaggaacagaataattgtaaattataccaccatttgtgtaaaaaaaaaaacatagatgcgtgcagtgcttctagaggatacacaggaaactgtggactagttgtctctggggtgagagtaggatagagactcagttttactttattcctttagtatataatatttgaatttttctaccacatacgtgtaatgatgtataacctgttccaaaaaataaccccctttcctatttcagtgtaagctggagctacaggcgtcaagggtggggtggaccatgcagcagcttttggaagaattgccttctcttgccccagaaagaggtaacgcttgataccagatcgtttgagctttctgactagctagttcaaccagctaagaactttgtccttcccttcttgaggtcctttttgattgtggctttagtatcaattcagcagttgtttcaagagcagctgagataataaattcaaacaaatggcgccttggtttttatggtatctgatactcctctaggactgacgagggccgtgtcctgagtagtgtgtgaccctggctcacgttgcctctgttttcctcaagttgccagacttagaagacttgatgaaagggagaaccagaagattctgactcccctggtgagcctggacaccccagggaaagcaacatacaggtggtcattctggccgaccctgtaagtatttctcaggcagggggcaggctggacaggggtttcttcaaggatgtctttggcaggtgtcttttctctttattggtgtaggacggcatgaaatttgctttgtcggggatgaagcatttcgagaactttctaagatggatccagaggaagcaaattgttggatgatgtgagtcccatttctacatttatgtcaccatgggcctggagggatggcattaagtgtgtgtgggaggagactaagcaacagggtccaggttcttaattcagaaccacgtcctttcgctgttgggttgacctcagccaaggaccgatgtcttcactgcacctgtgtagactgcttgtctagacttagcatttgtgccttaccacaacctcaggctgcctggaaccactgctggtggatctgtgcttattctgctctccacatggagatgcctctaccgaccccctcagctctccccatggagatgcctccatccgaccccctcagctctccccaggagatgcctccatccgaccccctcagctctctgcatggagatgcctccatctgacccctcagctctccccatggagatgcctctatccgttcccctcagctctcgccagggagatgctccatccgaccccctcagctctccccatggagatgcctccatccgttcccctcagctctcgcatggagatgcctccatcccatcccctcagctcttgccatggagatgcctccatccgtcccctcagctctccccatggagatgcctccatcccatcccctcagctctccccgtggaatgcctccatctgaccccctcagctctccccatggagatgcctccatccgttcccctcactctccccagggagatgcctccatctgatcccctcagctctgcagctcctttgatcatccttctccattctgcagcatcagtctcttctttccagtgagttattctcgccagcgtgcaacaggcgctgaaagctcccatcctttaaaaaccttttactgaccccatatctcctctccgatttctccttctaaaaatctgagtgcgcactgtttctctctctcacatcctctccagattcttcttctaaaaatctgagtgcgcgctgtttctctctctcacatcctctccagatttttctaaaaatctgagtgcgcgctgtttctctctctcacgtcctctccagatttcttctttaaaaatctgagtgcgcgctgtttctctctctcacatcctctccagatttcttctaaaatctgagtgtgcgctgtttctctctctcacgtcctctccagatttcttctaaaaatctgatgcgcgctgtttctctctcacgtcctctccagatttcttcctctaaaaatctgagtgcggctgtttctccctctcacgtcctctccagatttcttcttctaaaaatctgagtgcgcgcgtttctctctctcacgtcctctccagacttcttcttctaaaaatctgagtgcgcgctgttctctctctcacgtcctctccagatttcttctaaaaatctgagtgcgcgctgtttctcttctcacgtcctctccagatttcttctaaaaatctgagtgcgcgctgtttctccctcttagtcctctccagatttcttctaaaaatctgagcgcgcgctgtttctctctcttacgtccttccagatttcttcttctaaaaatctgagtgcgcgctgtttctctctctcacgtcctcttagatttcttcttctaaaaatctgagtgcgccctgtttctctctctcacatcctctccagtttcttctaaaaatctgagtgcgcgctgtttctctctcacacatcctctccagatttctcttctaaaaatctgagtgtgcgccgtttctctctctcacgtcctctccagatttcttctaaaatctgagtgcacgctgtttctctctcacacatcctctccagatttcttcttctaaaatctgagtgcgcgctgtttctctctctcacgtcctctccagatttcttcttctaaaaattgagtgcgcgctgtttctctctctcacgtcctctccagatttcttctaaaaatctgagtcgcgctgtttctctctcttacgtcctctccagattttttctaaaaatctgagtgcgcgcgtttctctctcttacgtcctctccagatttcttcttctaaaaatctgagtgcgcgctgttctctctcacatactctccagatttcttctaaaaatctgagtgcgcgctgtttctctcttcacatcctctccagatttcttctaaaaatctgagtgcgcgctgtttccctctcttacgcctctccagatttcttcttctaaaaatctgaatgcgcgctgtttctctctctcacgtccctccagatttcttcttctaaaaatctgagtgcgtgctgtttctctctctcacgtcctcttagatttcttcttctaaaaatctgagtgtgcgctgtttctctctcttacgtcctctccaatttcttctctaaaaatctgagtgcgcgctgtttctccctcttacgtcctctccagattcttcttctaaaaatctgagtgtgcactgtttctctttctcgcctcccattttcacttcatctgttttgcactggctcttgttactcagtgaagtgcttttgtttcttgccaaatatagaactacttttagattctcatcaaactcagtaattcagaagcattcaaagtagttgttggtcctagctcctagcacatacctggcatgtactagacgttctgcaaatactttgttgaatattaaaggaacaaattggtctttcttggttctgtcacgtaactctgtgactgaccttaacagttgacttaaattctttgaactttagtcttcttatccaaaaatttcagaaaataagagatctatctcataagattgttatggtttatagagcttggcaaattactgacataatagtgatgcacaattaacgttaaagcaggcaatgtatagaaaatacagtctttatacattttacctgaaggaaagtagaatctgtcatcctctcagctgacaaatttgccagactcttcctctcgctcttaatttaattaaattaattactgaattaaattttttgagatggagtctagcttgtcgcccagggtggagtgcaatggtgcaatcttgcctcactgcaaccttcgcctcccaggtcaagcgattcttctgcctcggcctcccaaggagctggaactacaggcacttgccacatgctggctaatttttgtatttttagtagagacagggttttgccaggttggccaggctgtctcaaactcctagcctcaagtgatctacccacctcatcctcctaaagtgctgggattaaggtgtgagccactgtgcctggcccattttattttatttattttttgagacggattcttctctgtcaactaggctggagtgcagtggcataatcttggctcactgcaacctccacctccgggatcaagcgattctcctgcctcagcctcccaagtagctgggattacaggcacgtgcaccacgcctggctaatttttgtatttttagtagagacggggcttcaccatgttggccagatggtcttgaactcctaacttcaggcgatccgtctgccttggcctcccaaagtgctgggttacaggcgtgagccaccacgcctgggcccattttattttttttaagacggggtctctcctgtcaccgaggctggagtgcagtggcatgatctcagctcactgcaacctccgcctccttgttccagtgatcctcccacctcagcctccctagtagctggaaccataggcgtgcgccacatgcctggctaatttttgtattttttctagagatggggtttcaccatgttgcccaggcggtttcaaacttcctgggctcaatcattcgatccatcttggcctcccaaagtgctgggatatagatgtgaaccattgatgaactcctgctccctgagctctcttctcctctgctgttacgatcctgccatttttcttttttttgagttgggagtctcactctcttgcccaggctggatgcagtggcgcgatctcaggtcactgcaacctctgcctcccaggttcaagcagttctctgcctcagcctcctgagtagctggtagctgggattacaggcacgcaccaccacacctggcaatttttgtatttttagtagagatggggtttcaccatgttggtcaggctggttgagtagccgggtgcggtggctcacacctgtaaccccagccctttgggaggccgaggcgggcggatacaaggtcaggagatcgagaccatcctggctaacacggtgaaaccctgtctcttgaactctgacctcaggtgatccaccctcctcggcctcccaaagggctgggattataggcgtgagcactgcgcctggccatcctaccattttcatcttcctgacagtttctcctcagacacgggacctctttctgtgtctcatcccaaagtgtttttatacccatagccctactttgctgttttcccattctgcattcttcctccactctgatgagagcttacctgcgacctctccttaccttgccctgaacgtaaccatcatcctggctccagcctcctcacttccagtttttaactcctcctcagctcagacaggtggttgttgttgatgaggcataatttaggtagaatttaaatgtttttgacggttgtgtttactcatacaaccactactcagaatacagaccattttcccaggagttccctcatgcccatctccagtgagttggcaccttcatctcccagatcagctgctatctgacttctgtcactgtaggtgagttcgttcttggacttcatacaaatggagtcattcatattttctttccttttgtgcctggctgcttttactcaccatggctttttttgttttttgtttttgtttttttttgagacggagtctcgctctgtcacccaggctggagtgcagtggtaaatctctgctcactgcaagctccgcctcccgggttcacgccattctcctgcctcagcctccgagtagctgggactacaggcacctgccacctcgcccggctaattttttgtatttttatagagacgggtttcaccgtgttagccaggatggtctcgatctcctgaccttgtgatccaccaccttggcctcccaaagggctgggattacaggtgtgagccaccgcgcccggcctactaacatggttttgagattccaccatgtaattgcatatcacagctcttttttttttaattgtgactgatactcaattttatgaatataacaatttgctcattcattcttataatggtggaatttggtttatttctagattttttaatctattataaggaagactgccatgaacattctatgtaaatcttcttgtagatagatgtttcatttctcttgagtaaatacctaggagtagaatgcttttactgtataagaaagtgtcaaacagtcatcgaaagtgatcggaccatcgtttgccacgagaggtccagtaggtctacattctcaccaacacttattttgctttttgtgggtttttagctattctagcacatgcgaaatggtttcattggtgcaatcaagcgatccttctgctcagccaccacatagctagggctgcagcactatgcccagctgatgttttttatgtttgtgagacagattctcactgtgttgcccaggctggcctccagtgatccttccagctcggcccacagaggtttaatttttatttccctgatgactaatgatattgagcaccttctcatgtgctattagccatttacttatttttgtgaattttatgttcaagtcttttgtccattctttaaaatttttaatatttcatgatgaaaattccaaatatgcacaaccgaagagagtacgacaggccttacgtgactcttaccttgactctgtactgtagtttttcatcattccttcgtcactgcaaattcaagtatttttcccagccattaattgagtttttgaagatgaggaattttttatttggtgaagtccagcttatgaactttttctcttacatgtagcactttctctgtccagacgatgttatatcctgagaacctcttcacctaggaaacctaccacatatcagactcagcggtccataacttatcttacctcaaatccattcttcttccagtaatattacataaaggctattgggagtgtagattctgggaaacctgaatctatgttcccgggctgcagtcttcaagctggcccagatgaactctctatttatactaaaaatatgtaaataaataaaaataaaaagaataaatgctactatatcggtacgttcttaagtgctttatttttatttatttatttatttttgagatggagcctcactctgttgcccaggctagagtgcagtggtgtgatctcagctcacgcagcctccgcctcccaggttcaagtgattctcctgcctcaggagagtagctgggattccgagtagctgggattacaggcacccgccaccatgtccagctaatttttgtatttttagtgagacagggtttcaccattttggctaggctggtctcgaactcttgacctcaggtgatcccctgcctcagcctcccaaagtgctgggattacagatgtgagccaccgcatccaaccttagtgcttcatatacattctctgattttttttttttttttttagacggagtctcgctctgtgcccaggctggagtgcagtggcgtgatctcggctcacggcaagctccgcctcccgggttacaccattctcctgcctcagcctcagcctcccgagtagctgggactacaggcgcccaccccacacctggctaatttttttgtatttttagtagagacggggtttcaccgtgttagccagatggtctcgatctcctgacctcgtgatccgcctgcctcggcctcccaaagtgttgggatacaggcgtgagccaccgcgcccagccacattctctgattcttaatataacctgcaaggtgatagcatcagcctttgcaaatgaggaaaccgaggctaagaatgagtaagtcattggcctcacccttgaataccatacactgagtaagtggcaggcaggggcctggatggtgatgaattattccccttcatccctgaagatcacgcactgagtaggtgcaggccggggcctggatgtgatgaaattattccccttcatccctgaagatcacacactgagtaggtgcaggcaggggctggatggtgatgaaataattattccccttcatccctgaagatcacgcactgagtaggtccggccggggcctggatggtgatgaaattattccccttcatccctgaagatcacgcactagtaggtgccggccggggcctggatggtgatgaaattattccccttcatccctgaagatacgcactgagtaggtgcaggccggggcctggatggaagcctttcaggctttacagttagcctttttcttcctctgcgccctgctccctccctggacagtacagcgtgtctgtgatcccgttgttcacgctggaatcctcagagccagttttggtgttattttgttgtgttttgtttttaacatttaatagtcgttttagatttacagacagtcacttttgaccattatttctcctctccttaaattattttagctattagtcaccaagagctgtgagttctacctctgaaatgtctctgcctatcagctttccctttgaaaggcctcattgtcaacttacggtctgtcccaaagaaacagccagtaatttttaaaaccgtttaatccgatagctctctcttgcctctgagataatttcaaactctctgacagagcatgtgacatttttggacattctctaccctctgacctttttcccacctgcctccctaagtcccctaactcatccctattccagtcccactgaactggtatattagctaagatacttcttcttgcatccaacccaaagggttttttccctctcctctttacttgtccttcaacacttaaaagctttcttaggttcagccgggcgcgatggctcaccctgtaatcccagcaccttgggggaccaaggcgggtggctcacctgaggtcaggagtcccgaccagcctgaccaacatggtgaaaccctgtctctactaaacacaaaaaattagccaggacggtggtgtacgcctgtaatcccagctacttgggaggctgaggcaggagaatcacttgacccagaaggcagaggttgcagtgagccgagatggcgccgttgcactccagcctgggcgcaagagcaaaactccatttcaaaaaagaaaaaaagctttcttaggttctccaaataattagttgttctttcctcccactttttatggctcctaaaagacagaaacgtgcatatttgtgcttgtggtttttttaagcatatctttgatttttaaattcttattttcatcaagataataatcagatagtactaagattttttagaaatgaaacggtccaactctgagtcacactacctggacagccactttcaccttcactgtttctaaataataaatatatttgtttcttctttttaattgccacctcatcttgtgacttcctgctgaggtagatattatagcaaatgcttcaagcacacacatgcgtacacacactctgtcatgcaaaatacttgtttccatatctgagttctagctgttctgcacactcctcaaagcttccgactgtctctgctgccacatctgaacccaggtggtacctggctctttttgactacataaatgagtgtttgtccttactaaacaacgaaaggatgcttgtggaaccaaaacattattgttaaggctttgtattattcatttatttttattgtatctgtatgtatatatatgagacggggtcccactctgttacacaggctgaactcgattcctgagctcacgtgatcctctggcctcagcctccaagtggctgtgactataggtgtgccactgggcacggcttaaggcttcctttttaattaagatgcccaaactaaacagaaccacatcagaagagtaggccgggaggagacttacgaaaaaggaatcattccaggcttcatcataaaacatcacgtagagtttcatatttggcctcactatcagactgagtttcatgacactaagattcttgagcgtctgcccagatgctgtgagtggcaggacttgctcttttaccagagtcctaccgcctggcatgcgggtccctgacctcgttggtccgccagccacacttcctggcacaggcttggtttgcccttgactctgccgagtgaggatccacagttgctcattatcaccgtatctcttgccttattgaacataacactctgtactggattaatactctttaaatgttaaaaattttttttatttctcttctcttttttttggagcgggggtttgggtcctttttttatgttaattttttttattgtggtcagtacagtgagatataaagtgggctatgtcttttgttttcaggcttggagtcagtgtatattctatttctattttacaggcaatggcagcagataaagtgacgagtggtttgccaaacacaataaacccaaagcttcaggttaacggaagacatatgcagagcaagcctctgtgattcctgcccagcacctgtgaggcctgacgtgtcagttccaataaatgctcttctgatttgtttcccgtacaggcaaggaggcttgggtagtgcagattgtgtatttcaatctttgaaagctctgatgtaatttagaaatgaaatccaatcatgagtcaggtagagaacgcctgctgtaatctacactgttgctgggactgcgcattctgtatatactgtgttggatgagtgacagatgattgtccagactaggacagcggcatgaacatgacttggttgggattgcggatagttagggttacctctgaatcgtgtagcttttatgagagcagcgtgcaagtgaatccacattaatgccttgtcgtggtgccattcccagcgcctgacgatacctcttctattgtcttattctggcaggttttgacgttttaaattttttaaagaaattttatccttggaccaaaaggtttggttaaccacccccctcttacttgctttcacattttgagttccagaggaaacagaaaggaatgagtgtgtgacgttgctgcacgcctgactctgtgcgacttctttctgtgtatatattttgttttatttttttccgtgtatatttttaatcccgacaaacatcatgtgagatttctttaaaatggattaaacgatttcttcagcctgaaaaaaaagttttgaaaatgttttcttgtagttttgtttggttctaaacaacaaataggttttaatcatcgaaatggaattatattgtgtattcattgaataaattttttttgaaagtaagcttctgaatcaagctgtgataccagtctctaagtctcatcatgtaaagtggtggccaggttcagattttaaaaataaacttaggagattggaagggattgactcagaggatcctggttcccaaaaacacatagagaattacttgtaaatcgtaacctctgctttcctcccttactggcagggctagggcatcgaaattttggttgtatttgagcttatcttcttataggggtgatgctattaaccttcacggagagaaataaattctcatccagctctacaacttttcattcagcttgaatccatatcctagggaagcagtcttgagtttcaaagcaaaccaagttatatatatggccctctctaggtaattggttctttttattttttattttttttttttgagacagagtttcgctctgttgcccaggctggagtgcaatggcgtgatcttggctcactgcaacctccgcctcccgtttcaagcgattctcctgcctcagcctcccaagtagctgggattacaggcatgcgccacacgtctggctaattttgtatttttagtagagatgggctttctccgtgttggttaggttgtctcgaactcccgacctcaggtgatccacctgcctcagcctgggattacaggtgtgagcaccgtgcccttctctttttttttatacatgtggaaattattatatgaactttgaataacaggtaaacttctgcttctctttagaatgtatgttaattttccaattttctattagattataagtaatttttaatgttcatctctagtaatattgtccttgtgaaaagaaactccttttccagtgtattgggctgctataatgtggccctcgaagtttgttgtagtaaaataagtggttatataagtaccgaataactaaataacacacacaggtttcccttttatctgcttatctttattttggcgtaccaaaacgtttttctcctaaatatacaactgtgcatgatagtgggcacatgcagggtgaacagtaatgctgtttgtctgcataggacattttggctttaggagatcgcctccttttatttatttcattgcctgtcatgtctcgctttgttgcgttttgtttttgctttgtttttgtttttttttaagacggagtttcactcttgttgcccaggctggagtgcaaggcgcaacctcggctcaccgcaacctctgcctcccgagtttgagcgattctcctgcctcgcctcccaagtagctgggattacaggcatgtgccaccacacatggctaattttgtattttagtagagacgggttttctccatgttggtcaggctggtcttgaacttctgacctcaggtatcagccacctcgtcctgttggcgttttttaacattttattcatcctaaagccctctaggtacaactttggctttttatcaaggcatccagaagcttgcttctgcacagttcagctaataattctaaaccaaaaaagagtaatttttaaaaattattatttaggccgggcgcggcggtcaagcctataatgccagcacgttgggaggctgaggcaggcggatcacctgaggtcggggctcgagaccagcctgaccaacacggagaaaccccatctctactaaaaatacaaaattaatgggtgtggtggtacctgcctgtaatcccagctactcaggaggccaaggcaggagaatccttgaacctgggaggcggaggtcgcggtgaagcgagatcacgctgtcgcactccagctggcaccaagagcgaaactccgtctcaaaaaaaaaaaaattatttagacgcccattagatcgcaaaaactaattttaaacaaaagtgattagtttcccacatctgggggatatgatcaatagaaaatggcatgaggaagatagctttgcccaagctggtgtttcatttttggtttttggacattgctctatcacgcagggtggagtgcagtggggcaccatcgtggctttctgcagcttgacctctggggctcaagagatcctcccacctcagcctcccgaatggctgggcccacaccacgtgccaccacacccagccaacgttttgatcttttgtagcgaccgtctcactgcgtgttcaggctgcaagctgttgtttcaaacagatgaagttggaaagttcttcagcttctccgagttgtttttttgaatcaaggggttgtggagcctacatgtaaatacaagtgtgccttggttaaatctccgggaagacttagaacggccgtgttgccagagctctcctagttagcctgaggactgtctgaagtccgtgtccgtctgacatgttaccggaattaacaaacctagggacgtgagtgctccttcatgtggctttctggctctctcacctgccactcagtgccgctgtgattagcagccagagttttcaggagacctccaacgtgtccgttgaaattcagggtaagagtgagaagtttccctgtttgttctaagagttcttaccccaacctcaggggaaatcaatagtaatttactctgacttcaatgataataaagaagtgcccttgcctcatcctctttatataagcaatagagccacatggttcaaaaatgaaaacaatatgaaaaggtattgtaaaccgggtagtgtctgagacaagtctcgcccatttagaggtttattttgccaaggctgaggatgtgctgagacacaaccacagatctgtggcccccgcacactttccagagaggatttttagggcccagtatgtgggatatgacgacgtttctcttcaaataatctgatcaatcttttattctttattcatagcgccccgccccctttttctccttttccctttttgcctttgtgagatgcccagcacgccacagcaccaggcgttatcagtaccagctcacattcctttccttatttggaaaaggactaactttctagctcattacagacaccccttccccttcctctccgctttcttttagggcccaccctatctaaaaaaatcaaatgtttagccaagcgcgattagtttagattgtagacctgaccccggccaatggggaaagggtagaggggcaggacttgtgtcaggaacaaagctctcgtgcccctttgttcaggtgtgctctcatgacaactggccaaggaggcacccctcgcacagaagtaaaattgctttgctaagaatcctttgttcgagtgttctatttccttaggttttgagcattattcctaacaagtatttaaaagggaaagagcaggaagggagggaagaggaaaggaaaaatacaggagggtaggtagggagataagtggttacattcttattaggcttgatcagcgctcaccaaatctacatgtcacagtgaaaggagggggtagaggaacagtcagtttgcattcagctcagtaaatctacatttagcactcaccaaatctacatgttacagtgaaggagcaggcagaggaacagtcagttttgcattcagctcagtaaatctacatttagtgccaccaaatctacatgttacagtgaaaggagcgggcagaggaacagttacgcattcagctagtaagtctacatttagcactcaccaaatctacatgttacagtgaaaggagcaggcagagaacagtcagttttgcattcagctcagtaaatctacatttagcgctcaccaactctacagttacagtgaaaggagcgggcagaggaacactcagttatgcattcagctcagtaaatctcatttagtgctcaccaaatctacatgttacagtgaaaggagcgggcagacgaacagtcattatgcattcagctcagtaaatctacatttagcgctcaccaaatctacatgttacagtgaaggagcgggcagaggaacagttatgcattcagctcagtaaatctacatttactgctcacaaatctatatgttacagtgaaagcagcaggcagaggaacagttatgcattcagctcagacatctatgttttgtctcggctggtgagggatggtttctggtgttgtctttgtcccttactatgaagataagctgttaatttatattgtcaggtgagggagaccacctggggagatattggccttctgtcttgtagcttatctgtttaggaacaaaaggaagttttttgcatattcctgactcaatttccaagcttaacttttccttttcgcttagtgaatttggtcccaagatttattttcctttcacagtataccccatgcccatcaatcccattccccctgcatcctataggaacctcttcttaagcaaatacaaatagataaatccttattttctgtttttttttttaaactttattttactgttactttctgctgtcctaattatggcacatttttactttctaggtttgtgatttacagagtggtctggctatgtggacagcttctaaattgtcaccacattttgggcaagatgtattatttttacaattaatttacatttaacatgaatcatgatcctaagtgctcagaatgtcttcataacattcgccaaagaagagagggcagcactgctgttctacagtgggctctcacctggtccacagttaccagaaatagttctttcgttgctgtgatgtcctggggggcttcattctttagtaatgtactttgtctacagcaacttcctgcaactatgtgaacaatcttgaagacacacagtgaggtttggtttcctttgtcctcttaagtctttatggttgtgcttctattgtttattggtcccagtgagaactgcagctgacctgatgtcatgatctgtgagatagtttctattaaagaagaagtaccaggaaatcccatatgccaccgtagacctgccttctggataccatttactactccatactccagccgccatgcacaatggttgtgtatgagctcctgtgatcattaacaggagtagaagctgggctcagacactctggcacttgcataggcaaggggtgtgttgtgctcttgcaacaaatcccacatagacatccatatgcatattgtccaccgtcccctaagcagaaaccagggttaagtacagaatagtcccgggaacattttggtgcccggccttaggtgagcctttctggggctgggattttgacaccatctgctccattgttctaaactgctgtgttctggcgcatcaattgtttcatcacattatcatcacggaaagcttgtctccctcaaaacatgaaccgggtaggccctgtgttccagtgggggcttttggacttgctttagtgtttaggaggacagagtccctctcccctctgtggtgctggggtattagtaaacagccttgaagagataaggggctggggcctcaacctcccaagaggctgtcactggagaaggtctcctgccctcagatcttgggcatttccacagcacactgtccccctcgtccttccaatacctacatacgctcttgtaataggagagctgggaactccacccaaaaccatacaaaagttagtctgtgtatttggacgcctccccagcactcagtcaccgagtttctcctttccaaagcagtcactctcatgcagtttaagtgatttattgatgtctcggctaagcttgcgacagttcaggacatttcagccatcaaggtctaagaagccctttccattcccgaggagccctcaccagcctccttcttcctcatctcctcactctggccgcgtagcccctcatggcgtccatctggacgcccctttgttcgcgctccacgccccccacttccttcttcgtcagctcctccacttggccgcgtagcccctcatggcgtccatcttggacgcccctttgttcgcgctccacgcccccacttccttcttcgtcagctcctccactttggccgcgtagcccctcatggcgtccacttggacgcccctttgttcgcgctccacgccccccacttccttcttcgtcagctcctccctttggccgcgtagcccctcatggcgtccatcttgcacgcccctttgttcgcgctccacccccccacttccttcttcgtcagctcctccactttggccgcgtagcccctcatggcgtcatcttggacgccccttttttcgcgctccaagcctcccacttggccctggctctcacgtcgaggccggagggccggggatgtcgcagtcgccctgggtggcctgtttgtacaagccgtaaccagcagcttctcctgatcgctcacgggacccttcagctgcttgagggccgcgcagctgaactccacttggcacatggggtggtggaggcggtccctggtgctagaagctggaggtgagagttggagtggctgttactactcgatctcagggggaggagacaggcacgcgatgttttgttttgtcaagcacagattgcaagctcggggtccagcgtaaaccccaccatgtttgggtcacacggcgcattttctggggaggaccagccgtcaaaaagcgtctaggatccggaacgtgctgtctggagggggcggcgcggcaggagcgcgttgagggactgtatgtggcgcgagcgggcgggtgggagtggaagcctcgcgtggtgcggccgcgctgggtggtgggcgtcccggggaggcgctcggtgggggtgaactgtgtgcggggcacgcccggggttaccgggtgaggggaatgcggggccggggaatcatgagcccgacccgctgggaccccggaagaggggccgggaggggacggtgcggaggggtctagtgagcgacgtccgggtacctgagggctggtgggaggctctgccggaaggcggcgctgtgcgcttggcgcgctcgttcgtgaggactgcgcgtgccggcggaggctgtgggcggggccgggcggaggttgtgagcaggcctaagcgcggccgcctggctcctgcgtctcccatcgtgccgtgcgtcccgcgccgcgttcgagttctcggagggagggggcgttagccccgcgcagccgccggcgtcgccgccatggacctaggtgggtgccgggctccccggccccgggctgcgtccagcaatgcgccaccagagcggtgctgccccgtcggtctcctcctgtcgcgcacgctcgcgcgggcccggaccgaaacgtcccccgcgtcgggggggtctaggggtcccggggtggccttggcggggggtggtccgggtcccgccgcgcgttggccgcgtcttgccgcctccggccccctgcgcttgaaaacacggagcagacgtgaagttaagcccttggaagcgcccggggctcgcgcacgtgctttgggaaacgggctccctccgagccccctgggcgccccgacggcctcatttcctgaacggcagctgcgttcttgagcaagtgtttaacgctccaagtgtcttacgctcatgacgtttcctcatcgacagagcggggagaatgaagtgtgtctccccactgagttttgggcgactttgcattgagatcgccgaggtacagtgcccttgtggggttgcgcgggtcacacccgcggtgggggcggctgcgctcctgaggtatcctttgtgaacctgcgtgcgtccggattcagaatcttacaggcaaggtctgggagggagccataggaactagatgctccctgctaaatcttggcacacgctgctaagaccaggaggctgtctgggagagctgggggtgaggcaccccgagatgtgtcagcagtagtaggctggggggaatggtctggtccccgcccccagacagcttttcaggagcggaatggcagagctctaagggttggagcccctcagccgtaattgcttcccagccccaccacattcaggctgggacaccctagcaaatcgtttctgcgcctcagtgtccttatctctagagcaggaatactagtcctcaaaggtgattgtgaatagaagagatcttacctgtgtaccacctagcacagtgtctggcatgagtaggtgcttaataaacctaagaagcgggctgtggcaagcactagttaaccatccatgtaga

SEQ ID NO: 5061 - DNA, 21791 bp, Homo sapiens
ggcgaagtgggtggcatgataatccccgccaagcagctccaccttcagattcttgttgcaattggaagcaggttcagcaccagctgtggcatattcaagggcttcctccggcagccagaaaaccaggccctgcaggtggaggctgggggcggctgtgaaaacgccactctgtggttccagatttgtgtttaccacagtgacttccagatcccatccattcatcctcacaacagcgagagggtttttttttttttttttttttgagacagagtctcgctctgtcgccccggctagatgcagtggcacgatcccagctcacaggttcaagccattctcctgcctcagtctcccaagagctgagattacaagcgacaccaccgcgcctgactaatttttgtatttttagtagagacgggtttcgccatgttggccaggctggtctcgaactcctgacctcaggtgatctgcctgcttggcctcccacagtgctgggattccaggcgtgcgccggcacagccagcctgttgttgtgttttttttaacctgtcttcccaacattaaaagcctgttgaagaaaaagggtatgttttcacattgaattcctaattgggaaaaaaaatactaaaaaaagagaaaagggtatgtttggaccagcacatacagcagatgaaaaccagcttcttttccagagcgaggtgacttcctgctttgcttttcgccccttggtacgtccttgaaatcaatggccatcacttaccagaacgcaggagcgagtgctgtgttggcatcggccaagcttcaaatagtaattttcagccagactttgtttttcctgttgcctaattaaagacactgaaaagctgttctcccctcctgctgccttgtctaggacagcaaactgaattcaggaacaatacagacggagccggatgtggcccaggagcgatgcgcgggacctaacacggtgttgccccgtgcagcttagggaggaaatgcaatgtatagaggacacacgtctgggaaccctgcacactgggaagcgtagtaccgggagggccctgacgagggcacacgctgttgacggtgccgttgccctgggcaggcccatgtgttgtgcgcgcgtgggtggctgtgcacacaggcccgcaggttcaggagtagcactgagcagggggctgtggctcaaaggatctttccagtttgccccgaagcagctgaatgagagaagtgggcacttggtacacccctcactgctgccgccagcagacgagggcacacgccctgcttcctccaggctgggctgcgcaagggaaaattctttgggaacaaatagctgttgaccagtagcttcattagtctgggaatataacatgagggcgttctaggtacacctcgtatgtgagcgcatgaagacagtaagtatgcctactgccatttttcaaggcgtgtgtctcacccccttggtgctttgggaccttcccaagcccgagaatgtgtcaggaggtttgggtggaactgttgggtttctgttaaagatacacaactcgtgaaagactctgtccccaggtctgtaggccagtgtgcaatccagagcagagacggcctccagtccggattccgggtgcttatgcctcactcacatgaggaagtcaccacaggtgctagaatgacgacacagtaggagacgtgatctcagggccaaaaagtccattctcgaatgtcagaggacatggaggtcctacttggcaggcttgcagtgagtacgccccgcctcggcatctcagaggagcagggaagggaggctgaggccggagcttgctgcagccgtcgctcctccctccccagccttgttccctgttcccttcctgcatttcttttttttttttttaagacaagagtttcacttttgtcacccaggctggagtgcagtggcacgatctgactcacgcaacctccgcctcccacattcaagcaagtctcctgtctcagcctcccaagtagctgggctacaggcgcacgccaccacgccgggctaatgtttgtatttttagtagagacagggtgtgccatgtttgccaggctgatctcaaactcctgacctcgtgatccgcccgccttggcctccaaagtgctgggattacaggcgtgagccaccgcacgcggcccccttcgtgccttttgagaagcagcagccttggtcatggcccataagaactcagacttcaactgaaaaaagtggctctccctacacaacagtccaggaagctggatattgggagtgtggtgagacgagaactgaccatccataagctattctggattctctgtcactctcagccgtggagcatcaagcaggcttctgaagcttcgggaggacctggcttcagctgctgtctcagctgctcgaatgtaacatggtccgtagttgagacttcagtcatcctgagcaataaaccagctcatccactaacttggctctagcttattacatgtgtgcactccctgcactgatgaaaacaggaaacatggcgggcgcagggctcacgcctggcatcccagcactttcgaggctgaagcaggaggatagcttgaggccggagttcaagactagcctaggcaacgtggcaaaaccccatctaaaaaaaaaaaaagaaacagaggaaacacaatcatggaatttttaaggtggcaacatgttttcttaaaaacaggtggcctgtcagctctgctcctgagggagaggtagcttggtcaagagggcagccccaggcccgcagtacagctggtgattttcagcccagagccctggaaccttggatggggagtgtgtgtagggctgtgcgtggtagaatggcaaaagtggggctaagtgtggcccagcgtggctggtgggacatctggggttgctgtcaaccccggggcaagcagcggaaggtcccaggtgaacggcggtccccagaggtctgtttctcctctggaccttaatgaccaggctcccagccaggagccgcggctggggcgaggggagagtgatttcagcgctctctgccccgaagcaggaaccgaaggccagccggtgggcacccagcgtgagctccaggcacatctggacacctatgctttgcccgagttgcttttctcagaggctgcagtcacagggaaaagttgtgacggtctttcctgctattcccgttcgtcctctttcgcctccgtttttgttcccatgtcttcctgtactccgggtttttcttctgaggtggtctgggacaatctggatgggtctccggctttaacaccccggagccagacagcttgcaaaatgctctctggtggagggagacttcactccatcctcttttcctccttttcaacgatttaaatccaggaaaaaatcgcagccccgcccttcagcactggggtggtttggaggtgtcgcctgccacctcctggcagacgccactgtgacagctacgccaccacaaaaggcgcgggagcgtggccaacatcctgacaatgttcgtctctcggccaagcagtgtttccttgtcaaatgtggctcgttttttattcctgtttactggggaaatggtgacagaacaatgtcagactcaaaactgagaattcaaggtagtgattttccagaatcactcagcaaatacaaccatctgttcccctgtattcactgaagaaaggacaatttgcctccctcctgcacccccctcgtccctactaaattatacccatgaatatataaagtgaactgaaggcaccgtggctataagccacggactctaaagcaaagggatgtaaatttcttttccctctcacacccaggtaaaatgggcttagaattacttgtcagtgttggccgggcactgtggctcacgcctgtaacccagcactttgggaggccgaggcgggtggatcacgaggtcaggagatcaagaccatccggctaacatggtgaaaccccgtctctactaaaaatacaaaaaattagccgggcgcagtgctcacgcctgtaatcccagcactttgggaggccaaggcggcggatcacaaggtcaggagtcgagaccgtcctggctaacacggtgaaatcctttcttcactaaaaaaacacacaaaatagccaggcttggtggcaggtgctactcgggaggctgaggcaggagaatggcgggaacccggaggcagagcttgcagtgagccgagatcgcgccactgcactccagcctgggcgacagatgagattccgtctcaaaaaaaaaaaaaaaaattactttccagtgtttacattgcttttttaaacaaggacaaggtaatacatggtttattctttcactgttattttgtaacgagtcaggggagtataacccggggaacaaatcccacgagattggttttaggctggaaagatgtgagttccttttcgtgactcctgctgcttgagcactgtcctgaggtgtctggggagactggaggggatggatttgcattctccaggccgcctttccgcctgtcctctctgcaccagcctttggagcagtgttggggggacacttgcattgcccattcatgtggagctctgggcaggcccagccacagtggggctccagagcagatgttcaaatattcagatgtcagcctgggaggacacttccctgcaaacacccctcccccaggggagagcaatcccaacctgccccttggcacgtgatcatgcttggtcatttggttttactaggaagagggagtttgactaggaagttgggggagagaagagaaagaaggtttctcctgggcacaccagcaacacacttgacctccctggagtggcagtgtccaaaccattacgggagccgctgggcagaggggtgtggggaaacgcttcctggttgtcttcaactccaactctgtgtggctgcaaaagcagtgctttttttttttttttttagacggagtctcgctctgtcgcccaggctggcgtgcagtggcgcgatctcggctcactgaagctccgcctcccgggttcacgccattctcctgcctcagcctcccgagtagcacctgcaccacgcctggctaattttgtgtatttttttagtgaagacaggatttcaccgtgttagcaggacggtctcgatctcctgaccttgtgatccgccgccttggcctcccaaagtgctgggttacaggcgtgagccactgtgcccggcctcccgaggtgctgggattacaggcgtgagccctgcgcccggcctcccgaggtgctgggattacaggcgtgagccaccgcacctggccagcgtgcttaagagtcccatattccacccacccaccccatccccacagttccttatagatacttgatgaccatcagcacttgccctgacaccctggctacatcctggtttggccgctagtagtaaagatccagcttgccctgggccctggaggggctgagagaacagaagggtcctgccgtgtattgtgggcgttcattctcagaaccttggcctctaaacattgggggatgagacgtagtaggactaacacagggaaccaggaaacagtgacactttcctgacacatgcagggtgagctgccgattttgaaattcagttttccgcatagacttccgtctctgcaaagtcctcaaaaggtatctgcagaggtgccaagaaggtctgacatggcctgttgaattaagccgtttctatgatacataaacagtggctcagtgaagccctgaacaatctcaaagacagaccatctgagccagagcagagctgctggatgccatgagcgtagccctcagcttcctggtgttcccttagcacgtcctcgttaccaggccaaacgtgacaggtactgtgacacaccaacgacacaaaacacttactaacgtaatctgctgctcatagtttattttccaccaaccagtgatcagctgtgatgatgtggctgtgacctatagctggtgcttggcgattacaaacacccaccagctggtgggcaggcgcctccctgccaggatgatgcttcaggaactttctgggcacaaagtgcttcttgtggacaatttttaaaaacacacagagccacgtgggtcacctattgtcaccaagagaaaaagaacctcaaaatcagtgacgcgacaggaagaattcggacctgttctttctgaggaagtcttatttttcctgtaactgtatgacggcatcacaccttcctcctgaacgtgggggccaagtcactgactccgccagcctcccaccagtgtgctggtgtaggaggagctgcagacgtctcaagcagaagtcacttctgcgtcctcagtggtaactcctgtccctgctcaagtcctccccctcccccgcagctgtcttttcccttcgaaaagcaggatgcttgccgccatggccgagtgaggctgtccacaccaggcacaacggggatcagcagcctcttgccaccagtgctctcgccagctgcagggactccaggctcacgccgtaggtctccccgccaatcaccacagctgccgcgcctctgtccagtccgagtcgtaactctgaacctcaacatgaggcagccaatcttgatggctccggtttctacatcttcctcttcctcatacttgtgaaacttcatcactcgttgacacacacccagccatggtcactagctttattagacatctcagcctgggcataaaggccaagttgtcagccacatagacccgagtgtcagggggcaggtaattgggcacggtttcccatccagattattgataatgggcatccggaaatgtgcgcccatacccgcccggagcactttggctcccaggcatccacacagcctggaaaataaaaaggaaacaatcaagatgttacaaatttcccagaccaggggactgtggagtaagtctgatcaattttggatcaggagataaaccattcttctatgatagctttcttgagggatgggaccttctgcctctctctgacagcatccacacagcgactataggagtcactcctgctagtgctgaagatattttatgcatcccttcaaatctcccattcacacgtgccagacactgcgcagaagatgcaaagataatgaaagtccccaccccaaggaacgcacagtgtagtggggtggtattaaacagatggctacagtatcagtactgatgtaaaagaagcacccacacagtcatagaaaacccacggacaaagcagggcgatgggaaaaccatctaaaagaccaccacactgagataaaggcccaggcagaggacagagctagagaggaagcgggagagtggcgcagcctaaggactgcaagcatggtgagccggccaatcgcggtggcgctgtggcggcacaggaggtgagccagccaatcagccggtgggggtgtggtgcacagttgaggtggccaatcagcgggtggggggggggtgtggtggcacaggaggtgagtggccaatcagcgggtgggggtgtggtggcacaggtgagcctgccaatcactggtggtgtgtggcggcacagggggtgagccggccaatcagcggtggcgctgtggcggcacaggagggagccagccaatcagccggtgggggtgtggtggcacagttgaggtggccaatcagcggggggggggtgtggtggcacaggaggtgagctggccaatcagcgggtgggggtgtggtggccaggtgagcctgccaatcactggtggtgctgtggcggcacagggggtgagccggccaatagcggtggcgctgtggcggcacaggaggtgagccagccaatcagcgggtgggggtgtggggcacaggcagtgagccggtcaatcagcgctggggctgtagtggcacaggaggtgggagtgggcaggccaacacggaggaggcctcctatgggaagctgaggagtttggcattttatcgaagacagtatcatgccattgagggatcttaagcaaagcagtgacagaatcagatctatgtttcatcaagacccattgggcttcaacgttcagtctgcaccggagcagggaacactctgagatgaggcaatgaggcaagaggcaaccccggcagcagcctgcgacgcctggcctttccaggggcggctcctcaccacgggcgggctgggagagtggccgagggtggggcctcgcaggactgcatggcctcccaccctcccccgcacagcttgttagcgcaagtcttctcctgacggttattttagaagttcatttgtcaaacctcgggatagacgaaccaggcaaaccagatttaaacggagaataagacacagaggatgtaacagcgcctgcacccccagccacgggctttcctctccctgcaggaaaccagagataggcccaggcgtgtgagaggagcggccgaggctgaccctctgcctggaggggagaagggaaaggggaaaggcgagactcctcccgtcatcctcagtcctggatactgggcaccacaccaagtatttcctaccttctttccctatttcttacacccagccatcagtatcaatgtgaaaaccacaatgcttggattatttagatttatttccaatcccacaacagctatcagagcactaaataatggggcgagtaagcgggtactgatcacagaccccagcacgtagctctcacactggcacagaaacgtattctagcaaggcgtgactgagaagagctgcgagcagcaatttaggcaagtctcaacaacgggtgccactattagtttactttaatggtggctggggtgtttctgatgaatggtactctctgtcccctccacctcccaagtgtaagagacattttaggcgtgctccaactgtgaggaaagtctgtttagagccaagcctttaatccctatttctgatgagaagagacagaaatgtaatgaggcgaatttgtgtgcgggcatgtgacccacgctgaggctaagggaatctaagggaaacggatcacaatgacattaggttcagagctgctgacgtcattcctttcataggattcagaagtcaagactcaggaatggccatatactcagcaatttgggaactcaatatcattacataaagaaccagaaaccaagtgtaaaattggcatctatttcttttccataatcgatgtgaagttctctaacagcctagcaggttcatgataattttaaaagataataaacatggctgggtatggcggctaatgcctataattcagcactttgacaggccgaggcaggaggatcccttgagcttaggagttccagattagctgggcaacacagcaagaccccgtctctacaaaaaacataatttttaaaaaagagaatcacattgactgaattactcgtgaggcaggtaaggtatgaagtaacttctgtgcatcatctccttaatcctcacagtgaccagggagattctgttattcctcccagttcaccaacgaggaactgacacttcagggactactgctcagggaccacagctagtgaaggcagacccatccaaaccgtgtctgcctgcccagagccctagctcacctaacaatggtcgacttggctgggcgtgttattcatgcctgtcattccagctactgctcagggaccacagctagtgaaggcagacccagatccaatgcatgtctgcctgcccagagccatagctcacctaacagtgattgacttggtgggcatagttgttcatgcctataattccagcactttgggagactgaggcaggaggactcttgagtcagagccagttcaacaccagcctgggcaacatagtgagaccccatctctttataaaaaaaaaaaaaaaaaaaaagaccagaccaactaatccacctggtttattattttttgagagggagtctcactctgtcgcccaggctggagtgcagtgatgagctcacttgacatggatgagctttgacatcccaggctcaagcaatcctcccacctcagcctcccaagttgctggactgagtacaggcacaccccaccacacccaactaattgtagttttttttgtagagatgggtctcactatgttgcccaggatggtcctgaactcctgggctcaagtgaccctcctgcccggcctcccaaagggctggattacgagtgtgagccactatgcctggcctttgatgtcctacctttggtgagtaacactttgctgcagcctgccccagctgcagatctcagaattgtcccaggttcccagggtcacggagattgtcacaaatcaataataaaggcagtgaatgctgaactgagtctttggatatgtcatcttaacatggtcaggcttggcaaaaatccctgaggaaaaaaacaggtggtttacttgcctggtgtgggcacggggaatagtctgacttttcatttactatcaatcttgatatggtcttagttacataaaaatacaggaatacaggccaggtgtactgctcatgcctgtaatcccaacacttcgggaggccaaggcgggtggatcacctgaggtcagagtccgagaccagcctggccaacgtggcaaaacctcgtctctactaaaaacacaaagatagccaggcgtggtggcgcatgcctctagtcccagctacctgggaggctgaggcaggagatcgcttgaatctgggaggtggaggttgtggtgagccaagatcacgccactgcactccacctgggcgacacagtgagactccctctcaaaaagaaaaaaaaggaaaaaaaaaaccacgatacattctgattggcaaaattcaaacaacataaaattctaccagtaccactctcctcccctcaactgttctgttttggagtgtatccttttagaacttgttctatgcatctacctattatatgcacacctgtccatatgtaaatgtgttttacattccgtgtcatactctgtattatctgtaatcgacttatttacgcaacaatatatcttgaacttaccatgtcaatatgtttgagctacttttttcctttaactgctgtaggctatttttttttgagacagagtcccactcttcactctgttgcccaggctggagtacaatggtgtaatgctggctcactgcaacctctgctcccgggtttaagcaattctcctgcctctcagcctcccaagtagctgggattacaggcaccgcaaccacacccggctaattttttgtatttttaatagagacgggattttgccatgttgccaggctggtctcgaactcctgacctcaggtgatccaccctcctcggcctcccaaagtctgggattacagttgtgagccaccatgcccagcctctattttgtagtatgaatgtaccaagttcatttagctcttcccctatggactgttaaattatttgaatttttccctgttacaatgctgctgcaatgggtatccctgtaggactgtctgtccatgtgtctaaaaatttctctacataaatacctgtgagtgaaatggacaaatgatgtgcgtgcactattaacgttcacacagctctttcagtttattcacatcaggaactcataaatacctgttttcggctgggcgcagtgctcatgcctataatcccagcactttgggaggctgaggtgggcggatcacaaggtcagggtttgagaccagcctgaacaacatggtgaaaccccgtctctaataaaaatacaaaaattggccaggcacggtagctcatgcctgtaatcccagcatgttgggaggctgaggtgggcggtcatgaggttaggagatcaagatcatcctggctaatacggtgaaaccctgtctctactaaaataacaaaaaaattagccgggcgtggtgacgggcgcctgtagtcccagctactcgggggctgaggcaggagaatggtgtgaacccgggaggcggaccttgcaatgagcggagatcagccactacactcccgcctgggcgacagatcgagacttcgtctcaaacaaacaaacaaaaacaaaaattagccaggcatggtggcgcatgcctgtaatcccagctactcaggaggctgagcaagagaattgcttgaacccaggaggtggaggttgcagtgaggcaagatcgcgccactcattccggcctgggcaacagagacactatctcaaaaacaaaaaacaaaacaaaacaaaactgttttccagctcaaacccttcttaaaagcgggtctatcatttgtttccatttgtcccatgtgatagaaaaaacagcatgccattattttaacttgccttttctctgattactagagagctaaacaccttactgactgactgcgatcttcttcagtgaattcctgtgctcctttaatgtcttgtttctacaacctgtgcccatcttcctaccaggtaggcttttaaaaaatagttataggcttaaatatttaaaaaacaattattagcctgctatactgatttatctttccttttcactcattttaaaattcaaactacattcctaggaaaaagaatatgaatttcaaaacttaatgcatcaaagtaacaacccctttttcaaatacgctggctcagaagcactgtcttaggacatactctgcaaaacgaaggggctgtaggtgcagtgaacgcttgagtcacttccaaggctcacgctggaggtccagaagcctgggagctttagaatgggtacagccacttactggcgccgctctgtcctcagtctaatacaaaggagtaaaatggggtctgggactatctgggaaatgaaaaccctaagtggccttcttagtggaaaattctctccttatttaatgatctctacagataaaattatatatacattatataataatctacattatataatctctacattattaattctaaagttttatggaaagaatttatgggaaaagagaaaaattggaaaaaggctaataaaatattaaaaatggctttgagtacatgaaattgctgtggtatagatgaagttattcacagggtgtatcacatatccacaagtttctttttgaatcaccatgtttactggtagaggtgaaatgataaccttttagtaagcttttttttttaagccaagcactaccctaaactctttattataattatcaaatattcaatccctttgtagtctgctcccaagggactgtacagttttttgaatcttactagtattttgtcgtatatgattgctacaataaatgggctactgactgaatcaggagatgaatgaaatagtacttgtactgaaacatgatacaatcaaagatttaggatctttctaaaagatggtgcaggtaaaaagcctatccaccactgaaggcaatggaagggtataggcgtctgtgtgctgtgagagagcctccacttcggagtcacagatggccaaaagccatcagtagggctgaggaccttagaagtcctttacttctacttggatgtctgtggtgatgaaacccactatacggaggccctacttatgtcgctggattctggggagtgtctgtctaaagctgacaggtgctgccagttcctatccatttctcccttattccctgccctcaaatctaaatatagtaacataaggataagccaggaaatgatgaaagcaggtatgatgatgaagttcaaatgggttggccactgtaagcacacctgccccaagtgacaagcacaagttcaagatgggcggccactgtgagcacacctgccccaagtgacaagcacaagttcaagatgggctggccacgtgagcacacctgccccaagtgacaagcacggtaaaaatgaataacactttcactgaagatggcgtgtggattagagggctgtagctagtgagaatatggttacttagcatgagtaatctaggtactttagtaatccaagtccccatcctaggatctaagagctctgagtgcagaggacagatccctgtgactcactgggttacagagacaagagatggttccccagaatctcctcctcagcagttcaaggattcagttttcatatcttaaaactcccatgtcaaaaacgtatgaaaacttatcttctcatatttagaccaaagactttgtaactgctaatcaacatcggagttcataaggttaagtcagattcagccaaatgaaggaacagactagaagacaaggttctctgttattgggctaaacggggcagtaaattgtggcttgtacctcgcttcttagatctgcttcggaataagcagtttattgacagttatcaccacattggcagaggttttgcaaaaatgaaggctcaatctttcagtaaacgctttcttaatttttaatctgacatagaaagttgaagaagaatctaaaaaatagaaggtttgaggaatagtggttcttcctagagaccataaagagccaaacacaaatgatagtgaaaaacgggtttcaatttccattgaaaatactctaagatacacggtttgagaattatatttttctaattgtaacattttgaatttcatttcaatgctgctgtctaagacaagtatgagaaattaatcctaggtctccacaccttaagatacactgtgtaagccaggcatggtggctcacgcctgtaatcccagcactttgggaggccgaggcaggaggatacctgaggtcacaagttcgacgtcagcctggccaacatggtgaaaccccacctctactaaaatacaaaaatcacccgggcatggtggcagacgcctgtaatcccagctactgcggaggtgaggcaagagaatcccttgaacccgagaggcggaggttgcagtgggccgagatcgcgcattgcactccagcctgggtgacagaacaagacaaaaaaaaaaaaagatacactgggtaacactaacccattattccttgtggcgttacgaggtcggaccaatccttgatatcctcaaattcaccttaatgaggctgacacctttcagcttatcgactggcaactcctttaggtattcagacggctaaagaagaacatttttggcacagctccagccttgagagcgtctgaaatgagctgcgaccttccagcaggatcttcccttgtttttcccgaaatggcctggactttactatgtcattacactgctgtagatggaaataaaaaaaaaaacaggtaactatcaacatccttgtactgagacacgcttagttgtaacagaaataaagagctacggagagggccgggcgcggtgctcacgcctgtaatcccagcacattgggaggccgaggcgggcggatcacctgaggtcagagttccagatcagcctggccaacatggtgaaacaaaaacaacaacaaagagctaaggaaaacagaagctaattccaaagacgcttattcggccctctgtgcataatacaaaaaccaggggctgtactggaagaagtcctccatcggaaggaggttaaggttccgctgtgcgacgggagggaaacgagaacattcgacaggctcaagaaccacatcacctcagcctcctgtccccggataagctttatcgtagcgaagcccagactcttcccaggtgctgggagcgcgggatgcgactcctcgagcggttgtttctctcgttgctcctgggcactggcctcagatggtgccttgggggctgcttcccaggagcgcgcttctgttccaccacctctccggaaggaaacaccacttcactgggctccgccgcagcgcccggacccagcgcctcgcgtcaaggtcccaagcctggccacctgcagcaacggtcgcacgacaaacctcgcgggtctcaccagcgccgccatgttcctgagacccgggctgcgtcacgaaagcgcgccgtcggcggctagtgacgtcacggcccgggcgcccttcgtggactgggctgtacggtgcgcgtgacggctgcgtgcggcgggaatcaggctgctcgcagagctctgcacttcgtattcaaagtgggaaaccgcttccagacggcgctttctatcgggacgtcctggggatgaaggtgcaggccggggccgacaggggctggcgcggaggctggaaccggcgcccgagccggccctggcggagggaggggaaaatgggtgtgtcggaacctaagccggagggtgtccgaccttaggccctgcgcggtgttcagcttcaggagcgggcgagttgccgttggggatcataggccttggagaagggcctaacacgattagtccccgggtgtgcccacgcacgtcctttcatttaagccactcgtaaacgtttattgagccccgccttgtggagcttaccgtctaccggaaaagacggtaaataaaatgttatataatgctttctgttaatatttgtgttttccggtttggagcctttgatgtagataaaatcagcgtattcaggttctgcttctagcaaggctggtctgaatagtccgtttcggatactcagtctctgaataatgctccaactctcaacccatctgcttttcaacagcacccagaagcggtctgtctcgggcctgaggagctgttatttgcaggattcagttggttggggaactgggttttggggacctctttgataagccagggaggtagggaacacaccactaaggaagacttgaaaggtgcaagaggcggtttagtgtatagacggtgcaatagacggggatctgaattcgtcaggtcatttttaaatatctgctattttcagggtactacgttgagttttggcaacaaaggtgcaaatgacccgatatatatcctccattagagctcatggcctgggttggggtgggagttggaactggattgtacgtagatgatggtaatggaagtcagaatttgatagtgaaaaaccaccaaactttcgtagcagaaaccacagagctgtcccttgttagtatttcctcgtcgatcaaaaggttgttgaaagattaaacacgtgccggcgcggtggcccacgcctgtaatctcagcactttgggaggcaaggcgggtggatcactggaggtcaggagttggacaccagcctggccaacatggtgaaccctgtctctactaaaaatacaaaaattagccgggcatggtggcacacgcctgtaatccagctactcgggaggctgaggcaagagaatcgcctgtatctgggaggcggaggttgcagtagccgagatcgcaccattgtgttccagcctggatgacgaaagcaaaactccgtctcaaaaaaaaaaaaaaaaaaagattcaacaccttattatatgtatagtatttaacatatcggtatagtagattatataagtgttagccactattataaaaatacaaaagaaggagcggttttcaacctgggtgatgaggaaataattcatgtagaccttgtattcgagttgactttttttttttttttttttttgaggtggagtcttgctctgtcgccaggctggagtgcagtggcgcgattcggctcactgtaagctcagcctcccgggttcacaccattctcctgcctcagcctcccggtagctgggaccacaggcgcgtaccacaacacccggctaatttttaaaaatatttttagagagacggggtttcaccgtgttagccaggattcgagttgacgtctaaagataggatatcacaggtagatgagaggaggagctacatagtaaaactgaagagccagtgcggagatggcaatgtttgcgaagccgctggttttatgtgcctttagttgaggttgcttagttgaagttaagagatgggatatcaggatggacaggtcggcattgcttctaatagtatcttgaatgctatctaaagaatttggattttatgctgcagtaagatgggagctcacttatgttcttaaacaggtggtgatgggatcagtgctttgtgctttaggcatgtgcttttttggtgttattaaggaggatatcaataaggatttttttattttttattttttattttttttatgttgagacggagctcgctctttcgcccaggctggagtgcagtggcgcaatctcggctcactgcaagctccgctcctgggttcacaccattctcctgcctcagcctcccgagtagctggtactacaggcgccgccaccacgccctgcttattttttgtatttttagtagagatggggttttactgtgttaccaggatggtctcgatctcctgacctcatgatccacccacctcggcctcccaaagtgctggattacaggcgtgagccaccgcgcccggccaataaggatgatttttaatagtctgagcaagcgttgggaacttcaactggcaggagccgtgggaatcaaaaaggagggctaaagctacacgttgagagcccgctgtgtgcagggttctgtgagatgctttcataacatccattccctcacatgttaggagactgagactcagattctaatttgctcagagttacacaactactaatgacagaattccaaatcagacttttttttttttttgagtttgagttttgctcttgtcaccaggctggagtgtaatggtgcaatctcagctcattgcaacctctgcctcccgtgttcaacaattctcctacctcagcctcctgagtagctgggattacaagcgcccaccaccatgcctgctaattttgtattttttatatttttagtagagatggggtttcactgtgttggctaggcggtctcgaactcccgacctcaggtgatctgcccacctcagcctcccaaagtgctgggatacaggcgtgagccacgatgcccatctttttttttttttttttttttttttttaatttgaatggaattttgctcttgtcacccaggctgtagtgcaggggcacgatctcggctcactgcacctccatctcatggtccaagtgattctcctgcctcaacctcctgagtagctgggatcaaagcacacgccaccacgcctggctaatttttgtatttttagttgagacggggtttcacttgtttgccaggttgatcttgaactcctgacctcaggcagtccacccaccttgatctcccaagtgctggtattataggcgtgagtcactgtgcccggcccaaatcagacttctttaatgtgaaggccacactttttcccactgcatagcactgcttaccaatctaaatagatttcacactgatttggtagcctgacccttggtgtcaagctgttcgtccttccactgcttctatcctggagaagtgtaaagctcatttgcttttgttcttttacaagtaaagcttataaatgataagtttgtgttttgacattttagtctgtgctaaagacgctgtgagcagtactagcaacactcacaatttattctaaatctcacaccaggttctgcggcatgaggaatttgaagaaggctgaaagctgcctgtaatgggtatgataccttgtttcttaaaatctcctttaggctctgactcacccggataacagaagacagtttctcaaagtgagtataaagcagtggaattaattaagaggcagtaaattagggaggcaacttcaggagcgtcgggaacacatactgtttctctgcatctcatgagtataaagcagtggaattaattaagaaggcagtaaattagggaggcaacttaggagcgtcgggaacacatttctctgcactctcatacaacacctgtgggacacaaagggttctccagctctctaacaccagccggctgtcctgttatttaattgattctgactctaccggagttaatgtcagatcctgcaagttaagggctcagtcccagaagattttccgccacgtaggcgccggtcacagtctggatcttcaggatttccgatgaccaactacaagtcagggctccgctcctgcttccttgggtttgatagtctgctacagtggctcatggaactaagggaaagctggaaacacttacttacatttactggtttatcataaagagtacgagtcagaaatggcggacagaggagatacacagggcagggcatggggagtgggtggcagagcttccatgctctctgggcaggctccaatccagcacctccctacgttcagcatcccagaagctcatgagtctattgttcaagcctaatagagcccagtctccatccctttccttcccagaggttggtggatggactgaaagttcagtcctctaatcatttgtctttctggtgaccagccccatcctgagttatgtagaggccccactctaagtcacttcattagcataaactcaggtgtgactgaaagggctcattatgaatataacaaaagatattcctatcaggaaattccagaggttttgggagcctgagacaggaaccagggacaatgaccagatatgtttcatattatgccacaaatgcaaaaagtacatgctctagatgaagcagcggctttccagtatctttttttttttgagacagaactcactttgtcacccaggtgggagtgcggggtcattatcctggctcactgcaacctctgcttctgagttcaagcaattctcctccctcagcctccctagtacgtgggactatgggcattgccaccatgcccagctaatttttgtatttttagtagagacggggtttcaccatgttggcaggctggtctcgaactcctgacctcaggtgatcctcccgcctcggcctcccaaagtgcgggattacaggcctgagccaccacgcccgtccatctcttaagcttagtaccgtgacaagtggaacagtccaaggcctattaggaatttcatgcttgttgattgatagtcaaggaaatacaggtcagttggagaactgtctttaggattctgttccttgctttacagaaaaggtgaacaatctttccttcaggtagatgctggatagtctttggagcttgtagtagggtcccatgagactgcccacagctgctttctgtaccatctgaggtcatctcatccttaagagaacttttagaccagacaggaatgctcatctctctgtgcccagtagttctctgggggtggcctgaggcgacttgtctgtagtcactgagttcatttacttttattttctaggccttatgatgggaaaggagtaaaacaatggtgggatttgggcctgaggatgatcattttgtcgcagaactgactacaattatggcgtcggagactacaagcttggcaatgactttatggtaaataccgttttttctagcagagttttggctgggggtaggtggctggttgtaaatttgagtagagtgccaaggtgtgtgtgagtgaagagataacatttgagcagagactcaaaagaggtcagggagttagcacgtggatatctgggggatgcgcgttccaggcagagaatattctggcaagagccgtcagtaacatctggcgtgttcgaggaggtgtaaggaagccagtgtggctggaatagagaacggaggggagcgtggtaagagatggggtcggcagtgccatggggtaagactgcagggggcccctaggccgtaagtcaccgagtgaaatgagccattggcggactttgagcaaagggaaaaaaggctggctgcagtctgggggtggactataggatgcgttttggaaagtttactttggcgcagagtgggtaatggatttacaagactggaggcagagaggccattataataaaccgagcagaaacaaggctggtcttc

SEQ ID NO: 5062 - DNA, 20642 bp, Homo sapiens
caaattaggagtcagtttctttttctttttaaacactgaaactcacactcaacgcagtggaggttcattagggagtggaacatgatggagacaggtgaaagccattctcagttggggccagggagagcagcgccagctgcacaggcagctgaagccatccccgccaagcatggatggggtcaccacactcctggaaacggcacgcccgcccacgggaaatgcagacaacagcaacaggaaacaaaaaggcacctggagaaacaggccatacctgcgaactctccagttcccagtcggatatcgtgtctaattttcttctcctgttcttcattcatatatgggattccgtttttggaaacttaagacagaaacagaacaacaaacagaacaaggagacaagtcagagggatccttgtgcctgatttcacgaggacaggtagaaaggggaaaggagacgggctgtataagccagtcgtctagatcacttgtaagacattcccaggccgggtgcggtggctcatgcctataacccagcactttgggaggccgaggcaggtggattgcctgaggctaggagttcaagaccagccgaccaacatggtgaaaccccgtctctactaaaaatacaaaaagaattagctgggcatggggcgggtgcctgtaatcccagctacttgggaggctgaagcaggaaaatcacttgaacccggaggcgaagattgcaccactgcactccagcctgggcaacagagcgagactccatctcaaaacaaacaaaagacattcccgttcccctcctccaatgccataccttgttatagttgaaccatactgattcaaaaactgaacactggaagcctggaaggagaattctgagtccaaaatccaaacgttgtagggaagagatagaagttacaagaatgggctatatacctataataaaaaaacatacagagaaaaagccacaaccatttaaaaaactctggctcccagggctggcttcgggtgggctctttcttttaggcaagaagaatctgagtgtgcccgagtgtctgctgtgttcaggagctatgattggcactgggggtgctaaatgaaaaaggcagagagcctgccttcaggccagcgtataccacagagacagcccctccacaagctgcccagggatgccaggttaggggtgcaggctggcaccctcaactgctcatggggggtggggaggcatcctgatagttggggatcctttctgcctactgtgtcaggtagtttaaacatcactttcattacaccacactgtgcaggcgcttttattaatataggtgcacactggagacaatggaaatggggaaaggagcactaaggtacagagcaaggctggcgggaaaggtactgcttccagagagacatcaaagacaactggaatccgcagagggcagagtgagtggaggaacagacacaggagagaatacggaagaccagggcaaaagtgatcggggcacctgaggcagaatttgaaggtggcagctgtggaacaaggtgggaagcacctatgtttgcagaagctcttgatacgtacttgtttgcctctccttcatagcggaaaacacagacaatcctggaagaatgaccgtagagggaatgaatgccaaggaaagcaacctgaatttcactacaaagacaaaaacaactcaaacagtactttgcgcccacaatactatgtgggctgtacaacaggataacatctttaatgacaaaaaagaaaagacagacggaagcatgagaaatgtcaaattgtaattcacactgaatttgctaaaatctaattgtggctgttcttcaaatacagaagtaaatattaaaatgacattctcatagttttaaaactatcacagaaaataccaaaaaccattaagatttatatatttaactcatttaaaatgtctattctcccccctcaaagaaaaccatatgcaaagttaaaaaaaaaaaagacttcaggccaggtgggtggcttatgcctgtaatcccaacactttgggagacctaggcaggtggatcacttgagtcaggaattcgagaccagcctgaccaacatggtgaaaccctgtctctactaaaaatacaaaattagctaggtgtggtggcgcgcacctgtaatcccagctactcaggaggctgaggcagagaattgcttgggcctgggaggcaagggtgttgcagggagccaagatcgtgcccctgcctccagcctgggcaacagagcaagactctgtcccccttccccccaaccaaatttgggtaaacaatggaaacataactacaactgtttcctatacttctcaaagaggtcttataattaaaacaaacaaacgaacaaaaaaaaaaccataacagaaaagtagcaaaggatcaggatagaaggaaaacacacacacgttcagcatcattcatagtaaaagcaggggctgggcgtggcagactcccagctacttcagaagctgagactggaggatctccagagcccaaaagtttgagccagcctgggcaacacagcaaaaacccaatggtgcgggagagggcacagacaaacccagaaagtaaaatctggcccagggtctgtttctgtaaatacaataacattttactggaatggagcatgctcatttgttcatgtattctctacagctaatttcacattacaaaagcaggattgatagctgtaaaagaaacagcattacgcaaccgttaacagctctgtcttgaccagcctggcaacatggtgaaaccccatcgctactaaaaatacaaaaattagccaggcctggtggcaatgcctgtaatcccagctgctctggaggctgaggcaggagaatcacccgaacctgggtggtgaggttgcggtgagcccacatcgcgctactgcactccagcctgggcaacagagcgagacccatctcagaaaataaactaataactaaatcaacaaatagatctgtatgaaccgatacaaaagatctccaaatcccatcaaggaaaaaaaaaaagtttctgaaactgagatgaccttaaaaaattatttttgtgtgtaaattttcttaagaaaaaaaaatcacaggccaggtgtggtgctcacgcttataattccatcactttgagaggcagaggcagaaagattgctcgagcccagaagtcaagaccagcctgggcaacatgacgaaaacccatctgaacaaaaaatttaaaaatagctaggtgtggtggtgagcctgtagtcccagtttactcaggaggctgacgtgctagttcacttgagcccaggaagtctaggctgcagtgagctaagactatgctactgcactccagcttggtgacagagcaagaccctgtctcaaaaaataaaataaaaatcgcacacacacagtttacttgaaagagtaacagtgagtgttccttaatactgacttatttaagcacggaaacatgctgctaaatttggtttgctccgaagtgttgatttccatatgtatacaatggcccaaccaaaacaagcatacaaaacgatactcaatatccttgaaaaatctcagagctgtttttacgtaggaaatccaaggacaataaaaataccttcttgaaaaactctaacagctgatattaactcaccaatctgacagactgtaaattgctgaacactctgacgggtctttagataccactcgatggcaaatcaaaaagactgtgaacaaacaggcatctcattccacgagcaatgacatccatcccggcactatggcctccgcggcaggaccaccactcgcaaccggggaggatttttccttgttacaacaactagggagcactaccatcatttagtggacagaaaaaagcaaggtctccaacacgtaggagcaagccacacaaaacgtcctgccccccaaatgccaacaggctgcggccagaaacagtgctggtctggccaggctcttatacagaggggacacagctttagtttacctgatctgctggggcccagacaggttagaacgaaggcccgtgaactctatgtccagactgccaggaaggcaaaaaatagcagtcctcgggtgcagaacatcgccagcactcctcacctgtagatctgcaggcggccaaggcacccgcgctcacctctgcgctcaagccaagtgagtcaggaagggaaaatggaggaaccaaggcaaggagcagccaggcacctgggcgcacgggctctggccaacaagggacgtggggctcggagtgtacttgctgctcaaagtcccaccgcccggggctggagaaggaagcccccctgtccttcccgaggccctctctgaggccctgtggctggcaaccgtcccgccaccccctccccaagctcgcccggggcaaggggctctgtccggccagccgcgaatcccaggctcttcacccacgaagtcggcctcctggacgagctcctgcagagagggaggctctcctcgaactcgtcggcgcccacgtccatggccgtgcagctccgcgggtcgcccagcgctatcacgtgctgcccacgtgctgcccacgcgcttccgtcgcgccgccggtcttaaagggcgcacacatggaaaccaggcagctgcctccgccccacgtgcccagctccccgtgtgctgctggcgtcgcccacacctgcctgcgggtgttttaattgtacgatttgtacagaggtttgattgcaattgcaatcaaagcctgtttacctggctcctcagcaatttcttgcagcccttaacgtgagaatgtcatttacatggacttagaatgttaagaggcgtggcggagacgaagacagagtccagaaagggtgaaatcagaaaagcggagcaggaacaacaccgacgcaactgcaataagcagatcctttgctgcggctcacggtcttctaaatcacctcttccaacttctccatcactgccagtatgtctgtccccattccctctcccacgcccctggactctttttcctcattctgctgtccaccttaccactgtcttcacacctgcaatcaaactttcaaagcctcaagaactgcccattaaattgaaggaatccttggtccccagggattatctctgcactcactccttgcggaaatccctacctacaccatcacatacatgtgagcttaattttacttttgttactgtttccagtgcaactagtccatggtcttccttacagtgtcctccctgaattctaggcttctacttgaacagcgttttggaactatggtcctcaaagtgaggtgctaaatcaatctttaaggttagcggagaaaacattaccgttatacttttttattttttcctttgagacagtctcactctgtcacccaggctggagtgcagtggtgccatctcggctctctcaatctccacctcctgagttcaagcgattctcccgcctcagcctctgaacagctgggatacaggcatgcaccaccacgcccaactcatttttgtttttagtagagatagggttaaacctattggccaggctggtctcgaattcctggcctcaagtgatccacctgcttcagcctcctaagtggtgggattagaggtgtgaggcactgcatccgatcttcaattatacttttaaatgctctccgggacattaattaagcaaaaggggactattaagccatttgattctgaagaccttcagaacaaatcatacttcatacagatgtgttccatttaaaataacacattgaatactcaattggcagaagtaacatatttcacttctaaacaaacatttaattggggtatacattaaaaaactggaaaacaatgctctagaagccaccttaactgcctacaggttttttctcacattatcaaatagccaaaaattaacaccttaatcagctcctttcagagaactgccatgattccatctacccaagctcaaattttagattaacttgcatgcatttcaagtttcatctcctattaataaaatgttcacttcatggcaaattgagcgcccactaaccccaaccatttccaccttgctttcagctcctgatgccacctccttcctctttcaaatttgtttctcttactgttggaaccaagagtccaagtgaggttggcatttggtcctttcattttcacatactgactgttcataatattagattgatactgacatttcctattttaaaaaacaccccacactccgagcagaaacaactgtcattcactgagatcactcgccatgaactagacacagtaataagtgctttcatcaacctcatatgtgctccactgccacagtgagctcagacaatgtcatataaccagaaataagagttcataatatgcctttattttgtaatttataaacaacttctgacttgcccttgaaagttaattataattgatgactgcttttcttagatgcttctgaagcccaagagagggcagaacgtagttcttgatttaaaaaaacagaaaggggaggaggatgaccttaactacaataatattccactgcaacattattgctgtaaaacttccaagctggctgttcttccagatctctcttttgatggctgtagtggctgacagatttatatttacatgttcaaaacaattaagcttccatttattcatagattctctgaggttcccgtagaaccacaccaccttctgtcatgcactttgtagtcgtttcatctggttttgaaaatcagaaaaaaaaggaaaagattaagtagcagcacgagtaggctgaaaatactttcaccttccaaaagacagaaataaattgatttttcttgctaacttcccagcctacaacagtttttcagaaagtgatcttaataatgatgtagtaaaaaggaaatgtagagatgtcaaggttcagcagcatttcaaaatattatatggacagatgtcaatatatgaacaggaaatacagtggctgacatcatggactacagaatcagtcacctgggtttgaaatccaccatacactgactctgggcaagtaagcctcagtttatttctgatagaatgagagtactagtccctaccctatggactgatgtgaggattaaatgaagtaacctgttgagtactcaccaaagggtctgacacatggaaagtatttggtaagtaaaaactgtattattatgtaagttatccaatgccaagaattaacacaataccttttcaataagtacataaaacaaaaataccgagtctgaggctgcctcccacggggttggttggtagaccatgaagtgattcccgcctctaagcatctctgtgccagcactcgtcctatactctcacaagccacccatttctggtactataaaggtgctttttaatagcccactcacgagtggaggccgaaacccaaccttgccattctgatgctccacaagtgcttctacatgatgctgagtccttataactgcaacctaaatggggtgagaagataataaaatcacagaagaatctgtatcctaaagttaattaattgaggtgaataaatgactaaatatttttcaacaatccagtgtttggttaatttacatatttaacttggattttgcttgggaaaagtatttttcctccgcctttatgagaatacctcaataataacaaactaaatagttcaagtatcatgaagaaatttgtttctgaagagcgagttttatttacagatctacttcaaagagatttgaagagacagagctaagttactgaaatatgcatgacatggatatacttactctttgcttttatttatagctagcaccaaaataatataagacggaacaaaaatttaaatgcaaaaactgaaatcataacagtactagaagaaacatgagaaatttttttataatctcaaggtatgcatatttaaatatgacatcaaaccatgcatatggcttttattatttttcagaaacagggtctcactgtcacccagctcggagtacacagtgcaaccacagctcactgtagcctcaaacccctaggctcaagcaactctcctgcctagtctcccaagtagttggcattacaggtgcatgccactgcaccaagataatttttatttgtagagacagggtctccctatgttgccaaggctggtgtcaaactcctggcctcaagcgaccacccttctcaacctcccaaagcactgggattacaggcatgagccactgtgtccagctcatatggccatttttttttttttttgagacagggtctgcctctgtctctcaggctagagacagaggcacgaacttggctcacagcagcctctgcctcctgggttcaagtcatccttcccctcaacctcccaagtggctgggactacaggcgcatgccactgcacccagctaattttttatttttttgtagagacagggtttgccatattgcccaggctcgtctcaaactcctaagccaagcagtctacccacctcagcctcctaatgtgctggggttacaggctgagccaccatgccagcccctcatatggcataaaaaagaaatgatggacaaaatttgctgcatggttaaaaaaaaaaaaaaaaaaaagtaaaatgaagtcaaaagaaaagcaatgaaacaaaaaatatttaggctgggcatgtgactcaagcttgtaatcccagcactttggaaggctgaggcaggaggctgctagagccaaggagttcaagaccagcccaggcaacacagtgacactctgtctctacaaaaatagaaaaaatcagccaggcgtgatggtgtgcacctgtagtcccagctacttgggggctgaggtgggaagattgtttgagcccaggaggttgtggctgcagtgagccgtgataagccctgcactccagcctgggtgacagagtgaaaccctgtcacaaaaatataaaaagaaaaatattttaaactcatatattgttcaaagagctaatttacacaatatgttaaaagcctctataattaacaagaaaatgatcaataacttgtggggaaaagcaagagatcagattgttatgtctgtgtagaaagaagtagacataggagactccattttgttctgtactaagaaaaatcttctgccttgagattctgttaatctatgaccttacccccaaccccctgctctctgaaaacgtgctgtgtcaaactcagggttaaatggattaagggttgtgcaagatgtgctttgttaacagatgcttgaaggcagcatgctcgttaagagtcatcaccactccctaatctcaagtcccagggacacaaacactgcggaaggccgcagggacctctgcctaggaaagccaggtatgtccaaggtttctccccatgtgatagactgaaatatggcctcgtgggaagggaaagaccgaccgtcccccagcctgacacccgtaaagggtctgtgctgaggaggattagtataagagaaggcatgcctcttgcacttgagacaagaggaaagcatctgtctcctgcctgtccctggcaatgcactgtctcggtataaaacccgattgtacgttccatctactgagttagggaaaaccgccttagggctggaggtgggacatgcgggcagcaatactgctttgtaaagcattgagtgtttatgtgtatgcatatctaaaagcacagcacttgattctttactttgtctatgatgaaagacctttgttcacatgtttgtctgctaatcctctccccactattgtcttgtgacccgacacatccccctctcagagaaacacccacgaatgatcaataaatactaagggaactcaaggctggcgggatcctccatatgctgaacgctggttccctgggtccccttatttctttcctatactttgtgtctttttcttttccaagtctctcgttccacctaacaagaaacacccaaggtgaggaggggcaacccaccccttcataacttaataggcaaagcattatccaaacagctgttcacagaaaagaaaaatattaatgactcaaattcacaaaaatatgctcaatctcataacaaaatgcatggacaagacaattcgatgcaacactgtaatcataaaagataatcacctctaggagcgagttaagtaaaatccatgcaatagtattccatacagttactgaaatgatgaaataatgctttataatgatgaagataatagttaacatttactgagcacttagtatagccaggcctgtcttaacggtttatagataaagcttatgtctcaattctattattttttcatatttttttttagctgcagaaactaacacagaaaggttaagtaacttgaaaaagattaaactagtaagtaatggagccatggtttaagtcccagtgtctggctccagagtcaatgctttaactaccatgaagaatctccaagatgtatttttaagtgcgtgcttggggtggttgaggtggtggtgaagaaagatgcggaagtgtttatcgtatgctaagatttattgtttttaacgtttttgcttatatgcatagacaatctttagaaggacacacaagaaactgtactcccttggattttataacatacgtatatgttaccctttaaaaagtcaagtttaagttaaagaaaaacacccaaatcattagattctcactaggattctcaatgtgaaatagaagaggcattagattggaaatatggagtctactcctggttttcctggtggctctagtaaaaaatcacaatcttttttttttttttgagacggagtctcagtctgttgcccaggctggagtgcagtggcgcgtctcggctcactgcaagctccgcctcccaggttcacgccactctcctgtctcagcctcctagtagctgggactacaggtgcctgccaccacgcctggctaatttttttgtgtatttttgtagagacggggtttcaccgtgttagccaggatggtcttgatctcctgacctcgtgatcgcccgcctcgacctcccaaagtgctgggattacaaacgtgagccaccgcgcccggccaaaatcacaatctgttaaaccaggagtcaacaatctttttccacaaagtgccagatagtaatattttaggctttctaggtccaatagcttctgttgaaactgttcgactcagccattgtatgctagaacagccaggtgatgcgtaaacaaatgagagtaggtacagctaggttctaagacctgggcaacgaaatttgattttcatttaattttcccaagccacaaaatattcttttgatttttttttaacttaaaaaaagtaaaaacaagtttttagctcacaatctacctttggccacgggccgtagtttgctgacacttgaaccatttgttcaatgaagggcccgattcattattcaaaggtcatttcctactataatattctgaaattctctacttttaatattgcgagtaagcagacagagaaaaaatgaggaaatacatctttagttatttttaatgatccaaatattaatcaaagtaatgcgttggggccgagtgcagtggctcacgtctgtaatcccagcaccttggaggctgaatcaggcagatctctcgagctcaagagctcgagaccagcctgggcagcagcaaaccccatctctacaaaaaataccagaaaaaaaaaaaaagaaaaagaaaaaaattagcggccatggtagtgtgtgcctgcagtcccagatgctcaggaagctgagatgggagaatcgttgagcctgggaggcagaggttgcagccagctgatactgtaccactgcactccagcctggtgatagagccagagcttgtctcaaacaaaacaaaacaaattagctgggagtaatggcagcgcctctagtcccagccactcaggaggctgaggtgggaagattgctggagcccagggagtcaaggatgcagtaagcagatatcataccactgcattctagcctgggcaacagacccaaccctgtctcaaaaacaaagaaaaaagaaagtaataggttgggtgtttcaaaagattttagccttaagatccagattatttaaaaagtgaactgcctactccctttcttggactccctctctatgagtaaaaatgtattacagcaactgtaacacatcattatccccattccactttcactatgaaacttaagacttttgatgacagggataacatctactttatctttgtaactctgcctctaacgcaatgcctagcaagtgatacaggtatgatgcttgttcaataaataaatatacatcacacagtaatgatttccaatttactcttacaactttacatagtacttaagaatccttaagaaattctaaaaaatcctcaccaagcagataagcagcagataaacctgataacacttacatgctgtagtatagtggtaataacctagcgtcctggctctgaggtcagttaaacatatgtaaatcttagctctggcacttactaatcatgtctccctaaacctcaatttcttgatcctgtaaaatgggggaaattataactgcttcatgatgtaattttaaggattaaatagaaaaaacatataaagcaagtagcataattcctggcaaatgtaagtgttcattaaacaccacctttataacaaagtatctcaagtcatactagactcctaactggtctttcttcaagcctgctccctcaaaaatttaatcttccaaaaagcagctaaaatgatttttttttttttggacagaattttgctctgtcgcccaggcgctcagctcactgcaacctccgcctcctgggtcaagtgattctcgtgcctcagccactggagtagctgggattacaggcgtgcaccaccaccccctctaatttttatatttttagtagagacggggtttcaccatgttggccaggttggttcaaactcctgacctcagatgatccgccttcttcggctggctccctaaagtgctgggatacaggcatgagacaatgcgcccagccagaatgatcttgaaaaaccaattcgggctcaagtttaaatcctctcgtagtttcccactataatgaaaagaaagtctaaagtgctcatcttgcttacaaagctaatcatctgtcgcctccttacccctccatgttcatcttgggccattcacctctgcccattgagcttcagatccacaagcccttcagttcctcaccccagcagtttccttgctaggactgctctttctggcagatgactaggcttcttcctctttcagatctcacctcttaaatgtcacctcagacaggcaggtatcctgtccgctactgtaacatcctctttaaaagcccccatcacacctatttgttgtttgttccagcccctccgcgaaccctgcctctaccgccgcatggcagctacctgggagagtgcctggagttgaatgaatgaaaatagtctgtaggtgcactgcccttgtcaatcacaagcagatttaattacctgtgccagaactcacgggaggaaacaccgtccgccagccccgctctttcctggctacagataaaagctccaggttccggggttccggttggtgaattctggggcgacagcttcattttccacagggtccacttcaggttcgctgccggctcggagctggttgacagggctgcgaacctgcaccctgggcaacgggaaaaccgcacagggcttaaaaatgacggatatggacagcgcacgaacccgctctaacgtcttccgcttttacacccccaatctttaggcccgaggggacgaaaaatacgtatgcccacaggtggagtcagcactgaccccgtccttaacttcctactgtggtcttcgcagtgccgcgagtctatttcgatccggcacgtcgaatacaaaatagaacccgcacgttccaatgtactgtgaagcccaggcgagtgagctgggagaaggggggcaagactaattaccagggttcctgcaaccgagaacccccaaaactgcgaccgaagcgccatcgctgagacgatctcggaaaagcctgcctctttttcctcacggacgactcagtcgctcgccaggcgcagccatataaagtcaggacaagcctttggctgctgtagatccccaaactctccacgccagacgccgccgacccggagtagcaagtcccctgccactgagtggccaagaaggcgatctgttatcctgcaccgccaacatcgctcacgtcgaggggcacgcaggccctggagcccaccaaccacctcgtagctacgccaagaccacgcttgttgcttaagtccggggtcaaaggcacacaccccacaaaaccatgttgggttttctactcggagagcttgggcggtcattgactggtccacacacaccccacctggcaccgcgtaggaataaggcagggcaagatgcagttttctccttaaaaagggtggttgcttcctcgaaccaaaaattttcccgtatggcccgctggaaaaactgccccgtcccacccggttcgcgcccttaaacttacactcctgaggcctggagcaaagccggccgatctgcctccgctccccgagcagggacaaggaaaagacactaaacctaaaacgcacgactcgctcagaccccaactctaacttggagaagggcccgcccctccagttacaccccagctccaagctcccccttcttacaaccttttctagaaggcactagaatggcccactgcgtctgcgcaacatctttgaggcgaaggttcaacctcttcccagcggtccaacatccgacttccgttctccgcttcgcgcccttcccatcggctatctaattggacaaaaatgccgaccccgccccttccccgagcctcacttccgtcacagtcctgtttctctccctgttgtccctgcctctttttccttccgccgtgccccgcggccgggccggggcagccgggaagcgggtggggtggtgtgttacccgtagctcctgggacatcgctcgggtacgctccacgccgtcgcagccactgctgtggtcgcggtcggccgaggggccgcgatactggttgcccgcggtgtaagcagaattcgacgtgtacgctgccgtcaagatggaggggcctttgtccgtgttcggtgaccgcagcactggggaaagatccgctcccaaaacggtaagggcgggccgggcctgggtcgggtttgcggccggggaggccgagtcccaccgcgaccggaccccggctgccctcgtttctctcctttacctccgcagaagggcctcggggccccgcagccggacccagcccacccgccgttctctggggcagggcgtgtggccccacttttcccacagcgaggaggagccccgccgcgcgcggcagggttttgagccggcaacgcgtggatgtggtgtccggggcggcgttggaaacgcgccctccgcgggaaacgggcctcccgggctcgcacgtgcgggccacgcctcgcacccccttttgtttcagggcgccccctgagtgtccatgttaaacgccaggttttattttaggaccatttaccagaaaaaggtaggtccatccgcgcgccctcggatgagcccggtgccctgtccgcccgcagctgcagtgaggtcgggcgtccggcgtccagccgtatccgggttgacagcttcttacagtagagttacccaggaaacgccactcgagtgcattgaccccaggagacggcagcgctaacttagcagacgtttgctgtcaggcctttggatacctacagagcttactgtttcttgatagattcctaattttttcgtaaacaaatctgaaagtcaccaccttccccgttgactaccgatttctctcccacagataaagagagttttaatgagcaaaaaacttgcagaatctgaaggaaaaggctggatagctgtacgaagtggcagagcatgaaattggtggttattactttttttttttttcccgccatcagattccaccccgcatcaaagctgtgccaaataggctcgctttgtttagggacgggtcccacctgtcgcccagacgagagtgccatcatagctcactgcattctccaagcacggtccgcgccgccgcatccggctttgtttttattttttgtagaaatgggtttcgctatgtgcccaaaggggtctcaaactcctggcatcaagcgatcctcctgcctcggcctcgcagtttgggattacacctgtgagccacagtgtctggccccatttacactcttagtaggtggttttaaataattaacacagatttgtagatttgggaaatacgggggctgttggatgtcatttcctttaggctgaaattactgtctttcagagttgtggcttatcctcatttcttttttattttaattgattgtctacagttatggctgcagcttcgattgccaatattgtaaaaagttctttggtccagttggcttggataaaatgttggtggatgatattggtgtaagtacacataacgttgtgttagtttccttaaagtaaaactatcttcagtgttttgctatgttctttctttgctttatcagaatccacgtactggaaggtgatattaaaggtgaacgtgtattataatgggctgtgttgatttctataagtggttcatattttttcctgcgaatttcttaggatgtaaccttactaacgatggtgcaaccatcctgaagttactggaggtagaacatcctgcagctaaattctttgtgagctggctgatctgcaagacaaagaagttggagatggaactacttcagtgtaggtagactggctaaagaatgatcatttttctaaaaacgaccgactttcagaaagttgagccataagtgggtcatttgtgctgtgtcagaaataagttacatattctgaatgcccagagattgagcaagaagaaaaaacaaaagaagttacacatttaagaggggaaataagcttctaggtacagattcagaaacaaaatttgtaagttgatagttacagctagtttgtacagttaagtaggaaagaatttgagttcatttgacatagccccattgttttaaatgttggtattccaagttttgagggcttatttttccttttatggcagtattcagacatcacacagattttttatggtctctcaaaagtcttgtttcctcccccatcaccccttgagacttggaaagctctaacttttctgattatttggaggataaaatgttaccaatctgggggagaaacaatgttttatattattatttttaagagaccatctgtagcacagtctgaagtgctgcagtgctgtcattctcactgcagcctggaactcctgggttcaagcaatcctcctgccttagcctcccagaggcttgggattgcaggcatgtgccaccacaagcaactaattaaaaacctctttttttttttttaagagacagggtctcgctatgttgcccaggctggtcttgaactcctggcctcaagtatcctcccttctcggcctctgtagtgctgggattacacgcatgagctgcactcagcctgtctattttttaaatcctgacaggtaatctcaggaattcaaaatgggagtgtgagaaattataaatacatcatgatatgacagtgtgatcttaccgagtcagtaaatgtgatacacagttaaactcttcatagatcatccagcatgctggtatagtagaaacactattgtttggtgagaagatgttaattctggagaaactagatagtttgtggggaaaatgtatttctagattaaatttagccatgaaagaatggaatctactcctaaaatatgaatatgatctttgtctaacttcgataatgtgatttaacaaatgtagttttccttccataagaagctgacagtctttttgcttaaaaatatttcttagtgttttatcaacttgaagaactatcttttttaaataaaataaagcctaatataggtcatatgaatagtcacactcggtttagcttctgttgagcatttttttaaaggtaatagatgtgttgtcttttacggttgtattgatgaactagtttcttattgctaactagtttcttagaacatttttctggctcctacccagttttggccatttgcatttatatacaataagacctcactgaacatccacagtggcttcatggaaactgactttaagaggaagatgatgtataaaaaaacaagttttcctccccccatcagcgttacaataaacaactgtattgagaaattgctgtccattgttttgcttaaagtggcagtttccaagaatttatgagtacgtggaggacttggagtgttttgtagcgttcttctcccttcacgcccaggtttctaataccagttaattcatttcatcactaccattttggttaataatatatggccattttagtgtcttccatatgtattgcacatgttgaatatccggcacactcagaccggtgaatgttttctcacaggttattattgcagcagaactcctaaaaaatgcagatgaattagtcaaacagaaaatcatcccacatcagttattagtggctatcgacttgcttgcaagtaagattgtttgcattagagaaattttttttgatgtaatagttgtaaactgtgttgtcttaacgttttgattaatactaaattttaatttgaaaaccttcaatttaaatgttttagcatttaagtagtaatattgaagttaaaaacttggaccagtatcttttttctcatttgactaccacattttctcctaaaatagattttagtggctatgcttatgggatagattaaacttgccatgatctgaagaggggggttttttcatgtcctcctcctatatgaaatggctgaacgggtattattacttacgacttttggctctgtgttaagcatgatgaatgcaaagagtttgagtagtgactttataagcgttttctcccccacacttttaaacagggaagcagtgcgttatatcaatgaaaacctaattttaacacagatgaactgggaagagattgcctgattaatgctgctaagacatccatgtctccaaaatcattggaatgtatccttgtggttgtcagataaaatttagactttttaaagcaaagactttgagatgggcatggtggtatgtgcctgtagtcccagctactaaggaggctgagtaggagtattaattgaacccaggagtgccagtccaatgtgggcaacatagcaagacccgtctcgggagtgggtgcgtgtgtgcgcatgtgttgcgcgcacgcgtgcgtagtagcagcgtatcaattttgtgcaataaaattttgaataaccaattttatgcaaattgatatcaataagaggagtaatgctgtattgaaattacctgttgccttccctgcttttttagggtgaaaagtaataaaaagcatgtctaaaagtgatatgaattgcagatagtgataatgttgtaacatttggtgacaagtaatgcttgctgctttaatagattagattactaaaaggaagtcccttgaattacccttgatttttcacgtgtgtaccctttgtccattccaaacctgttactgtcctaacttttggcgtagaaatggtgatttctttgctaacatggtagtagatgctgtacttgcattaaatacacagacataagaggccagccacgctatccagtcaactctgttaatattttaaagcccatgggagaagtcaaatggagagtatgctcatcagtggctatgcactcaactggtggtgggatcccagggtaaggtttgggatttggtttatagaatgagattgctacagataaaactagcttttcttttggctgggcgcggtggctcatgcctgtaatcccagcactttggaggctgagtcaggtggatcacgagggcaggagtttgagagcagcctgtccaatatggtaaacctcatctctactaaaaaatacaaaaattagctgggcatggtggcacctgcctgtatcccagctacttgggaggctgaggaaggagaatcactggaacctgggaggcggagattgagtgagccaagatcacaccactgcactccagcctgggctacagagtgagactccgtctcaaaaaaaaaaaaaataaaaaatgtttttttgtggattatgtgcagtacatctttttgtatttaaagcacatacaacatggtagaaggaatgtgaattaaaagaaattacgtgcatttatgccataaaatttttctaagataaaatgcaatgaattagtctaaatttgtgtgtttacaacaatcgattataggtactctttattatgcttttaaggatagacgtattaacttaatctatgttcaattgtaggcatgcccaagagaatcgtaaatgcaaaaattgcttgccttgactcagcctgcaaaaaacaaaaatgaagcttggtgtacaggtggtcattacagaccctgaaaactggaccaaattagacagaggtatgttgagagattatttttggcctttta

SEQ ID NO: 5063 - DNA, 31130 bp, Homo sapiens
aacctcttttttttttttttaagagacagggtctcgctatgttgcccaggctggtcttgactcctggcctcaagtgatcctcccttctcggcctctgtagtgctgggattacacgcatagctgcactcagcctgttctattttttaaatcctgacaggtaatctcaggaattcaaaagggagtgtgagaaattaataaatacatcatgatatgacagtgtgatcttaccgagtcagaaatgtgatacacagtataaactcttcatagatcatccagcatgctggtatagtagaaaactattgtttggtgagaaagatgttaattctggagaaactagatagtttgtggggaaaagtatttctagattaaactttagccatgaaagaatggaatctactcctaaaatatgaatagatctttgtctaacttacgataatgtgatttaacaaatgtagttttccttccataagaactgacagtctttttgctttaaaaatatttcttagtgttttatcaacttgaagaactatctttttaaataaaataatagcctaatataggtcatatgaatagtcacactcggtttagctctgttgagcattttttctaaaggtaatagatgtgttgtcttttacggttgtattgatgactagtttcttattgctgaactagtttcttagaacatttttctggctcctacccagttttgccatttgcatttataatacaataagacctcactgaacatccacagtggcttcatggaactgactttaagaggaaagatgatgtataaaaaaacaagttttcctccccccatcagcgtacaataaacaactgtatttgagaaattgctgtccattgttttgcttaaagtggcagtttcaagaatttatgagtaacgtggaggacttggagtgttttgtagcgttcttctcccttcagcccaggtttctaataaccagttaattcatttcatcactaccattttggttaataatattggccattttagtgtcattccatatgtattgcacatgttgaatatccggcacactcagacggtgaatgttttctcaacaggttattattgcagcagaactcctaaaaaatgcagatgattagtcaaacagaaaattcatcccacatcagttattagtggctatcgacttgcttgcaataagattgtttgcattcagagaaattttttttgatgtaatagttgtaaactgtgttgtctaacgttttgattaataactaaattttaatttgaaaaccttcaatttaaatgttttagctttaagtagtaatatttgaagttaaaaacttggaccagtatcttttttctcatttgactccacattttctcctaataatagattttagtggctatgcttatgggatagattaaacttgcatgatctgaagagggagggttttttcatgtcctcctcctatatgaaatggctgaacggtattattacttacgacattttggctctgtgttaagcatgatgaatgcaaagagtttgagagtgactttataagcgtttttctcccccacacttttaaacagggaagcagtgcgttatacaatgaaaacctaattgttaacacagatgaactgggaagagattgcctgattaatgctgtaagacatccatgtcttccaaaatcattggaatgtatccttgtggttgtcagataaaattagactttttaaagcataagactttgagatgggcatggtggtatgtgcctgtagtcccactactaaggaggctgaggtaggagtattaattgaacccaggagtgccagtccaatgtggcaacatagcaagaccctgtctcgggagtgggtgcgtgtgtgcgcatgtgttgcgcgcaccgtgcgtagtagcagcagtatcaattttgtgcaataaaattttgaataaccaattttatcaaattgatatcaatagagaggagtaatgctgtattgaaattacctgttgccttccctgttttttagggtgaaaaggtaataaaaagcatgtctaaaagtgatatgaattgcagataggataatgttgtaacattttggtgacaagtaatgcttgctgctttaatagattagattacaaaaggaagtcccttgaaattacccttgatttttcacgtgtgtaccctttgtccattccaacctgttactgtccttaacttttggcgtagaaatggtgatttctttgctaacatggtatagatgctgtacttgctattaaatacacagacataagaggccagccacgctatccagtcactctgttaatattttgaaagcccatgggagaagtcaaatggagagtatgctcatcagtgctatgcactcaactgtgtggtgggatcccagggtaaggtttgggatttggtttatagatgagattgctacagattaaaactagcttttcttttggctgggcgcggtggctcatgccttaatcccagcactttgggaggctgagtcaggtggatcacgagggcaggagtttgagagcgcctgtccaatatggtgaaacctcatctctactaaaaaatacaaaaattagctgggcatgtggcacctgcctgtagtcccagctacttgggaggctgaggaaggagaatcactggaactgggaggcggagattgcagtgagccaagatcacaccactgcactccagcctgggctacaagtgagactccgtctcaaaaaaaaaaaaaaataaaaaatgtttttttgtggattatgtgagtacatctttttgtaatttaaagcacatacaacatggtagaaggaatgtgaattaaaaaaattacgtgcatttaatgccataaaatttttctaagataaaatgcaatgaattagtctaatttgtgtgtttacatacaatcgattataggtactctttattatgcttttaaggatagcgtattaacttaatcttatgttcaattgtaggcatgcccaagagaatcgtaaatgcaaaattgcttgccttgacttcagcctgcaaaaaacaaaaatgaagcttggtgtacaggtggtattacagaccctgaaaaactggaccaaattagacagaggtatgttgagagattatttttgccttttaagtgtgagtgtcttggaggactttaacatttttagccaagtcaaactatttacttccagaaaaattagcctggtggtgtttttagagggatttggggttatacaacctattgaaaatcggcctttttgtggaattttgattgtatgagtctattaatattaaagatgtaaagacaggaatctaatttcctcaaagcagtacagaactcagcagtatagtattgactgtacctactgtttgctagatactggaggtgcaggtgatattagtggttggcatgccagaaggctaatggtggaggtagtgtgaccattgctatagatttgactgcctgacagtcacttaaacaataaattgtttaggctgggcacagtggctcatgcctgtaatcgcaacactttgagagctgaggtggcaagaatctgaagcccaggaggttgaggctgcagtgagctgtgattgtacactgcactccaacctgggtgacagcgagaccctgtctcaaaaaaaaaaaaaaaaaaaaatagtttaaacagtagttaaaccagacctacaagaaagctttgccaagagtaagaaatggctgtcatcttttaaatcagtctgcacgggtattcttttttccttccttcctcatacaaaaagtgtcctttcttccatcaaagccagtccctctacagtaagtgttctagagtctgttccttctgctctagagccttttctttgattcttgtttcatacttgcatcttcaactaatttgctctttcctggattcttcctgtggctcttttgtccttcaagcttcttcgtacatcctgtgctataggtactccctatcgtacatctttacaggcagatgtcatgagtggtttactaacaaaacttctctggtgcttttcttctcatcccttttcagccctgttctccatttgaggactgcatgttaaggtctctagcgtgaaattcggaagacattttcagccttcctcttactgacctttagcaaccctttgattatgtccttcttgaaatgctttcggggatggaaggcttgtgatgctgctttgtctggaccatgtcataatactctccaggatagcccctttgttccctgacttcatgtattatctctctatgccagagactctttcagctgtttctctaagctccaacacacatacctctatctagtagaatgcttttcaagcatctcaaagtgaacatgtctaaactgaacttgtgataataccgcaaatctgcttttgaccattttagtgatggggagtcctcacacaggcagaaaactaggaaatgtccttaactcctcctttttaccaacactttttctctaatctgtcaccaagaccgcttgatttctacctccaaattaaatttacctacttttcatttcttgcctagactgttgtagaaacacacccaagctagtctcttagagaagcttttcttcttcttcaatctaaattatattctgttgtaacttcctgtattttttcttcctggggctattacagtttttaccatgagtttatataacagtgtgtagcacacagtacttgtttagtaacaagctgcttttgaggttgatctgtaattcattttactttaaaaattcttcgaatgattattcacatggcttcactcatattgactcttcaaatctggatctcccatagtttatggttccatgatgtaagtgactgcctcctgggagcttcacctgagtaacagcagagacttcaacttaatcttgtcctcaactaaactctcatttcccatcctgcccccaaaactcttgttattattttactccaggagtcacccaagccataaaatttgacttttctgtttaggttgtcttcagcttatatctcatgttattatcttcttgtcttcagccattcagtgcagtttccacatgataatcagggaatccttttgaaaacacagatgatatactagtcttgcttagagatattagcttagtatctagattgtttggtgtaacctgcaaggtttttcacttttctggttctgcttcttttgtgctttcaactctggactcctgtttttgtttgtttgtttgtttttgagacgagttttgctcttgttgcccaggctggagtgcagtggcacggtctcggctcactgcgaccccgccttccgggtttaagtgatactcctgcctcagtctcctgagtatctgggattacagcgcccaccaccaggcccaactaattttttgtatttttagtagaggcggtttcaccgtgtggccaggttggtctcgaactcctgacctcaggtgatctgcccgcctcagcctcccaaaggctgggattacaggcgtgagccactgcacttggcctggactcatcttcattgtccacctctaggctaaatttatgtcttttatgtgcttgtaatctctgcataccactttagtgacactgccctggagtgtgattggtaatccctctccccactagatccttgaaggcaggacctgtttccctgtttaaccatagttctcaattagtaattcaaatttgggttggggagagctaagggtaatttttaattccttcaaattttccatgaattggactaatttaaattctggtcagaataacaaaggataatacaatttgatctatgattatcttgtgataaatacttaatggaagtaaattatttttaaaaatcacagaaggtaactcaggttacaaaaatactttgcagagaacagatatcaccaaggagagaattcagaagatcctggcaactggtgccaatgttattctaccactggtggaattgatgatatgtgtctgaagtattttgtggaggctggtgctatggcattagaagagttttaaaaagggaccttaaacgcattgccaaagcttctggaggtatgtctgtgctggctgtcacataaaatacttttattatccctgatcctatcaaaggtctttttacttggaatattgacagaaaacagctcaaaaacatttatattctcttaatgctttgtgctacaacacatttatagagccatttttcatgtaactggagaaattttgttggaaatttgtgactgaatttgttcatttctaaaatgacagttccatcttaggataaaaggagttaccgtgtctgcctaactaaattctaaacttgtaatatagcacttttaccacaaatgctactgagtcaaggatattaaaatcatgaaagagcaatattcacagatcctttgtaactctcttattagaactattctgtcaaccctggccaatttggaaggtgaagaaacttttgaagctgcaatgtgggacaggcagaagaagtggtacaggagagaatttgtgatgatgagctgatcttaatcaaaagtaagagccactttctaaaattgtaaagttataccgattttgttaagtaaaagtagttttcttcccatttatttgctgcttgtagtctcacagtgatacgagcagttatacgcatggataaaataacattgggccactgtaaattgagatgaagtaaccattttcatctcttctcagggactagacattgtttctgtatagtatatctaaatatcctgtgtaggcaggacttagggaactttatgtagacttattttattaaaatgccattttttttgagaaattgatggtctggcaaaaaaaaatttttaaaaatgctattacaagaattgtacttttgttttgaacagtctaaggctcgtacgtctgcatcgattatcttacgtggggcaaatgatttcatgtgtgatagatggagcgctctttacatgatgcactttgtgtagtgaagagagttttggagtcaaaactgtggttcccggtgggggtgctgtagaagcagccctttccatataccttgaaaactatcaaccagcatggtaagaacagtcatttcttgtcttagaggcctgagagcagtagctgtgacttcaattttttttttcccttttgtgaagtcacctaattttcttcttttcctaggggttcgggaacagcttgcgattgcagagtttgcaagatcacttcttgttattcccaatacacagcagttaatgctgcccaggactccacagatctggttgcaaaattaagagcttttcatatgaggcccaggttaacccagaacgtaaaaatctaaaatggtaagcatggtttcccgctcttgttaacctctgcagaacaggttgcattaaaaaggatagtagtcaattacatgtcagcaacataagtaacagacttgtcaaatacttaacatgaaaaacttcacagcaagcatttgtgttcagtcactgtaattcaagggataatgactaattattagcactggtgtgtcttcgttactgtgattgctaatctctccctgcttcttttggtagaaagactacctacaagatctctgtctgatttaaaaatcaaccttaatacttgaatgaaatgctggagttaataggccacctatgaaattgtaagcggccgttaaataattctttcttaattgcaggattggtcttgatttagcaatggtaaacctcgagacaacaaacaagcaggggtgtttgaaccaaccatagttaagttaagagtttgaaatttgcaacagaagctgcaatcaccattcttcgaattgatgatctattaaattacatccagaaagtaaagatgataaacatggaagttatgaagatgctgttcatctggagcccttaatgattgatctgatgttccttttatttataacaatgttaaatgcaatgtcttgtaccttgagttgagtattacacattaaagtaaagtacaagctgtaaacttggtttttgtgatgtaggaaatggtttccatctgtactttggtcctctgatttcacatattgaacctagtactttattagtttaaaaagaaattgaggttgttcaaagtttaagcaattcatctctctgaacacacattgctattcccatcccacccccaatgcacagggctgcaacacccgacttctgcccattctctccagtgtgtgtaacagggtcacaagaattcgacagccagagctccaagagggtggcccaaggctatagcccctccttcaatattgacctagcgggggagaaagatttagattgtttattcttctgtggacacagtttaaaatcttaaacttgtcttttcctcttaatgtatcagcatgctaccctttcaaactcaaattttcattttaactgcttagaataaatttacacctttgtgaaaattcatccctgcctatcttacctcgttccttttatgcaagtaagccaatgtctttttttttttttttttttttttaccttgggaagtaatgaactagtcctagtaactagtatttctttaactattacccacatggccaacacctagaagatacatcttaaaattggattgtgaaattcactggtaagctctcagggttacttgtgcatctttccttctctgggtttaatccaagttctttaactattgcagcagagacagctgcaaaggctcattgatttcaaatatgtcaacatcttccagtgaccaacctgcttttgtaacctagaggaagattcatagaaaagaggtctaaacttgggtggaaaggctaaagttaaaccattcttttcaacataaatatatgctgcatgatactggtaactgctactttggtttgttcttaggttatacagtgacattctcacacatttttgccttagtgacatccattccatccaaaaggttagggtgtgatctaaaagatcccttagaaattctaaattgtcttaaaattttgaaccagtacatctgttatgtgtacctaaggctaatgtaacagaatcagttcccctagaaagcatgtgtccaaatgctctcagtggctgggggtagtggctcacacctgaaatctcaacacttgggggcctaaggcaagaggatcaattgaactcaggagttcaaaaccagcctgggcgacatagacttgtctctacgaaatgaagaaggcgtggtgcacctgtagttcgaggtaatgggaggctaggcaggaggaatatttgagcctaggagttttgaggctgcagtgagctatgatggtgccctgcactccagcctggacaacagagcaagaccttatctcaaaaatagaaataaatgctctggttactcttctggtagggaaagactagagctaactacatgaataagctcacttaaggtaacaggaagacaaatttcataaaagggaatagggttatactcacagcttgctttatggtggaattggtcctattcccataatggaaggctccacacccacttgggaccaggaaactaccgtgctaaaggtgtaagcccacgtttatcagcttctgacttcttcataagaacgacagtgcagcaccatcatttattcctgtaaaatatgagtgacttaatttctaccatgcttattacctcagttacatatctgtggcttctttaccacctgaagacatgagttaaatgattttactgttggctaaggcatttactataattcaacagactttacatagaaattatgtttggcatatattgaccacaaaactttccaactagagaaagtggtaggattacagtagtcggggctggcgtggtggctcacgcctgtaatcccagcactttgggaggtggaggagggtgaatcactgaggtcaggagtttgagaccagcctgaccaatagggtgaaagccatctctacttaaaaagaaaaatcagccggtgtggtggtgtgcgcctgtagtcccagccactcaggaggctgagcaggagaattgcttgaacctgggaggcggagattgcagtgagccaagattgcaccactgactccagcctgggcgacagagtgaggctccgtctcaaaaagaaaaaaaaaggattacagagttggggaggggagatctctgacaggaaatggaagaataagcctgggcttcacaaggagtattgggagtttctggtactggaaaaatacaaaggtagataaactgaagttccctaattacttcttcatttgtatgtctagttgggatgtcaagaaaccaaattaattctttcagtaaggttaagtcaatgatcaaatacagagaaatgacatgtttccttaaactgttttaagaaaattttgtacataaatattgagttgggtgtggtggctcatgcctgtagtcccccagctattgggaggttaaggcagggggctcacttgagcccaggagtttgaggctgcaagtgagcatgatcatattgctgcacacgaacctggctggcagagtgagtccctgtcccaaaaaatagacttttgtatataaataaagagaaaaatattcactcggtagacattatagaacatagtatcccccagatgtccttcagaaaatctaacctgaagcattggctggggtgactgttcccgtccatcagtaagaaagtaaggctttagcttggacatggcttctatgttgctcccatggcaggaaactcatctgttttaacttcaataagacctaagcaaaggaaaaccaattactcaaattagtccagagacagaagtaagtgtgctgggaatggtgggttctctgccattaaacataggattcatatttagcagaaaagttttaatatgtgaccactttgatgacaacaggaggaagtacacacaagaattattgtacatgaaaacaatttatgagtatgtccttatgagacactgtgttttccaaatccataggccttcctgaggaaagtagctaccagggacctgtttgtgcaaattctgctatagtttgggtcatagtacttggctggttacgagtgagtggatcaggcgtctcaaagccaatcgtgcactgctggcaggacataagagatatcagttatcaataaggagcttgacgggagcattctgtattagaaaatagcgagtgaccccaaaagatccacccttagaaatgtgaaatggagatcacacagaaacagcgagaagtaatgggtgtccacttctgagaggttgagcctatacaggaaacaggtcagctggtgcctcctaacaaccatgagccagtctccagcttctcatgaaacctgctgtgtgtgcacagtggtcatggacgctctggaaccagagtgcttgagtgctgacataggtcccatgttaccgtgtcctgtaaacccagcatacccctccccacattcatgtatccaggacatatatttgcaacctgaaaaacataactaagataaatttctaaagattcctatgtattactcttttagatgttactcttacctataaataggtgatgtttaaaccactatgatatactcaccttttctagttgacaccaaaactggtacaattctttgtcaaaatggccagctttctgtgcattctctgtcctgttctgggacagaactgcaccttgtcctgatcttctctactcacttgccattttttggctacattttcagctgggaaggagaaaaacagcaaaaaactaacattttcatgaactggcatttgatagctcaagtcgtcacatttgaccaagcactgactgaccacatatgctagcaggctcatggtggcctgtgcatgctctgtgtggggtggccctgcctgccactggcagttggtttggaaatgttgcagtgatctcaggagtcatacttctctccttccctttctatataattgtaaacttacagaaatttcttcacccagagtcaccatttatattttccctccatttgctttaatattttctttctgaccatctgagagaaagttggagatacaatgccttcttactcttaaattttaatttcagtgatacttccccaaaacaaggccactttcttacataagcacagttataaaactcaagaaatgggccaagtgtggcggctcacacctgtaatcccagcattttgggaggccgaggtgggagatcacttgagcccaggagtttgagaccagcctgggcacagcgagaccctgtctccattaaaataaatttagccgggcatggtgtgtgtgccatgtagctagtagtcctagctgcttggaggctgaggcagaaggatcacttgagcctaggagttcaaggctgcagtgagccatgatttgcctctgcactccagcctgggtgaccctgtctcacaaaacaaaacaaaaatcaggaaattaacatgaatcaaacactattatctaatccttggtccacattcaaatttcacctatattcagtaatgtccttctagctcctttatttgagccaataaagaagcatgcattgtacaacatcaatctctctagtttgcttttgtctgtaacagttcttcagactatgcttcttaagctgatatttttgaagaacatgggcgagttcttttgttaagggtcatcaattttgatttgtcgatgtttcctcagaattagattaagattctgccaaaaggcaggtataccactgaatgatgtatgatttttctcagtgagtcttattaggacacaaatgacaatcagtttatcccaggtatgttatctttgatcacttggttaaaatggtttggtattcaccaggtttctagcttttaaggtaccattttttcatttataagtaatcaataatttatcagaggttctttttggattaccaaatatcttcttccccatcatattttcacccactagttttagcattcattcatgacttctaactccaacattccttctattggtaagatattaattggcattttaccataaagaaaccttttccttttctcccatttattcagttatttatatcaggatggactcatacattttcttttattgaataagttataactcattactttcattacttactttgatgctgaaatttttaatacttgggcagttataacccattactatcattacttatttgcacgctgaaattgttcaaatttaggcagttacaacccattactatcataacttatttgcacgctgaaattgttcaaatttgggcagttacaacccattactatcattactgactctgatgctcaaattgttcaaattccactacaggaaagtggaagccccgtaggctgcctcctgtgtgctttcaacatgtcctgagcatgtccttaattttttagcattttttccctagccttggaaagggccatttctcaaacaaccttagttccttttagtggataaatgtatttagaagatctgggtgtcaggactcttgttgttactggtttgtcattgtttctaggtctgttcagtagaaacttccatatgtatatttataattttacatatacacacacactcatggtaacaccttgagttcatactgcatttgagttctccaaaatgcaacctaacaccacaagctacattcttctccctttccgtattgtaactctcttctacaaatgtgagaattggccaggtttggtgggtcacacctgtaatccagcactttgggaggctgaggtgggaggatcccttgagctcaggagtttgaggccagcctggcaacatggtgaaaccccatttctacaaaaaatacaaaaaattagccaggcatggtgggagtacctgtggtcccagctactcaggaggctgaggtgggggttgcagtgagccaagatgagccactgcactccaatctgggtgccagagtgagacccgtctccacacacacacacaaaaagttattgctttgctttctatgtcttgtctttacttatcaagctgtttttctttcttttttttttttttgttggatgatgtctcactatgttgaccaggctggagtgcagcagctataacaggcaaaatcaaccatagtatactatacaacctcaaactgctggcctcaagtgatctcccaccacagcctccctagtagctgggactataggcacctgccactgcaccctgtaaagctattctcttatatatacttctagaagctttacattttttgcttttatttttaaatcatgatttatctcaaattagcttttatatagggtgtgaggtagggatctaggttcatcttcccatgtgagtaatctgttattccagcaccatttgttgaaaagactttaatttctccattcattccattgatgcctttgttgaaaacgagcataagtctgggtctatttctgaactctttctctttctctgtccttatgccaaaaccacattgtcttgtttacaacagctttataggaatgttaaaatcagagcatgtaagtgctattttctgacttcaaaattgttttggctatttgagtgctttgcattttatacagtatttatttacactatttatttatttatttagagatgagtttcattcttgttgcccaggctggagtgcaatggtgcaatatctcagcttactgcacctccgcctcttaggttcaagcaagtctcctcccttggcctccagagtagctgggactaaggcacctgctgcaacacctggctaattttttgtagttttagtagagatggggtttcacgtgttagccaggatggtctcaatctcctgacctcatgatccgcccgcctcggcctcccaagtgctaggattacaggcgtgagccaccgcgcccggctggaagctattcttttgttgttttgttgttgttgtgtcactatgttaaccagactggaatgcagtagatactcacaggtgcatcatagtagactatgatagcattgcccaggctagactcaaactcttggactcaagcaactcttgcctcagctcttgagtaggtgggactacaggcacataccaccatgcctggctccttagtatttcttgtagtgtaggtgtgcaggcaattcattttccttcatctaaaaatggccttcactttcactcttgttttttttttttttgagacagagtctcactctgttgcccagatggagtgcagtggcatgatctttttttaactttttgctacaatttgctaaggtgtaattttcccttgtctatcttggtctttgaacttcttttcacaccaaatgtggaaattttcttcgtttttttctgccccattctctctcttccttatgtatgagattcctattccatgcatgcagtcctatttattttgtcctgcagaccaccaaggctctgttcatttatattttattttttgagacggagtttcattcttgttgctcaggctggagtgcaatggcgtgatctcagctcacgcaacctccgcctcccaggttcaagcgattctcctgcctcagcctcccgagtagctggattacaggcatgcgccaccagcctggctaattttgtatttttagtagagatggagtttcccatgttggtcatgtgggtctcaaactcccgacctcaggtgatctgcctgcgttgacctccaaagtgctgggattacaggcatgagccaccacacctggcctattttttaatttaattaatttaatttaattttttgagacagagttttgtttgttacccaggctggagcgcaatgggtgatctcagcttgctgcaacctccacctcctgggttcaagctattcttctgcctcagctcccaagtagttgggattacaggcatgggccaccacatccagctcatttttgtatttttgtagagacagggtttccccatgttggccaggctggtcttgaactcctgacctcagatgactacccggcttggcctcccaaagtgctgggattacaagcgtgagctaccgtgcctggccgttcatttattcttcattatttttctctgtgttcttcaggtcgtgtatatgatctatctcaaacttcctgaccctttttcttctgtctccaagatgctgttaaggccattcagaattttttttctttttttttagagatgaggtctaactatgttgctcagcctagtctcaaaccccagcctcaagtgatcctcccacctcagcctcccaaggtgctgggattacaggtgcgagccccatgcccggccccatcccagtgaattcttaatttcagattgtgtactttgcaagttctgaatttctatttggttcttgtttatattttttccttttactcctgagatgtccacatctttcctctatgaagattatattttcctttgtatctttaaacatatgtaaaatagagccttaagatcctcatctgataattctagtattgcagggtctgttgactgttgtggtttttttcaccctggttgtaagctatattttcctaattctttgtgtatctagaaagttctcattgcagctgaacattatagttgctacataactggacatagagattttattatctttagagaataattgagttttgtttccacaagcagtcaaaatactggcaaatcaccttgatccttttgagcttgtttttaagcttattagtttgggtctagagtagcttttactctatggctttggcccacccctaaactgtggtctttctgagatgtcaatggagtgtccaaggagttcagtaaggttccactcgcttgtccagaacttttatctcctagtaatctataaaatctccagttcaccttcctttgcagctcttttctactaggccttgtaagctgttatctacaagcttagtatttgtcaaagacttaaggggaaccttttgcagatttctggagctctttttttcttctccccctattctgccccacaaactccagccatctcagaagccccaaattctctgcttcttcagatcctgagaccactgtttccagcttaggctctgcctctccataacacagtttgggaagtgcctgggtagagacagtgacagtggggttttcccttctctcaaggatctcagtcttacatgatattagtcaaaacctgacatacataaaacagtggctttatatattttcacaagttttatcttgtttatagtaggaaatctaatctttgtcaattactccatcatgacctgagcctttttcttttctttttttctaaagaagagcaatttattttcttacagttctggaggctggaaggtaccattcaatccacagtacaccttggaaagggctcgggatctgaatttttaatgacccctctagttatggttgaggcagttggtcacacagtgtcttccattgtctgcctgtgttttatagccttctctgttgtggctgtaagtcgagaagtggtcaagatgccttgagcttctcttgcttcccatatccctaagcccttccttccttcctagcattcatgcacacagttccctttggaatcttgtacttttccccattacctttttcacatatttatgtgttacataaaaccgagccattgctgcatgcatttgagcaaggtgcttaacttctcagggtttgattctttaatctaaaatgtctattctgtttcttaagttttacatgtatactaaagacaagagtgctttgatttcccagttgctttgccattaaacttagaccacaggacccttcagcatgaatgaccataacccaattgtgtagtacaaaaagtacagctaggtaccaaaaaaacaactggtttattctgtcactacctctgccacagaagcactatttgtgggccctgtttcttcatttggtaaatgaggggttgatccagaagaactctgaggtacttcccacttctaacattctctgataacaagagttcacaaagaagagaatacttacttcacttcagttaatcaaagaagagatataaaatccttaagacagtctctggccataaggacgaaagcacctaagaagcagattagtattggtctttttaacctttttaaagctaatacagtttcagccatgtctgccttacctgtaaacccatatgacagttgtgaaatgcatctgtaagaccatcacagagtatactgtcagtcatggcatctcacctatctttactcctgttctcaagtaagccaagtgaggagcctagaagtagaaataaaaatggatttaggcttagttgcaattagtcttctccccagaatacaactcaaactatctagtatttcctaagtcttcatctaggcccctttgcagcccttctccccagtttaggtcctcagccaggccaaggtctaaagacccctggaattagcagacttcatctttccattgttgggaacgattactctcctacctacccattttcaattctccctcaaacctacccttctgtgtcctgtttccttaagaattccatttattctttccatcgaggcaattaattattgttaaatgaagaaatcctctaagggcttaagtaaagctaacaatgtgttacctatttcatggatgacataatgtctacagtgagaataatcaggctaactaaatgatggggagggattctgagtagcggccagtcttaactctcaccaactcaacagcaggtatattagaatggaagagtcattgattggacttagagtcggaagagttgtatttgaatgctggctctggtcctcgtttccttacctgtaaactgggaatggtatcatctaccctatatggggctgttgtgaaccatgtacaaaagcacctggtaaagtactacacagatgtcagtgtcatcccatcaaaatcctccgattatttttgttacctttagcctgcctcctcctgaacctcagcaatggctgggcgaatcagcttctatctagggaatctgcacctcagcccctgagctgcatcagtaggaagcgggggtatagtttttctttcaaccactatgccagtttgaggtatggaacttggtgaaacaatcatgcctggcaaacctactggagaagggcaccacttggtggtcctcttttacatgtctataccctgaaaaggtcaaaaagtctggtccccaggatctccttgtcatgtgcaggaagtaagtggcaacatctgttttttgccttttactcacaatgggaaagaaatttaaaaccaggacatcaagcaactaatatgaatttaattcagaaaatattacatgcttcattaatagttagaaaaagtatattcggttccaatcacactggttgataaacttcttatcaacccggattcccacccaaactgaagaatacttcacattcaagtagggatcaaggttgtcatttctgttatttgttcactgtttggttccagctctgctatgcatctgtttactctgttctggcataacatgagtttctcagtgtgaggtcagtgaaagccacctcatcagagaggccttaccttgtcatattttccatgcctcctgcaaccacaatgctggagtctcctatccctattgactggctgcaaggcacacagcttttaggcctgacccacagatcatctggcagctccatgctggacagagtagggaattcctgcacccacactggcttgtctaacaggattctgcccacagcctgaaagaggaacacagaggactcttagcaatcaaggagaaagacaaaatgtcacagtgaagtgtgtggaaaattgccagttgggttacctgccacttctgaaagcctacaggtcaagtagtgcccactggaggcaaaaaggcctgtatacactctccacctgtcacagtctagcccttaatatatactgccttgtgctgctctgtaggtatttcatagatataagctttctcctccaaaataagtcattaatacattaagaaagaagtgtcatcctcatcttttgatatggcttaatagttgggcgcggtggctcatgcctgtaatcccagcactttgggaggccaaggagggcaatcacctgaggtcgggagtttgagaccagcctgaccaacatggagaaactctgtctgtataaaaatacaaaattagctaggcgtggtggcgcatgagtgtaatcctagttactagggagctgaggcaggagaattgcttgaacctgggaagcggaggttgcggtgagctgagatcacccattacactccagcctgggcaacaagggcgaaactccgtctcaaaaaaaaaaaagtgcggggggtgcttaaataagcattatcaaacctatgtctaataaacacaggatataacctagcattatcagtgtttctaactagggccatttgctcccaagatcatggcttaagacacttagaagaaaaagggttacttaaaaaggaaaacctttgataataagcagttctgttcttgctagtattcattacactatgcttaaatggttatataacaaaatatatacaaactcagaatcacaaatacctttttttctcattctgagtactgaaacacaaatatcttttcataattcactatgggacttcctttagttgggaagaaatacataatttacttaaagtagcacagaagaaatggagttaaaagtttcaaatattctcaatcgccattgtctgttatcagagtcaatggaaatgtttataaagtggttactctattcccagtttcagatatactcaaacctaccaccctccttggagagtttgtggggaagaactagcaaataagtcgctgataaaaacttagagatatattcatcacaatgttatcaatctgggattaggctggaaactaaaaacgggtaaggttcttgagactgaaaacatatgcaggatcatatacatattaaaaagacaggcccagtgcgggcctcaggctgtgagcagtggctcacacctgtaatcccagcactttgggaggccggggggggggcgcattacttgaggtcaggagtttgagaccagcctggacaatatggtgaaacccccctctctactaaaaatacaaaaattagctgggcatggtggtgcacgcctgtaatcccactactcaggaggttgaggcaggagaattgcttgaacctgagacagaggttgcagtgagcgagattgtacggctgcactccaccagcctgggcgacagagtgagactccatctcaaaaaaagaaaaagaagaaatgaggtacagggctgggcatggtggctcatgcctgtaatcccagactttgggaggccgaggcgggtggataacttgaggtcagaagttcgagaccagcctggcaacatgttgaaaccccatctctactaaaaatacaaaaattagctgggcacagtggcaggacctgtaatcccagtcacttgggaggctgaggcagaagaatcactggaacccgggaggcgaggttgcagtgagccaagattgcgtcactgcactccagcctgggcaacagagtgggacccatctcaaaaaaagaaaaagaaagaaatgaggtgctaacacaattaataatgctagcattagcatactacgagcttcatgagaatgagaatttctatctgatatgaacattgcttattccagctgctaaaatagtgcctggcacaaagtaggtgctcaataaacatttgttacatgttgtagaaggtatctggctcaaggaataggacagatctaagttcaagtgctagctccactcaaactgtgaccctggtaagtcatttaacctcttaaactctcatttattcatttgtaaatgaagataataggatataacagacttgtgaggaagattaaatgaggtaatgaaaggaagcatttagcacagtgctttaaaagccttaaacttagtagacatgcaccggtagtcccagtagctcagaagttcaagggcatggtgcaccatgattgtgcctgtgaacagccattgcaccacgcccaggcaacagacagactccacttctacaaaaaaatttaaaaaattagccaggttggtggcctgctcctgtaatcccagctactccagaggctgaggtgggaggataccgtgggcccaggagtttgaggttatagtgggctacgattgattacaccactgcattccagcctgacaacagagtgagaccctgtctctttaaataataataataataattaattaattaattagagtgttcaaacccaaagaatcagaagatgggggcactctcaggactcagctatattccctggggagtgatatgccccatttgcaaggggcatgatgtggcacctattttccaagctcgaactgagccctaagagggcagggaacttacctgtattgttggaaccatactcccagcataagcacagtatggggcacataggaggaactgaatacatttttgttgaatgagtgacacttgaggtagtaaggaggagcaggcatactttcctatgcgtcaggctggccctgctgctgttcttcttcttctttttaaaaggagtctcactctgttgcccaggctgaatggagtgcagggcacaatctcagctcactgcaagctccgcctcccgggttcacgccattctcctgtctcgcctcccaagtagctgggaatacaggcgcccgccaccacacccggctaattttttgtattttagtagaaacggggtttcaccgtgtcagccaggatggtcttgatctcctgacctcatatccgcccacctcggcctcccagagtgctgggattacaggcgtgagccaccgggcccggcggccctgcttcgtaagaatgaaaaggcagtgggccgcctgtagtcccagctactcgggggctgaggcaggagaatggcgtgaaaccgggagacggagcttgcagtgagccgagatcagccactgcactccagcctgggccacagagagagactccgtctcaaaaaaaaaaaaaaaaaaaaaaaaaaaggaaaagaaaaggcagtgtaggtggtgtaggtcagtggtctaagttcatcacaaaaagcatattaatgaagctaagtctttttgtttgtttagagaaggggtctcacctgtcacccatgacggagtgcagtgacacaatcactgcagtctcaaactcctgggctcagtgatcctcccacctcagcctctccagtagctgggaggcacaggccatcatacctggctttttattttttgtagagacggggtcttgctttgttgcccaggctagtctcaaacttctgactcaagtgatccttcctcctccgcctcccaaagtgctgggattacaggcgggagccacctgcctggccaagaagctgagtctcaagctggatagaagctactgacagggctggaagagggggccaacaggaggaatcataacagagggaactctgagcaaaagcaaggaggcaagacttgagtgagtgagagagtgtgtgagtgtgtgagagtgtgtgtgtgtgtgtgtgtttatggctgtttctaataagcctgacttctcctggaatcactgagacttacctgctgccaagaatgtccaaagatgacctcagacacatcttccggagccacagtggccctcttcaagactttttgatgacagtggagcccaggtcctggacaggaacagcagctaaggcaccattgaaggacctacaatagaaaggcggagagcgtggacatcacaagcctgcgggtaatacgggaacccctacgagcaggggagcctcatgaccctgtttggcaaggccacgcgaggaggcagtgcctctcctcccacacgttcctacacctgctggtctgagcaaaggtcaaggtgggtgccacactcgcagcagccgagggctggacaggcgacctccagaacggcctagggacgccgctgtacccttctatttccccaaatccgaaggactggatgcgaccccatgcttcccaaacaaaagaaccggcgggtcaagggcgttgaaaaccatgcggcacgaaggagacgaagtcacgactttagccattgtgtgacagcccgaccccagcccaaagccgggctcagaccacctagcagttcgcccctgccgcaggcattaccgatggcgcctcccggagccggccaatcaggggccccgaggagaacacctccctacgccaaccaatgggagaggcaggccacgcgatggctctacccgggagccaatccaagcacgagggacggagtacgcacatcgggagaggagagggtggggcgtagcaccaggtcagggaacgcgggagccgcagggttccagggatcccgcggctcctcgggcttggcctgaccggcttcctccacatacgcccctctcctacacaagtccggccctcgcgctcctgccgaagcagcaggcgcctcggactctgcgcggctcccgccggccactcaccatgatggtccgcgccgccgagacgatgaccacaggatctgagcctgcattcatcttgctctcctgccgccgtctgccctgcgctgcctgcaagctaggcaaagctcctcctcgcagccacaggcctgccgcgggcgggacctgaggtagccccgcccctcgccctccacctccccgccaccacctccccgcgcatcccactgtgcgcaggcgcaaggccggagcaggggcgggcggggcgcgcggggcgcggggcgcggggcgcggggcggaagtgaggccggggcgcggggcgcgggcggaagtgaggccggggtctgggcttgcgggcagaaccgcggacctcggacgcattacagagcgcctgaaaccccagtgtttctggacaccccaatgttggagttccccgacttgcgtcttgggcttttttttaaaaaatcttagggtttctcgaaacagtaaagactgggggggacaaagacttatctctcgttcagctcaggactggaatcccacgggcgagaatctcgaggcgagcccggcccgcggcgggtctcagcacagctctgatgggtccttttgctctcggcgcttcgggaggtcctatgcgtttctcctggcgccagtcattcgctcgcgtgaggggcttgtaggagcgtctcggtgcgagccccctgccttctaagatcaactctggctgtgaacgggtaggacgccgggagcgtcttagcgtcacaaaagttcctttggttgacgtttggacagtgaaggagcatgtaacaagtggggtcagttttgtttaaaaccctttctgacttcccagcctctactgggcaaagttcataatttttctgagctttctagggtttccaggcaagcttatgagggccaccgttacagcaacttgttgggaacacctggatagtggaacaagaaagctttgtccaaagtcatgaaggggaaaactgttgacggacctggagaatcttcctgaagaactttaagttgattgaaagaatcattaaatcctggaaacctacattaagactttgcagagatatgcgatgggtcagataaatcagagaaggtaaagagtgtaggccccagaggtggggcaatagaaaggaaaaaaattgcataacagtgcaatttcaggagaaatctttagggtctggaatagtgtgaaatcagctgtctactctgctaagaactcagcagcacactgaagtctcttcagttgcttcaatgtgtttcctgtcccctaacatatctgagtccaaggaattcaaggaatgcctccgtggcttttgctctattctatcccattttccccttactccctggccacttctgagtcttgtgggcttactctcacatccccttaacatgttccccaaggctcctactttgcaccagcccctgggtaataccagtcattcctacggcatcaatcaccacctgtatactgacaagtctaaatccttacatctaacctcgtctcctaagctgactgaccctcttcatttaaattcttaaagcacatcaggtcgggcaccttggctcacacctgtaatcccagcactttgggaggccgggagggcggatcatttgaggtcagcagtttgacaccagcctggccaacatggtgatatccgtttctaccataaaatagaaaaattagccgggcgtggtgccgtgcgcctgtaatcccactactggggaggctgacatgggaaaatcgcttgaacctaggaggcagaggtttcagtgaccgagatcacaccactgcactccagcctgagcgacagagagaaactgtctcaaataaataaatttcctataagcacatcaaatttgacatattgaaaccaaactcttccagcctgtttttctgtaatctcagtgagcagtgaaactatcttctgttaaccaaaccagaaatttaccttgaaactccccctaaacatcacttcttccagaaaaaccttccaatctcctgcatttggtcagcatcttacccctaacttcctctttcaacttaccatgtaattcctagtttatctgtccctctactgactacataagctttccaagatgatcctgttacactgctttatgcacagctctagcacattataggcagttatgaatgaacaccaatattctttatggccagtgcctagccatttgaatgagtatgaatatattcttctggagccaagggatatagagtttcctgcctgaggctctatctagagtaagtttaggagccaatcttgagaaggtaattgcatgcttctgcgagtggccaaacagaatctgtcccctgaggagtcctcattatagctactcatatgattactactcatatgagacagacagagactaagaataatgaatgaaggaaagaagaggaatttttttttttttttgagacggagctcgctctgtcacccaggctggagtgcagtggcgctattcggctcaccacaacctccacctcccgggttcaagcgattcttctgcctcagagtcctggtagctgggattacaggcccgtgccatcatgcccagctaatttttatatttttagtaaaacggggtttcaccatgttagtcaggctgatctcgaactcctgaccttgtgatccgcccactcggcctcccaaagtgctgggattacaggcgtgagccaccgcgcccggccagctggaaataatttttaaaattatgtcttggccggccgcggtggctcatgcctgtaatcccagcacttgggaggccgaggcgggcagatcacctgaggtcgggagttcaagacctgcctgaccaaatgcagaaactctgtctctactaaaaatacaaaattagctgggcgtggtgccacatgccgtaaatcccagctactagggaggctgaggcaggagaattgcttgaacctgggaggcggagttgtggtgggccgagattgcaccattgtactccagcctgggcaacaagagcgaaactcatctcaaaaaaaaaaaaagaaataaaataaaattacatctagatctcaaatcataaactcctggactggtgagcagggtgagtgggcaggaagccacaaaaatctccaagtgcttactatgaggagccatcattacagcagtgctatggagccagtttatcctgaaggggccttctcgcatcttcccccgctggaagatgcaatcattcttggttaagtttcataaagagttgcagagtccaagccaggtctttgctacaggctggattcaccaacctaccatgcagcaaattccccttggtctccatgaggggaacagtgaatcaccaaagtggaattgccataggatgaaggcagcagtgtactccttaccactaggggctagctcaacactccctcagcacagccacccctgatgggtccagatcagttaatgacattacctgggattatgaaagtgttcactataacccagggataggtgaactcccaagacagtgacgtagagcagcaggcaatgatttgagtacaggcataactactcatgaaagagggaacatctgagaaagaaagttgtcagaaggaatggcttacattgttttgcaaaagtgtctcaaaaactggagtagtcagttgtatccaatacaccgaggagccaaggaaactgacatctattgcgctctctgtatgaggactaccaggaaccaactggggcaccaatcagggggcactgtgatctttagacttcccagcctccaaaaacagtgggaatgcgcgtgtaaagccacccagtctgtggttttttttttttttcacagcagcccaactaagacagcagtgagtgctcttacaggggagaaaaacaaaacaaaatatcgagcctcgggatacatttgcccaaatcagttaagtgtaataccaggattcaaaccaattagatgcagagccactctatcacctctcttatcacaggcataccagaaaataaagcatccaattccagaatgagaaatactgactctgtgtaccacagaataagtgctctgagttattcatcaaggcgactcaacagaaacatgaaaatgtcacattaacaggtccatattaaattcagtcataaattgtatcactggttgaaaaattaatttcctatcacaaactcttgattacattacaccaaaggacagagaaattacatttttgtttaaattggtcaagttgaaggatgtacataacaaagccaaacacagtatctgatatatcaaacaccaaaatgtttaatcacatgcaaattaaaatcgtataggattttttactcacttgagcagactgtagaaaaggttaatcaaggttgggccggtggctcacacctgtaatcccagcactttgggaggccgaggtgggtggatcacaaggcaggagttcgagaccagcctggccaacacagtgaaacctcatctcttctaaaaatacaaaataagccgggcatggtggcgcacgcctgtaatcccagctactcaggagtctgaggcagagaattacttgaatccgggaggtggaggttgcagtgagccacgatggtgccactgcactcagcctgggtggcagagcgagactctcggcaaaaaaaaaaaagagaaaaagaaaaaaaaaaaaggttaatcaagagacagtgcagtatttaacatactgctgaagaccggatataccttatcagctaaacaagcaaaagcagcaattactttcaaataagttgtacctcagttttcggtattataactccactcccaaggttccttgattgtattacaagttatgtctaaaacaatctttgcttttaacagaaatggaatttcatttcaaccatatatgaaagctacacatttgaggccattcaatatcatacttttatacttaattacctctgagaaaatggagcaaattttgcattcttccaccttaaaaacattttctcctacctacattctaacaccccttactcatatatattaccagatatgttgttagtaaaaatcagtagtgctggccagcgttttaaaacaaaatcactgactacaaagatactctacttgaaatcaggtcacaaaaaaccaacgctgctttcaattaaaactcaaaaagggccaggagctgtagctcactcctgcaatcccaacacgttggaagccaaggcagaaggatcccttggggccaggagtttgaggccagcctgtgcaacatacgaggccttgtctctactaaaattaaaataaatgtagctgggtgtggtagtatatgccttagtctcaggtactcggaagcctgaagtgggaggatcacttgagtcgaggactttgaggtgcagtgagccatgactgcaccactgcacttgagcctaagtgacaaagcaagaccctgttcaattaaaaaaaaaaaaaaaaaaaaaaagcctaagaaatagatgactattttctttatcttttctgtattttaaaatattttgtaacaattataagtcaagaaaaaattttaagtgtgccctaaactccagctccgttttgcaaaataaggcataaattaaaaattgtgtgcaaaacgtaatcgatgcttggtcttaagtttgactgttgtggtacttgaaggataatgagtagaattcaatgactcaatgaaaatgacaaatgctaaacatacacccaaaacaaaacaaaaaactaattaaggagttacaataaaaatctttatttaggtttggtcagtacaggtaagatatctggagtcacagagcaatatgcattaacaggatacaacagttcataaaaactgagtaacatgcacacaaatttcttaaacagtcacctaaagagaaaatgcacagatgtatggtggaaaaactgtatctaacactgaaactactacaggactccatcaatgagtccaacttttagtgtaaaaaactactgtactgggcaaacttggcagtcataaacccacatctactctaacaagctgaatggtgcataagtacagtaacagcatgagtacgaatgcccttacacagcacagatctaaacagacagatttatacagacatcattgtgttgtattttaaggaaaaatttccattacaatttcacattaactcatataaaaataacttgaccctacacaaaatgtccttttagcacattcaaagtaattaactgttacaatttccaaagcggcagaagtattgaagcaaaaaaaaaaaaaaaaaaaaaaaagaaaagaaaaaaaaaacaaagaaaaaaaacaacaaaaaaaaccaaaacgtacacccacaaaaaggcaaattgtgacaaaagtatgcattaattttctggaagtatcctctcccaaattaaatgacactgtataaaaatttgctgaaaaaatattacaaactgaaccctgtacatttacacttgagtccaagccattctgaacgtggcgggaacccacattcgattacctttcccactcactgctttctcctcttgagggtcatgactggagtctgtgcatttgattggtgtgtgagagagttttcactgcccgt

SEQ ID NO: 5064 - DNA, 32623 bp, Homo sapiens
tggggaaaagcaagagatcagattgttactgtctgtgtagaaagaagtagacataggagctccattttgttctgtactaagaaaaattcttctgccttgagattctgttaatctatgacttacccccaaccccctgctctctgaaacacgtgctgtgtcaaactcagggttaaatggttaagggttgtgcaagatgtgctttgttaaacagatgcttgaaggcagcatgctcgttagagtcatcaccactccctaatctcaagtacccagggacacaaacactgcggaaggccgcgggacctctgcctaggaaagccaggtattgtccaaggtttctccccatgtgatagactgaatatggcctcgtgggaagggaaagacctgaccgtcccccagcctgacacccgtaaaggtctgtgctgaggaggattagtataagaggaaggcatgcctcttgcacttgagacaagagaaagcatctgtctcctgcctgtccctgggcaatgcactgtctcggtataaaacccgatttacgttccatctactgagttagggaaaaaccgccttagggctggaggtgggacatgcggcagcaatactgctttgtaaagcattgagatgtttatgtgtatgcatatctaaaagcacacacttgattctttactttgtctatgatgcaaagacctttgttcacatgtttgtctgctatcctctccccactattgtcttgtgaccctgacacatccccctctcagagaaacacccacaatgatcaataaatactaagggaactcagaggctggcgggatcctccatatgctgaacgtggttccctgggtccccttatttctttctctatactttgtgtctttttcttttccaagttctcgttccacctaacaagaaacacccacaggtgaggaggggcaacccaccccttcatacttaataggcaaagcattatccaaacagactgttcacagaaaagaaaaatattaatgaccaaattcacaaaaatatgctcaatctcactaacaaaatgcatggacaagacaattcgatcaacactgtaatcataaaagataatcaccctctaggagcgagttaagtaaaatccatgcatagtattccatacagttactgaaatgaatgaaataatgctttataatgatgaagataaagttaacatttactgagcacttagtatatgccaggcctgtcttaacggtttatagataagcttatgtctcaattctattattttttctatatttttttttagctgcagaaactaacacgaaaggttaagtaacttgaaaaagattaaaactagtaagtaatggagccatggtttaagcccagtgtctggctccagagtcaatgctcttaactaccatgaagaatctccaagatgtattttaagtgcgtgcttggggtggttgagggtggtggtgaagaaagatgcggaagtgttttcgtatgctaagatttattgtttttaacagtttttgcttatatgcatagacaatctttaaaggacacacaagaaactgtactccctttggattttataacatacgtatatgttacccttaaaaagtcaagtttaagttaaagaaaacacacccaaatcattagattctcactaggatctcaatgtgaaatagaagaggcattagatttggaaatatggagtctactcctggttttctggtggctctagtaaaaaatcacaatctctttttttttttttgagacggagtctcagtcgttgcccaggctggagtgcagtggcgcgatctcggctcactgcaagctccgcctcccagttcacgccactctcctgtctcagcctccctagtagctgggactacaggtgcctgccacccgcctggctaatttttttgtgtatttttagtagagacggggtttcaccgtgttagccagatggtcttgatctcctgacctcgtgatccgcccgcctcgacctcccaaagtgctgggatacaaacgtgagccaccgcgcccggccaaaaatcacaatctgttaaaccaggagtcaacatctttttccacaaagtgccagatagtaaatattttaggctttctaggtccaatagcttcgttgaaactgttcgactcagccattgtagtgctagaacagccaggtgatgcgtaaacaatgagagtaggtacagctaggttctaagaacctgggcaacgaaatttgattttcatttaatttcccaagccacaaaatattcttttgattttttttttaacttaaaaaaagtaaaaacagtttttagctcacaatctacctttggcccacgggccgtagtttgctgacacttgaaccattgttcaatgaagggcccgattcattatgtcaaaggtcatttcctactataatattctgaattctctacttttaatattgcgagtaaggcagacagagaaaaaatgaggaaatacatcttagttatttttaatgatccaaatattaaatcaaagtaatgcgttggggccgagtgcagggctcacgtctgtaatcccagcaccttgggaggctgaatcaggcagatctctcgagctcagagctcgagaccagcctgggcagcagcaaaaccccatctctacaaaaaataccagaaaaaaaaaaaagaaaaagaaaaaaattagccggccatggtagtgtgtgcctgcagtcccagtgctcaggaagctgagatgggagaatcgtttgagcctgggaggcagaggttgcagccagtgatactgtaccactgcactccagcctgggtgatagagccagagcttgtctcaaacaaacaaaacaaattagctgggagtaatggcatgcgcctctagtcccagccactcaggaggctaggtgggaagattgctggagcccagggaagtcaaggatgcagtaagcagatatcataccctgcattctagcctgggcaacagacccagaccctgtctcaaaaacaaagaaaaaagaaataataggttgggtgtttcaaaagatttttagccttaagatccagattatttaaaaagtgactgcctactccctttcttggactccctcctctatgagtaaaaatgtattacagcaacttaacacatcattatccccattccactttccactatgaaacttaagacttttgatgacaggataacatctactttatctttgtaactcctgcctctaacgcaatgcctagcaagtgataaggtatgatgcttgttcaataaataaataatacatcacacagtaatgatttccaatttatcttacaactttacatagtacttaagaagtccttaagaaattctaaaaaatcctcaccagcagataagcagcagataaacctgataaacacttacatgctgtagtatagtggtaataactagcgtcctggctctgaggtcagttaaaacatatgtaaatcttagctctggcacttacaatcatgtctccctaaacctcaatttctttgatcctgtaaaatgggggaaattataactcttcatgatgtaattttaaggattaaatgagaaaaaacatataaagcaagtagcataatcctggcaaatgtaagtgttcattaaacaaccacctttataacaaagtatctcaagtcatctagactcctaactggtctttcttcaagtcctgctccctcaaaaatttaatcttccaaaagcagctaaaatgatttttttttttttgagacagaattttgctctgtcgcccaggcgctagctcactgcaacctccgcctcctgggttcaagtgattctcgtgcctcagccactggagagctgggattacaggcgtgcaccaccacgcccctctaatttttatatttttagtagagaggggtttcaccatgttggccaggttggtctcaaactcctgacctcagatgatccgccttttcggctggctccctaaagtgctgggattacaggcatgagacaatgcgcccagccagaagatcttgaaaaaccaattcgggctcaagctttaaatcctctcgtagtttcccactataagaaaagaaagtctaaagtgctcatcttgacttacaaagctaatcatctgtcgcctccttcccctccatgttcatcttgggccattcatcctctgcccattgagcttcagatccacaagccttcagttcctcaccccagcagtttcctttgctaggactgctctttctggcagatgacaggcttcttcctctttcagatctcaccttcttaaatgtcacctcagacaggcaggtatctgtccgctactgtaacatcctctttaaatagcccccatcacacctatttgttgtttgttcagcccctccgcgaaccctgcctctacccgccgcatggcagctacctgggagagtgcctgagttgaatgaatgaaaatagtctgtagggtgcactgcccttgtcaatcacaagcagattaattacctgtgccagaactcacgggagggaaacaccgtccgccagccccgctctttccggctacagataaaagctccaggttccgggggttccggttggtgaattctggggcgacagttcattttccacagggtccacttcaggtttcgctgccggctcggagctggttgacagggtgcgaacctgcaccctgggcaacgggaaaaaccgcacagggcttaaaaatgacggatatgacagcgcacgaacccgctctaacgtctatccgcttttacacccccaatctttaggcccaggggacgaaaaatacgtatgcccacagggtggagtcagcactgaccccgtccttaactcctactgtggtcttcgcagtgccgcgagctctatttcgatccggcacgtcgaatacaaatagaacccgcacgttccaatgtactgtgcaagcccaggcgagtgagctgggagaagggggcaagactaattaccagggttcctgcaaaccgagaacccccaaaactgcgaccgaagcgcatcgctgagacgatctcggaaaagcctcgcctctttttcctcacggacgactcagtcgtcgccaggcgcagccatataaagtcagggacaagcctttggctgctgtagatccccaaatctccacgccagacgccgccgacccggaagtagcaagtcccctgccactgagtggccaaaaggcgatctgttatcctgcaccgccaatcatcgctcacgtcgaggggcacgcaggcccggagcccaccaaccacctcgtagctacgcccaagaccacgcttgttgcttaagtccgggtcaaaggcacacaccccacaaaaccatgtttgggttttctactcggagagcttgggcggcattgactggtccacacacaccccacctgggcaccgcgtaggaataaggcagggcaagagcagttttctccttaaaaagggtggttgtcttcctcgaaccaaaaattttcccgtatggccgctggaaaaactgccccgtcccacccaggttcgcgcccttaaacttacactcctgagcctggagcaaagccggccgatctgcctcacgctccccgagcagggacaaggaaaagacataaacctaaaacgcacgactcgctcagaaccccaactctaacttggagaagggcccgccctccagttacaccccagctccaagctccacccttcttacaaccttttctagaaggcactgaatggcccactgcgtctgcgcaacatcgtttgaggcgaaggttcaacctcttcccagcgtccaacatccgacttccgttctccgctttcgcgcccttcccatcggctatctaattggcaaaaatgccgaccccgccccttccccggagcctcacttccgtcacagtcctgtttctcccctgttgtccctgcctctttttccttcccgccgtgccccgcggccgggccggggcagcgggaagcgggtggggtggtgtgttacccagtagctcctgggacatcgctcgggtacgctcacgccgtcgcagccactgctgtggtcgccggtcggccgaggggccgcgatactggttgccgcggtgtaagcagaattcgacgtgtatcgctgccgtcaagatggaggggcctttgtcgtgttcggtgaccgcagcactggggaaacgatccgctcccaaaacggtaagggcgggccggcctgggtcgggtttgcggccggggagggccgagtcccaccgcgaccggaccccggctccctcgtttctctcctttacctccgcagaaagggcctcggggccccgcagccggacccacccacccgccgttctctggggcagggcgctgtggccccacttttcccacagcgaggagggccccgccgcgcgcggcagggttttgagaccggcaacgcgtggatgtggtgtccggggcgcgttggaaacgcgccctccgcgggaaagcgggcctcccgggctcgcacgtgcgggccagcctcgcacccccttttgtttcagggcgaccccctgagtgtccatgttaaacgccaggtttattttaggaccatttaccagaaaaagagtaggtccatccgcgcgccctcggatgagccggtgccctgtccgcccgcagctgcagtcgaggtcgggcgtccggcgtccagccgtatcgggttgacagcttcttacagtagagttagcccaggaaacgccactcgagtgcattgacccaggagacggcagcgctaacttagcagagcgtttgctgtcaggcctttggatacctacaagcttactgtttcttgatagattcctaatttttttcgtaaacaaatctgaaagtcaccacttccccgttgactaccgatttctctcctcacagataaagagagttttaatgagcaaaaacttgcagaatctgaaggaaaaggctggtatagctgtacgaagtggcagagcatgaaatggtggttattactttttttttttttccccgccatcagattccaccccgcatcaaagctggccaaataggctcgctttgtttagggacagggtcccacctgtcgcccagacgagagtgcatcatagctcactgcattctccaagcacaggtccgcgccgccgcatccggctttgttttattttttgtagaaatgggtttcgctatgttgcccaaaggggtctcaaactcctggcatcagcgatcctcctgcctcggcctcgcagtgttgggattacacctgtgagccacagtgtctgccccatttacactcttagtaggtggtttttaaataattaacacagatttgtagatttggaaatacgggggctgttggatgtcatttacctttaggctgaaattactgtctttcagagtgtggcttatcctcatttcttttttatttttaattgattgtctacagttatggctgcagttcgattgccaatattgtaaaaagttctcttggtccagttggcttggataaaatgttggggatgatattggtgtaagtacacataactgttgtgttagtttccttaaagtaaaactatttcagtgttttgctatgttctttctttgactttatcagaatccacgtactggaaggtgaattaaaggtgaacgtgtattataatggggctgtgttgatttctataagtggttcatatttttcctgcgaatttcttaggatgtaaccattactaacgatggtgcaaccatcctgaagtactggaggtagaacatcctgcagctaaagttctttgtgagctggctgatctgcaagacaagaagttggagatggaactacttcagtggtaggtagactggctaaagaatgatcattttctaaaaacgaccgactttcagaaagttgaagccataagtgggtcatttgtgctgtgtcaaaataagttacatattctgaatgcccagaagattgagcaagaagaaaaaacaaaagaagtacacatttaagaggggaaataagcttcttaggtacagattcagaaacaaaatttgtaattgatagttacagctagtttgtacagtttaagtaggaaagaatttgagttcatttgacaagccccattgttttaaatgttggtattcacaagttttgagggcttatttttccttttatgcagtattcagacatcacacagatttttttatggtctctcaaaagtcttgtttcctccccatcaccccttgagacttggaaagctctcaacttttctgattatttggaggataaaatgtaccaatctgggggagaaacaatgtttttatattattatttttaagagaccatctgtagacagtctgaagtgctgcagtgctgtcatatctcactgcagcctggaactcctgggttcagcaatcctcctgccttagcctcccagagtgcttgggattgcaggcatgtgccaccacaacaactaattaaaaacctcttttttttttttttaagagacagggtctcgctatgttgcccggctggtcttgaactcctggcctcaagtgatcctcccttctcggcctctgtagtgctggattacacgcatgagctgcactcagcctgttctattttttaaatcctgacaggtaatctcggaattcaaaatgggagtgtgagaaattaataaatacatcatgatatgacagtgtgatctaccgagtcagtaaatgtgatacacagtataaactcttcatagatcatccagcatgctgtatagtagaaacactattgtttggtgagaaagatgttaattctggagaaactagatagttgtggggaaaatgtatttctagattaaactttagccatgaaagaatggaatctactcctaaatatgaatatgatctttgtctaacttacgataatgtgatttaacaaatgtagttttcttccataagaagctgacagtctttttgctttaaaaatatttcttagtgttttatcaactgaagaactatcttttttaaataaaataatagcctaatataggtcatatgaatagtcacatcggtttagcttctgttgagcattttttctaaaggtaatagatgtgttgtcttttacggtgtattgatgaactagtttcttattgctgaactagtttcttagaacatttttctggctctacccagttttggccatttgcatttataatacaataagacctcactgaacatccacagtgcttcatggaaactgactttaagaggaaagatgatgtataaaaaaacaagttttcctcccccatcagcgttacaataaacaactgtatttgagaaattgctgtccattgttttgcttaagtggcagtttccaagaatttatgagtaacgtggaggacttggagtgttttgtagcgttttctcccttcacgcccaggtttctaataaccagttaattcatttcatcactaccattttgttaataatatatggccattttagtgtcattccatatgtattgcacatgttgaatatccgcacactcagaccggtgaatgttttctcaacaggttattattgcagcagaactcctaaaaatgcagatgaattagtcaaacagaaaattcatcccacatcagttattagtggctatcgcttgcttgcaagtaagattgtttgcattcagagaaattttttttgatgtaatagttgtaactgtgttgtcttaacgttttgattaataactaaattttaatttgaaaaccttcaatttaatgttttagcatttaagtagtaatatttgaagttaaaaacttggaccagtatctttttctcatttgactaccacattttctcctaataatagattttagtggctatgcttatgggatgattaaacttgccatgatctgaagagggagggttttttcatgtcctcctcctatatgaatggctgaacgggtattattacttacgacattttggctctgtgttaagcatgatgaatgcaagagtttgagtagtgactttataagcgtttttctcccccacacttttaaacagggaagagtgcgttatatcaatgaaaacctaattgttaacacagatgaactgggaagagattgccgattaatgctgctaagacatccatgtcttccaaaatcattggaatgtatccttgtggtttcagataaaatttagactttttaaagcataagactttgagatgggcatggtggtatgtgctgtagtcccagctactaaggaggctgaggtaggagtattaattgaacccaggagtgccgtccaatgtgggcaacatagcaagaccctgtctcgggagtgggtgcgtgtgtgcgcatggttgcgcgcacgcgtgcgtagtagcagcagtatcaattttgtgcaataaaattttgaataccaattttatgcaaattgatatcaatagagaggagtaatgctgtattgaaattacctgtgccttccctgcttttttagggtgaaaaggtaataaaaagcatgtctaaaagtgatatgattgcagatagtgataatgttgtaacattttggtgacaagtaatgcttgctgctttaatgattagattactaaaaggaagtcccttgaaattacccttgatttttcacgtgtgtacccttgtccattccaaacctgttactgtccttaacttttggcgtagaaatggtgatttctttctaacatggtagtagatgctgtacttgctattaaatacacagacataagaggccagccagctatccagtcaactctgttaatattttgaaagcccatgggagaagtcaaatggagagttgctcatcagtggctatgcactcaactgtgtggtgggatcccagggtaaggtttgggattggtttatagaatgagattgctacagattaaaactagcttttcttttggctgggcgcggggctcatgcctgtaatcccagcactttgggaggctgagtcaggtggatcacgagggcagagtttgagagcagcctgtccaatatggtgaaacctcatctctactaaaaaatacaaaaatagctgggcatggtggcacctgcctgtagtcccagctacttgggaggctgaggaaggagatcactggaacctgggaggcggagattgcagtgagccaagatcacaccactgcactccacctgggctacagagtgagactccgtctcaaaaaaaaaaaaaaataaaaaatgttttttttggattatgtgcagtacatctttttgtaatttaaagcacatacaacatggtagaaggaagtgaattaaaagaaattacgtgcatttaatgccataaaatttttctaagataaaatgcatgaattagtctaaatttgtgtgtttacatacaatcgattataggtactctttattatgctttaaggatagacgtattaacttaatcttatgttcaattgtaggcatgcccaagagaatgtaaatgcaaaaattgcttgccttgacttcagcctgcaaaaaacaaaaatgaagcttgggtacaggtggtcattacagaccctgaaaaactggaccaaattagacagaggtatgttgaagattatttttggccttttaagtgtgagtgtcttggaggactttaacatttttagccaatcaaactattttacttccagaaaaattagcctggtggtgtttttagagggatttggggtatacaacctatatgaaaatcggcctttttgtggaattttgattgtatgagtctattaatttaaagatgtaaaagacaggaatctaatttcctcaaagcagtacagaactcagcagtatgtattgactgtaacctactgtttgctagatactggaggtgcaggtgatattagtggttgcatgccagaagagctaatggtggaggtagtgtgaccattgctatagatttgactgcctgcagtcacttaaaacaataaattgtttaggctgggcacagtggctcatgcctgtaatcgcacactttgagaggctgaggtggcaagaatctgaagcccaggaggttgaggctgcagtgactgtgattgtaccactgcactccaacctgggtgacagcgagaccctgtctcaaaaaaaaaaaaaaaaaaaaatagtttaaacagtagttaaaccagacctacaagaaagctttgccaaagtaagaaatgtgctgtcatcttttaaatcagtctgcacgggtattcttttttccttcctcctcatacaacaaagtgtcctttcttccatcaaagccagtccctctacagtaagtgtttagagtctgtttccttctgctctagagccttttctttgattcttgtttcatacttgcatttcaactaattatgctctttcctggattcttcctgtggctcttttgtccttcaagcttctcgtacatccttgtgctataggtactccctatcgtacatctttacaggcagatgtcatggtggtttactacacaaaacttctctggtgcttttcttctcatcccttttcagccctgtttccatttgagggactgcatgttaaggtctctagcgtgaaattcggaagacattttcagcttcctcttacttgacctttagcaaccctttgattatgtccttcttgaaatgctttcgggatggaaggctttgtgatgctgctttgtctggaccatgtcataatactctccaggatagccctttgttcccatgacttcatgtattatctctctatgccagagactctttcagctgttttctaagctccaaacacacatacctctatctagtagaatgcttttcaagcatctcaaagtaacatgtctaaaactgaacttgtgataataccgcaaatctgcttttgaccattttagtgtggggagtccttcacacaggcagaaaactaggaaatgtccttaactcctcctttttaccacactttttctcctaatctgtcaccaagaccgcttgatttctacctccaaattaaatttcctacttttcattttcttgcctagactgttgtagaaacacacccaagctagtctcttaggaagcttttctttcttcttcaatctaaattatattctgttgtaacttcctgtattttttttcctggggcttattacagtttttaccatgagtttatataacagtgtgtagcacacagtcttgtttagtagacaagctgcttttgaggttgatctgtaattcattttactttaaaaatcttcgaatgatctattcacatggcttcactcatattgactcttcaaatctggatctccctagtttatggtttccatgatgtaagtgactgcctcctgggagcttcacctgagtaacagagagacttcaaacttaatcttgtcctcaactaaactctcatttcccatcctgcccccaaactcttgttatttattttactccaggagtcacccaagccataaaatttgacttttctgttaggttgtctttcagcttatatctcatgttattatcttcttgtcttcagccattcagtgagtttccacattgataatcagggaatccttttgaaaacacagatgatatactagtcttgttagagatattaagcttagtatctagattgtttggtgtaacctgcaaggtttttcactttctggttctgccttcttttgtgctttcaactctggactcctgtttttgtttgtttgttttttttgagacggagttttgctcttgttgcccaggctggagtgcagtggcacggtctcggtcactgcgacctccgccttccgggtttaagtgatactcctgcctcagtctcctgagtattgggattacaggcgcccaccaccaggcccaactaattttttgtatttttagtagaggcgtttcaccgtgttggccaggttggtctcgaactcctgacctcaggtgatctgcccgcctcgcctcccaaagtgctgggattacaggcgtgagccactgcacttggcctggactcatcttattgtccacctcctaggctaaatttatgtcttttatgtgcttgtaatctctgcataccatttagtgacacttgccctggagtgtgattggtaatccctctccccactagatccttgaagcaggacctgtgttccctgtttaaccatagttctcaattagtaattcaaatttgggttgggagagctaagtggtaatttttaattccttcaaattttccatgaattggactaatttaattctggtcagagataacaaaggataatacaatttgatctatgattatcttgtgataaatcttaatggaagttaaattatttttaaaaatcacagaaggtaactcaggttacaaaaatatttgcagagaatcagatatcaccaaggagagaattcagaagatcctggcaactggtgccatgttattctaaccactggtggaattgatgatatgtgtctgaagtattttgtggaggctgtgctatggcagttagaagagttttaaaaagggaccttaaacgcattgccaaagcttctgaggtatgtcttgtgctggctgtcacataaaatacttttattatccctgatcctatcaaggtctttttacattggaatattgacagaaaacagctcaaaaacatttatattctcttaagctttgtgctaccaacacatttatagagccatttttcatgtaactggagaaattttgttgaaatttgtgaactgaatttgttcatttctaaaatgacagttccatcttaggataaaagagttaccgtgtgctgcctaactaaattctaaacttgtaatatagcacttttaccacaaagctactgagtccaaggatattaaaatcatgaaagagcaatattcacagatcctttgtaatctcttattagcaactattctgtcaaccctggccaatttggaaggtgaagaaacttttgagctgcaatgttgggacaggcagaagaagtggtacaggagagaatttgtgatgatgagcgatcttaatcaaaaagtaagagccactttctaaaattgtaaagttataccgattttgttagtaaaagtaggttttcttcccatttatttgctgcttgtagtctcacagtgatacgagcgttatacgcatgggataaaataacattgggccactgtaaattgagatgaagtaaccatttcatctcttctgcagggactagacattgtttctgtatagtatatctaaatatcctgtgtggcaggacttaagggaactttatgtagacttattttattaaaatgccattttttttgagaattgatggtcttggcaaaaaaaaatttttaaaaatgctattacaagaattgtacttttttttgaacagtactaaggctcgtacgtctgcatcgattatcttacgtggggcaaatgattcatgtgtgatgagatggagcgctctttacatgatgcactttgtgtagtgaagagagtttggagtcaaaatctgtggttcccggtgggggtgctgtagaagcagccctttccatatacttgaaaactatgcaaccagcatggtaagaacagtcatttcttgtcttagaggcctgagacagtagctgtggacttcaattttttttttcccttttgtgaagtcacctaattttcttctttcctaggggtctcgggaacagcttgcgattgcagagtttgcaagatcacttcttgttatcccaatacactagcagttaatgctgcccaggactccacagatctggttgcaaaattaaagcttttcataatgaggcccaggttaacccagaacgtaaaaatctaaaatggtaagcatgtttcccgctctttgttaacctctgcagaacaggttgcattaaaaaggatagtagtcaatacatgtcagcaaacataagtaacagacttgtcaaatacttaacatgaaaaacttcacacaagcatttgttgttcagtcactgtaattcaagggataatgactaattattagcactgggtgtcttcgttaactgtgattgctaatctctccctgcttcttttggtagaaagactaccacaagatctctagtctgatttaaaaatcaaccttaatacttgaatgaaatgctggagttataggccacctaatgaaattgtaagcggccgttaaataattctttcttaattgcaggatggtcttgatttgagcaatggtaaacctcgagacaacaaacaagcaggggtgtttgaaccaccatagttaaagttaagagtttgaaatttgcaacagaagctgcaatcaccattcttcgattgatgatcttattaaattacatccagaaagtaaagatgataaacatggaagttatgagatgctgttcactctggagcccttaatgattgatctgatgttccttttatttataacaagttaaatgcaattgtcttgtaccttgagttgagtattacacattaaagtaaagtacaagtgtaaacttgggtttttgtgatgtaggaaatggtttccatctgtactttggtcctctgattcacatattgcaacctagtactttattagtttaaaaagaaattgaggttgttcaaagttaagcaattcattctctctgaacacacattgctattcccatcccacccccaatgcacaggctgcaacaccacgacttctgcccattctctccagtgtgtgtaacagggtcacaagaatcgacagccagatgctccaagagggtggcccaaggctatagcccctccttcaatattgactagcgggggagaaaagatttagattgtttattcttctgtggacacagtttaaaatcttaacttgtctttttcctcttaatgtatcagcatgctaccctttcaaactcaaattttcatttaactgcttaggaataaatttacacctttgtgaaaattcatccctgcctatcttacctcttccttttatgccaagtaagccaatgtctttttttttttttttttttttttaccttgggagtaatgaactcagtcctagtaactagtatttctttaactattacccacatggccaacactagaagatactatcttaaaattggattgtgaaattcactggtaagctctcagggttactgtgcatctttaccttctctgggtttaatccaagttctttaactattgcagcagagacactgcaaaggcttcattgatttcaaatatgtcaacatcttccagtgaccaacctgctttttaacctagaggaaagattcatagaaaagaggtctaaacttgggtggaaaggctaaagttaaccattctttgtcaacataaatatatgctgcatgatactggtaactgctactttggttgttcttaggttaatacagtgacattctcacacatttttgccttagtgacatccattccaccaaaaggttaagggtgtgatctaaaagatcccttagaaattctaaattgtcttaaaatttgaaccagtagcatctgttatgtgtacctaaggctaatgtaacagaatcagttcccctgaaagcatgtgatccaaatgctctcagtggctgggggtagtggctcacacctgaaatctaacacttggggagcctaaggcaagaggatcaattgaactcaggagttcaaaaccagcctggcgacatagaccttgtctctacgaaatgaagaaggcgtggtgcacctgtagttcgaggaatgggaggctaaggcaggaggaatatttgagcctaggagttttgaggctgcagtgagcatgatggtgccactgcactccagcctggacaacagagcaagaccttatctcaaaaatagaataaatgctcttggttactcttctggtagggaaagactagagctaactacatgaataactcacttaaggctaacaggaagacaaatttcataaaagggaatagggttatactcacagttgctttatggctggaattggtcctattcccataatggaaggctccacacccacttgggccaggaaactatccgtgctaaaggtgtaagcccacgtttatcagcttctgacttcttcaaagaacgacagctgcagcaccatcatttattcctgtaaaatatgagtgacttaatttctccatgcttattaacctcagttacatatctgtggcttctttaccacctgaagacatgagtaaatgattttacctgttggctaaggcatttactataattcaacagactttacatagaaatatgtttggcaatatattgaccacaaaactttccaactagagaaagtggtaggattacatagtcggggctgggcgtggtggctcacgcctgtaatcccagcactttgggaggtggagggggtgaatcacctgaggtcaggagtttgagaccagcctgaccaatagggtgaaagccattctacttaaaatagaaaaatcagccggtgtggtggtgtgcgcctgtagtcccagccactaggaggctgagacaggagaattgcttgaacctgggaggcggagattgcagtgagccaagttgcaccactgcactccagcctgggcgacagagtgaggctccgtctcaaaaagaaaaaaaaggattacagcagttggggaggggagatctctgacaggaaatggaagaataagcctggcttcacaaggaggtattgggagtttctggtactggaaaaatacaaaggtagataaactgagttccctaatttacttcttcatttgtatgtctagttgggatgtcaagaaaccaaattattctttcagtataggttaagtcaatgatcaaatacagagaaatgacatgtttccttaaatgttttaagaataattttgtacataaatattgagttgggtgtggtggctcatgcctgtatcccccagctacttgggaggttaaggcagggggctcacttgagcccaggagtttgaggcgcaagtgagcaatgatcatattgctgcacacgaacctggctggcagagtgagtccctgtccaaaaaatagtacttttgtatataaataaagagaaaaatattcactcggtagacattaagaacatagtattcccccagatgtccttcagaaaatctaacctgaagcattggctgggggactgttcccgttccatcagtaagaaagtaaggctttagcttggacatggcttctatgtgctcccatggcgaggaaactcatctgttttaacttcaataagacctaagcaaaggaaaacaattactcaagattagtccagagacagaagtaagtgtgctgggaatggtgggttctctccattaaacatgaggattcatatttagcagaaaagttttaatatgtgaccactttgatgcaacaggaggaaagtacacacaagaattattgtacatgaaaacaatttatgagtatgtcttatgagacacctgtgttttccaaatccataggccttcctgaggaaagtagctaccaggacctgtttgtgccaaattctgctatagtttgggtcatagtacttggctggttacgagtggtggatcaggcagtctcaaagccaatcgtgcactgctggcaggacataagagatatcagtatcaataagggagcttgacgggagcattctgtattagaaaatagcgagtgaccccaaagatccaccctttagaaatgtgaaatggagatcacacagaaacagcgagaagtaatgggttccacttctgaggaggttgagcctatacaggaaacaggtcagctggtgcctcctaacaacatgagccagtgctccagcttctcatgaaacctgctgtgtgtgcacagtggtcatggacctctggaaccaagagtgcttgagtgctgacataggtcccatgttaccgtgtcctgtaaaccagcataccccctccccacattcatgtatccaggacatatatttgcaacctgaaaaactaactaagatataatttctaaagattcctatgtattactcttttagatgttactcttactataaataggttgatgtttaaaccactatgatatactcaccttttctagttgacaccaaactggtacaatctctttgtcaaaatggccagctttctgtgcattctctgtcctgttctggacagaactgcaaccttgtcctgatcttctctactcacttgccattttttggctacatttcagctgggaaaggagaaaaacagcaaaaaactaacattttcatgaactggcatttgatgctcaagtcgtccacatttgaccaagcactgactgaccacatatgctagcaggctcatgtggcctgtgcaatgctctgtgtggggtggccctgcctgccactggcagttggtttggaatgttgcagtgactctcaggagtcatacttctctccttccctttctatataattgtaaactacagaaatttccttcacccagagtcaccatttatattttccctccatttgctttaatatttctttctgaaccatctgagagaaagttggagatacaatgccttcttactcttaaatttaatttcagtgtatacttccccaaaacaaggccactttcttacataagcacagttataaactcaagaaattgggccaagtgtggcggctcacacctgtaatcccagcattttgggaggcgaggtgggaggatcacttgagcccaggagtttgagaccagcctgggcacagcgagacctgtctccattaaaaataaatttagccgggcatggtgtgtgtgccatgtagctagtagtctagctgcttgggaggctgaggcagaaggatcacttgagcctaggagttcaaggctgcaggagccatgattgtgcctctgcactccagcctgggtgaccctgtctcacaaaacaaaacaaaatcaggaaatttaacatgaatcaaacactattatctaatccttggtccacattcaaattcacctatatttcagtaatgtccttctagctcctttatttgagccaataaagaagcatcattgtacaactatcaatctctctagtttgcttttgtctgtaacagttcttcagactatcttcttaagcttgatatttttgaagaacatgggcgagttcttttgttaagggtcatcaatttgatttgtctgatgtttcctcagaattagattaagattctgccaaaaggcaggtatacactgaatgatagtatgatttttctcagtgagtcttattaggacacaaatgacaatcagttatcccaggtgatgttatctttgatcacttggttaaaatggtttggtattcaccaggttctagcttttaaaggtaccattttttcatttataagtaatcaataatttatcagaggtttttttggattatccaaatatcttcttccccatcatattttcacccactagttttagcatcattcatgactttctaactccaacattccttctattggtaagatattaattggcattttccataaagaaaaccttttccttttctcccatttattcagttatttatatcaggatggaccatacattttcattttattgaataagttataactcattactttcattacttactttgatctgaaatttttcaatacttgggcagttataacccattactatcattacttatttgcacgtgaaattgttcaaaatttaggcagttacaacccattactatcataacttatttgcacgcgaaattgttcaaaatttgggcagttacaacccattactatcattactgactctgatgctaaattgttcaaaattccactacaggaaagtggaagccccgtaggctgcctcctgtgtgcttcaacatgtccctgagcatgtccttaattttttagcattttttccctagccttggaaaggccatttctccaaacaaccttagttccttttagtggataaatgtatttagaagatctggtgtcaggactgcttgttgttactggtttgtcattgtttctaggtctgttcagtagaaattccatatgtattatttataattttacatatacacacacactcatggtaacaccttgagtcatactgcattttgagttctccaaaatgcaacctaacaccacaagctacattcttctcctttccgtatttgtaactctcttctacaaatgtgagaattggccaggtttggtgggtcaacctgtaatcccagcactttgggaggctgaggtgggaggatcccttgagctcaggagttgaggccagcctgggcaacatggtgaaaccccatttctacaaaaaatacaaaaaattagcaggcatggtggtgagtacctgtggtcccagctactcaggaggctgaggtgggggttgcatgagccaagattgagccactgcactccaatctgggtgccagagtgagacccgtctccaccacacacacaaaaaagttattgctttgctttctatgtcttgtctttacttatcaagctgttttctttctttttttttttttttgttggatgatgtctcactatgttgaccaggctggatgcagcagctactaacaggcaaaatcaaccatagtatactatacaacctcaaactgctgcctcaagtgatcctcccaccacagcctccctagtagctgggactataggcacctgccacgcaccctgtaaaagctattctcttatatatacttctagaagctttacattttttgctttatttttaaatccatgatttatctcaaattagcttttatatagggtgtgaggtagggatcaggttcatctttcccatgtgagtaatctgttattccagcaccatttgttgaaaagacttaatttctccatttcattccattgatgcctttgttgaaaacgagcataagtctgggtctattctgaactctgttctctttctctgtccttatgccaaaaccacattgtcttgtttacaaagctttataggtaatgttaaaatcagagcatgtaagtgctattttctgacttcaaaattttttggctattctgagtgctttgcattttatacagtatttatttacactatttatttattatttagagatggagtttcattcttgttgcccaggctggagtgcaatggtgcaatatctagcttactgcaacctccgcctcttaggttcaagcaagtctcctcccttggcctccagagagctgggactacaggcacctgctgcaacacctggctaattttttgtagttttagtagagtggggtttcaccgtgttagccaggatggtctcaatctcctgacctcatgatccgcccgctcggcctcccaaagtgctaggattacaggcgtgagccaccgcgcccggctggaagctatcttttgttgttgttgttgttgttgtgtcactatgttaaccagactggaatgcagtagatctcacaggtgcaatcatagtagactatgatagcattgcccaggctagactcaaactcttgactcaagcaatctcttgcctcagctcttgagtaggtgggactacaggcacataccacctgcctggctcctttagtatttcttgtagtgtaggtgtgcaggcaattcattttccttcactaaaaatggctcttcactttcactcttgttttttttttttttgagacagagtctcacttgttgcccagactggagtgcagtggcatgatctttttttaactttttgctacaatttgcaaggtgtaatttttcccttgtctatcttggtctttgaacttcttttcacaccaaatgtgaaattttcttcagtttttttctgccccattctctctcttccttatgtatgagattcctatccatgcatgctagtcctatttattttgtcctgcagaccaccaaggctctgttcatttaattttatttttttgagacggagtttcattcttgttgctcaggctggagtgcaatggcgtatctcagctcaacgcaacctccgcctcccaggttcaagcgattctcctgcctcagcctccgagtagctgggattacaggcatgcgccaccagcctggctaattttgtatttttagtaggatggagtttctccatgttggtcatgtgggtctcaaactcccgacctcaggtgatctgctgcgttgacctcccaaagtgctgggattacaggcatgagccaccacacctggcctatttttaatttaatttaatttaatttaattttttgagacagagttttgtttgttacccaggctgagcgcaatggtgtgatctcagcttgctgcaacctccacctcctgggttcaagctattctctgcctcagcctcccaagtagttgggattacaggcatgggccaccacatccagctcattttgtatttttagtagagacagggtttccccatgttggccaggctggtcttgaactcctacctcagatgatctacccggcttggcctcccaaagtgctgggattacaagcgtgagctacgtgcctggcctgttcatttattcttcattatttttctctgtgttcttcaggtcgtgtaatgatctatcttcaaacttcctgaccctttttcttctgtctccaagatgctgttaaggcattcagaatttttttttctttttttttagagatgaggtctaactatgttgctcagcctatctcaaacccccagcctcaagtgatcctcccacctcagcctcccaaggtgctgggattaaggtgcgagccaccatgcccggccccatcccagtgaattcttaatttcagattgtgtacttgcaagttctagaatttctatttggttcttgtttatattttttccttttactcctgagtgtccacatctattcctctatgaagattatattttcctttgtatctttaaacatatgtaaatagagcctttaagatcctcatctgataattctagtattgcagggtctgttgactgtttggtttttttccaccctggttgtaagctatattttcctaattctttgtgtatctagaaattctcattgcatgctgaacattatagttgctacataactggacatagagattttattattttagagaatatattgagttttgtttccacaagcagtcaaaatactggcaaatcaccttatccttttgaggcttgtttttaagcttattagtttgggtctagagtagcttttactctaggctttggccctacccctaaactgtggtctttctgagatgtcaatggagtgtccaaggattcagtaaggtttccactcgcttgtccagaacttttatctcctagtaatctataaaatcccagttcacctctcctttgcagctcttttctactaggccttgtaagctgttatctacaacttagtatttgatcaaagacttaaggggaaccttttgcagatttctggagctcttttttcttctcccccttattctgccccacaaactccagccatctcagaagccccaaattctctgttcttcagatcactgagaccactgtttccagcttaggctctgcctctccataacacagttgggaagtgccctgggtagagacagtgacagtggggttttcccttctctcaaggatctcgtcttacatgagtattagtcaaaacctgacatacataaaacagtggctttatatattttacaagttttatgcttgtttatagtaggaaatctaatctttgtcaattactccatcatgactgagccttttttcttttctttttttctaaagaagagcaatttattttcttacagttctgaggctggaagagtaccattcaatccacagtacaccttggaaagggctcgggatctgaattttaatgaccacctctagttatggttgaggcagttggtcacacagtgtcttccattgttgcctgtgtttttatagccttctctgttgtggctgtaagtcgagaagtggtcaagatgcttgagcttctcattgcttcccatatccctaagcccttccttccttcctagcattcatgccacagttccctcttggaatcttgtacttttccccattacctttttcacatatttatgtgtacataaaaccagagccattgctgcatgcatttgagcaaggtgcttaacttctcagggttgattctttaactctaaaatgtctattctgtttcttaagttttacatgtatactaaagaaagagtgcttttgatttcccagttgctttgccattaaacttagaccacaggacccttcacatgaatgaccaataacccaattgtgtagtacaaaaagtacagctaggtaccaaaaaaaaactggtttatctctgtcactacctctgccacagaagcactatttgtgggccctgtttctcatttggtaaaatgaggggttgatccagaagaactctgaggtacttcccacttctaacttctctgataatcaagagttcacaaagaagagaatacttacttcacttcagttaatcaagaagagatataaaaatccttaagacagtctctggccataaggacgaaagcacctaagaacagattagtatatggtctttttaacctttttaaagctaatacagtttcagccatgtctgcttacctgtaatacccatatgacagttgtgaaatgcatctgtaagaccatcacagagtaactgtcagtcagtggcatctcacctatctttactcctgttctcaagtaagccaagtgagagcctagaagtcagaaataaaaatggatttaggcttagttgcaattagtcttctccccaaatacaactcaaaactatctagtatttcctaagtcttcatctaggcccctttgcagccctctccccagttctaggtcctcagccaggccaaggtctaaagacccctggaattagcagattcatctttcctattgttgggaacgattactctcctacctacccattttcaattctccccaaacctacccattctgtgtcctgtttccttaagaattccatttattctttccatcgagcaattaattatctgttaaatgaagaaatcctctaagggcttaagtaaagctaacaatgtttacctatttcaatggatgacataatgtctacagtgagaataatcaggctaactaaatgtggggagggatttctgagtagcggccagtcttaactctcaccaactcaacagcaggtatttagaatggaaagagtcattgattggacttagagtcggaagagttgtatttgaatgctgctctggtcctcagtttccttacctgtaaactgggaatggtatcatctaccctatatgggctgttgtgaacacatgtacaaaagcacctggtaaagtactacacagatgtcagtgtcatccatcaaaatcactccgattatttttgttacctttagcctgcctcctcctgaacctcagaatggctgggctgaatcagcttctatctagggaatctgcacctcagcccctgagctgcacagtaggaagcagggggtatagtttttctttcaaccactatgccagtttgaggtatggacttggtgaaacaaatcatgcctggcaaacctactggagaagggcaccacttggtggtcccttttacatgttctataccctgaaaaggtcaaaaagtctggtccccaggatctccttgtatgtgcaggaaggtaagtggcaacatctgttttttgccttttactcacaatgggaaagaatttaaaaccaaggacatcaagcaactaatatgaatttaattcagaaaatattacatgctcattaatagtttagaaaaagtatattcggttccaatcacactggttgataaacttctttcaacccggatttcccacccaaactgaagaatacttcacattcaagtagggatcaaggtgtcatttctgtttatttgttcactgtttggttccagctctgctatgcatctgtttactcgttctggcatagacatgagtttctcagtgtgaggtcagtgaaagccacctcatcagagagccttaccttgctcatattttccatgcctcctgcaaccacaatgctggagtctcctatcctattgactggactgcaaggcacacagcttttaggcctgacccacagatcatctggcagtccatgctggaacagagtagggaattcctgcacccacactggcttgtctaacaggattcgcccacagcctagaaagaggaacacagaggactcttagcaatcaaggagaaagacaaaagtcacagtgaaagtgtgtggaaaattgccagttgggttacctgccacttctgaaagcctcaggtcaagtaagtgcccactggaggcaaaaaggcctgtatacactctccacctgtcacgtctagcccttgaatatatactgccttgtgctgctctgtaggtatttcatagatataagtttctcctccataaataagtcattaatacattaagaaagaagtgtcatcctcatcttttatatggcttaaatagttgggcgcggtggctcatgcctgtaatcccagcactttgggaggcaaggagggcagatcacctgaggtcgggagtttgagaccagcctgaccaacatggagaactctgtctgtactaaaaatacaaaattagctaggcgtggtggcgcatgagtgtaatcctgttactagggaggctgaggcaggagaattgcttgaacctgggaagcggaggttgcggtggctgagatcacaccattacactccagcctgggcaacaagggcgaaactccgtctcaaaaaaaaaaagtgcgggggggtgcttaaataagcattatcaaacctatgtctaataaacacagatataacctaggcattatcagtgtttctaactagggccatttgctcccaagatcatggttaagacacttgagaagaaaaagggttacttaaaaaggaaaacctttgataataagcagtctgttcttgcttagtattcattacactatgcttaaatggttatataacaaaatatataaaactcagaattcacaaatacctttttttctcattctgagtactgaaacacaaatatctttcataattcaactatgggacttcctttagttgggaagaaatacataatttacttaaagagcacagaagagaatggagttaaaagtttcaaatattctcaatcgccattgtctgttatagagtcaatggtaaatgtttataaagtggttactctattcccagtttcagatatactcaacctaccacccttccttggagagtttgtggggaagaactagcaaataagtcgctgataaaacttagagattatattcatcacaatgttatcaatctgggattaggctggaaactaaaacgggtaaggttacttgagactgaaaacatatgcaggatcatatacatattaaaaagacagcccagtgcggtgcctcaggctgtgagcagtggctcacacctgtaatcccagcactttggaggccgggggggggggcgcattacttgaggtcaggagtttgagaccagcctggacaattggtgaaaccccccctctctactaaaaatacaaaaattagctgggcatggtggtgcacgctgtaatcccagctactcaggaggttgaggcaggagaattgcttgaacctgagacagagttgcagtgagccgagattgtacggctgcactccaccagcctgggcgacagagtgagactcatctcaaaaaaaagaaaaagaagaaatgaggtacagggctgggcatggtggctcatgctgtaatcccagcactttgggaggccgaggcgggtggataacttgaggtcagaagttcgaaccagcctggccaacatgttgaaaccccatctctactaaaaatacaaaaattagctgggacagtggcaggcacctgtaatcccagtcacttgggaggctgaggcagaagaatcactggacccgggaggcagaggttgcagtgagccaagattgcgtcactgcactccagcctgggcacagagtgggactccatctcaaaaaaagaaaaagaaagaaatgaggtgctaacacaattataatgctagcatttagcatactacgagcttcatgagaatgagaatttctatctgatatgacattgcttatctccagctgctaaaatagtgcctggcacaaagtaggtgctcaataaactttgttacatgattgtagaaggtatctggctcaaggaataggacagatctaagttcaaggctagctccacttcaaactgtgaccctggtaagtcatttaacctcttaaactctcatttttcatttgtaaaatgaagataataggatataacagacttgtgaggaagattaaatgaggaatgaaaggaaagcatttagcacagtgctttaaaagccttaaacttagtagacatgcacggtagtcccagctagctcagaagttcaagggcatggtgcaccatgattgtgcctgtgaaagccattgcactcacgcccaggcaacagacagactccacttctacaaaaaaatttaaaaattagccaggtgtggtggcctgctcctgtaatcccagctactccagaggctgaggtgggggataccgtggagcccaggagtttgaggttatagtgggctacgattgattacaccactgattccagcctggacaacagagtgagaccctgtctctttaaataataataataataattattaattaattacgagtgttcaaacccaaagaatcagaagatgggggcactctcaggactagctatattcctctggggagtgatatgccccatttgcaaggggcatgatgtggcacctatttccaagctcagaactgagccctaagagggcagggaacttacctgtattgttggaacctactcccagcactaagcacagtatggggcacataggaggaactgaatacatttttgttgatgagtgacactttgaggtagtaaggaggagcaggcatactttcctatgcgtcaggctgccctgctgctgcttcttcttcttctttttaaaaggagtctcactctgttgcccaggctgatggagtgcagtggcacaatctcagctcactgcaagctccgcctcccgggttcacgccatctcctgtctcagcctcccaagtagctgggaatacaggcgcccgccaccacacccggctattttttgtatttttagtagaaacggggtttcaccgtgtcagccaggatggtcttgatccctgacctcatgatccgcccacctcggcctcccagagtgctgggattacaggcgtgagcaccgggcccggccggccctgcttcgtaagaatgaaaaggcagtgggccgcctgtagtccagctactcgggaggctgaggcaggagaatggcgtgaaaccgggagacggagcttgcagtagccgagatcacgccactgcactccagcctgggccacagagagagactccgtctcaaaaaaaaaaaaaaaaaaaaaaaaaaaggaaaagaaaaggcagtgtaggtggtgtaggtcagtgtctaagttcattcacaaaaagcatattaatgaagctaagtctttttgtttgtttagagaggggtctcactctgtcacccatgacggagtgcagtgacacaatcactgcagtctcaaatcctgggctcaagtgatcctcccacctcagcctctccagtagctgggaggcacaggccacatacctggctattttattttttgtagagacggggtcttgctttgttgcccaggctagttcaaacttctggactcaagtgatccttcctcctccgcctcccaaagtgctgggattacagcgggagccaccctgcctggccaagaagctgagtctcaagctggatagaagctactgacgggctggaagaagggggccaacaggaggaatcataacagagggaactctgagcaaaagcaggaggcaagaacttgagtgagtgagagagtgtgtgagtgtgtgagagtgtgtgtgtgttgtgtgtttatgggctgtttctaataagcctgacttctcctggaatcactgagacttactgctgccaagacatgtccaaagatgacctcagacacatcttccggagccacagtggccccttcaagacttctttgatgacagtggagcccaggtcctggacaggaacagcagctaaggaccattgaaggaacctacaatagaaaggcggagagcgtggacatcacaagcctgcgggtatacgggaaccacctacgagcaggggagcctcatgaccctgtttggcaaggccacgcgagaggcagtgccctctcctcccacacgttcctacacctgctggtctgagcaaaggtcaagtgggtgccacaactcgcagcagccgagggctggacaggcgacctccagaacggcctaggacgccgctgtagcccttctatttccccaaatccgaaggactggatgcgaccccatgcttccaaacaaaaggaaccggcgggtcaagggcgttgaaaaccatgcggcacgaaggagacgagtcacgacttctagccattgtgtgacagcccgaccccagcccaaagccgggctc

SEQ ID NO: 5065 - DNA, 60158 bp, Homo sapiens
ggattcaaccttaacccaaagtataaattaaatatccacaagtccttattgatatagtgttaaataaatcaattggaaattaaagacaaatttcccatgtggaggaattcaaataattacgtagctactccaccctcaaggaggaggaacataactcctcactccataaatgtgggagtacatagcatttccttccaaagagtgcactatgaaaaaaagggtgaagaaaaacaattactttacaatggagaaatctgacaacactgctgagccaggtgatcaaagtcaatgtaaaagagataaatcatgttgatattatgtacctctgatgtaatgtggtatcaagaaaatagcctttacctctgtggtattcctcctccaaacttaacaacctcagtcaaatcatgagaaaataccacaaaaattcactagaggaatatcttgcgaagtatctgaccatttctcctcagagtattacagccaagaggagcctaaagatacttgagaactaaatgtaatgtaccctggatggagattggaaaagaaaaaaagaattaggtaaaaacaaaagtaacctaaataaagtatgattttagttaataatatattaatattggtttattaataataacaaatcaactacactaattaagttattaacagaagtaactgtgcaggctatatgagaaatctttgtgttattttagcatttttctgtaaatctaaaactgttataaacaataaacctattttaaagtaacatatacttatacaatgtgagaaaatataatggcaaaaaaagaaaatgcaagcacaaactatattcgtctctcagggataataattattaaggtgttcagtgaatattgttctaatcctttttcttgctcatatgtatgtatattgtttaaacaagaaatctcaaaccatatctacatctgctgttaccagactgcttcctttacttactaagatatggtaaatatactatatttacaagtttcatatttacatataccaaactatacaaaatacacacttttatagtattattttaaaatgcttcatggaattctgttgaattgatacgccataatttattgaactatttttgtcattaacaaacatggtatccaaattttcactataccacaaagttccttgtgacaccatttttaatttttttttttgtgcactttatgcctaactccacaagacactgttattaagagccagtgttttctccaccatactttctttgctcttcatcccttcttgcatctcagattttatctgggtcaatttttttctaattgaagcagatttttaaagatgtcatttggaggagtcctttactgtaaattttcagttttagtttttctggaaaatctctatttcaagtttatacttaaaagaatctttacagaatatatatagaatacttaattcacaagtattttctctcagcacattgagacaacattctaatgtctcctaattttcattgatactgttaataatttagtagttgtctcttctctttcttcttgaaaataatctgtcctctctatctagttcctttaaatatcttcttctctctctgatattctgcagtttaattatgatgtatctacttgtgtgtatgtgtgtttaaaaattatcctgcttaagacttattgagcctcgtgaatctgtggattggtatctgtgaaggcagacaatggctccccaaagatcttaaatgtcttaatctccagaacctgtgatagttaagttaaggttgtagatgaaattaaagttaccaatccacagacctcagggtaaaaagatatcctggattatttaggcaggcccagtataatcacaaggattcataaaacggaagaggagacagaagagatggtcagagtgatatgaagtaaaaaggattcagcttactcttgctggtttgtaaatgcaggaagggaccacgagtcaaggaatgcaggtagcttctagaagctagaaaggtaagaaacaaattctcccctaaagcctccagaaagggatacacctgccaatacttcattttatccctgtgagaccagtgttagacttctgacctccaagagtataagacaataatctgctgttttaagccactaagttttgtggtaatttgttatggtagctatggagaactgtacagtgcctttcaatagttcttggaaattcttcaaatatattccccaaatattgccttgcaccactcactctatcctctatatctcttgacctctctttaacattttttattttcttttttggtaattatttaaaacaattggcttcttgttccacttcaaataaattcatattttatatctacatattaagaattagttcataaatgtaattgttgtatcgtatatactttaaaggaaaattgcatttatacttggatattattatattttaggttttgaaatttctttttttaatgtctgataaatttattctgatcaaaattaaaatcttattgtatttacagtagtctataaaagagtttacatcaattctctcctttaaatgctagcaattcagttttgtgtggtcaagataatttagaatccttttatggtaactgatatgatacaaaggatttttttggttgtttcaaatttgtatgtgcgtatatatgtatagggggtagaaaatttggttagtgactctatttggaaaaatgaatgttctttttggagttttagattcccagtgtttcaaaccaagtttgttttgataaggaattcagtgaatctttattttctcgtagagaatttttaaacaataccttcaaaatattgtatgtattcctatataattttgccttggaataaaaaaagtcatcacataagaatatttttaacttaagaaattttttcaagattctttcaaaatgctaactccctcatgatttgaaaatacttttagagtttaaactattatgaccatgtagggataacttaaagttccttctaaatttttttttcattaatgtcatgcttctttctaagaacaaagtgtttcaagttataaacagactgttttttcacatagctttcatacatcctgactttctatatctagtgggtaatacatttccttccaacctttagtggggtgaagttcatttgtcttctaatctaaaaaatacgttaactcctgacaacctctgacactcaacagaaacacaactgtactttggattaatcatccatctttatttcatagtctccttatttatcaatgcaaatggaagtatagcaatatttcacagtgtcatgtactacctaaggaatttcattgcaatagcattgttttgaatgtatcatttgattttgatctaactatcatagatcagttttacccctgtatgttcagccgaatgtctaaccacaatttcacaaaaatcaagggctctgttagttttcatacaaaattggatgacttattatgaagacagtcccaattaacaattgcatgtcatctgtaagaaatcaattttttctcactccccacctgtaattttttttaagcaaagaagaatacttgggtctaggttcaaggtttatttttctgtagtcctaatatcacttcagtaaattaatctgagactcattttctaatatgtcaaatgactgttgtaaggattattataaaaacgtaaggtgattaacaagtatgtaattgttccatagatggcagctcttgtttttttactgtgctttgcttctgcctgcttcacatattatgtaaaatagctggtgagttttaggaggtagtgctcacatgtttgacagtgtttgctgtggacgatcaacagtaacagaagagcatacttcttcgatacacagatttactgaatttggaaaggctttggcattcttatgtcatctgtaatgaaacaatctccaaagtcttttctaaaatgtccttgtaaaaagaaaaaagttatgtttatattttataaaagatgatgttatttataaccagcagaagcagccttatttgaacatcttatgttgaaattgcacttaatacagtgactcataggagctttctagtggaaatcaaatgctcaaatgaaatagatttagtttgttaggcaatagtgatatgtcttttattggttggactctggaaaacacttacaacgaatagtactttacccgaagggcacgtatcatgcaccacatagcctaaccacaacattaaaggtcttgtaactgtgagcctcaaatgaaaatacataaggacagctctcatacatcaaatacaatacaaactagcttttaatttaaataaatatgtaagtaaagttcaagtgctataatgattttatatccctatgtatgtatcacagaaattgtggcaaactgtagaaattattcaaatggaaagtaacaaagcactttcacattgccttgtattcaaaatccctactctcataaaaacttatatttctttaacaaagctacttttctgtttaactcccggaaaacttgtatttataacttaagggggtttctccaaccaaacaatttatttttgctaggtactatactatattttttatacaaaatttgtgacagcaaatgaaattctaatcccaatagaagaacaacaattttcatgtttcgatcttcatatatataattcaagaggaaatatgcttaacttttagatttttacattttaaattgcattgtgtctgtatcaagtctactatcttttacctagttgtctggaagatttaagctcaaggttacggtttgagaaaagggttttgagagtgaccagatagatttaagaattcattttatactaaaatatggccataaatatttttaaatacattaaatagccctttgctggcacattttttcccttctttgccaaaacattcccacaggcggctaagtcacctcattttataggtttagtaggtttagcaggctttatgtgctctagtagggtagtaggttttgttcatatcaggtctctctcatgggagtttccagggacaaggattgctcagttagtatggccttagccatactagggtatttgctttaattctacagaagttttctattaatattctgtagcaaaagaactaagatctggaattccccctcttaatctcttcctagaatgagattcagaaaggacaggactgcatccagcctgtttgggaactcagacaaatgtggttgtcacagacacaaatagaggtctactatgaaataattggcttgctagtgtgctaatacagacaatgctgatttgctccaacctcatacagtttcacacataaggacaatcatctagtttcatgaaagttctatctactttaacattattttgaagtgattggtggtggtatgaataacagtttaaatttaaatcctaaaattcagtgtgaattttttataatagcataaaaatcaaagatgtccatacaagaaaaattaaaatttggttaggtttagcagagtttgagaatcttactaccctcccacatagtattgtaatgtgaatataggcagttactattacaggcatatgatgattatgtattaagcagaaagaagtatcaccaccagtttttttctttgaatgccctcagtacttctgcatttataggatggtagactggtttggtttagctctcaaaagtgaaacatttaaagtttcctcattgggtgaaaaaaattaaaaagagtgagagactgaaaactgcgcccacctacgtttaatcattaatagtgagcccttcagtgaacttaggtcctgattttgagtttggagtctgacctttccccaaagataaacatgattgttgcaggttctgaagagggcactccctcactggctgccattgaaagagtccacttctcagtgactcctagctgggcacggatgcagttgaggattgctggtcaatatgattcttcttgctgtgctttttctctgcttatttcctcatattcagcttctgttaaaggtaagtttgtgttgccttttgctaaactttatttccatctttggagttggaggcagatacgtgcgtgtgtgtgtgtttgtgtgagtgaatgtgaaagagtttctgactaaactatcttcaaaaccatgtaactttggaatgtttgtgaagcatggctgagttgaaatgaaaaccaaattcaaatccctacaaacattaagaaaacagaatttcttttagtttcagttcctcagaccagtgtgttcttgcttcaatttctcattcatgtctgtttttaaaagaaggaaaaaagatacccactattgttacctgctgttgttggtcacttgaatgcagctccttcatttgaattgtaaatgaggattttttttaaaaaccgagttctaaattttcttttagttgcttagcaatgtgacctcaagaagaattagacccaatgaaaaagcatttgatttgccaaagaattatgaatgaaatggcacaacatatatttaattccgttaaattaaaaaatgatagaattcatagtgaattaaagaaaattaaatttcctgatacagattaagaaataagacattatctttggaaaaataatgttgctacttacagtttctattttaaatgaaattaattttaaaaatacatatgaattaataccattgaaaaggcaagtgaaaaaaattttatgaggaatggtttcataaaactgttgtgaagtgtattaatatagaatcatgttcagatcagctacattataaacatcggttttccaaatgctgcattgtgtaaaatgatcacttttagtttcttaggaagacacactgttaaaaaccaattgatataacaacatagcgttaagggaccaattttaaaaccatgtactctaagtaattgatagaaaacaattcacttataacttataaaacctgttagggataaatgtggcttttgatattaaagtaaagtttgcctcagattttttgtgtagaaaatttccacatgaggaaaaaaacctaatcttcattattggagcatagagggttaaatttaaaccaattcacctcagcaaatcacactgtaggttcttgaactaagaaaatattttcaccaatttctaaatatttactatttaaacatacagttcttacttggcaaaagaaattttttaatgagaagaagatttataaattatatctgactgagagtgttattagaggacttactatttcatctgccaaataaactgttgagtagtcaaaatatgtgtgattaaataccatagtatcaaacctaataccataagtattttgagaaaaataattgagacatgtacttatcatgagcttctcctgttttcccattttataaactagaacattgggtgacctatgttttcaaatatacttataaaaaatttaaggccgggcgtggtggctcacgcctgtaacccagcactttgggaggccgaggcgggcggatcacgaggtcaggagatcgagaccatccggctaaaacggtgaaaccccgtctctactaaaaatacaaaaaattagccgggcgtagtgcgggcgcctgtagtcccagctacttgggaggctgcggcaggagaatggcgtgaacccggaggcggagcttgcagtgagccgagatcccgccactgcactccagcctgggcgacagagcagactccgtctcaaaaaaaaaaaaaaaaaaaaaaaaatttaaatatacacatacactagcaatggcataattgggaaatggcataaatgagaaaatgtggtttagaatattataggtactacagtttattgtaaacaagcttagtagtaaatctagatttttaaagcttgaaacataataatttaggggccacttttgagaaaagattacaaaaatatcttactattgcaaaggttctgaaaaagatatggcatgtggatacattgctagggtccacttctggagtctttggaagatcctgggcaagagagcttaagcttcatcagcatcatggtacgttgcttatgctgatatataaattaaaagtgtacaacttgagagcttctttacctagatggaataactttttgcatatggtaccatgatttaattatagattctttgcccttgtaacaactgacattaattagcaacaacttgtgaagagtttaccttaaaatcagtccatttaaaatttggggatcccatgcccattgcctcaaaactcatctctaaattaccaatgcaactgtttggtaaatcctcagatcgggtggatgttgaagggcaggttagaatctaaagaaaattgaggctgggtgtggtggctatgcctgtaatcccagcgctttgggaggccaaggtgggtagatcacttgaggttgggagtcgagaccagtctgaccaacgtggagaaaccccatctctgctaaaaacacaaaattagcaggcatggtagcgcatgcctgtaatcccagctactcaggaggctgaggcaggagaattggtgaaactgggaggtggaggttgcagtgagctgagatcacaccattgcactccagcctggcaataagagcgaaactctgtttcaaaaaaaaaaaaaaaagaaagaaaagaaagaaaggaggaagaaaagaaaaaggaaaattgaatggcagattggaatctgaagagggtattaggataggataaaagagcacatctatatgatttgctgtgtgaactttctaaagactcaagtttccctactttttcttaattatactttgtcatggttggactattttcagcgccttctctgtttttccttatatagtatttttaccttctatttaattttgtcacctttaaacctgtacactccttcatttccagtctttctctcaatccctcaccccacccttactttttagtcaattttattaatcatcttccagttcttttttcttcttacccttcatcttcttttttaacttctgccctttagttttctgttgggttcataaatgccattacctatcacccttatcatcactgctgtctcttcaaacctcaccaataactcagctctgctttgtcttcttgactaagccagtttcagtgattgtactcatataaatctgacaaaggagtatttaaaaaatatttcttgaagatcaaaactaacagttttgttgcttttaagtcacttaaaaattctaaatgcacttgaaggcaaatgaaagagattctgacttttttggctaatattactttctgttttggttttatctacaacagttatcaaaaaatattactatacatactctgaagagcactatcctacaaaaggattaagtcaacaatataaatgggacatgccccaatgcccagtgttgccagatctctgcaagcataaacagagaaatacttatcaaaaaggaaagtataagaggatgacactctagcacatccaccttatttgaaccgttttaggctttatctcctgttgaaagaggtaggaaacagttggaggaataaagggcccattcttttctgtgctttaacatttcctactcatagtcaaaaatgatttattatatggccagtaaagtagaggtaagaaaagaagtgaataacataatagttggaaagctttggaatttaagaaaggttaccttcctacaaatgtttcgtagttattttaacagaggacaccttaatatagtccacagaacttggattttggtaaatttaaacatcaaattgcattatatttgctatgttgggttgaacttggggtcagcttctatctgctgtcacacatgcttacttttcagaattgctctgaggattagataagacaacatgtatttcctttatgcctatgtggaatttgataggtgtcataaaaagaaggcctcctgaccgaaatatttttcctaccagaaagccagtatttgaacccgctatagagtccccaattacaatgcagaagacataagataagagggaatcccagtcttcatccccttcaaggtttttcctgactctctttgcctctgtgtctcacacctcagtttctgcctgacttggtgcttggacacagcttggttttgtgatacacatagatcctttcatacttccttctcctggctcttcttgattcctatgaaaatgttgtcccttttctttgaaggttcgacagattatgtgacttcactacccaaaattctatgcagcgtcccatctcactcaaactccccaaatcttcctgccacccataggtacctcctttccttgtctccttcactgtgtcttttacttatttatttccagcctctttggtctccctgccttcctccattacacctgcaggagccctcctcggggcctttgcacttgctgtttcctcttgaggggaaggggtagaaagggtaggagttgggggagggggatgcccttcccacagataccatgtagctcaccgaaaacctttgtccaaaatgtcacctttccacagaggtttttctccagcatctccattccctttcctgcttcagttttctttatgagcacttctatcatactattaacttgcttatgtactcatttttttattgcccttctccatcgcatttaaatgtaccttcaatttacatttacaaagggtagaaaatttacaaagggtattaaatttacaaaaggtagaactttgtctgctggttgggtgcggtggctcacacctgtaatcccagcactttgggaggtgaggtgggtggattgcttgagctcaggagttcaggaccagcctggccaacaaggcaaaccctatctctacaaaaatataaaaattaactgggcttagtggcgtgagtgtgtggtcccactactcagaaggctgaggtgggaggatcacttgagcctggagatgaaggttgcagtgaccgagatcgcatgactgcactccagcctgggtgacagagtgagaccctgtctcaaaaaaaaaaaaaaaaaaaagtaaagaaagaagaagaaactttctctgcctttctctgcttgttactggtgtagtcccagagccttaaaaagtacttactattcaacaggtactcactatattcagttgaatgaatgaataaatttctagctcactgcctaggaatggaaaataattcaaccttagttttagagatatatagtatagataagagcatcatctttagagacagacagcctggataaaatcatatctccagccagacgtggtagctcacatctataatcactttgggaggccgggtgggtggattacctgaggttaggagttcaagaccagcctggctaacatggtgaaacccgtctctactaaaaatacaaaaattagccaggcgtggtggcacacacctgtattactagtactcaggaggctgaggcaggagaattgcttgagcctgggagatggaggttgcagtgaatgaaatcgtgtcactgcactccagcctggccgacagagtgagactctgtctcaaaaaaaaaaaaaaaaaaaaaaaaagaatcatgtctctatgatgaattacctgggtgaccttaggtaattatatagtttctgtgtcccctcagtctcttcatctataaaatgagactaataataggcctacctcattagatttttgtgaggattaaataagttaatacatgtaacatgcagatgtggatttttgaccaccatttcctctgggcaagtacgtgctgtcatatgtagaggagacatgaacagattgttactgtgtaggtgggtaaggccttttcaggcattgcaaagtaattttgctatcacctttctcagctgctttgcttcttgtctagtcaccccaaaccccttttctgtcctctccccatatgtatatttcctgagagaaaaaaagattatggttgcgtgtcatagtaactgggcaatgcaaccccattagcattgaggaataaggtaaactgaagtcttttttaacatctcctgagagccatacatagaaaatatacaaaagaaaaaagatttatgtgaccatacttttaagtcatctctgggaaagacttgctccttggcatttctttgggctaggtaaactgattggatactgtgtgaactcattcatacatcagttttcttggctcacagtacagatttgatactatttgatctttttaaattaccccatgccaactttaagcctgtactaagatttcaatagtaaaacattattttattcgggcacagctaatttaaagttacatatgtgcaacgctaaatgtacctttgtactaaaagtttgataattacattaatagagtaaattacactgaaggatgtttcttaaatatcaaaaatgtccaaattaaagaacttccttctaaccactaaaacaccttggcattgatctgcttgcatttaaataatacgttaattacgaatggctcatattaatttatcaaccaattcctggtgggtcctctacttgaaatcatgttcatataattaagagaatacaatggcatttaaacaaaaaaaaacccaaaatatctatagttcaaccatggcacttcggataagtgattaggaatacaaactaaggttctctgaaatgggagtttatttgtttgtttttgtttgtttatctatgtttttcaagtcaatgatttcagcagatgaagtagcaccagtttcaatcagcgaatatttaccaagcttcctgagccccactgtggtagagagatgcacgatggtgagacagcatgttcccttacaatgaaaactggatatgtgtcattatctttatgaggtcacacaactggtctctcattaaataatgaccggctgtacaagctcacgtactccatgaagttcttcttgatcggggcaaaggaaaactgcaagacagcgtgggctaccgcatttctccaacgtggatgtggccttactatggaggaatcctgatggtgatgatgaccagttgaccaaataacggtgggcattttctaccagataaatgcaaagattagatatcagaagttttgagaagtgtaccattggacagcacttgtattgggttcccgtttataaatccatttagttcttatctatcactaaaacaagcagttctatgtatttaaaggttttgctgatgaaaagtgactgatctttccaagttattgcaacagacaatagaaggtatatactggtaaacgaccaggtatggtgttcaattctatagatcatgttaatagggaagttatactagagtcttttcaaatgttctgggagagaagggtcaataatccatgttgtatgaaaaacaatttagaccactcaactcaagaggagatcagttaggaggttcctgcattccttgatacaacaggtggaattatgaagagagagtaaacctagtctgtgttcttcctgaggaaggaaccaagtactcccctgataacagtgtttggtcagttaaaatggtttagatttatgtgctgagaagggaggccaaatagttggtctctggggacttttccaattgtaatatatggtgattcccttatttgcttctaagaacctaaagataatagattccttgagtaaagtcagttattcttctacatcttggtggaaacaggtacacaggacaaagtacttggaacaagtagttgctggtgtcctttatattgggtgtcatagcaatacatttacaagtgatatttgcttctttgggtgtctctaattgctctgtgttttccaagttagatctaagcatcatcatccatctctctgagccatttctcaataaacagtaaactgttctccagaaaacattatattcctccttattcagtaattagactttattttatttacacagataaggtagaatagggcaggggtcctttccaacaagtggtaaagaagtgaagtgatcaggtagacagcaaccacaaaaaacaaatgaagagtggcaatgataggaagaatcacactcaagtcacaattattttaagcctaaagtcacagagttctttaagtatgctatttttgccttattaaaaaacctagtttttaaataccttctccattcttttaaagtagtggcaaggtcctataaatcatgaattgaaaaatgacagaagaaattgtggccaactcttctgtttctttatcattttattttcagagatactctgatgaagacagatataggaagtttttttaacagctttctttctgttactccagatgaaggatgtaaatgttgaaaatgtgatcagcagagaggagagaagagcatcttcaaaggaaaaagcccatctaaaataatgggaaggaaaacttggaagctctgcaaagacctacgctccttcatctaatccatggaaaggtaaggggcgtttagattccacaactttttctccaacttcatatttttcttcccttcagtagaattattttgaggtaatcacattgtaactacttttatggtaaatggaatttcttcaagaataaagaacagaggttgtaaattaaatgtttccaaactgaatcaatgccctgagttccctacatttactagccaatttgtttcctatttttctggaaatctttatagtggaatgaagtattatttattgatgaaaggcattattaaaaggtaaatttctcatcaaattataagggattcaaacataatgtaacaaagcaagtcatcaaagcatgattggatgaattcaggaaaggagcaaattatgagactgaaatgatccaactgagattagtaatattgatttgttatgagatttcgatatctggctaaagtacaaggttaaagattttaaaagggtatgacaagtctaaagtgagtttttttaaagcctttagaaattattttaaaactatgacatggaaaagccttttattattaaaataatgattgaacactttataatatatatttgaaaatctgttttaaaaattcatgtgtgcattacttatggcttgattctagtcaattgaaatggtctaaataaatttggattgagaaacaattgtgatcagttgattattaggcattacatatttgtgtttatgaaaatacagatagtgtgttgacatacataaaaatgtgtctaaagatgagagctcaattttaggacaaaagcaggaaaacagaaagggaacattgagttataattccatacgtctctgaaatttactttctaaattcaaaataaagaaaaactgatctttatatactgataaagtaatacttttttattttcaactgaagtatttgaaaacaaatactttggacatttcatatatgtatattctaatcatgatgcacatttttatatgaagttctaaaaaggaactcacaagaagaaatctgtgttttcacctcgcctacaaccaaatatgaatcactatcttcaagaatgctttctcttcttctttacttgtcaaaatacttgccatgtttctgactgctcacatgccatttctgtcaaaagttcatacccttccagccagctggaaataaccatcactctttagaatgctcttagcctttgcagctcactcatgacccttatcactttgtttttggtcatttgtgttcattgctaattatgggtgttggatagaaaaaaatccaattcctctttgtatttcagcctctccccttacctccatgcccttccactccctccttccccaaagcacccagaattatgccttgcactgatattttatgaagccttctccgacatctttccaaacccctgggcctatttctgtcaaaggtttatcacagtgtattgtcactctccttttatgtcttggctctccacattcagaataatttctcatgggcagagttgtatctgtctattcagcaccttgctcataggggatactgaaatagatgcttctaaaataaaggataaacaaataagattatatggggctcaactgagttgactttgataaaggttttacttattgtttacttaataatagctaaaatgaactaagcactactgtgtgctaggtgctgactaaaggcattacacgaactgtctcttttattcttgtaatgccctgagcagtaagggctgccttatcaacctcttgtgatagatgaggaaccaaagttagaaaagttaggaaatttgcctatggtcatacaactggcaggtggtggagttgggacttgaatagagtctatgctcaaacttctatgcctactgtcttccagctggaaagtatttggagaatgcctgcctctttggttgacttgtagtgttccttatttacatcatgagatcagttgattatttgattttcttatggctcaactttgttaacaacaagaaatattgttattttcttcctgagcttccaatgtggcaagacacttgagttcatagatattatttgcatttataatctactgacaaccaatcattttatagctcctttggtagcagctgagtacaaagtcttctgctcacacatgaaaggactcagtaccctcactgttcaaaggctgggatggaactgccacatcttattttaataactgcaatgggccaattctagaggagctatgatttgcgatgatttacttaaccacaggttaaagtacatcattgtatctttcaagtatataataaaatatttgttggaaaaacttaacaatgaggactaagaagccaacaggaagttttggccatgtcactgtcagaagatcattacttaaattatcatttcagtttactatgagagaaattatggacaggcagataaggctatggacaggctattttcttagagagcattttctaccacaggctcaaattaagtgtgctcctgaagtttctgggatttcaaggatgctcatcagcatgtaatttttgtccttcagacctccccctgtctccctttcccatctgaggctctcatatttacattttaaaagaggtccattaaaatacttagatacatattcattgcacatcttcttttttccatgcccactctcttccctacataagtgggcataactctagttttgtctacaaatcattaagttgtaaactgacagttatctgattacgttgattaatgctgacgagtgaaagatgcctcaagttatacatggattcttttttaggcctgaaatgctgctccaattaactggataattaccagatttcatttctggttttggctttgtgttgattaaattaaccacgtggctgctgagtcagaccttattttgtattgtttccgggcattgatttgctctctaaatcagcatggctcttgtacacaactgaactgccacaagaaatgtgacaccttgaaagtccttctgaaatttgttgtatattctttacttgtttgttctccagtgtgtcatttcctagccatgctctgtcttagatagatacaaagataaaattactaatctttgtttgctgggattctttttattatttttattgtttgccacttaatggaatttagtctcctcttattcttaaaataaatataaaggaaggtgtggaaaaggcatcttcttcctaaggaaaaaacaatatgaatgatgcctacctatttcaagaggaactggcccctcatatttggctggaagaggcactgtaccaccttcccagccattttaccagtctccctctagctgtggtttccttgggttaaagacttcgtttgtaaccaggtcatactgctgctgctctttggaagctctgagtactgtaaatttagataagaacctgtgctcttgatgttcagaactaatttcattgctgaatgaagtaatcaactttatggcctgagtataataaacttactcagttcctgttgtgaaataataaatttaagattattgctgtgacagccattggcttgaaatgcaaaattctgatttcagattattattttttaaatgattacaaggcagtcaattctaacagttttgacatttagctggtatggatatcagtactatcttcactttggtctcatcagtctacactaaagaaacagaatttaggccctagaagtagcagtcatataaagaaaaagagatgtgttcatttttctagttctggggaagcaataaaaactaatagaaaggttaaaaaaacttttttcattgtgtttcacagtttatatctatcattcagcctgccaggaggaaaaaaggctctaacaccattttctaagggatccagaggtcaagatcaaaacttgatcattgcagtgggtcagtaacagataagcactgaaccttatgcacagtccaaagattaaaccaagaactgggtttccttaccttttaggtaaaactttaaaaatagctcagatacatttgtagcctggaaggaaagtgacatagtggtgacaatactggtatttttcccacttaggagtcttgctttctaaagtatttaaggttcataccaaaaagacatgggccatatagacatgttgcattgccactgagtgaacacttctgactattttggggcaatctagttatgaacttctatggtcatgatacctggagatacacttccaaatatttgaaaaggaaattacactgtgatattagaggaaggagatatagtttacaaaatagaacttcagaaactcaggcttgggtctggatattgccagtgatttgtttgagaatatgatactgtgaattttcagacactgaggtcatattccagttcctttctaagtcggacaaacactattccaacatttataggttagtccagctaatgactaaaactgattgccagataaagtacctagtaaatccatcactaggcagagttatgtaggaagtaaaaatagagatttgagacacttgtttggataattcaggaaaagtatctcttcttctaaggcacaagataattttcatgtagactaaattactgagcttggtattattggattcattgcatagctattgagctttatgttttactttagaagctatggttggtttaaagagtactaggaaggcattcaggatatttctggtagaaatgctcagctataattatctagaccttgggaatttttacagggaacatgtatctatcctctatttctaaattgtgtgagcatatcaagtctacagggtgaaaaccaacaagctgattttcattaaattcactttgtattttatccttgtttcttaaacattagttaaattatcaaaatggcaaaagacacttatcactctgtgcctataaatatcaaagatgataaaacaaaactaagtggcttactattcctgcaaatcatagtcaccctcctcatttcaacctcctttctctgccttctgatggtaacctcaagcagtgcctggggcaggttatgcagcagtagcaatctcaacctcaaattttccagcctctgaatatatatatacacacatatatatatatgttcatatatatacacacatatatatagttcatatatatacacacatatatatatgttcatatatatacacacatatatatatgttatatatatacacacatatatatatgttcatatatatacacacatatatatatgttcataatatacacacatatatatatgttcatatatatacacacatatatatatgttcatatataacacacatatatatatgttcatatatatacacacatatatatgttcatatatatacacaatatatatatgttcatatatatacacacatatatatgttcatatatatacacacatataatgttcatatatatattcatatatatatatattttttttttacccaataccaatataaagctctggagggtggaaaacattgcccctgtgaaatgttgaccatgggtattatggccatcctggggccttgcaatagcccataaaggctgtgccatctcaggaatctcaaaggtagtgttgccattttcgtccaagaacttttttatttgctattattttaaaccttagttatttttgtttcaagtacagttacaggtagagaacatgctgacatgttcaaacagaattttcatcattctcttccctgggccatccttgttttcatgaggctcccagcctatatcagtgctctctccaatgctgtgcccatcatgcaagagccttcattatcggtctccctaaacttcatattcgatggtctcagagatttaaatagcttcttttcacaaaaaggaaattccagatttggagttcagatctctttctcccaggattaatacaggtaagaatctgaccttgcctgacacttattaaatctgataaatgatgcatttttgcttcatttgtgttctgttcccctctccccaccagtcaaagagttctactcatatcaaaatgaggcagtggccatagaaaatatcaagagaggctggctagcctatttcagacacagttaagctctggaaccaccaatgaggtacttaccaaattaataaggattcagcatctcaataaaatttgtaaggatttctacttatacaatttcatagaagagttactactaaggtaatgctcagaaaaggtgacttgtgtagtgaagtcgcattgcctatgaaacaattgccatttatcccaatgttttgttaattaattacaaggtagagagattagaaatatttatactaaaggagcttcgtggggatcattccagtggttcccagatacactgtgcaccactgtaccatggaggggcttgttacaaatatagattccctatattcatccagagattctgattcagtagatcggggaggacccgaacgtctttttttttgagatggatctcactctgtggcccaggctggagtgcaatggcgcaatctcggctcactgcaacctctcctcccaggttcaagcgattctcctgcctcagcctcccaagtagctgggattacaggcggtgccaccatgcccggcttgtatttttagtagagacagggtttcaccatgttggccaggtggtcttgaactcctgacctcagatgatccacccgccttggcctcccaaagtgctgggatacaagcatgagccaccgcgcttggtcaaacatctgtattttaacagtctttgtggatttttggatgcattgtcaatgtagggaaccactggtctataccaacactgttcattttgcaaagaagaaactagagaagttaggtggatcttccagtatcatacctggagtcaaggctgggtccaagtttcttagactgaattcaaccagcccatgagtgggtgaaaaatctgatggtaggttggaccaaaagaatgttggttagcttgctagaaaagagacctctgcttctgtgatgtggcagaggccccaggaaaaagctcagagaagctagacagagtctgtattgggatacattgcctaaactcaaactgatgatgtagctaatgatgatttgagttaatcccagtggatttaattaatcccacaggattttaagaatttctaatcatgttcagctagttgaagttacacaacacacacacacacacacacaccacacacacacagaatctagatacagcattaacaatcactcccttgccacagaattacccatttatccaaagtttcaattattaccaggccatttgctaattttaattggatttcgagagaagtaggaaatcccacattatttgtgaaaaaaaatagaaggcgctattaagacactcaaccaaagagaatgggagggaatcaatgagctaccagaaccttgttcttgtctttgtatcttatcatcctgggggagaaaaaaagtcccctatggctattagagacctcaattttcaagccacttctcactagaattcaaatggcccacaaggaacccaagcattatgcccttgcctttctttttaggtagatatctctggaaattgtaaagtgcctaccaggctcatcaagacaaagtgatcaaaattaaggccttggattcatgcaaaatacgaggtctggatttacgaccccaaatcaggtatgatagatgtcactttctttgaggcataaaataattacattttgtagagactaatttaatgtaatagaaaaataaagtagaaatagattttgaaacatttgtaatttttagtttaggctacaaattcacacatatgtaatgaataacccatttcaattgttgtaggtgttagtaatgagggatgggtgtaatggggaagctgttgtagactgaaagacagtttgctatttgacttgattcaataatttaaacgatgattacttttataaagatggctatttatttatttaggtcttgggtgtcagttcaaaagctacatctgcaccacctataagatagaagacagctttgttatagctgtgcttgctgaagaaacacacattttggactgaatttcctacaaaccattaaggggaaaatagtatcgaagtaagataatgtaaaatttttattttctttgctattctttgttatattattatacttgatttgtaaatagtctgtgtttgtgtgtgtgtgtgtgtgcgcgtgtagtcatgcattgcttaacaatgggaaaagttctgagaaaagcattgttaggcaatttcatcactgtgcaaacatcatagagtataatacacaaacctagatggcatagcctacactacattatatggtatagcctattgctcctggctacaaacctgtatagcatgttgctgtactgcatactgtagacaattaaacacaatgtaagtttttgtgtatctagacatagaaaaagtcagcagaaaaatacagtataaaagatatatgtaggtgtacctttattcataaaaggtacataagtgaaatttgcagggctgaaagtgctctggatgaatcaccaaatgagcactgagtgaatgtcatagactaggacgttactgtcactactgtagactttataaacactgtacacttatgctacgctgaatttctaaaaaactttttcctccatcataaattaaccttagcttactgtaatatttttacgttaaaaacttttaatttttgttaacttttgaagtactctgtaataacacatagtttaaaacacattgtatagtgtacaaaaaatattttttctttaaatctttataagcttttttctatttttaaatttttatttttatttttttcttttaaaaatttctggttaaaaattaagacataagcatatatatagcctcggcctacacaaggtcaggatcatcaatatcactgtcttcctccagtggaaggacttacaacctccaaatgttgtctcactgaaaggtcttcaggtgcaataacatacatagactgtcacttcctctgataacaatgccttcttctggaatacctcctgaagaacctgcctaggctgtcttacagttaatttttttaataagtagaagaagtacactgtaaaataataataaatgtgtggtataataaacacagaaatcagtaataatcatttgtcaccattatcaagtttatgtattgtacgtaactgcacgtgctatacttttatataacagtagcacagtaggtggttaaccaccagcatcgacaaaaacacgtgagtaatgctttgcactgtgatgataggacgctatgatgtcactaggcaagaggaatgtttcagcttcataattttatgggaccaccttgtacatgggtccatcattgaccaaaatgtccttgtgcagcacatgactgtatttattgtcttcctcatttcaactgtgagctccttgaaaatagtgattatatcttgttcatctttatttttacatcatctacaacaattcacggcacatggtaaataattactttttaaataaaatgtattaaaaatcaattatttattgaacaggttttaagttttaaaaagacaaactacttgttcattctagttcattttctaatttctctgtcaaatgtttttaatattaaggtaaaaaatggtagcatttgtaatttttaagagtttttaaaaaaaattgttgttaaaaaacataaaagttccgtagtgaagagatgtgacaaaatttttgatatgacttatgcaacttaaatatttggcctgtttatcatttgaagaccattctctggacagaattgttctaacaggattaagaatagaatgttaaatcttagagtttctgttattttcagattttaattcagaaaacaatgtttctagcagtgaatgtgttataccttatgccattgcttctcaaaaaatttctctggagtactgtaatattagcaccaaatagatgcaaaatagtagtaaaaatgcctgattaaaatgctgaaattttatagaagtctcatctggaatagaattttgcattctacttcatatactactgtatatctatagtgttttattatattttcatataaaataaatattttaaataacttatcagcctatgagatttccattgctatgtaacaaccccagatttagtggtataaaatgcaacatcactgtactgttctctgtcataatttacaggcttgccttggccttgctaggcatctatatgtagtttcagacagtcaaactattcaaaggtggttcccccatgtatctggtgcatggctggaaagactcaaacatctgaggctcctcatgcaactatctttatttccctgtcgccttcagcattgcagcttcatgtcagacttcttatgtagtagctcaaggctccgaagcacattactgatagtgtgccagagaaaagctgaattctcttttaagacatagccttagagatcaacagtgttactttcagtctcctctattagttgaggcagtcacagagtcctacccaggttaaggagagggatgtagaccctaccttttgatgacagacaggttctggaagagcatgtcaacaaaaatagagttgagactatttttggaaaataagattttctagctgtcttggttaatagtaacacgtggttgtattgacgatatcattttcagaaagctgggctaaattcaaaagactgacattgcatatcttattcatcatccaggcaatttttcttccctgtatactgttgaataatattttgaaaatgcaaacttaaattttcaaatcttttaatataattgttgctccagaagacttcataatgagctttcagttacctctggagatatcacagtttgaaagacatggcatatacaacttgaataaattactatcttgtttgccaaaagaatggcaattagtatcttgtcactcaaaagaatgattataatatagcatttccctttggtattatgcaggcagaaattgagctgaagacaaccgaagcaggcccaagattgatgtctggaaagcaggctgcagccatatcaaagcagttgattcaaagtacacggccattcccattgtggggcaggtcttccagagcagtgtaaaggatgtccttctgtaagtgcagacaaatatgggaataatcatgacatcagctctgttttcattttgtctccagtgaaagcatcaactcattcaatgaagacagtttctaagaactaccagctaccacagagttgtgatgacagcagtctcacaatatgcacctgacatgtgcatgacacatcaataattaacaaatagttaccattcattcctctcaaaaagtgttaaactcaagggcagcctttaataagtcacatctagaattcagggaggatagagggcttaagaagttagggggaagcatatggtgtcaagaatgtggacaacggctgaaccttgaaagtttgtcacataatagttatttgtccacaggtgacatactttactggcctcagtgttctgatattgctgcaaggactgaaaaaggataccaggatctttgcctaaattaggaaacatttattaccccagtttcccctacaattcctgtcagaaatgcgatatctcatccccagggcaaaggtagatcattgtaacatttttaatccaacaaagaaaattttccttttattgcatgaatcgttatgatatacattcagagaaatgacttaccacccagcatttccttatctgtaatctctgtcagaagagcaaaccattggcttcatgctctgtgtgtaactatagggagatgctcttccttcagtattactggtgttcagaaaagtgaaatcatcaagatgtaataccataatttgttaaagtacaagacagtaattgcttattagtttctgaaattgagttagaggaaaaaggaacattttaaaacacaaaatcatcattttcaaacattgtttcttcttttacctgtttttttttcatatgtcatttaatgttctaatgtaattttctaatgctgtatgagatggaaattattaggaaggtggctaataaaactaaacttttcttatgctctgcactattaatttctctccatagatattaaacattatgagccatctaagatttttgataattatttcttaattattaagaaaatgatttatttatgttattgaggaatttgcttttccaaatttggaattccaaatccaaatttgcttttgtaaattctattgcagccctttaaagtaaaacaaaaacaaaaacactgaattcatattgatatgctctctgccttcagaaatgacccagtaaatctttagctaatgcagctggaatttcacttggaatatcttcttaagattacatagctaaaaggcacttgaaaagagaaaaaaaaggatccattgcttattaaaagtaatgaataatttaaaaactggcacaagttattactatagagttagagagttagtagtcactgataggatttcataaaactagggggaaagtagtaaagtatgaaaaataagttcttcagttagtttcaaagccgagagatgtgttaattagaactatttattaggttgttgcaaaagtaattgtggtttttgccattactttgtgacaacctaatattatttttaaaaccgcaatagaataacttagtgtgtgtgagaatacctttatctaaatgctactctaaaaaacatagatataagaaatgaataattcagacctagcaacagcaaaacattgaattttgtacaaataataaaataaagagagagaatagggactcaccgaaaaattgattttcagtgaggtgcaggtaaattagaaacctgatgcaattctcagcagttctcattattttatctctgaaatattttgctgttaattaaagttctgcacaattaaattgcactatggtagtcaaagcctggcctcggataaattcccttggtgtagccgtaaatgacctatatacccagaaaccagttaattattgccctaggatcttcaagctaaatagaatagacaaaaacagtcctcctatagaggaatggttcacagagtggatggaagtcccagggtatgatatgggcagggaactgtcatgtgtattgaggtaaggtacaaaaagctgcttcgcttcagacacaagggacattttattcctaggagaacaccctttgtaaatgtggatgtcacagttatgagtggggtatgagcctgcagtgtatgttttgcagctctcggagctctggggtccaccaggaaatacctgcagcctgacaacctttccaaggctgaggctgtcagaaactcctggccttcattcagcacctcaggactgcgaagaaagaagagatccttcaaatactaagatggaaaataaggaagtattgtaagttccccaacctttgtgtggggttgtctgtcagaacatttctggattgttggttttttgaagtaagaaagaccccttttaaaccaactgcccaccaccaaaacaattattttcttgtactacattttcatcgaaaagttatgccacagtgcgtaatttaatggtcacttgaccagaaatacaatagcagattttcagcagggactaggaaaaacatgttgttgtgtttatgagtttaaatcaggactagattggtacatagataagtgaggcaaggcttcgtcgtgacatcgtggggcatgtgctgcctcgctgtttttgaaattatgtcctcatgctgttaattgacacctgaacagatttgagttcatttaaaagaaaacaacaaaagggtttgacttcttcagttgaaaatgtgatttcactaaacagccagttgaaactatgtttatgtaaaaaattgagaactgaggcgaatggtgaaaagaatctggagaaaataaatcatatgttacttaatatttggtgaaactatgatccattttacatgtgtaataaacagagtgacttaatttttccccaaaacattgcatctgtttctaaatagaatgtatttttagtctacatacagaatttgtgtatatatacaaattgagcttatgataccaattatcctaattgatatatagaacaaggcccaattaatttgacaaacagtgaaaaacagtcattaacataatcaaagtggaaattagccaagttacacacacacacacagcagtagcagtcactgagttcaaaaactgaattccccaacaggaggaaaattgcagcttttttctgaaaagtctgtttatgctaattgcatttatttacttgccttaaggacattaaaaaattgataggaattccaaatgacaatcaaagttggttattctcttcaaaaataaataaaccagaaattgaaaaagaagcaaatcataaattatcaggctctgttttaattacagcatgttaaaatatattggtagagggactgtcttaacattattttttatatttttaagattctttaaaaattttaccactctcaaagacataggcattgtcttaacattaaaggcagacattactgagaataaaagtggaataattggtattaatttagaatagagattacattaaaccttattagcattatctgtatcctaaaatcttaaggcagcaataatttggaggactgcatgatgtattttctaaatcagattatttaacaatattgaaccatataacatgcaacacacatgtagtgtagtgtaatagaaaggatacaagatgaactaaaattggaaaatttagtttaaattctgacctccaacaacagtatatcctcaaggaagtcttttttttttttttttttttttttttttagacagtgtttcgctcttgtgcccaggctggagtgcaatggcgcaatcttggctcaccacaacctccaccttcagggttaagcaattatcctgcctcagcctcccgaatagctgggattacaggcatgtgccaccacaccggctaattctgtatttttagtagagatggggtttttccatgttggtcaggctggtctaaactcctgacctcaggtgatccacccgcctcggcctcccaaagtgctgggattacagggtgagccaccgcacatggccaaggaagtcttttatatttagcttctctgagcctcacttcaacatctgtaaaatagggataataattctttctatttattgtaggctagtgagaggcaggtggtggaatgtaacatttcccaaaaagcctatatgttgtatcctgtaatttgcaggagttaacaggtatgcaaaaaggaaaagattctgtgagcaactgagtttgcaaaactggataaaccttgttaatttctctgttgcagaacttttcagtatctttaatcagataatattctgtaagttttgaatattttctaaaacacatgatcttgaaaatcccttttcttaaagcatttgtaagactagtgttaacatggaaaacactttgagaaacatcactataattaagaaacctggactccagagtcagaaaaacctaggtttcaatcccagcaatgccatttaccatttacagctatatgaccttgaacaaatgactaggtatatctgcgtctgtttcctagcatgtacagggaatattaatattaaactgacagagatgttcagtggattaaatgaggtggtagtattgtaacagctaatatttatcaatcacttactatatgtcaagcactcttctgaatgttttaagagataacataatttaatcctcccaacaatcctgaggtaaatactactttggcttcatttacagatgaagaacttagagattagacacataaaatttttagtacagtgcttgcacaaataaactcaataagtattatgtcttctagttatctaagcttaattcactagttttttgtatgatcaaaatagtacaagtatatcattttttaaaagtataaactactaagcacatgtccattgtctggtgtgcttatataggggtagtatgtaatatttacatacatgtgttaattatatgacaactatttttagaagttttaccatcccgggctcaaaaagccaaagatttttgagactagaatatataactagagttttcctgtaggggttccattctgttcacacatattcatgtggttaaacatagaactatactatggtgtgtttttatttttaaaaagaggaaaaccttccccttggatttaaggttaaaggattttccatcaaataatactgctttagttcaattagcacttctgaaataggtttgtttgcaaagctaattaaagaaagagaataaatttggggaccatagcttttatgtattactcatataggaaagaatttgaacttaatttataattgtattatataatttttacttacaaatcgccaaattatacttggcttaggttaatatagtaaaatagtttgtatattctgagtatacattgtttgagtgagagagaggggcgttcaaggagaaattaaaataaaatggggaggggtctttttgagaaagtcttaatcattttttcatttgttaaattaaaaaaaaaatcacttcttgagaaaactcaaaccaatagaaactctgtgaatggagagatttttaagtattccttcccctaaacattgatatccatgattatgcctttttttaagacctcagctggtggatgctgtcacctctgctcagacctcagactcattagaagccatttggactttttggatttcaaaagtgacagcagcattatcctccaggagaggtttctctagcctgtggatttgcttctcatcccaatgaagaactcctgagagccctcattgtaagtcaatagaaaataaagaccctcaactcctataaaacttcttaagaatattaacagtaattaaagtttcttagatctgaatgaaggctatcaactagagacttctgagtattcatattcaaatggggtattttctatccactaattattaactgtataataaattatttcagttagtgccttttcgtaatttcagtaagtagtataaactatatggaaatttaaagattgtgttcacctacatgttatatagcataggacagaatttcagaggggagaaatctagcttatgcttcagtatcaattttacaagatttgttttgacttcaaaaattctcatgatatttaatacacctacatgaagagatacaattcttctgctgttaaagatttatgttgaaaacaaaagctagacttccttgtgtccaagaatgttatctatttaattgcacttgtctacctatgatctagtggaatgttcataatctttatggaaaatgtacccattcagaatctgataaaagtgatgaggccccttttactcatacataaaattttataaccctcacccctcctttttttttttttttttttgtcattgaccccatgaatccaatccataaatttccagggttaagaattccctgtaccacagttaaaaatccctgaaaaggggattaactcttcaattcaaagctagatagcaaatgtgtagtgtctcaaaagcaaaattctgagtttgcaatctagaaacataaaaatactttaccaatatgtgtttattttttaactaaaagtgttccttggaaatatttaaatgtcttggtaaccattttatccctgtttggttaatagagtaagttcaaaggttctattggtagcagtgacatagagaaactgttatgatcatcactgggacacttgtcagaaagttgtgtcagaatgaaggtgcaaactcaaagtaagtgcaaatccaatctcatgtattacatcattctacaccattgtcatttgatactcaccatgctgcctactattggcactcctaattctctttactctattctcttaccttatttgcatagcaatttttgccatctaacatatattaaaattcagtcatttatatgtttattgtatatttctatttcactagaatgtaagttccatgaagaaatggatctcgtttttttcaacaccaattgctcaccagttcccggtacatagataatatttaataaagattgctaaaaagtgaatagtacaataacctccctacccatatactttattgagtgcccacatgtactcagttttaaatggtgtgtatgatatacttcttgttttcagagaaatattagatctaagtctatctcctagagtagaactttgtatatagtaagtgtggtttccagttttaattttgatagtagaaatttagttacttttaatcacagagaactttatattttattttcaattcatttgcctaaagcttttccacttgcctgagtggactatcaattttcacgtctttctattaaaaagcaaaaagcaaaaacactttttaagtataactaaatatggaaaaccaaaatgattaatgtctaacacagtccatctttctataatgcaaataaagatgctaaatatataaaacatagtctttttttctgtccacattatacagccagtgtcccatcagcattttttctactcagacagcactatatatcattttgcttactaagtgcttgctattaaaaatagtagggaaatgttcttgaaaccaaatggtcccaaaagaggcaagccaaaactagaatatacattagtatgaaaaagatcactaaaaacagtagtactgaaaaggcttgggtattaacttattaattctggcagaaattaaatttattatttttatattagggaagcatgacttcttatattttcaatttccataattatttgagtagctgatttacttcagctatttgtgtattaaatatctggcaaaagataaaacccacatatcaaaagatctattcagcagtatttaatgagcatctatctgtactaggcatgatgctagtcctcaaataaaaagataaataaaatattctaccatctcaaagaactcctagtctgtttatcaaatataaacaaataaataatattgaaatataaaaaagtgctcagacaatacagaagatgcagcaacgttttctgtttgagtgtgctcgagaatttccaccaaaataacaatttttgcacttaatctagaagaggtttttaagtgaagaggtaaagtatggaatgaaagacattctaggagacatacaataatgtatgaaaaggcccaaagcaaaataggcctggtatggttgggaacagtgagaaattctgtggggttggaacataaaaatgtatgtttctgggggcagataagtgacagtggagacacaggaaagatgggaaaagagtggaaggtgagccagatcttcattaataacaagctaaggagtctggccttcattccacaaaagaagagaacagtgaagtctttaggcggatgaatgacatactcagattttttattaaaaagaagcaagatgttttgtggactgattgtttaactggattagagttagtgagatctgctggaagcatttgcaataacctaggcaagaattagtaaaggtctgaattaatgtaggggagagggctgagaggagatagattcaagggccactttatttagtgactgataagatgtggaaatgagaaagagataagaatccaggtgactctaaagctttcagttgaggttaccaggttatggtgatgccgaccacttaagtaaggtttatacagcctggttgggggtgggaggagatagagctattagtttgttttggccatgttaagttcaaaatcctttgggtcaccaggctcgttgtccaacaggcaggtgtccacattcacctgcagctcaggagagaagttagggtcagaatagagagtggctgaaaccttcaaagagactggggttacctaggaaagtcatgtagcaaaggaaacagaacaaaggatcaaatttaaagttcttctgataatggacagcctggttctatcacatctttaaaattaccttgaaggtagctgcaaaccatctactatcactggcattcattttgttaatatttttgagcaaacattttttttcatctttgaggataataagatttggcatagtgaatttactacagaagaactgtagtaaaggttcagtttttcttttgaattttcgctgtgaaacactcatctacgttttgtccaaatcaaagatatatgaaagaaaggaaagaaattatgtattgtattaaataagcacaaatttaaggtagctactgggcacactatatgctgctgtgtaaaaggaacctgccattctgtgtagttctatagcctttcagaacttactagataaaagctacagtcctgtgacagtctgaatggcagctagacaagtgcacaaccagtacatgccacatgtttcttttttatgtttgtcttttgcttatgttttgacctcccggcatccaattccttattttcactgaatttgtacttgaaaaaatgtaaacctacagaaaagttgtagaatagtacaattccatgaacacccagatatctttcatctagattcatcagttgttaactattttcatctttgctttatctctttctgtcttattttagttgaataatttgataataattgcagacatctgacattttacctctaaatacttttacttcttattacttgagtgccatgcaactagtctcttacaatgaaaaaaatacatgtatttaccaaattgtgagttcccactctatctctaattctaattctaattcaacactacagggttattttttccctcatttcatcttctattttccttctcccactgtgacaactgtggttttcgagaacaccaatatattgatcacctgctcaattctaaaacatacacaatatatttttggaattgccatactgatattacacagaaacaaactaaataaagttcaagacttttacagttctttttgtccttagaatatatccatcgcatgtacacaaagttctatgctcaaaagttacttggattaattctttttcatctcttctgtttagtcatattatcaagttgatagacatttagtttcatttgtttctggttaactgaattttgataattttccatcctgttgatttaattttatttcttgaacatgtgaatagtaatgtggttcaaaaggcagaactgtgttttaaaagtattaacagagaggtctcatgcttctcgatgcttttcccccaatctcacctacttcctctaggtaaaaaaaatcactcataaaaaaaatttttctttctatgtttctttttgcaacagtaaacagatgttcacacattacatacttttttgcacaaaatatatcattctatacatactctttttgtatcttacattttcacttaacaatatatcatgaaaatattccctacatagagatctttttcattccttttgcaactgcctagtactccattgtgtctatggactatgttttatttaatatctcctatgaaggtcatgtaagtggcttccactattttgctgttataaataatactgaagtgaataatctaggcacagatttttgctattgttgagatgtagcttcagggatagagttgctggtcaaaagcagttctgtttgtttttctcacattatcttccataggaattgtaccattttaggctttatcagcaatttatgaaaaggcctatttccccatagtctcacctacaaaatatgttagcaacttttgaatttttcaccaatttgatagttgagaaatgtcacttctctgattaagtgtgtgtttagcatctttccttctattgggagccttttgttaatacttctccactcttccccaatcatccattctccccaaccccatgtatgtgtgtgtgtgtgtgtgtgtgtatgtgtgtgctgtgtgtttgtgtgtgcttgtagcctaatttcagaggttatgaatcctgtggatgaatagatcttaaaaccctttatttttaaaaaatttttcagcctagactctgtcatacaaagatctttattttaaacatgaaactgaagcctctaaaacatatgtagtggcaaatataagacagaacccagatgtccctatttctaatttgctttcccattaaactattaacttacactcatccccctttttctcagactaggacaaaaggacttttctgattgtagaacatatttgaaagtacctagtaaagtacctaccacataggaggtactgaggaaatattttttgaactatatgcagcattaattaaatttggaattaagtgaaaacaaacacttttaaaacatttagagccgactttatggttgaactctaagaggtctcacccaagttcttacttaaggaaaggtgtatgtgacactaagactccatctaattgttgctttagcaattcagtgaatgagcagttttttaataaccaatcacaatgaaattaaaaagtggccttatatattcaaaatgtgttcaaaacaaatatgcccattattgataatactcattgcttcttaagaatgtatatgtattttttttaaaaaagcataacacctttatcaagctttacttgtttgcttttattccactgtgtgcctagtcaagcaaccaatgcaaaactttgtaaaactgtaggttgctttcttggacccaagaaaaagccagtctcacccaagtcttcttcaatgtatggtcatgcatatatctaaggtatatatttttcaggcagtagtggaagctaagaagttaatcctgggaggacttgaaaaagcagaaaaaaagaggacaccaggatgtatctgctggctttgaagaatgccctgcttccagaaggatcccaagtcttctgaagtatgcagaagcaggagaagggcccatcagccacctggctacactgctctccagagatatgatctccctttcataactgatgaggtaaaatctccaagaattttgcaacatttacagaagaaaaaaaaaaagcatgctgaacatgagtcaaatgcaaattcgctcaagtcactctgtattttccccaaatagtcttctctcctgcttaaaaataactctaaattgcatttgcggctattctaaatatcctcacagggtaacgtcctatatctatatccgaagcataaatattgaagcatattctcttattttaagaaacaaattcttttttgaaataatttacttttataagttttaagatgctgttacatttttcaatactgaaatatcctggttaagtataactttgtttgttactacaactacatttttcaggaagccatctaaattaaaccttgttagggcagagaatgtctataaatctcaagataaaccatctgccgagaatggtgttccagtttatagctaagcaccttcccaccagttttgtgttgaagttggtggctgcaaatctgatggttaggggcacaggcttttgagaaagacagacctacgtataaactctggctctgccttccctggttgtttgttcttgggtgacttgtttaacatctacatatctgagagcaaaccaagatttgagggagttagtaaaaggtaaagggaaatgaaattaaagaaatatttataatgcttagtatagatccttacacattgaatatcattaggcagttctaataatcaatgaattacttgttgctatggaatgcaattattttggcacgttttcttcgatgctaatgttttgttagaaaacaaaaggatcctaatgtaacctacagactttgggtaataatgaagtgccagtagatttattgaatgtaagagatgtaccactgagggcattgttgatacaaggggtgatttgcgtgtgtagggttaaaaggtgtgtgggaactctctgtactttccactcaattttgcttgaacctaaactgctctttaaaaagtctattaattaaaaaaaagagagatgggaagatttgaggtacttcattgtaaggaaacattacttcatataactacctttccccagagccccagccatgtagtatccttaaaattctatattagttaggtaacaccaggttatgctgcaataaaaatgtccctcaaaatctcagcaatgtgttaaaagtttatttctgagccaggcatggtgctcacgcctgtaatcccaacactttggaaggccgaggcgggtggatcacgaggtcaggattcgagaccagactggccaacatagtgaaaccccatctctactaaaaatacaaaaatcgctgggcatggtggcacacgcctctagtcacagctacttgggaggctgaggcaggagaacacttgaacctgggaagcggaggttgcagtgagccgagatcgtgccactgcactccagctgggcaacaaagcgagactctgcctcaaaaaaaaaatgtttatttctcaggctatgcctatgtgcataaggaagtatgtggtctgaagttcactacagtcatggaagaaagagatggaaaagccaccagctcttaacggcctcagcctagaagtgatcctcatagattctatccatgcgtattagccagaactagtcacgtggcccccaccaaatcacaaaggaatctgggaaatgagtaacacatgtatatttttatgaacactcactattcctgctattcctgctgaaatgtcattttaaaaatctagatgtgcactaagtttgaacatcttatgaacaggtgaagaagacctaaacagaatataccaccaaaaccgtaaagttcatgaaaagactgtgcgcactgctgcactgctatcattttaaataacaatccatcctacatggacgtcaagaacatcctgctgtctttggggagcttccccaagaaatgaataaatacatgctcgccattgttcaagacatcctagttttgaaatgcctgcaaggtataatacattgcacatgtctctctgtgtattcaagctttttgtgtgttcatggggtaccgatgtagctaataataatgatgtggtcattatgcagggtacgttgcataaaaccaaagagtgccagatttcccataatagggctatttagggggccaatgaaacaacttcactttggcactatgagtccatgactggtaactctgggtataattttagtagggatgtcttgttcagtctggcaagtgtatattgccaaatgttttaaaagctaacgcattttcaacaggattttaaaaataagtacaacaaaacaaagtaaattcttaccaaatgttttcattgtaacatttcaagtgttaggaatttttgaagcctcatttatcacagatcaataaatttcccatttaagtttaaaatcttaggcacggcccacatttcaaggtgattcaaatttaaagagtgcaatcagtagagttcatcactctataactcttgctgaattaatttcctccagttaccaagtctgtcctcccaaatgcaaagtggctcccccaaggtgcctcctcccggaattagagggtcagagaaggaagtttcatttttcctgagttacatgcagaacactaccccacgaaagatcagatttaagcattcaccacagagattggaagggtggaaaataaaggaaagaaaatgaaaaaagacagcattaaaaggttgaaagaaagagaaacaaggactaagatgaaggaagacataagaaacgggtgtgagtagaacagagataagagcaggacattcaggaagagcaatggagcaagtgagtgagaaaagaagccaaatctctctgcagccatgtattttagttgaacgcatttagcttctccatttctttgtttgcttttatgagaccctgtgaagggatcctgggtgtacttgctgccttcgtcttatggctctagcatttcagggacccggaaaaggagacagtggggtagagaacagactagaaattgtgaggaaaatatcaccaacattatgttcagagtctcagaaccaaaaacattagagtggggaggaacactaaaggctcccttgctggtatctctccactgtagggctgtagtctcccagcaggtggtattcagactttgcttcctctcccgatgacaggaagctcaccatctttgagggaacttgtgccagtgttgttcagaactctcaccattatgtctttgtataatctgaaatcttcctattggctctggttttatccaggagcaaagcaaaacacgtctagtcattcatccacaagaagaccctttgaatatctgagatagctgtcataacccttctcatctttgcttctctaggctaaaatcttataacctagtatattggaggggaaacctctcaggatgccattgcctcccctcaattattttctaccttaacctaggaccagatttctataattgattattttgatgttttgctatgttgtcataatgtgctattactgatatgattaatgttatgtaatcagaaatgaacatcttaacactaattactagacaagatggacgcaatggggtaaggattaagacttactccagaggagacgatgattctatatgggttttactgagctgtttctgtaattggaaacttcacagatatagaagaaatctggaaatgtactgttatatgtcattagtgagagagactattagggaatgcagaaaaactttaaagaaatattgtgcaatctccccagtttggcacaattttcctttaagtgtatgcatattaaacaataaaaccatgacgaatcaaagaattttgccatgcctgaaatgtgtctacagtcaacttaagccacctcaaagctggacacccttgccttgctgtcattttgataccaactaaatttcaaatatctgagtaatgaaggggctagccctaatcctgatgctaccacgccgctggcaccaccctggctcttggaaaggcatgaggaaaatttggcttcctcttttttccctgaggattttttttttccaaatttgacttgggaaacagtcattacaatgaatgtgcagtttttttttcctcatatgttgcagcaaaattgtccgtcgagttctgaaggaaatggtcgtcacaattatgaccgtttctccaggagtggatcttcttctgcctacactggctacatagacgtatgtacaccaaaaagaggttctccttccataccccacaacttagcattgctggaatgctattaaattacagttattgtgtgtcatcaggtagtccccgttcggcatctacttacgcctagacattctctactcgggttctggcattctaaggagaagtaacctgaacatctttagtacattgggaaggctggtcttcacggtagccaggtaactcacttctcatggattttgttaataaagtatgcaagaaatcaggctgaggtaaaataaaacatatatgctgtgggtaagctatagaatgtataagttaatggtggcttctgtcatattttgcccatgatttccttattgtaagaggctgtatggtttatagtcactcagagaaagtttcgaatttgaacttgaaactaagtaatttgatccattgaacttgacaaatgtccatttgtcttttcaaaggtgcacatttcacaaaactgaaattgtgccaatatttcttacataaacgtttaaaaataatattttattttattcacagatatatttcttagcctcctctcacccccaagtatttaattctagaattattttccttttctggttgtttctatgaagagattgattccccataataaaacccttcaaatagaatatgatgctctaaagagtcaatctgtatttctccaacactgctagaagagaaagaataaaatgtaggcattcaacagctggctgacttccatccctttagtgttatccaaatgaggtgatggtctataaagacttcctaataatgacatgtactttctttttagtttttagtacatgaaattattaccttgtaaatacagccatttaagtttttaaaatgatccaatgcataaaaacttgagtctttatcaatcttatattactataccttttggtagtactgtagtcgagtactatgcctttctgtcctgaggaatcacaatctgttttctgatatgtactttgaatgcaaaacatccaggggttaaagggctgggtatggaggacagaaaatatgtaggattccatttgttgtggaaataagtgtgttagccccctcatggtgtttatcgactttttttttttttttggctagggagaaaagtttgacatggaatggggtgagtcatggcttagagaatacctgtcctcacatagcagcagccttagaatgactctgccaacacctttccatctacttttaatgctctgcaagacagctgatgcgttgtatatgacagtcctggaaagactaagagtctgaggatgccatcataaaatagaaagctcatggttttcatagtcagacagaaggggtatggtcccgcctctgacatttattagctgagtaaacttgaaaactttttttgcctcatctacaaatgggtaatatcatatgtacttcaaagagtggttgtgaggattcaatgaaaaactaaccaccttatattcaggcacagaggtttttgtctgttttagtttttgtttttagctgttgcaatatttaagtttttggccccttgagaagttctagctgcagctcagaagcttcaccatttttacagagcaggcagggagcttgcgtcatgaacattatattgattttatccaggtggtattgaagcccaaggactggaagccttaatcgcagccacccctgacgagggggaggagaacttgactcctatgctggtatgtcagccatcctctttgatgttcagctcagacctgtcactttttcaacggatacagtgatttgatgtccaaaatgctgtcagcatctggcgaccctatagtgtggtgaaaggacttattctgctaatagatcattctcaggtaattcattcagtctggagtatttattgagtccctaaaatacgccaggcacgttttaaatatgcttagttcttggggatacaagacaaaattgtgcccatcttggagctcatattccaagcacttggccctcttgtattggtcccctttctcctttactatagatatgttataatttcatatattagatgattataagtgcctttaattggaggcaaagagaaaatgttgatgttaacagaaacaagaaagttaggacacaacagaatagagctaccactgtctcctcacttggctctctcaggcacgaggcttaggtgatatttatcctgaaggcaggagctgaactatgtggccttataagtcactgagacatttgtaatgacagagatgatgaagatgcatacagtgcatcattttgaccctgccaattagtagaggcacaagcaaccacggccatgagccacatgcaagaaatcatgaagactcttgcccaaaattctcatgtatataaaatctcagaaagatgtgttcattcttagagtatagagtactttcattctctagagccacattcttcaaaatggttttcaattttttgtggcccaaatcttatgatactgtaccaaaaaatgacaatactatctttgatgcagtaagatttaatggccaagatactgtgggatggagatggtctgcctaattagattttctgaaaaacagaaagggttaatctgaataacctttgagtctgaatgtttggtgcttaaaatttttctttaatgtttgatttattttctgcttcactaagcatagcaacataaaaaatgatatatttgctaataaaatcttatgaggaatcaaagtgatcactgtgtactctaattcatacttattatattagaatatataaggagattgaaataaaaatttacagatgattggattgacttgtaaagttactttattgttttaatacattaatggataatagcctacgtttgaattttgcctccgttacttcttgctatgtgctcttgggcagttacttaatagccttaagccacaatttcatactataaaatgaggcacctggaacaggtggtctgaagattttatcagcttttttgtttgccagtaatttgaggattctgatttgttaggttctggttatgaaatcatagattttaagggctggagatatcttaggtattagactgtattaaaactcctccaaaagctcattatttgggattaacagtgttaattttctatctttcttgttcctcatatcagctcaggatagctgtatatacaaaaacaaaaagcaatttagagtggcttaactaaatagtttcacttttatagtgtaacaacatttggaagtaggtggtccagggttaatatggaaatcttaagatatcatcagaatcaagctgccttccttcagctcagccattcttacttgtgacttttgacctcatgcttgtcacttgtgattatcagatggctgctccacttccagcaccacttcctcattccaagatggaaaagggaaggataagaggtcacagagtctgactctttttcaagaattgtttggaatcccttctaggttttggaccaaaacggtgttacatggctatctctagctgagagagaagcttttaacatagtttttcaatgggtgtctgaacaaaattgtttctgtcaatacaaatgtagaaagacaaagagcagtgcgtcttgtatcccttaatcctcaagtcacacatgaaaaaaacagtctcaaattatatcagaattttacattgcacaattccagttttaatgaaagaatcgtctaaggcagcataagtactgaaaaagtagtccacgttttaggacacagaggacagctcaacacacctgtatgtgcttagctacccataaacaatgcctgaggatttgaatcggggtgtaaaccatgaggagtaatctagatctgggtcagcaaacttgttctgtaaagggtagaaagtaatattttacgctttgcaggccacatggtttctgttgcagccactcaattctgttactgtaagtgaagacagccatcagcaatacattaacaaatgagtatggctgtgttccaataaaatttatgtacaagaatagccagtgggccagacttgcctgctggccatagtttgccaatcccgatctagattatcttgtacagtttttctattcactaagctagggcagctaaggcaaggctattctatgagaaagattgccccctagctattaaacatagcccagtgtctgtgtgtcagttggagtatttggcagatctgaggttattatacaaattaagctgtctgaggccccctggtctgcagagcactccagtaatgccatcctagcttcagagacacataccactctaggtcagtgctgacactgaaggaaatgttggcagtgggtagcccatcacagccaccagggcagatgaattactctgtgcttgctcacactttctctcttcagctaattggattactcttcagagaagatgtctcataaagtcagtttaataaggggatcctctttagccagtaaagaacatattccctaaatggaagcaacaggatgagttgtcaaaatgtcagcatctgagctataagaaaacttatgggaccaagaggatcaaagaggtcacattagctacaaagttctaataacttttcctctagttcataggaaagaatctaaataaatatgcactctgggccaaacaaggacataacctatgctctctctctctttttttttccttttttgcaatatttcttagaacaggctttttgtacaccaggagacaaaagagaggtatgagtttgtgatagccatgaatattagtagaaagtcttcacccaggccaggtgcagtggctcacgcctgtaatcccagcactttgggtggcaaggcaggtggatcccttgagctcagaagtttgagaccaggctgggcaacatggtgaaccccagatctacaaaaaataaaaaaattagctgggcatagtggggtatgcctgtagtccagctactcaggaggctgaggtgggggtgagaggattgcttgagcccagcaggttgaggcggtgtgacccatgatcacaccactgcactccagcccgggtgacagagcaagaccccatccaaagaaagaaagaaaagaaatgtcttcaccctagagacaattggagtgtttattctggttcatgtgtagcctctgagcctgatttttcctttcaatcttaagatataatgcctaccaggaatattggtatgaggattaaatgagacaccaaagctttgtagagctttgggcacacatatgtgctcaaaacctgttagttctacttactttatactgcttaaaaattagcaccatgggcttagtccctttcaaaaaggaaagagtgctttgtttttctacaggagtcagtggttttctttataagggggtccaagaaaattcctctttgcacatgcattcttcttttgtcccttgtgtaaggaagtagaattttcccagaaatccaaggcactcctcataacccaccttgcaaggaaatgctctctccccacaaaaggtgcgttgtctaacagccatgaaatggccttttcctggcacttggtgtattttgccttccatttaatatatggttggtgggaaggccaagatcccatcacaggcctctgctggactgggtggatgaacaagattataattttcaaattaggaaagagaaaaagatgcaaagaaaggaatatttctgaggtgaggcacaccatagctttcattggaaacaatcatgtttggagtacacatacagaactctcatattttggtcccatagttcaaggcataggtgaaaatgtgggcatgactattgtgttttcttcaggatagtttgtgtccacacattagttataatgcctcaaacaaccccttcatcccatgcagccatattttgtcctaatcaaatgtctctttaagtatccttagagctatctcctaatgtgtcctgagcatggcacgagaatctcatgcttccatcaaagagtgtccttcagactgaaagtagcttcatgccgcaccgtacttttttaatacacctggttgtaaaccaagtcctttgcctggggtttcctgtgactttttttggaaagtgaagagaactcagggagatcaacacaatccttgctagaaagttaatcatggcagttatagctggcaaatgcatggcttgtttggtctgagtagggcagttacaaaagaagttagtcatcctgccggttgccaggaatttaagatctttggaggaatatcaaattaaggatactgagtctctttctcaaaatcattatcacttccaacactgtccccaggcatctgattccaatccaactaaaaagttttgtgccaacatcacctcaactaatgtacatgaaaaaaaatgcaagacttaaaggctaaatgcaggcaaacagcacaaaacaatgggtttcaacaaccacaaaatttgctcaggatgggccatgtttgtaaataattactgtccctatgaaaatactattgagttcatgttgaacttgactattaactcagtgtcatttcaaatgtcaaaagcagggtattaggcttagttaaatttgccttcgttttctagttggatgtaggcaattctggaacttgtatacagttggcgtctctgtaaccgctggttcctcatcaaattcaaccaactcagatcaaaaatatttggaaaaaaaacaccaaacaataaaatatagcaaaacgacagatatattcatacaatttttaaaatacagcataacagcaacatagcatttacactgtattggtattataagtaatctagagatgatttaaagtgtatgggaggatgggtgtaggttacagcaaatactatgcctttttatataagggacttgagcacccttggattttgttatactcaggctgggcataggtagtcctataacaagttccccttggatactaacggacaaacacactcactgggagttttaaatcttgtctgttattttctagcaggatgcagttgactgtatttgcacagcacataactagagaagtgctgaaggacctcgagagatcacctgatccaaacctctccccttacttccctggacaaaaagccacagctagatttctgatggagatgccttcatttccttagttcaaaagtttccaaatttaggtggatcagaatcatacaagggcttgttaaacatagattgctagaccccatcctcagagtttctaatttagtaggtatgaaggggaactttaatctgtacttcaaaccagttcccaggcaatgctgatgctgttgttcacagaaacacatttgagaaccattgttcctttcaaagtgtagcaatgattgaaggaaaacatccttcttattggcacttcatcactctggtattttaattgactaattaatttagcaaatcaacagagttacttccggtgcttaaaattaggacagcatgtttccaagcctagagaaagactccaacacaacacaactcaaatggaattatctacagcaggaggtcaaatgtgccattggaaaggggttaactaaattgtacttattatttttataactattattatgcttttttcttctaggaactcagttacaatctggactaaaagccaatatagaggtccagggtggtctagctattgatattcaggtgcaatggagtttagcttgtggtatcgtgagtctaaaacccgagtgaaaaatagtaagtgtttatgcattatacatttatgaattacatataagactatatacagagaacttcgaaatatgttttgggaattaatcttctgacttttcaaaatctatgctttctatttggattataaaacgatagagttggaagtgatcataggaaattattctgtctatagcttcttatagcaggtcagtacctaatatgactcagccaagaattttcctgcttttaaagacatacatgacaggatgccctgtgaatcagatggttcatcttcttttggtattccaccaagagaagaatttcactttaaggtaaactttcctcttttgttgtcttcagtggggaaaaataaaatagtaatttcatctgtgcagaaactaactattaaatgttaagagtccttaagtcttttcatcgcattcctttttctaaataaaatactctaagctcctttaatttttctaatctacctgtggatttaatgaaagtgttttactttgaatataaaacaatgtctttgaactagtgtgaagagaaaattattagccttctgttacagaatttttaaaaaggaaatagaaatgcaactaatttaattttttgatatttaaaaacacattcaggcaaaagtgagatatgtgataaaatcaaattttgattcatcttgagctatggatgaaggaactgagagcaatcaaacagtagcacattaatgtgaagtgtgacccacagtgttaccaaaaggaaacacagaatgaaaaatgacactgtcatcaaaaggttcacaatataacttagggcttcccacataatcagtcatctttcaccttttccaaagtactttctagacagaagtttttccaaatgaaatggaattgaattctttgcaagagaaatcaacaacagcaacaacaacaaaaagtaatttggattttttaaaaaagtaccagtatccttaagaatctacccttatccatattgtaaccaatctgtcttccatttccactgttcatttgaaaaaaatatcttttaaacctttgctgaatataggacatcagaaggtacctaagtgattcagggattaaaacgacctctgacctatttttacactgatcataacagcacaggggttttaatttgcgcagcaaaaattaatattcctgtcaaaacataagggcataaactctcatttaattgtgaaagcagtttctcacagtttgatttaaagtccacaattcaattcagtagaagtaagtcttctgttgaaattatttatcctcttcatcattatccagggcacatccccagccaatgcaatctgtttatccagttatctagagcatcattaaaggacccaccaatttttcctcctaggacctactgtacatgccccactgtaagaatgattttttgtaacacatattttttcaaatatcttggcaatcaagggcttacgcctctagagactctttggagaagtaatgaaatggaattaaaatagctgcctagaagccaacagagagatagttaacaaaaactataagcatcgattgtcttcttggtgagtttagactccattttaatataacttgggtattctgacctgctgagaggactgggttccaagaatgttttcattttggtctttgttatgccatacaaaacaatgtagtatcttacagacactccccacatctgcaactgaaggcagggggagctcaggggaagggcaaaccttccctgcccaatatctgagactcaccaggccctggtaccagcagaactctaagcacatccaggtcacctctgaatcccttaagtgtttccttccatcactggcatcatacgttcagaccctgtaaagttacagctgttagtccaataccattaatataatatgaacaagttttttctttttttctcaaatgtttagggtgactgtggtaataacactgacatcacagtggactcctcttttgtgaaagctggcctggaaaccagtacagaaaagaagcaggcttggagtttatctccacagtgcagttttctcagtacccattcttagtttcatgcagatggacaaggatgaagctccattcaggtaagatgcagcgttcaggtcatgttcaggaccatccccagtgcaccaggaacttgcattcagtttagaacattcagtttcagaataaaacaaaacagtagaaacccagggaaagatgaattttctttaaatgagtagaagaatattgataaggccaaaaaaagtcagtttctgggataccaaaaaaaaatctaatgactagtcatttgattctggagatagttatcatattctaatccagaaacaatttatccaggaaagaaggcctatgatttaccataggagttgccacatagtttcataaaaaaaatcagatacacattactgtctggtatcttcacaataaactgctggacaaaagatttcaaataaaacacctgcaatccatttaccatgtttaagggccaaaatgaattcgcaatttttaagtattccatatgcagcaacttgaccctgtttaagttttggctcaagtttcagagtttgggattctgaattttttaaataatgcttttggtaaaatagttagtgttttaaaatacaaagatataatttcctgtaacatttgtgctgtgtcatttgaattttgtaaccattatttgtaacaatactatcaatagagctagaatgccttgagtctaggtagcactgaccctttcataatagttgacctacgtaagcataagggtcatttgtacagttaaaacagcaagccacatcttacatcatctcctttttaagtaggccaaaattgagcaccttcattattttactgacatttcatgattcatataaaaaacgcattgattatataaaagtaaacgagtcagttgtattttcagagaataaaagttgtgctttatagttaaactattaagctgtcactaacttacattaagttatatctagaagaacctccacaaatgcattttaaaaaccccaaccttctaatggttgaaatgcagtgaccccaacccacccacatgattaattggtttggttccacatttgccttgggccagagctcttgaatgtttctctgtccgcattctctgcttaaatccagctgggcttgcctgttactcaaaggagagtgctcccaaggtggggcttctggaatgaagggtgagacacagcacagcctgcaagcttaatggcatcaccaaaaagctgaaatgaatttagtctttcattctagaaaaatgttggcaggactcccatatcccaggcatttgaagtgtttctgttgatataaaaagaaatgaaagaaaatcacccattcatggagtagcctttgacactcatatcctttctcagattgcttggaacagaaacttcaagtacattcagtaacttggctggagaggtatagggtgacttaacgtgtgtgtaattctgttattgttgctgttgttgtacaggcaatttgagaaaaagtacgaaggctgtccacaggcagaggttatgtctctcagaaaagaaaagaaagcgtattagcaggtgtgaattcccgctccatcaagagaactcagagatgtgcaaagtggtgtttgcccctcaccggatagtacttccagcggatggttttgaaactgacctgtgatattttacttgaattttctccccgaaagggacacaatgtggcatgactaagtacttgctctctgagagcacagcgttacatatttacctgtatttaagatttttgtaaaaagctacaaaaaactgcagtttgataaatttgggtatatgcagtatgctacccacagcgtcattttgaatcatcatgtgacgcttcaacaacgttcttagtttacttatacctctctcaaatctcatttggtacagtcagaatgttattctctaagaggaaactagtgtttgttaaaaacaaaaataaaaacaaaaccacacaggagaacccaattttgtttcaacaatttttgatcaatgtatatgaagctcttgataggcttccttaagcatgacgggaaaaccaaacacgttccctaatcaggaaaaaaaaaaaaaaaaaagtaagacacaaacaaaccattttttttctctttttttggagttgggggcccaggggaagggacaagacttttaaaagacttgttagccaacttcaagaattaatatttatgtcttgttattgttagttttaagccttaaggtagaaggcacatagaaataacatctcatcttttgctgaccattttagtgaggttgttccaaagacattcaggtctctacctccagccctgcaaaatattggacctagcacagaggaatcaggaaaattaatttcagaaactccatttgattttcttttgctgtgtctttttgagactgtaatatggtacactgtcctctaagggacatctcattttatctcacctttttgggggtgagagctctagttcatttaactgtactctgcacatagctaggatgactaagagaacattgcttcaagaaactggtggatttggatttccaaatatgaaataaggaaaaaaatgtttttatttgtatgaattaaaagatccatgttgaacattgcaaatatttattaataaacagatgtggtgataaacccaaaacaaatgacaggtgcttttttccactaaacacagacacatgaaatgaaagtttagctagcccactatttgttgtaattgaaaacgaagtgtgataaaataaatatgtagaaatcatattgaattccttttgtctttgttacttccaacaccatatttctcattcctgccactttctgagcctagacacatacacgttaagcctctgcagcaatacaggtcaggccaggttctctagatgggagaccagacccattgaaaaatgggccactgaaaatatcagcagtcagaacctcttaaggacgtgtgagcttaaaacatgccataaccccagttttcataaagctctggactggcccctttactgtcatgtactaaaaaggaagaaaggaatcagaaactaaggtggtgggtggagcatggtatgtggtacatcagccttggggaaaccactctgtaaagatgctgacgtcgcagggaaagtgagttggctagggtactaagctgaagatgttgtggactcaggcgcttcagccctgtgaggtttaacaatcacagccacctctgcaaaatgtaatcatttacttaacaatgatgactgtggtgctcgaatgttagtgttttgccatttcccaactgtttactgggctgctgagccaagtatctgccacccagtggagaatggatgatcctgagcaactctaacatgctccaaagaaacaagaaacagcagcataggacaaacagtaactcctttgtagataaacaagacagaaaatgaagagggtagagtgatagtccacatttggaaataagatattggagccagaaaaataactttaaactcatttgcagtcctctagttctgactacttctccattataaatgccagcatacagacactttgtcttctgaaaagacatctatttgggaattgtatagccccctaatgtgaatctccagcctctgtccagtcagatctttcctgcaagctttaagattagcgtggcttcttttcttcgtgaagtgttattgtcattccctggctcatgttgcagtcctgcctgtgacaagttgctcctgcttctctaaactgaccaccttcaagtaagtgttaaagctaacacttactgagtgccattatatgcgaggtattttaaagccttttccgtacattaatttaatcttcataaaaacttatttaataggtagcattatttccatatgatagatcagcactaagagaaatataatatggtcacataagcaatttggaatttctagtagccacattaaaaatgtaaaccaaaacaggcaagtaaactgtaataatatattttatttaacccaaaatatccaaagtattatcgtatcatatataagtaacataaaaattattaatgggaagctttacttttgtggggaagattaggtttcaaaatgtggtatatatcttgtatataaagcacatttcagtttggatgagacacattcaagtgttcagtagatgcatgtggctagaagctgctgtattgaatagtacaatattgggacacaagacatttaatttgccccacagaagacactttctcacttagaaagtgaaagaacaggactcaaatatgagtagtttcacctcagaacctgctctctgaacccattataggatgttcccacatgcttttggttttaaagatttgctgccaaacgaatacagacagtaggttataaaatgagaaacatgtgacagcagcaataaagctaagagttgttgccctttcttttttttgagacagagtcttgctcggtcgcccaggctgcagtgcagcggcgcaatctcagctcacgcaacctcttcctcccaggttcatgccattctcccgcctcagcctcccgagtagcagggctgcaggcgcccgccatcatgcctggctaattttttgtgtttttagtagagacagggtccaccgtgttagccaggatggtcttgatctcctgacctcgtgatctgcctgccttggcctccaaagtgctgggattactggtgtaagccactgcgcccggcggacttgttgccctttcttgtggtcgttcagtctcctcctctgatggaatcagaagcccaccataatcaattgtagacgcatccatcattccaaaaagaaacctgtacactttagctatcacttccaatgtacccactcccagccctaggaaatcactagcctactttctgtgcctagattcattgtggacaattatataaatgcactcatatatactatgtagtcttttgtgactggcttctttcacttagcatgtgttttcaagtttcgtacacgttgtagcatgtatgagcactttattcttttttatggcaaataatattgcactatacagttatgccatgtgtttatccattcattagttaatggactttggtttgtttccaccttctggatattatgaataattccgctatgaacatttgtgtacaactttttggtgggcatgtgtttacatttctttatacttagcagtacaattggtgactcaatggtaacactatatttaactttttgagaactgccagaattttctccaatgtaactgaccattttacattcccaccagcagtgtataagggttctgatatttccacattctcaccaaacttattaatatacttctttttgattatagtcatcctagtgggtgtgaagttagcactaatttcgaataaataaaaaaatgtatttggctgggtatggcggcccacacctgtaatcccgcactttgggaggccaaggtgggatgattgcttgaggccaggagtttgagaccagcctggtaacataggaagaccctcatctctacaaaaaataaataaataaaaaaattagctgggctggtggcacatgcctgtagtcccacctactctgaggctgaggtcggggaatcgctcaagccaggatgttgaggctgcagtgagtcgtgatggtgctaatgcactctagcctgaatgacgagcgagaccctgtctcaaaaaagaaaaaaaaagattcaagtccttgccctttttaaagtgaatatttttccttttatttttgaattgcaagaattagttatatattttcagtgtaagcccttatcacatacataatttgcaaaaatcttctctcattctgttggtgtcttcactttttgataacggcctttgaagtacaagagtttgtaattttgctgagatacaatttatctctctttttcttttttgtttgtttgttcttttggtgtcatatctaagaaaccattgccaaatcaaagtcacaaagatttaacactatgttttcttttaagaacttcatattttagctgttaattagtccatcatggttaattttttatatagtgagaagtagaggatcaaaatttattccttgtgtatggatttccagttgtcccatcattgactgttgaagaaacaactctgtccccatgaattattttggcatccacaaacatgaaggctcatttctggactgttagttttattccttaatctctatgttgatctttatgctagtaccgcactgccttgattactgttgctttgtgtaagttttgtacttgtgaagtgtgaatcgcatattttgttctttttaaagattgttttgcaattctgagtcccttaagttttcatatgaattttaggattagcctgtcaatttccacaagccagcttggattcaaatggagattgtgttgaacctgtgcatcaaaaattaattatatgtctccaggtccatgaacacgaaacatctttccatttatacacatcttgaatttctttaacagtgttttgtaattttcagagtataagctttgcacttttttcgttaaatttatttcaatgttttattctttttgatgctattctgaacacatttgttttgtttcattttttcattttcattgcaagtatataaaaatatagtttttttttgtataatatattgctcctgtaaaacaaattatgttgcaacactgctgacctcatttattcattctatatcttttggtaatagatctttagaattttctatgtaaagaataatgtcatttttgaatagacatagttttacttcttctttcccatctgaatgtttttctttttttattttcttgactaattgccctggcaagacctccagcacaatcttgaatagaagtggtgagagtggacatagcaaagatgataatgctgtgaaaaatgtggtggtggtgacagcagtgacagacactaataaccacgggacatgaaagaaggcccaaattgtttggcagtagctctagttctattttcactaagtaatatacagttttccttggtatctgtgggggattggttccaggacccctgtgggtactaaaatctgtggagctcaatcccttatataatggcatagtatttgcatataaactacacacatgcttgagtaactttaaagcatctctagattacttataatacctaatacaatgtctaaacatcacttcatcacatggcttcaacttagtagtcaatgtggggcaaattcaagttttgctttttgaaacttatgaaatttttcttccgtatatttttgattctcagttagttgaatctatccatagatgagaactcatgcatatgaagtattgtaagttctgctgtgcttgaaaattaataaaagctatttgaacgtttaaaacactttcaagatagtctagatgtctgactgcacagagaagagaacacaacttgaggtgcctgtaccagcactaaggatatgtttgagattcagattggttgagcttcagtgttgtcaacttagtcaacttcctcccctagaaggaagcggggagagaaaggaataggacagggaggcctggcttagaaatccagttccactacctgctggatcttggacagggattcaacctatctgccatttccaaaatgggtattataatctttatttcattgtgttttttaaggattcatggagataatgcatgtaaagcatactgcccagcacatacttggtagatttggttaatgtttttaattttggagatgtagtgagcaatatcttataactgatcagtttaataaaaaggagtttgtttgcactttatttctacctcttccttacaggtagttggaggcatagtagtaattttctctctaactctccagaattggtgcagaatggcatgaaaaccttcccatgcagcatccaggaaggtaggaggcaggggattgcagcagtgaggagatttggataagatactcctgcatacgtgaaatctcacctcttcttcttactactgctacataaacctcaagcctctcagcttctacattgggaaaatgagcagcacctcataggttgttgtgaggtgaagtaaggtaataagcaagttcctggcgcataacaagcatttaataagtactcattatactaacttttcatgtgcagtcttatacaatttctgagtaaagcaacattttatgttttactcaatggagtgaatctattttctggacattcatccatgaacatcataagttttggaaggctaccagttttgtttatttatcatgaaaacactactttcacattataaaaaattattctccattttgtaaaaacatgactttcatccatttctctgcatacctaaattgacctgagtttcactgatcctttctttaccatttttctttgcttttgtcctctgtaaatatgataataccaagagtaaaagaataagtcttttcactagggggcatggaatgaatttaaaattcatcacaaaataagaaagttctagtagaaagtttttggagaaaatcttaagagaactctacacataaataaaatggataggatttttgagaggaaagaaaataccagaagacaccactccactcagtcattcttgtttaggacttgagcagaatgtca

SEQ ID NO: 5066 - DNA, 66224 bp, Homo sapiens
ggcattggtgtccatggccctataccgccatcttacacgaaagccacagagttgaaagcacagagttgaaagccacagagttaagtgacctcaggtaacataatggtgatggttggcctttgagtctttgtaacctaggaaagacaaaggtctgattcagattgcatgggggattttaacatatttgaaactcagggggaacatgattaagaacacaaactggtagctacacatgaggtttacttgagcttttgtgattcaaagttcaggggtggtaaggactctggtaccagggagagggagaattaatttattgtgcaaatgctggtatttcttacatgattttttgttttctctgttgctagataaatagaaactaataatagctctatttctctgccaatataaaatctcctttcatataatgctacattgaaggcacagaatttgctaccatctctctctccccctactaccaaactatccacaatttaaataaagaactgctgtgtctgacttactctcaataaagtttgtgtctttatttctggtctctagactttattttgtttagctgccttttaaactttgaaagaatccttgtatatcagcagctactatgataattaatgaatacctcttcagaaataagagaacactttattttagttcatttgcattatttatttcaaaaaggtcttaaaatgatgtatataaaattgtaaaaaggatttctggtaggtagatatgtaatatacatgaaaaattttatcattttttaaggaactgagatcatgtttaagatgcatcttaacacgaacaacttaagaaatctctgtaatcatcagagtaatacatttaaactatgctgacattttcatagcatcgtttctgcatatttacatgggatcatacttttggcatattttcaaatggagaacggaatttaagtttttcaatgtgatagggaaaacatttaaaataagtaataatagagaattatgagaaggataaagcaccagagtataataaagaagaaatatgtttgacagtatgagaaagcaaccacttctcttaaaacttgaactttcatcactctaaaaaacaataggattgtaaaagcaatgtcaaaaactatatttaccaatattaaagtatcagacagaaacataccacaatgatatgggtttctgataacccctacaatattctacttaacttcaaaactcagtattgtttaagacaatgaaaatgtgtatatagttcatgaagaacatgagataactgagccaggcaataatacaaacacaatgacatgggtagtagtaagcagctgaactcactcagaacatggcaactacaaaatcaaatgatgatctctagtagctaactgccagcacaggagaattttggaaagaatttagaaagtaatttggatgtttacctagaatttaaagttacatacttgattcctttttataataacttcagtcgatcagatgcaaaagaaaaagtacttaaaaatgtttaattcaacatcctttatactccacagttttagttttattctccccttagcaaatgttttcaggcatctttaacacaattcacttacttaatctttggcttctcttgtttttaagctaatatgttaaaactagcaaatttggggtagttgtttgaagcagaagacatgtgtgtaatcttcaacaaataacaagcaccctgataattaagaacttgattactccttcaagtttggaaaatggttccagagtgtaagttcacttgagatacttttgtgcagaaggccagatgcagacaaagcttacacctgaaagagttaaaaatatctaaaaacattttattttctttatgttgtgaatagaactcttgatatttctttcttccagatcaaagcatcaaaaaaaaaaatatatatatataatatatatatacacacacatacagtatatttacaaaaattgctatgtttttgagtggtccttaaaaatctattcatgctatgaaaaattttaatttaacatctaatataaagggtttatatatagatgcttatgaccaatatccttaaactggtaaatatctgtcaatcaataataaacagaaagctcttgtttttgaaaaaaatatttattacttatttgatggtgactcattatagaaacagcatattagaagttgctgtatttgctggaaaatgagaattttcccttgtgtttgtatgtgtttttacaaagcaaagattcacataaacttgcaaagcgactctaattgaaagataactattgttccattaggttgaaaacagaggcattaaatctgtttagtgtgatgtttttttttctttctttgagatacagacaccaccaacacctggaatactatccattaagctcattagggatatataatactttatatggcttattcaaaactgtcaaaaaataaatatttgtacaatatctctggttaatttttttttctaattgtaaggcattttgtcttgtagcaacattgagtaacccatgcaaaagttgttgcaaaagcacagtagtgacaacctacacaatgataggaataaaaagtcatggtttgtgttttaaaggactccaactttttaactttttattttgttcaagatgagcaatctgctagctttgattaaaggttggagggatcaagggttggtatattaatacaggagtcattaaaaatttattttaggccattagaaagggtaaaatagttccggtggatttttcctttaataaaaagcagcccccaagccacttattttctaacaaaaagagcctgaaaagtcaagttgcaagtatagatatgcaagctagaggctcccatatgtaaagtagcagctgtacctggaagccaggcacattcaatatggtgattcctgctcccttttcctgtcaccaggtgtgtgggtgacatggcactggtgaagtgaagccacgtgtgcaaatgtcaggtgacagccaggtagaagatgcatttgcataataaaaggttagggtgggagggccagtttttcaccggctatgtaagtagtatacctggttaaaccaatccccgggccctatgtatacaatcaccgcctcctcaagcctctgtatgaaatcaatcaaatcttgccccaaacccagaaaccctctcttgagcaactgtctttctcaacatgaggaagctttctcactctcttcttttctattaaactttccactcctaaacccactcctcatgtgtgtctgtgtcctgaattcttcttggcatcagacaatgaaccatgggtatttccccagaaaatggagctttttcaatattttcacagagaaagaatcctccacatgtccacttctttctttcacatttggtccaggagagaaaaagaataggttctgcatgaagtcaaagagatagatcacagcaaaacatgtgggggagccatgtttatacctacacatcaattggttaccacagagagagagagaccatgcttctttttctgtttatacaacatccaaaagaggccaaaggggtttaattcaatctcatctcaaactgtggcatcagtaatctgagaccaagaaacttttaaatgcacccacctgagatgacaccctttgtaaagaagaaaattaattatatagcagcatggtatagtgagagaaatttttttgagccagataaaatggaaactgggttttatctcttacttgtgggatgaccttgggcaattaccaaattcctcatctgtatgtgggagttatccttcttgttcatataacagggagaagagagtcatttgatgagttgtacccatcagtgagatgggacacatatagcacctacacaatagtacctacacacactcaatgataattagttcctttcttttttcccatcacccaatgcatttttttgttttaatccaagattttggggctttcttctgaggtaaaaattattattatattttttgagatagagtcttgctctgttgtctaggctggagtgcagtggcgcaatttcgctcactgcaacctccacctcccgggtacaagcaattctcctgcttcagcctcccaggtgctgggattacaggcgcccaccaccatgcccagctaatttttgtatttttagtagagacgggtttcaccatgttgcccaggctggtcttgaactcctgacctcatgatccacccacctggcctcctaaagtgctaggattacaggtgtgagccactgcgcctggttggtaaatttttttcttgtattctgaatataggaattcaatcagagatgttaaaacaaagaaagatggtacctctggcatgtttcaatcttattctattgcatgagtgcctgctagaaataattacaagcattcatgaaatcaaggttggttgggaatattggactcctatatactgtaaatggtatcttgcccctctgcagtcccaaactaatactagaagtaaggtgttttaatatctaaaagaattttccaaattagtgtggcgaagctaataatacattgtgatcatggcacatggtggtttgtgtgaatgacagctgaggggatgtcaacaagcagtattaagcaaatttgatgctggtgaagaacaagattgtaccaacaacaactgtgtcagcttacaagagagtagggcagaagcgcgggtaactgttgaaaaggagaaagaaattgtgcaaactgaaaagtctcagaagcacttaatggcttggtaagttggttagtgctgtcaaatattatcaagaccacccttgtattcaagtaacaagatgcatagactttttttttttttttttaaagtaaaggcaatgacctaagctatccagggaaaaatctgtagctcctgtaacacagcctcctattgaagaattcagtgctgataggacctgtctcatccaaaggtttatcactagaattaccagaagaccgagtagcatgttacctttattctaatctcctgaaaaaatttagaaggctatgcttaagaaaatgttggtatagatgtaataataaatcaatacactcaagtttaggcccatatagattcccaactagtgtcagttccttgcttcttagagtaactgagcaaatatatgatgaaaagcaatgtataaaatctatccaagaacaaatttgtgatgttcaaaaacaatcctttgttatattgacaatataatttaaatatagctttatataataagtttgtcagggtaaagtcagaaaggatgtgaactagaggactgcagaagtttctgttaaggaaaaaaatccaacttcctttagttgatataccaaagataagtgtattcaaaatgcaattcattttttttcagaacagagttgacttctttgggaaactattttcggataaaaagagagcctatatacccgggggaaaaaaacctctcaacttttttagttacatgaagaattacatgaggcacctagcatgttcagtttgtcagtaactaattagtcttttgacaactgacttgcgtccccccatcccccttgccccatatggctctgtttgaaaagaattagagtcatgcatcatttaataacacaaatacattctgagaaatgtgcattaggcaatttcatcattgtgtgaatatcagagtgtacttacacaaacctagatggttaggtagcctactacacacctaggctatatggaatccctgttgctcctaggttacaaactgtgcatgttactgtattgaacactgtaggctattgtaacatcatggtgagtatttgtggtctaaacatagaaaagcacactaaagataccatattattaatataatcttttgggaccatgtcaaatatgtggttcattgttgactaaaacatcattatgtgtcatataactgtatccatttcctagtcattctcttactcatctgcagttttcaattatatgaagaaaacatcttaatatgttacaaatgtgcagaaatagttctttttcccattcttagttatagttttgctttacgtaactcattgggagtcaaaattaaatgttaaactaggagtcagaatgaaagatactagtttcacaatcatctcaactgaacaaaagtttaaatttaaaaaaagaaaaaacatataacaagaatatagtatggttgtcctccagggacccaatcccagcaaagaattgtgtatcctttctaaggaattctgtgaagcagatttgttcgggccagtgacctgaggcattagaatagccctgtctctggaaacctgaattctaatcttgattctttgactaacttgcctgggtttaagatttttaggtaatttatcctctcagcatcagttttcttaccaaaatgaatgcaaagctatcctgatttctaaggtgtcttctggtatgccaaagtattggtatgcttaagattaaggctttatttggatgaaatcagtatttaacttttcccaaatttgtcagtgttctcactggttcacactgagggctttactcttttttccttcatagagatactagatccccttcttttttggccaagtccagcggaattttttcttaactctcttcctaagacttgtttacctcatcctttcccctttcatgatgtttccttcacttcattttccctttgaaatattttagaaccatttttcgcatatttcatccctgtgaatgctactatatctaaagtagtattttattattttatataaaagaaactttcagcagctctatttctgctttactcatttcaactcctcttattggccctgcactagagtgcattcaatgcttaaatgcatttttgattactacagtgtgtataatccagccttttttcattgccttaaaaaaaatccacatgaatctaggaagttattgtatcataaatctttaaaactgtagttttaaaagcacaaaatgaactgaaatagtgttcaacctagaattaaataagcatttgaaggcctcttcttcctcacttaaatttttttccactattcagattgggaaaaaccattatgtaatttagatcaaaatgctgccatcaagcagggtaccagcagtagatcaatactatttcaaactgttaggtaagcatgcatgtagtctggaggatttcacaaacgtgacagctgtgggcatctgaggtcttctagccataagaactcaagaatttttgtttgatgaaaaaatccccaaataaaggactaagttaagttctcattgatcattctacttgtgggccagaagagctgattattaccaaacatagtcattgggaatatcctcatctttctcaagtccttctgtcttcatttccagttacctgttagctttcacagggaaatttcatgatgaggtctagcatagggtggaaagcaggcaattcaaaggccacccagttccgaaaaggacttcagtccaatgttggactgttttcctgagtcatcttttggtattccaaatatgtgatttataaaaaatcttccattcaaatgttattaaaattgaaaatttaaactaccgcgagaaatatagtttccaagttcagtgttattttcacagtatttaatgggtttactatataaaacatcagttacacttcaggcttcataatatttttcaaatttccacttttgatatggttcactgggtcacaggcagctactttcaggatcttttgagaaaaatttccttccaagcaaataattgctgattgttttcaaaaacaatgtgattcacctggagagaaagaagagctggaatgagccacaggctgaatttgataactgcaatatgaagaaatgaaaatcaattaaaaaatggacaggcagttatatttttgatttttaagaattcttctgaactaaattattaacataacacagactttgaaaagtattaaatttgtctctgtctcagactaagtaatcatcctccccaagctataagacttttaagtcctcaggaggcaaaagaaaaatttcttgatgatatggtgagaactatactctttaaagagaaaacattacagatgacatttattggatttgatagagataactacttcattgatggtaaagaaagaatacataccgtaacaaaaagttaattaattttaaagtaggtgtctttgtgagtttggattacaaaattctggaagtgatgtattttattatgagctccttaccataatctctgacaattcataataactgatgtccaaaatccagataggaaaaagtcaacagcattaaagaaagttatattattgcttaatatttagtgaatatctagaaatggtagataaattagatagaccttactaatggcttatatattttttcatctataattttcttaattacgtatgactatgacaaagacaatcttaattacacatgttgtttttaactttaaaaagttatcaaacaggggtgactttcataataatttattttaaagattgctctacaaaagtattgtcacccttgcaggattttggaaatacgatgcttgagtattgtcaagatttgtaaggaagtctcattttatacttctcttgttgtttaagacttacatataatggagacctagtagcaatagcatgaaaactactgaaaaactgaaaaaagaagaaagctgatcccaagctattcatctccaggacatttggtaacatcaaaagggaaacccaagacagaaggagctgtgtaaaatgttccaaagtcataggtacaaacaaggtagggaaaaggctttctaattttgctatcttaactaaattacctcctttaccaaatcagcttaccgcttaagagaaacgctatgcttgaactctttcccaagattcaattctggagatgaagaatgtgttttagttccgttcttattcatattctctctctctcactctctctctctctccttaccacatcccccctttctccttccctccctcctgactttggcacagggagaaggtaagatgtaagttattcatacactgcatgtttatggatttcctaacactatgcaaaataaaattagtggcatatatgtaataattcctaatctttctgaataactcaataataaccattattactaaagagaaaaactgttcagaaagaattgaaatacaacagagaagatctaatgggagaaatgttggagaatcattactcaggccccagttttggctctgagcaggaagaaaaatgttgagaaaagaatagcattgtgttgttaaaaggaacggaggcacctaaaggaagcaaaggtgcttactttggggtagcccaggacaaactgagagtctccaaatacccaaatatttactgtagacagtagattggtggctacctgctggagagattgtagaaaatttaagaaggcaattctgagactattctgccaatcccaagctcctacaccaaggcttatgactccgtattctgttaaaatgtaattggacaaatggagaggactttgagaatgaatacagtagaccaggaatgttctggtaaatggacaactggaccttcagaaaagtatccctgatccagtaacatcttccaatttctgtggtaaaatactcccaatatggccagtttccagctaccaatgtggtatgattaaatgcaaagctgcaagggtgtgcacaagtggctccagcgagctggtgagagttggctccagcagacccttgaagccccggtttctgggtaccacaggggatgggaagagtctcttatggaaagggggcaaatgaggaaccagattcactctaaagtgcaggacttgtaggagacatgctgcttcctgtttgcccatatcctctccttataagcattactgatgaccagtggggaccagttctagccttaagcctgactttcggtgttgttgattgactgaagcaaatgatagcaatgcaactagaaaacttggtgatttctatttaaaataactcatttgaaataaattttgaaaaataaaaaaaaaggacttgtcaactttcgaaagatatccatgcatctctgtgaatgaacttttacataacccatggtcacaaacacacaaaacttctgactgaggaaggtgacaatgagaattttatgcctatttgatcaaaagtcaaatttgtggtaaagaagaggtaccaatcttttgcttaccattctggatgaaagactgatgttgatttatgcagccattttagccctttgtttctgttatacaagggtgcagccttacggctcctttatcagggatgggggctatacaccattctccactttaataagtcttaaccaggtgtaattaaattgttgaagctgtgggggaaatgaataaaaggtcacttcaggcagcaaacacaggcaggggctttgtcaaacatttttgttaacaacattaagaatataggaactatgatctgacattttatattcaagtcctggtattatcatttgaattctgatagtatgggcatattatttaccctgtctaatcttatttttctaactattttaagttggatagcgattgtgtctatctcagagggttggggtaatgactgtcaagtgtttacacacaataagccttcaataaatgttagttacaataataaaaattattcagtgcaattattctgtctgcatatggatgtcatttcagtgttctgaatcccgacaagcctggtgcttaagaattggaatgttcagtctaccacatgattaaggttctaagccacgggtggctacaggggataccagtcatagccctaaatttcttgggtggagattttatgcttccttgtataaaacatcataaaggctttgtccgattgtaggaaaggtggaagtccttctttgctactagcatgggaatcatcaggttgctaccaggttggcatcccccagttcatagaaactgctcttggagaattgccagtgtctaaaataaataccaattcaggtaatgaaaccatgtttttaattctgaacatttttcttcagttgtttacaacctactattgtctacccggtcaatttactctaatctctgggtctgtgggaaatttatcgttttgtactaatataaacatatttgaaaaaaatagcttctggtaaaatctatctaaatgcctttacctaatgaatcatttgtattgtaagtgagtttaactttgattatcaggttagatcaaagtcattgtgttggaccttgccattggaaggtggtccttggaccaacatccgcatcagctgggagctacttagaagtgcggagtctcagcacatcaccgacctactgattcagaatctgcagtgtaacaaactccccaggtgattcactgaacattaacatgtaggaagcatggaagtatggcataatataaggaagttatgtgctataagagaagctagatattaccttgaaaaaatacgtttcaaccgctttaaaggttaataataaggaaactttttaggtaaggtaagggatagagcttgatgattcaatctaagggtcttttctttctgagcctttttggatgaatgttgtagtcactggcttggtattaagcctcattattctgctgaaaatgagttaacttcctccacatttctttactttttattacccaagcaaccacaagaggcagaagctaaaaatgagcaacaaagactaaaagggagctggggctttgtgaagtcgaaggctgcataatttatacttttgcctctcagcatccaattgagaaagactcatggtcatcaagaatagaatttgggttttcagataaaatgctggttactctggcacaaaactccctgctatgatgattcctaaaaaaaaaaaaatgcattatttaatactttcctttctataatgtgaaataattgtggttttgtttttacaatttatgactttatttcctctttgtagtaagtgaaatttatttcttttaatgagttttaacacttcttcacttccctttgactctttctttcctaattaaaaaagagtggccttggcttcaggtttacaattcacagctaaattagcaacagagataccttttcttctagtagtagctctgagttaagaggtagagatgggagcaccaaaaaatataaacagtatcttgaagtcaaagcaaagatgtaagacttaacaagctagattaccattgcaaaataatctctgtaccaaagaacaatctgcaattttgggaactgtttctattcatgaatccattttcctctgagtcctatttgccactcaaaccaataactgttccacaaacacagaactgttaaggaatgtatgttagagagggaagtgtaatcactcagactcacctccagcactgtggaaggagtctctattccctgcttcctggcccgactccctctctaaccattgcgctctgagtttggggagttttcctataggagtttctaccatggatcatgatttggttatttccattactcccttaaaatgcgggaaaatgaggggaaagaagaatggatcagacaataagactgcttccttagaatgattatttagaaatatgttgtctctttagttctttatctatgttatgcattttttacatttttatctttattattattacagcaaacattacagagcagtaagcattaggtattgttctacatgcttcatatgtattacctaactccacctcacaccagttctaaaagtaggcatgattatcactaccatttacccaaaggttaaggatctgcagacgttaacacgcttttgcaaatgatggtgccaggactggattcattctggaccagtgagttgactgccggacccacacctttattcccttagtcactgtctttgtgtttatgatggactctctttttacaaagaaatttagaaaattatttttctgttgggcaaagatgatttctcagttgagcaatgaatgtgtcataccctgcacctatcagctaccatgagatagaaacagtttagcatacctctttgctcccatcgcagtcttccagaatgactgtagtgtttcaatggaaatgcatttacccaaagccacattaataagctaaaaagcaaaatacgaaacagaattacaaaatattttaaagtaaaacaagacattcagacacatttagaaaatacagaaataaaactataataaggttaaaagttaatagcttagcattacttagcactatccagtttattggttgctatctctaacagagacataatgtaatcttgtaatagtacagcttcaatctttaattttggcctgtgatcagccacagagccaacacacagaagcttttaattaacccttcctggaatgctaaataacaaatgagcaaaggtggcaagaaaagtaattattttcttgtctaagtttatctaatgcatatactaaaagtcaatgcacctataagagttatgagctatgtccctgactgaccccttcaagccttttgactgcttaagcactgaatcatagataaattgatccttcaaagaacagcagattccagctgattccctgtcagaatcttcttaatgacccaacaagctacaattcattataggaaagtcacgaaagctaatacagagccaagcataaaggcctttctggcaggcccccaggtttttaatggatttacagggtcaaatatggaggtagcttctttaagtcaccatttaatgcagaaaaatgttgatttcctttccccctttgacatcctggcagggctaacaagatgatgggttaacagtgcaacttagggttttcagatttctcgaacgctgtgcagagccgaatctatatgacatgtcctgggaaagcctcctgagctgggaggagtgaagtctttgttgccagggacactatttgtgtccttcctgttctatgatgcctaacaagagctctaactcagggtgctgcactgatgcagactggatgctcacagaattgccagactcataaaagggggctcagtacattggtcctcaattttacatgcttagcttagtgaacaagaagtaagggacatcttcagggatcagaatatgcggaaaaaattaaaggctacagggaaattgcaaaggttggcaagaaagacttgttccctcatatggatggaagaaaaacagaggtagtgtaaaccaaaaatctggaattcaggtcttccacataacagcggaaaaacagatcttcgttgaatgctgcactgggaaaaacaatttgcccattagcaaagggagaaaacaaggaagtggattgtccctgagaatctgaaactttacaccaggcttcatttggatttgagatgaattttacaccacctgccttggataggaaccatcacagactttcaaggcatagaaacaaacataaaaatagtaccaggttgttaattacttctgaggtgcctggcacaggcagaaacaaagaactatggaaggatggaatctctatcaaaaatcctcagagaaagctctattagcaatttaaatgacaaatatgggaggagacagctcactgttagtaaatgtgggcatcacaaggcacgaaggattcaatgcccccacagtcccacccctgaacttcagagaggaaggtgaatagaagacatgaaggtagaataatctcggggcttaaaggaaggaaagcatgctgcaattgctcttgtactgaagcagagataaatattatgtaagctcctgtatttgtggatcatgcagaaatttctatcttcaaacaaatttggaaaattctggtttccacagagccgaacaggtggttctctccagaacttctcaaaatcttcagggtgttaatgttcagcttgctgtcagaatgttgtcaaatgtttctcaaatgtgcttgaccatggaaccctgagacagcacaagtaacattggtaggacagtgtttgggaaccccctgtttaactatttgtgtctattttgtataatccttccagaaccgaaaagcattggaaggaaagataaaacttttctgtcccttacatgtccctccccatttgacctgaagatttttttttcctttttcttagaaattactgaggaaactatttaatgaggtttttgccatggaaggtacttttacaccaacctaatacttttcttcatatagactcatctctgaagtgttttggaattgttattcttcatttcattattagttgttttcagaatttcctttttatttaaaaataattgatccatgtttttactgtaaaccattttaatctttaaaaaaataggcagtgtatgaattttaaattatccatgttgtattatttcattttccaattaggaagtagacattccgcacaatttatgacagaattgttaaacattaggctatttgcagcggtttaatccagtgtaaaaatacattattggtgagattctttcattagcttcaaattcgtcgtttcaataagaaaatatttcttcttattacaaaaaaccaaaactttcactggattaaatttctgcttgtggaggttgaaaaaagggaaacggagctatagactgtttgccagagtttaatccagtgaaaaatacattattggtgagattattagcttcaaatattgttggtcgataagaaaatgtttgttcttattacaaaacacaaaactttcactggatctaaattcctagtggaggttgaaagaagggaaacgaagcaagtaacaaaaagaagttgtggagtttatttcttggaactttccacgattgtctatctaaaataatgatctacttaatttgttgtaaatacctggagaaaggtcctaattttttaaaaatgttaataacgctccctgctggtttgctcagaagggagcaaactacatcttcactgaaatttgtttaaggaagacaacaaaggaaaaagaaggaatttgttaaaatcactttttaaaatacttggtgcattttgatatagtatagcgaggcatcagcagaaggctgtttcattaggagagctctccagaaatttcataggaactcctcaggttagcgcaacagcggagcccaaaggtagttttctagtgccctctggtggttaagcttattattactctgactgagattctgcgttgctggaatgggaaatattagaatagtgaaattcctttctttttttttttttctgctcagcggttgaaattaaaaattgtaaatttatttacagttatatttgacatgttgttatttgaacagtgtatataaatccaaaatgtctgtaagttaccaggttgagccacttaaagtagctgccattctatttggacccataaaaatgcaattttataatacagtgcgttatctaaaaacaggtcacatatacttatttatcagttgattttgtaaaaaacagaaccatttttttaagactagtttcttgtctttcatagctttccggatttcccgaatactttcaagggggaatattatagtaagtttttgctatcaggagatttccagacagaaagcatggtataatccactctcaagaagaactgaaaaaatttggcctaaagggcgggataactaatggtcacatttttaaagaatttcttggatgaagaaaaaggaagtgaaataaaacaaaaacactggggttagttataagtcaaattaaattagaaataaaagatagaaataagcatgactgtctaagaaccccagctgaaggcttgactaatcatatctaaaccacgtgtcttaccatcctcttcaaatgcagcttcactcctagaaggggtttgaaatggttttccccagcttctcctctttcttgatgttttctcagccttgtactctggctaccttactggcttagcttcttccctttggataccatccttcatgccctggaatgttatctgctatctctgatattttctgttattttaagttcctctttgaaatctttacaaaccccaattaaacttatcacccccttgcttaactctgctcaataacttcccactgctttcagaagaaagaagaagcaaggcaggaaagaaggaaggaaagaaataaaatccttactttgcttacaaggactgtgtgatctggctccttccttcctcttcaccttcatctggtgccattcttccctccttacaccctgacaacattcgtcttctttccagtgcttggatggagaacactcacctgtcttgggctttacgtgacctttaccctctgcctagcactcttctttagagcttggctgactgaacttagtgttttaggcctgagttacaaagtctccttctcagagaggatttctcagccacctaactgaggagtcatcaactgtggcctgttccctaaatgagagctattatattttgtattacacttgacttgcttatttgtttataatctttcttctctacccaaattaagctccacaggaaggaaccaagtctacttcattcatcaccctgtaatccaagtctgaaatactcccaatctacggatactcaatagatatctgttgagttaatcaatgaacatgaccacttggtagcttcctcaagtttacctatatttaattctcagccatgctttgtcccatctttgctcatattggtgtttatttataatgtaattactcattctttccacacatttttgaaagagatttttgttttgtttttatggagtaagattttaaattgccacttgaacttaccacaccactagcctcacaatgggagcccttaagtcaggaaagacattctccaagtaccatttgaaacttttcacttcagtttctttcgcagctccctttgctgggtgaggttgccaacatctagcccttgtcgatgaggtggtctccgtggccatagaacagctccttatactcatccagccagacctcgcaacccgcaccaagttccgctccactgtcttcatccggtctttggggaaggaatatggttgtcatttctgaatatatggcccactcgggagcagggaatgatctcaatttcaccacccacatccacacctggaagaatttgatgataagcatcaattatcaaatgattatccacaatcatcggcacttaacaatgacaagaaaccaccttgtttccccctacctgaagtaatactaacttcaaaaacacttttgcaatagaaaatcaaactcaacaggcttatttaattttgtgattgctgtggatcattttaggattagtaaaatgtaattttttctttcctaactttcaattaagttttttttaatttgtaaataaatcttcacagaatcccattttgtaaaacatgagtcttgttttgattgaatcagggaaagaagtatagatgtccatttgttcacgttcctctacctcatttttgggaagaaccaaaaggcttgtggaacacaactcaaaaccatccttcatgacagcagctccaaaattacacccttttacatacatacagaacacccacccaataggaaagaattactttttggacactctctactactgctgttgccaaggctttctcagaagttaatcatgattgtataatagattgtataaagtgcccaaaggagctgtactataaggcacacctgcctgttggtgacctgctttagaggtattttaatgtacttctgtcatttgtgttctctaaatgatccattacagattgagtctattccttccaacattctagacagatgttccaggagattattttgtagcacgtatgactcccacagcatttactctgagtggcagaaagtcatttccccatatttataagcagaaatggtgttgtgaaatattagggaatgctaataaattttatacagcaattgattcttccaaattcaatctgagatatgaaaaaattaatccagagaccctaaatttctgtgaaatttcctctcagtggcagtcacatacctgattatggtagtaaaatcaaccatttaaaattgattaactcattatcgtaaagaaaagttgggaaacacctggtaatccttgaatgagagctccatattttccccaccccaaacatcaaggccagggtcgtatgttcaagttcaaaaaagtaacttttgtcaatagaaaacaatccaccagccatgacagggcactacaaaaagaaaagtttgttttttaaacttgcatctcatgaaagctcgacttttagagtgttcctctgtacatctgtacgggaggtaggaggcttttcagaatagctacctgatgcaggaagccctgggatggagtcacaaatagggcttaagtgatgcgatccctggatcatggtgcagagctagattaggttcagcaaagatgcatcctggaactagtattatttgtcctttatctgtgacacaaactgtccaggaatgttatttttaacacttattcagggctaagggagtacaggcactattgtaagtattatatatatattccagcccagacttcacaaaaaatcttgttgtgcaattattaagaatctgcaacactggatgtgagggcgatctggctgcaacatctgcagcccattgattgccagggttgattcggctgatctagctggctaggcggctgtctcctcctccctcaccgctccatgtgcgtccctcccgaaagctgcgcgctctgtggaagaggacaccatccctgatagaggagggccggtcttccggtcttctggtcttccggtcttccggtctccgtcaagggtatatgagtagctgcgctctctactagaacctccaagcaagcgctcagaattggcaacacggagaaggtaagaaactttcccaaggacagtagacaccttgggtttgtctgggcagtctgaggggacgctgtgccactcactccactgtactgcctctcagccgttctggaaggaaggccgtgagtgtgagttgtccaggttctgggtattttgaacaaagagttaacaaaacacactaacaaaggaacgaaacacatgaacgaagcggcacaagcagggattcttaaagcgggaaagcgctccacagggtgggagtgggccggagcaaacggttcaagggccggttaccaagttttctgggtttcaagtactcctttcgaggtccctaccagctgcccctttctgaatggaggatttggttggctaatgaaaggctgcggtgaattggcgccctgtgcagtgaagggaaggtccctgcttggccagtccaaggcagagactctccctttccttctgagagtggtggaaggggagggctgtagggagagtagccgttgatcctttgttactcgggtgtgggaaatggggttttccttctggtttagctttaggaagtgggtgttaatcggccttagatccctgcccctagacccaggtgttttccttttgatccaggtttgggaagtcagcaggaatggccttagattccctgcccccagaccttggtgtttttccttgattcagctttaggaagtggcatgaattggccttaagcttcttgcctccagaccctattctcctgcctcacaaccaccacaaactttactgacagcgtgttatatggcaagcacctttcaaagcactttatatgtttctgattcagttcttaaaacaatcgaagtagcagctacttttatgagtctttatgtaaaataaaaaaacagaggctcaagatgataagtaaccttttcaagctcataccacttctcagggtacagttgagattcaaactgtctccagaaccttcactaataatattgatcatggaggtagaaactacattttagtcagcagttagccaagactggaatcacttcctatggtggtcacactcagccagctaaagtagtttctgtggagagcctgctttgtgcttagggtatacagtatctcaagggggagataattcctgtcccacacctctctcccctccgccaccatttatgtcattttctttctgctctccaattttcctactagactatccagaacgcattctcgtcctacattatgttgaatatagtctgaactcaaccactacattggccctcaacatgagagtatgaaagagcagaggttctttaggtgtaggttcagaataagagtgttaaatccaggtaattcgggtttgagtctcaaattcttctttgattagctgcgtattcctgggaaaattacttaatcttttaagtctaaatttccccatctctttaaggtgaattcttccacctccctcctagagtaggaagagagttaggtgcctggcacagagtgctcaataaatggtagaaccttcacttcttgcttggtggaataattctgaaggcatcacacctggcaaggaaggcgggtatgactgatgaggggtaagtttggggaaaacacgcttcggtgcacggtctgggcttggctttctgttgggctggcttacttgtgtctgtttaagtggtcactacaacagggaaagtttaagcccccgcagctcttcctgtggctggcttaatgcttgtgctgcaggcttatattctgaagaagtataggaagcctccacttcagcttcaagtctaagctgtgttcttcaatgcagtttcttggaataaaagcccaaacttgaattcatatccagcttctgaatcaatttttaaatttattcatgaatttggcacttttctcatggagggggtaggattaggctgtaaaagaaaatcctaaccttgctatcattagaatgatatttctattaccattatttacttttaatttgcacttatgttactttaatattacatgtgtttgtatagtatgtatgcagcacattttgctagtttgtgttcttaggttgcaaatcctaggggacaggatagcattagtgaatttttctgtgttcaggctgagtagggtacaaatgaccagtgaagaatgagttttgggaacgaatttctcaagaacatgtgtttgctttggtaatctattggctagaactgtgattcttaatgttctatagaataaaagatacagctgttttgtagaattttttaatgcttttacaaaaagatacatgactgcttctagtcttaaatttcccacacttaccttattgtatcagtttctttaattctgttttttgaatgacatctggaggaattgttctccaaccaaagttcatgggccacacaaagatgcctcttgaaagttatccactgtcatgtaactaatccaggaaatgaaaaacaaagtgttatctggattatatacatctttatatactttatcgatttggcttcacgatgtaatcaaatgaatgaacaagtgcttttgatgagtttagatcaccaccttttaataatagttcaagaatgtttaaagtacaatttgcattagtaactgattggcttatttgtgcttaacttatacttttataaaacaatatgctagccagttttgaagaaaaaaaatacaagagcaacttaaaagcacatatcgcttcccacagaaataagaactaaatttgaggtaaataaatatttggggttcagctaatataaaggggaaaaactaggtcatgagtattaggatttattggtatttagagttaagaattgtagtgaccagatagattattgcatcagcagactctgatcccaagatatcgaccatgttttccatttatttaagtagataaactgtatatgtcttggattttgaaaaaacacacatttaggcatatactcagcactttctgctgcttgtgattaaagatgtgcttgaaagtatctgtggaatgtgtaaatattacctcatatccttatcattgatgacttcgattactggacagccactttctttctacttaaataaactctttccagaagaggttccaaccaaccaacgttaattccacatgagaatctaaaaatgtcaacacatcacctagagggccaaacacacacaaaaacttagaaaatacgatatattgaatgtgtgtacttcatgttcaaaggtattgatgattctccagaaatgtggctataaatgcagtgaccttttttttttttctgaattcgtggtcacataatttcatttcatactgaaatgagagaaactttgctcctaggagtcctgtggtgcaacataatttatgtttggaaaaaattgataagccatttagaatgggcaaaagaatctgaaagaatacttggtattaaatgtagttgctgaagtcccctctgagagagtgtgcccattaacctgggggtgcaggatttgggactttgtttttaagaagcagacagactgagatgacaagttggccttaggaatgatgaagaggaaaaattacttcacacaatagggatgaaagaaattaagtggacaaaccagcgaggctaggaggtaatgaaaagagttataggagacaggagtgggaatgggaggttactgattaatgggtatggagttttatttttgcaaggtaaaaagagttgggagattgcacaccaatgtgaacgtatgtaacactatgggcctgcacacttaaaaatggtaagatggtacatttttatattctatgtattttatacaatttttaaaaagacttagaggggaaaaaaaaaaaggaaaagaaacttggaggccagaaatagtattaagaactcttttattccctgttagttgtgtgaagtaacactctctctctctctctccattgaaacctcagtagatctacattgctccagaggatcttatacaagtgaagtgtgtgtgtgtgtgtgtgtgtgttgtgtgtgtgggtgatgtgatgtgtgtgtgagagagtgtaacaacccaggaaataagctctggtccacatcctatgtgtgatctttcaggcccaaccacaggtaatacaaaggctctactactggggctcatgggggaaacctgctttctcactcagacttggtgcccagccagtgtttgaagtctctaaagggagttgcggtccaggtctcagaccctccactcggctgcagcactgctcttctgcctgtctgcattcctaactcaggtgcctccattcaggccaaaacctctgcaggaccactttattggagatggaatgggtcttgaagacactttgctcgactctgactcctattcagtgctttcccactcctagcctttcgctttcttactctggatcccagggccactaacagaaggagccttttgtgctgggttccttgggcaggcagtgagatgcccctcttgttgctctgttctgctctgatccatcactcagcaacattccagggggaaaaatggaacatagaggagccagtgccttctcctgttcagcctcctgttgatactgttgcagtaagggattaggcttgactactgctttcattttggtttatcattttaattgactactttgatacctggggctcagctcagctcttgacatacctgtaagagcaaccatcatctaagtgcttgttctatccagtctctgttctaaacattcttcatgcatgttttatgtagtctttacaacaaccctgagtatagaactaatttttattcccacttaagagacaaggaaactaaagaacaaagacccaggtaacttttctatggttgcgcagctaacaaacagcaatgtgatattagaaaataagtgctcattccatagattacattctttaaaaaatgctagaaggaggcagagctttgagtatagaaggcttagagaacaagatgaggatagttatctagatgacagatcattatcactgaatctgcaaactacctctcaattaatagaatttagcatcgtattaattacttggttaacaaggcatttttgcatgagggcaaggtattggtgtggagtgttcttgaggattctgtttagtaaaccatctgtgagaagcaaacccgctccatgtagtcttctgttcttggagatagcagttcatctcctgaccaggctggaagggtcctattttcagggcattaatgcttgtttgacaagacagggtattgtcccctgcatggtctgaatgtacgtgtcaatccaaaattcatattttaaacctaactctaagatgacagtattaggaggtggggcctttgtgataagatcatgaggtggagtcttcttaagtaggattagtgctcatatgaaagaggctggagagtgtttgtgagtccttttgcccttccaccatgtaaggtcacagtaacaaggtgccgcctttgaagcagacgtgagctgtcactagacaccgaatctgctagtgccttgatcttggacttcccagcctccaaactgtgatcaataaatatatgctatttataaatgatctagtctaaggcattttgttaagcagcccaaaaggactaagccatctcctaagggtgtcctttggggatggcacctttggacagctgtctcccctgtcatgggaagactcacagagtcatgtaggtgtatgaagcgtggctgctaaagtccacttggctagtggtatacaatgtagtagaaaaagattcctggccggggtggtggctcacgcctataatctcagcactttgggaggctgaggtggtaggatcatgagctgagagatcaaggccatcctggccaacatggtgaaaccccatctctactaaaaatacaaactcaaccgggcgtgtgtgtgtgcctgtagccccagctattcaggaggcctaggcagggaatcacttgaacccaggaggcggaggttgcagtgagcagagatcacggcactgcactcagcctggtgacacagcaagactgtgtctcaaaaaaaaaaaataataatacgatttctactgtggtccattcagacctagagtttaaagagcattctttactacgccacctgtccctatcccatagcagccttatgaagtcaaaggggcctggattatctttctcagtccccagtggcgcaggatgggtccccaaacctgcattcacttcccacctggcccagatccctatgaaaatctcattcatttgctgccaggacctaagggaagcagcatctgctcaaaacatagtctggattttatattgttttattttggggaagaggagaatcctcctgtgcatgcatgctattgcttactttcagacactttgttttaaaataagatcctaggactatgttaggtgagaaaacaggagctctctgcgtagctgactcttggtgggatttctgattggcgtggttattgtctatgacattgtacgcactgttcctgattcagagaggggagaggcacagtgaaataagcatagcttaaagttacatacaacagccttcaatccgagctctgcttttcctagccaggttagatagttacttaacttttttgagctttgccctatgaagatatttctaagagctacctgatatcaaattctttaaaaattgctagtataatttactgtcagaataatcaacccaatcacttaaatttttaaatgacacataataattgtatatatttatggggtacatagtgatatttgataataaagtgtgtagtgatcaaatcagggtaattagcatatcaatcacctcaaacatttatatttatctgtattgggaacattcaaaatcctctctgatagctacttgaaaatatataataactattgttaactatagtgaccctatagtgctacagagcactagatttggaaagggtagagagaggggatatagggagaggcgggttaaagaatataaaattttagtccaaccttgatgctacctgttaggattttctgttttctaaggataggtcccaataatactggattgtttcagatgggtttcatttgtaacttaaaaatctggggggggggtgggtggtaacataaaacgttcaatgtgccaaaaattttgggtccttgttgagcatggacccccacttatatccagttaccagcctggaatattgctgctgtaccagttaatgctagatggttatgtctaggattcttgagggatgttggcttggcgtgccgtttaattttacataatgcctcctaagtaatgctaggaaaaaatttttacctgcagcagatacaagttataaaagtttgcagacagatgtctatgttgctttttaggagaccttggagtttgctaggagttagatgtcacttgtccagttactaaagttagccaagtgattatttagaatgctcatagaaatgtcaggaattttgccaaatccatgtcatgaaggaaatgaaaacctaatatttactttgactctctactgcctgactgtactcctcttggcagggcagtaaatcacttggtctgttccatactaggaagggatatggggatctacttcttccctgatatctcatttactctatctttttaattctgttggcttcataagtgagcaattcttagagatccattgccccggcctacctgtcaattttaaaatcctactgggcctctcaacctcctcattcacagcaagcaactgattggacctaatctttttgcctgattagattcagatgaagaactaacatgccctggaaactgaatgcatagtagacattgctatggtaaggccgatcactgcttggccccttattattttgtagatgattgcagactttcaagagcctcttgcagaacttcagagagcctcataataccctgggaccaaaataggccatcgacttctatttctgcatgtctttggatctctggatctcacccttgcctgttacttccctttctttgagtcctaaagggcaaattttagggaacagtagcatcaaggcctgtcagattcggactcagattcttatctttaaactccttgtttggcgaggcatcctagagaaaattttttctgctgtctttgctgatctctaatttacaggaactcttcaggaggcccttagtctcttcttatctctactcttgagagctgtggcacacccaggggagtttgagaggacccaccacgctgccatctctgctcaatgccagtctctgaattacattctctgctaaaactgatcctgcttgccttgaattccccacaggggacaggtgtacttcccagcattggatgtatccttgggaaggatacatcgagacaaacctttcttctttccaaactctcaggcacccaagctccactatgctgctccaagtgtaggccacagaccctgctgtctacagggtgatagcaatagaaatgagaacaaatattttgaaactttatagcaatttgtcaaatttataaatttattatttattactgtttttatatacatgtagatacatatgcatatatatgtatatatgtgtttgtgtagtgtatatatatatatatatacattttttttttttgagacagaattttgctcttgttgccaggctggagtgcagtggtgtgatcttggctcactgcaacctccgcctcccgggttcaaagattctctgcctcagcctcctgagtagctgggattacaggcacctgccaccactcccactaatttttttgtatttttagtagagacagggttttgccatgttgggcaggctggtctcaactcctgacttcaggtgatctgcctgccttggcctcccaaagtgttgggattacaggatgagccaccacccagccatatatattttgtatgtaataaaaatgggtttgtgttttataatctactttcctttttgggtaattaatattgattataatttacaaaggggtaggtcaataaaaattggaaattaggggaaaaaaattccttttcagatagtttgggaagcatcactctctaggcagtggcaagcaattaagatacacctagctggggtttttcaaactgagagctgtgattcccttagtgaatcaatcactaaatcaatttattgagattggctaggatctaaaactaaataacatagaaaagaaggtattagaatctattccacatgttatttgataaaatgtcactgtagttatatgtgtgattacacatgtactgagttgtgatgaaacatttatttctaccaagccattgtcaaaatggtttgacagttactgagctaatattctcaaggctgttaatgatctgaatttacattcagatttgctaaattcaaataaattacattatggatgttaactgaagcacttgagcaagcagttgcaactgctttaatcaagctcataacaccccttctaagaactccacccatgttgtctaatagtttggactgtgttggaggccgttactagcatactcttgctccgtgcaggcagagagaaaatttttaaataagtaacccatatttggttctgtatttactttctgtgcatgaatatctcattttcatctcaaatttatatggacaaaatcaaaaccaactgcaattccaaacctgctcctccagttttgagcctaccacccaccaagttgttcaataccagtcctagggtttgtttctgattggtgtcattcttactctcttcacatcttatcgacggcaagtcctatacgttccatgtgcacaatctatgatgaagctgaccatttctccctttaccctggcacctccctggtacttggacaactatagtagcctcctaactggcctcccacttcctttttcatcttcctaatatccattctctacacagtggccagaatgagctttgaaatgtacatcagacagtttcgttcctatttaatattcttcattggcttcaccttatactagaataatgcctacaatctttaagtgatgcacaaaactttagaaaaatttgcttttttcttctccccaaatgaatcttttatgactctccccatggtcagcacccatgagtcaaaatgacttatttctttaccttgaatatgccaagctcatttcttcattaggacatttgtacttctgttccatttgcttgggaatattcttcacccagacctcagctcaaaaattacctatttaactagttcttgagtatcctatttttacatcatttatagataattactttccaaaggaaataagcatggaatgccattaaatttttctgaatgcagtctctcatcaagaatcttaactgcactgcaatgccaattttggtgtgatgtatttgttgcttacttaaaatttcctctacaagagaagacatttgttagcaaaccaatgaaatgagaagagcttcaaatatggggtccagtatgagaaaattaaactcaggtaagcagaaaacttcccatcagaacatgcttgaatttaactggtggagacctgtaaaagcagggcttacagggccagagtggtggctaaatgtctagagcctcaaggtgtagttgataagaggacggactctggggtcagggcattcaggtgccagcttggatttaccactggctagatgggggagcttgcataaggcacagcctcactgtgcctcatattctcatatgtagaatgaggatgtgattgtactcatctcatagagttattgtgaggttcaatcagttaatacacaaagtattcagaatggcacctagcatataaatcagctagtatacagggcacagatccttccatagaaatgtatgaacatgaacccaaatgtttgatgttgttttagaatactcataaaatagattcacttctcattcactcaccaacacctgcacactaaaaggggagaggaaaagaaggcatatggcctttggggaaggcagaaagaaccataggaaaatagacatgggtcagagaagagaggggtgaggattatagaattaaaacattacgaaatttgaaatattgatgggtcaggtcaaaagggcacaggcttgaagaagctcctagtggtcaatttgggacaatttgaacaccaacaagaataatggtgatataatacacatttaatttctagccataaatccatatcgatgaggggatgagagggaggggagagggagattgaggggaagggaggaagagttagaaagcaggagagggagagatagagattttctccttacacatgaagccagctaaataaaaaagaatgaattatagaaaagcaaattttcagtcctcagtgtaatattgatttaagcaaggatgatcaatggatactaaaaaccattgggtaaaacattgtaagaaaacagaatattttcatggatcaatgtgtcattccacaaattacttcttaatcccaaataaaggtttagctgtcaacatcttaactaacaaagttagtatcaacaatactggtgatatatgttatattatatgcctcttgatgagatgtataccatttctatcacctatgtagtagattctatataatattttcactccaaaaacatttatcctgcaggtaacaagaggaaatcaaaatttcagaacatggtcactggtaccaaacaaatggcatgaacttaaaatacacacaccacacacacacacacacacacacacacacacacactggtatttaaacaaagtgtgtgagagttgacttttcagactaagaagaccaaagtatcaaatgcagagtatgaaacttaattattcccgaatttaaaaaaacattttgaggcctgtaatcccagcactttgggaggccgagggggcggatcacgagttcaggagtcgagaccatcctggctaacacagtgaaaccccgtcttattaaaaatacaaaaaattagccgggcatggtggtgggtgcctgtaatcccagctactgggaggctgaggcaggagaacggtgtgaacgagggaggcggaggttgtggtgagctgagtggcaccagtgcactccagcctgggtgacagagcgagactctgtctcaaaaaaacaaaacaaaaacaaaaacattttgggaacaatgagaaaacttgaaaagagcatatagtaggtatatatttagttatgaaagctgtgcttatttaagagaatgcttctgttcttcagagctgccactgaagtacttaggggtgcagtatgatgatgtctgtaacttctttttcaaaggttcagaaaaaagtatatacaataggtgtctatgtgtgtttatgataaagcacatattataaaaatgtttaaaattgatggaactaagtgatgcatatataggcatcattgtgctggtctttcaatttgctgtatgtttgagaaacattttaaattaaaataaaaatgtaacaaacaaaaaaagagtaacttcttacctgttgcattctgtgctcctgccagcctggcccttattaagccattctctctttgaggcgaagaatccgaacttttggaaactgggacatgtatttatccaaatatcttttagatagtctacatcagagtaaagataaaccaggaaatacttgaattaagtaatccggatagtatcagaagtgctccccaaagtcaaatgccaaaaactatgacattaccatatcactgaattttattccttgggtcataattttattttctgatgtcattttcttggaagattctatctggtttcagtattcaaagctgtctgatttttcaaaccccaaatgtttgtttcagtgttgtaaggtgatgtagtggagggcacacctttctgagtatttgtcaaggtggggcagatttgccttaaaatatatgtagctcaggcttctgcacaattctgcctctactctcaccccacctcttgcaaaagccccttccatgacccaaggaagaggctaaacaatgtgtgcaataagaccctttcattctctactctgacatccccttccattacaccttttctctcttatagatggccatggagggatccagctaaaggaacagttttccgggggctttatgagctatgttatgtgacttacagtcatttctgtgtgtaatcaagctattgacagctatcctaggttgaatggcttccagaaaactttctaagaaagtttttcttagacaggaccctgaaaactgaaaagcttcaggtcccacagaatctggacctgcccctcataaagggactcctatctacttataattgggtactattcctgtttatgcttccaaggccacattttatgtttttcagccagttttctctatcatcccacagcttcttgagctcagtgtgattatggcagaaactctgaagcaaagaaacttcccatgttgctgtggtcacagctcaagggtaagctgttccattagcattccaagtctttgctattttctaaacttttctgaaaaatgggttccatttgggaatttgtatgtggctgtcagaccacctacatacacaggttatttgacaacccaaagagtgagattctcactgtaataagcaaaaatgaacataaaggctatggtggattctggttttgaactttgtggaatcacctcatctctcttgtcctattggcaatttgtcttcttaacacttaactgaaccatcatatgccttgctctcaaggaagaagccataagatcttaatttctttgccttccatgagtctaactgtaactctagttattaccagtaggcaaggcctcccgttaattgtgattcattaaaagggatttgtgcaattgtagaggacatctaaactccactacttctaagtgccctctccaaggagccatagttagatcattccaacatggtagcagagttacaactgagacaataactgaacagagctccagatgacttttaacgtccatagatgcttagacttatgtctctaggctccacgtaaaacaaagcatttgtacgatgtttatgcttcatcaaattatcctatattttgccatccaaactgctactaaactttgcttctgccaaactttgaaatttcaagagaagcctgagtggttttcttacctttggtgctgaagtcatctaccagcagaatctccttgagaggtgtggaggagagcgattgatgacactgtgaacagatctcaggagagtggaccacattcatccacaaagcacatgatgacactggtggttgggaggttattgtgaactagctgcttgcacatctgggccagaatataagcagagcacaagagatgtgctaaggagatccacaagtagttttaaaagtcacagagtgcgatggtgtgcatatacacacacacttaatctgtcatgatctgtctggtctatctatcatctatttatatataccaatgatgattttattatttatatgtgcctttttttggggaggggtacatgcaaaataaaaaagcagaagaattacccgtaccgtggttgttataaaaggactagaaatgcaagacatgagaatgtcccatgcagacatccactgcagtggaaaggacagggtttacaggtagttagactctatttcaaatctcatggcaatatttctcaggtctttaaccattaatgccttctttaacttctctgtgcctcagtttctcatctgcagaatgaggtaataaatggttcttattcaatagagttttgtagcctagtgaaatgtacatacaaagcctagcagggttcctggcacaggaatttatgaaatggtagttatgctatcattactagattatatgctagaagatagcattctgacttatttaatgttcccaatggtttatgattgcctttccaactggctgtctgccaactgccatgggatttattctttttcccattctgcttgtgtatgtacttatggcataatatatatgtgccaaataattaaacttttttagcttccgtatccggggcttccttgctgatactctgctacagaatagccacagtgaaaaaccattttgctggcataggaatgcaatccaggctacagtgggagttagtattcagtgggttgcaactggcctgggttttttcccatgccctgcagaatacactgcctcactgcggcattctttcaccccctgcctgtgccactcttcataagcagtgcccagtggaacctcaaaaatgtatttgccatcttactaacacagctactgtcagtaatgtgataattaatgatgtcataaatattataagcattctatattatttcaatgtcgacctcaaattaccagcatcttttccctttttattggtgaataatcaaaatcatggaaagactagtccatgattctgcagtagtaaatggcagagctgggactcgaacactgatccagtctggctccaaaagtaaccatgaggaagccttagatccacaagaatagaagcagctggcagtagatgcgacattttgtgaagctggcacttctgccaaataacatggttatactttacttattccataaataagaaatagtaagagcaaaaacgatagtaaagcaaatcacatttgcatgacactctagtgttgccaagtgctattctgtacataattgaattcagtcttcataacaactgcttgagatacatattatatacacttcttcaaatcttgggaagttaaatgacttacccacatcatccacctagatagatatataaggaaatatgaacaaataatgtttttactttactgctggttttttttgtagatgggctttggaaatagatatgtgctcaaatatcagtttttctaattactgatttggaaagctttactacttctttgaacctcaatttgccaactacaaagctgaaattaaacatgtactataagattacatataaacattatgtaaaactcatctaatatatatctgacacataggggtacttaagaaatggtagacaaatccagctgtgcttcataatttcaatggtttcctagtggttgtttatcataataattgacaaagccttagaaaaacataaatatccaatcctcagcccagaaaatcaatttacaaggtttgctgagggcccaagaatccatgtcttaaaatacaacaaataaaagaaaacacaaagaaaccaacccaccaacaaacaaaagaatgactcacaatcattgattggtgagtttaagaacttgagctcaagataaagttaatttattcttattattgaggctaatattaaaaaaaataaattgacagctgataggagcatgtcctaaatgttcagtgacagagaattaaaataacacattttgattcactatcttcatgtagtgatcaggtattaatgctaacttaaaatatcagactgtctaaactaatattagtctacactaaggatccagcattagcacttctgaataatatgagaagatattcctctcttcacttaagagctttatcgtttactttggccaccataacaaattactgaaaattctgcttaacagttccttcctgaagtatctattttctctcacatttgtactctgaacagaaagaagatatcagtatgcaccttaacattttgcttggtactctcctcagctaaatatccgatttcatcattggcaagttctgtaattttcacatgactataggacacagttaagccaagctcactgccactatgtaacacgatcattttcttccatttctcaatcatgtgctctatatttccttctaagcctgcaccagagtacttacaatgctcatatttttgccaacattctgctcaagatagcatacatattttcaagatgattgatagaagctttctttctttctttctttttttctgaaatagagtcttgctcgtcacccaggcgggaatgccatggcgcaatttgataggagctttctctactgtgccgctacttccttctgagccctcaccaacagcatccttgatattcatattgctaccaacagtgattcagggcattctaggctttttctatgatgcttcacagaattcttccggcctctacctatagcgaattccttggtgtattaggccatttttgtgttgctacaaagaaatccacctggcgggcacctgtaatcccagcactctgggaggccggggtgggtggatcacttgaggtcagggttcaagaccagcctggccaacatggtgaaatccagtctgtactgaaaatacaaaaattgctgggcatcgttgcgggtgcctgtaatcccagctacttgggaggctgaggcagggagatcgcttgaaccctggaggtggaggttgtagtgtgcagtgagctgagatcgcactgctgtctccagcctgggtgacagagtgagacttcatctaaaagaaagaaagaaagaaagaaatactgagactagctaatttgtaaagaaaagaggtttaattggctcacggttctgcaggctgacaggaagcatggctctgccatctgctcagctcttggtgaggcctcagggagcttttaccatggcagaagacgaagtgggagcaggcatgttacatgacagagcaagcaagagacagtaggtgaggtctctgacacttttaaccaaccaaatcttatatgaactgagggagaacacaatatcaccaaggggatggcactaagtcatccattatagatctgcctccgtgatccagtactcccaccaagtctcacctccaacattggaggtcacatttcaacatgagatttgaagggacaaacatccaaaccatatcacttggctattccttggatgatacttctgtatttttgggacttgttatagcagcacctcactccttgataccaaaatttatattagtttcttctgactccatgacaaattaccacaaacttggtaacatattctgtcacatttctggggtccagaatctaaaaccaagatgtcagtaggacctcagtccctccatatgttgtaggggacattctgtccttgcctctttcagcttctgctggcagtctttgacttgttgaatcactcaaatctctcctctgtcttcacatcactttctcctctgtgtctctctgggtgaaacctctgcctggctccttttataaggatacatgtgatttagggcatttggggcttatctgggtaattcagggtaatgtctcctctcaagatccttcatcacatctcttgcttcagaaggtaatattcactgttttccaggtgaggtaataatcacaggttctgagaattaggaagtaaatatatttttggagaccatgtcttttagcctgacacaagggcttaatgagttaaggcaagaaataggctgggtaggtagctcatgcctgtaatgccagtgctttgggaggccaaggtgggtggatcatctgagtcaggagttcgagaccagcctgacgaacatggagaaaccccatctctactaaaaaataaaaaaattgaggtctgttccaagatggccaaataggaacagctccgatctgcagctcccgcgtgattgacacagaagacgggttatttctgcatttccaactgaggtacctggttcattcattgagagtggttggacagtgggtgcagcccacagagggtgagccaaagcaggttgggcatcacctcacccaggaagcgcaaaaggtctggggatttccctttcttagccaagggagctgtgacagattgcacctgaaaaaatgggacacttctgcccaaatactgtgcttttccacagtctcagcaactggcagacccagagattctttcctgtgcctggcttggcaggtccccacccatggaaccttgctcactgctagcacagcagtctgagatcaaactgggaggcggcgcctggctcggggagggacgtccaccattgctgaggcttgagtaggtaaacaaagcagccaaactgggtggagcccaccgcagctcagcaaggcctactgcctctgtagactccaccttgtgagtagggcatagctgaacaaaaggcagcagacaacttctgcagatttaaatgtcctgtctgaccgctctgaaaagagcagtggttctcccagcacggcgtttgagctctgagaaggacagactgcctcctcaagtgggtccctgacccctgtgtagcctaactgggagacacccccagtaggggctgacagacacctcatataggcgggtgcccctctgggacgaagcttcagcagaggaaggatcaggcagcaatatttgctgttctgcagcctccactggtgatacccagtaaacagggtctggagtggacctccagcaaactccaacagatctgcagctgagggtccgactgttagaaggaaaactaacaaacagaaaggaatagcatcaacatcaacaaaaaggaatctacatcaaaaccccatctgtaggtcaccagcatcaaagaccaaaggtagataaaacacaaagatggggagaaaccagggcagaaaagctgaaaatcctaaaaaccagagcacctctctcctccaaaggattgcagctcctagccagcgatggaacaaagctggatggagaatgatttgacaaattgatagaagtaggcttcagaaggtcggtaataacaaacttctctgagctaaggagcatgtttaaacccatcaaaaggaagctaaaaaccttgaaaaaacactagacgatggctaactagaataaacagtgtagagaagacctgaaatggcctgatggagctgaaaacatggcaagagaacttcgtgatgcatgcacaagcttcaatagccgatttaatcaagtggagaaagggtatcagtgattgaagatcaaattaatgaaatggggtgagaagacaagtttagggaaaaagaggaaaaagaaatgaacaaagcctccaagaaatatgggactatgtgaaaagccaaatctatgtttgattagtgtacctgaaagtgatggggagaatggaaccaagttggaaacacacttcaggatattatccaggagaatgtccccaacctagccaacattcaaattcagaaatacagagaacaccacaaagatactccatgagaagagcaactccaagacacataatttcagattcaccaaagttgaaatgaagggaaaaatgttaaggacagccagatagaaaggtggcttacccacaaagggaagccgatcagactaatggtggatctctcggcagaaactctcaagccagacgagagtgagggccaaaattcaacattcttaaagaaaagaactttcaaccagaatttcatatccagccaaactaagcttcatgagtgaaggaaaaataaaatcctttatgacaagcaaatgctgagagattttgtcaccaccaggcctgccttacaagagctcctgaagaagcactaaacatggaaagaaacaactggtaccagccactgcaaaaacagaccaaatttaaagaccatcgatgctatgaagaaactgcatcaattaatgggcaaactaaccagctaaatcataatgaaaggatcaaattcaaacataacaatatcaatcttaaatgtaaatgggctaatgccctaattaaaagacacagtctggcaaattggataaacagtcaagacgcatcagttgctgtattcaggagacccatctcatgtgcagagacacacataggctcaaaataaagggtggaggaggatctaccaggcaaatggaaagcaaaaaaagaacaggggttgcaatcttagctctgataaaacagacttcaaaccaacaaagatcaaaagagacaaagaaggccattacaaatggtaaagggatcagttgaacaagaagagctaactatcctaaatatatatgcacccatacaggagcacccagattcataaagcaaatccttagagatctacaaagagacttagactccacacaataataatgggagactttaatgccccactgtcaatattagacagatcaatgaacagaaggttaacagggatatccaggacttgaactcagctctgcaccaagcagacctaaagacatctacagaactctccaccccaaatcaacaatatatattcttcttagcaccacatgcacttattctaaaattgatcacataattggaagtaaagcattcctcagcaaatgtaaataacagaaatcacaacaaactgtctctcagaacacagtgcaatcaaattagaactcaggttaagaaatttactcaaaactgcacaactacatggagactgaacaacctgctcctgaataccactgagtaaataacgaaatgaaggcagaaataaagatgttctttgaaaccaacgagacaaagacacaacataccagaatctctgggacacatttaaagcagtgtgtagagggaaattatagcactaaatgcccacaaaagaaagcaggaaagatctaaaattgacaccctaacacacaaattaaaagaactagacaagcaagagcttacacattcaaaagctagcagaaggcagaaataactaagatcagagcagaactgaaggagatagagacacaaaaaacccttcaaaaatcagtgaatccaggagctagttttttgaaaagatcaacaaaattgatagaccgctaacagactaataagaaaagagagaagaatcaaatagatgcaataaaaaatgataaaggggattcatcactgatcccacagaaatacaaactaccatcagagaatactataaacacctctatcaaataaactagaaaatctagaagaaatggataaattcctggacacatataccctcccagactaaaccaggaagaagttaaatccctgaatagaccaataacaggctctgaaattgagcaataattaataacctaccagtcaaaaaaagtccaggaccagatggattcacagccgaatctaccagaggtacaaagagaagctggtaccattccttctgaaactattccaatcaataaaaaagcaggaatcctccctaactcattttatgaggccagcatcatcctgataccaaaactggcagaaacacaacaacaaaaaaagagaattttagaccaatatccctgatgaacatcatgtgaaaatcctcaataaaatactggcaaattgaatccagaggcacatcaaaaagctttccaccatgatcaagttggtttcatccctgggatgaaaggctagttcaacatacacaaacaataaatgtaatccgtcacataaacagaaccaatgacaaaaaccacatgattatctgatagatgcagaaaaggcctttgacaaaattcaacagcccttcatgctaaaaactctcaataactaggctttgatggaacatatctcaaaataataagagctatttatgacaaacccacacttaatatcatactgaatgggcaaaaactggaatcattccctttgaaaactggcacaagcaagttgcccctctcaccactcctattcaacatagtgttgaaatggccagggcaatctgcaagagaaagaaataaagggtattcaattaggaaaagaagaagtcaaattgtccctgttgcagatgacatgattgtatatttaaaaaactccattgtttcagcccaaaatctccttaactgaccagcaaattcagcaaagtctcaggatacaaaatcaatgtgcagaaatcacaagcttcctatacacgaatagcagacaaacagaaagccaaatcattagtgaactccgattcacattgccacaatgagaataaaatacctaggaatccaacttacaagggatgtggaggacctttcaaggagaaatacaaaccactgctcaatgaaataggacacaaacaaatcgaagaatatccatgctcatggataggaagaatcaatatagtgaaaatggccatactgcccatagtaattatagattcagtgccatccctatcaagctaccaatgactttcttcacagaattggaaaaactcctttaaagttcatatggaaccaaaaaaagagcctgcattgccaagacaatcccagcgaaaagaacaaagctggcggcatcacgctacctgacttcaaactatactacaaggcccagtaaccaaaacagcatggtactggtaccaaaacagatatatggacgaatggaacagacagaggcctcagaaataacaccacacatctacaaccatctgatcttcgacaaacctgacaaaacaagaaatggagaaaggaccctatttaataaatggtgctgggaaaactggctagcatatgtagaaagctgaaactggatcccttccttacactttatacaaaaattaattcaagtggattaaagacttaaacgttagacctaaaaccgtaaaaaccctagaagtaaatctaggaataccattcaggacataggcatgggcaaggacttaatgactaaaacaccaaaagcaatgcaacaaaagccaaaacagacaaatgggatctaattaaactaaagagcttctgcatggcaaagaaactaccatcagagtgaacaggcagcctacagaatgggagaaaatttttgcaattacccatctgacaaagggctaatatccagaatctacaaagaactcaaacaaatgtacaaaaaaaaaacaaacaaccccatcaaaaagtgggcaaagaatatcaacagacgcttctcaaagaagacatttatgcagccaacagacacatgaagaaatactcatcatcactggtcatcaagaaatgcaaatcaaaaccacaagagataccatctcacaccagttagaatggtgatcataaaaagtcaggaaacaacagatgctggagaggatgtggagaaataggaaggcttttacatgttggtgggactgtaaactagttcaaccattgtggaagacagtctggcgattcctcaggatctagaactagaaataccattcccatagaaataccagtgatcccattactgggtataacccaaaggattataaatcctgctactataaagacacatgtacacgtttgtttattgcgcactattaatgattgtaaagacttggaaccaacctaaatgtccatcaatgatagaatggttaagaaaacatggcacatatacaccatggaatactatgcagccctaaatgatgagttctgtcctttgtaggtacatggatgaagctgaaaaccatcattctcagcaaactatcacaagacagaaaaccaaacaccacatgttttcactcataggtgggaattgaacaatgagaacattggacacaaggtggggaacatcacacactggggccttttagggggtggggggctggagagggatagcattaggagaaatacctaatgtaaatgacgagttgatgggtgcagcaaaccacatggcacatgtatacctatgtatcaaacctgcacattgggcaggtttaaagtatattttaacatttattaaagtataataaaaaaaatacaaaaaattaccctggcatggtggcggtacttgtaatcccagctacctggaaggctgaggtaggagaattgcttgaaccccagaggggaggttgcggtgagctgagattgtgccattgcactccagcctgggcaacaagagcaaaatctgtctcaaaaaaaaaaaaaaaaaaaaaaaaaaaagcaagaaatatgctgttttcaataaaaaatttaaaatggcttccctatccctcaacaaaatgtaggtttattttgaatttaagaattgttagtcatgctgtttttttttccctaaatttgaagcttcttttaagtttgagaatttgcacattgaagtccacgaaagtgttaattggtgataccaaattatgaactatcaattgaaactctattttagaaaataaagataattagaaaaaaagaagaaagaatataaatgagggatttccaagaagtactaaaaaattggtctatttggttgcataattaccaacaatccaacaattagaggacaattttggaactggacaaactttagactctgaaatgtttttcaaaggcaaaaaagggaacatctccaaaataagattctaattctcagaatctcttgtgatgccattaaagaccagagtgatgagactaaagtttcccaacgagagaattggtggggctaggcacaatgaactgcaaagtaaaaggtaaatgaacaatgagacaccatctcataccagttgaatggcagttattaaaaagtaaaaaaacaacagatgctgtcaaggctgtggagaaaaggaatgcttatacacttccatactgtcggtaggaatgtagttcctaccaattagtttagcactgtagaaggcagtttggaggtatctcaaagaacttaacacagaactaccatttgagcagcaatccaattactaggtatatatccaaatgaaaataagtcattctaccaaaacaattagcactattcacaatagcaaagacatgtaatcaacctaggtgcccctcaatggtggattgataaagaaaatgtgatacatatatatcatggaatcctatgaagccataaaaaataacaaatcatttccttagcagcaacatgaatgcagctggaggacattatccttagcaaattaaacaggaccagaaaaccaaatatcacgtgttctcacttataggtgggagctaagcattggtactcatagacataaagatggcaatgatagacactggggactactagagagggtaaggaggaggggtaacagttgaaaaactaactgttgagtactatgctcagtacctgggtgacagatcatttgtgtcctaaacctcagcagcatgcaatataccctgtaacaaacctgtacatgacttcctgaatctaaaatgttgaaattatttaaaaaaggagtaaaaggtaaatgagggaaggatagtattttgtggacaattttgggagaaaacctagaaaagaaagaaataggagggagataggtgggataccaggaaaatttgtcatccctgttctcccttcctctgttgagtagcatggacagaatcatatttatgagcatcagagtaggtacagatagagctgagagttgaaaaaaaatcagtaattgataggattatcaatgaagcaaggtctctttatattaacccacctacaatggcagttgatgcaattaacaagtctagtttcctttggccactctctattttttattttttgtcccatgagacactacaccctcctagttttcacccatcattcactggctttcaccttcagtttccttcttagctttcctttcctcttaagaaacacaagattctcagagcgggtctggggctttgttttcttctatgtgtgatatgattgtatgagcccatcatgctcaagttttaagtgtgataatatcttcatagtttatatacaggtcagatttcccatctgaatgcagacttaacttatatccaaacaatttctgaacatcttctctgcatgtctcacaggcactcactcataatgtgtctgaaacagaaaccttgacttcaccccactcaacccaaccagccctctgcatttccctcataatggcatcgccacccaccttgctgcagaaatatggattctatctagacttcaccctcttcctgaccataaatacaatcaatccatcaacttctattctggtgttgccaacagatatctcagctataacatctttatacctccacagttgcctcccctactcttgagcatccactctctttctccaggattattgctggagtctcctaaagggacactcttccacagtttgtcagatcaacaccactcttctgtttaaaatcctcagtcaatttctagggacaaagtgaaaaggaaaaaaatccaaattctttagtgtataggacccctgctcaacttccaactgcctgtcattccactctcccctcacacactccaccttggccttctttcagtccctgaagaacactccagcttttgttatttgcttaacttctagcatttttgctacccttccatgtcttcgcagctggctgcttctattcctttagttcctatcttaaatattcccttctagagatgccgtctctgacaacgctttcacattttttttttttttgagacagagtctggctggagtggagtggcgtgatcactgctcactgcaggctccgcctcccgggttcacgccatctcctacttcagcctcctgagtagctgggactacaggcacctgccaccacgcctggctatttttgtgtatttttagtagagacggggtttcaccatattagccaggatggtctcgattcctgaccttgtgatccacccgcctcagcctcccaaagtgctgggtttacaggcgtgagcactgcacctggcctaccctctcaaaattaactattcttttattattctctattattgttttctgtcacagcattcatctatcaatcttatttccttatcttctgcatccaaaatttttgagggtaggacaaatctgccttgcttactacagtaccacaagcttccagcacagttaccaataaatatttgataaatatgtattgaatgcatgaatgaatggatggagatgagatggacttaaagcttaaatagtggaagaaatatttccctttgagatagaaagtacaaaaaggtgtaacgtatacaaatatatttatgcacatgggatgagaagttgaaaatattcatagctctactggaggaagggttatctgttaatgtaataggctaggggcttgaggagaatggagaaattttggacagatactatgggcaatgggagagaatgctggccagctagctaggatttcaaggggcagtgagcactttcctgaaactggagatgccaaaattttatgaaatttcaatattgatttgctccaccagtgcctgccagcctgcgtgtaagaagagataaagcaaattgctgattaatatgagtctaagggatatcagagcacatgaggtagaaagagaatgggtagtgagtttgaggggactggtgtaaggtggttgaatgttccggcatgggctctgggtcagggaaaaggaagtaaagctaaggggagtttaatagcctgagtgaaagggagggtacagaagaaaaagctacagcctatgacttcctcatctctaactttataatataaattaatgagaaattcaatttcacagttacattttttttaatggtatttggtgctgaaaaaaaaatcaaatcagtttgaaaagaaaggatcaattacacaaattcggcataaaccaacaagcccggctgtgaagtctgagagttgctttatggttaaaatttggttggtctgagaaacatccagtgacaaaaggattgtatcaggaggagttaactaagcaggctcatgcaaatgactcttcctatattttaattagtagagtttttgtcctttttagaaggaagttctaaaaagtgctagacagtctaaaatggaggtaagaaaaattctcagaaatttgagagatttggggaagacacctctaatcaccaatatctaatcctctattcccccgattatgtcatggtgccttaatttcactattagtacctacatgggcagatcatgagagattccactagatgctaatatcccagcaaataagtagtcctctgccaattgttgacaaatatatatcttagatgtgtttaaagaattacaatgaagaattctgtggaagattatatggtacagatcatattagtgcctggtaaaagcaatattacagatgggaaagagggacccaaaagagatgcctgagatttccaatacaaagtttcagggtggccttgatttggggtgactgacatgtcaaggcactctgacatttacagagacctgttctctgcattactaaacagattaaacatgtttccgggtatctagcaaaactagtgtgcttgtttgttcaaaggaacagtgggaaacccccgcaaagctttcagcattttaaactcttactcagtctttcatactggaagaaaggttacttgctaatgtaatagggtaggggcttgaggagatggagaatattctgggcagacactatgtcatctagttggcataggttgtaaaaaccattcaagttatcctacaccaacctaattcaagcaagtttcctttatttcagtttttccttatttctgcctatatcatgggaggagaaattgctgctaaagtctaatttgaatgccagatattctaggtttgtaacttttttgaggctaagaaatcacatttatattctatatgcctattattatacaaattaggtatttagagtctactggtcccatgctatacttaaaaaattaatcaatctctttgtcttgggggggaatctaggcttagattactgcagccaatccaagttctaaaacaaatggggcctctaatgtggggagtttcactatcctgcacttagctgacatactatgtggtggacagaaagactctggacttgagaaagatgacaagagactaagtttttagttattctagcatttattggccctatggccatgggcaagtcagttaggcccctagaaccttatttcctcacttttaggatgaagattacaatgccttcatcacagaacagtggtgaagattgatgagataatggatgtaaaaatattttgtgagcttcatgctgaaaaactcatgtgagacctacgattacccataatgcaaatacacacattttgagggagcacactgcctttttctgagcagtcctttaatctgaatctatcaagtgctcaaccatttatcgagagacccagaaaggatgcgtcccaccctcctggcttctgtgtgctgaatgctgagccactaacctgatttgatgtagcctatcaaatagagaaggttttaaatcataagattgagggaatgataacattcttcatttctatgaatttttcattttattccgagacagtcaagatgtactatgtgggtcaatctcagccttcacaggtttgaacagaaggtcaaggagaatattttcttaacttctatttcaattcaactactgccttcatgtgagccttcaggggccttcactccccaagcactgatgctcaggaacatcaggaggagaattgagcacacagctgaagagctctgcctgggattttatcttttctcccagaccttagaattgttggggctgctttccctctcactgataagaaggtcagtgatataaaaactgtattttcatgttttgttctttctagggtagactatccatgacttcagtcaaaatcacctggctactgattcagaaaatttaagtcacactcatcacttctatccaaagttcttagccagctgcggctgtggttgccatggtaaatgtaaagtcatcaaaggacaggactcaggcttagaaatataagccaccagcataaacattcaccacttcaacaatgtctgttttgagcaggaagctgtcacagtgaaattgggacggcagggagaagaggaggagtggtgtgatgtggcagaaatagtactaggtggggatgttctgtctttcctgctgtgtagaccttgggcaagtcatttttctcctggaacattgtctgtaacataaaggactagattaaaaactttcaaatcttcacctagtattaacattctgtggttttctatgcaactttagcattacctgtaagtgctttcctttgggtcataagtcccctgagaaaaggcaaattaaattgtatttctatggtcttaaatcatttaacggtttcccactggcccttggaagaacctgaagtcctgagtgatctggactctacttacttctgtggcctcatttacgtcctcattgctctctgcaacccatgtcagatttccctcgatttctcaatggatcatcctttttactgctttctcatttctctgactctctactctttcaggttgcagctcaaacatttttgttctctcccagacaggtttagctttttatctcctttttcccaacagtcccctgtgtttcggcatcacatttgctgtatacgccttgaagtcaatgaccatgctctgatgccatactttgcagtagcagccagagagatttgttcactgcagggctgtggttatggccaagttttaaagaatcacctttcttagtgctatataggaaatgctttcctataatttttttctctgatgaggtacatgtcagcaaacttaattcccatcatgcatctcttacccatgtataaggaagagaggtgttttaattctgccaatgtcatatgactataaggaaacaaaggaaggaaaagctgtcacctgtggaagaacactagaattaaaaattgggaaattttcttttgaatcccaaatttgctattagttgctgggacaatggataaatcatttattcttttacagtctcactcttctcaactgtaaaaatatgaaagttaatatctcatagggttgctgtgaggattgcttagatacaaacacacaccaaacacacacacataagtctacatgcatacatatatgcatacacacacatcactgactaaacaaaactaagcattttctttgtgtgtgaagctgagcaatggagggattcccctttacacagggccttggcaagctaaggagacttgcaggtgatgatggtcactacgtggggagattgctggaggtggagagggaaccagactggtgcagtggaattattactgagtgaggaaggtcagaaaactagaggttgggtcccaacattggcacttgtgagctgtgaggccttgggcaattactttaccatttgctcttttttcccccctcatctgttaataaagagaggtaacacttgctaatctggcatggccacaaggatcagatgaaataatatgcctgaaggatgaaaggctcaactgcctggcatggcgcaccgctcctgattgataggcaatgagcaaatatcacgtcaatgaaatgaactgccactgtctgaaatatctgctattatctgaaacctcagcttccttgtctcagtttttctataggtaaagctgggatgatgatagtatctaccttgaggaattgtttaaggattaaatgagaaggcaagttgtgaagcctttgtaaacactgtttcctcatatgctgcttctcacacatgtccatattatcaacattttagaagcaacgccagttgaggaggacttgagtttggtataatatagctgtttttccaggagactctaaaaagctcctttcattcgaaagcaaacagcaaaatacagcttctaaacattgctattttccctgaattttctgaacttgagcaaaaaagttgtttctctcttgagaggctctgttctgattggatcagccagaaagcccaataggaagttattttcagggccaagagtaccagggcaatattacagcaaaagttgatatattatgctgatggttaaactgggccttgtgttccgtatatgaaaaagtatactctttcaaattcctgcatatactaactactctctcccaggagtgtttctagggctttcacgtatttaggaggaaaagtcaggaattcactttaacatttctgttttctattaattaggcctgtttagctgttttctttttagaaagaaactagtagcagaatttgaactagtagcagattgtgctttccattcttctcctctaatctttgttgtctttgttattccctttgttataagagagtgggataaataaaagtattcaaaggcccagttcattgtcctttggccatatttcccttcattatgttacagcctagtctgaacccttttaacaagttttcctttttatgtcctctctcctacatgacttttgagtgaaaaagagtactgtgctctaacacacaaacacaaatctcacaaatgcatgcacgtgcacacacaaatgaacacatacacactattcaaaaggcacactgcattgcttacccatagaggtgaaagcaggaagtaaatccttttgaattcatctcagaggtttttttttccctgcctccaattggtttctcaaggagatctcatagcttctccaacaattttaattaatgttctccaatcactattagtcacaaaatcacgttcatttcatcaataagatttgtgtcccatgtaaaaattaaaaatttaaatttaatttaactttaaagtttcttttttctctcagcctgataaacttttagaagctcaaagtttgggaggatacctgatcatttattttctctcttctgtctcctccccctcctcctcttcctcctccagtaactcattcttatagtttttgaccctactaggatcaaaattaaggttccagaaagtttttctttcccccagtaatttagattggtttgtggcaaatgcatggtgctatcttttgcttttcaaatgtgcaaaaaaaaacctttctttagctgtgtaggaaggaatcaaattattggttgacagtcctgctctgggctaagagaataaagaccattttaattgctttattgaggggcttgccagagtttgtagggaaagcaaagcattaaattaagcagttgagtaacgttatgaggacacagcagggtagacaagcacgccagaattcttattgtactttaaaaactaaatgctggcagcaaaattcctttgagtcatttttctctaaattcagattcaggaagtgcactcttaaaataagttatttttggagttccatcttaactatagcttcaggccaaaagacagacttctccaagtagactgccctgcataggatcacattttagcaaaacctgtgtgtacgtgtgtgtgtgtgtgttgtgtgtgtgtgtatgtgtgttgattgttgctgacagaaacaaacttcaatcattaggacaagaactgaaaggattagcttttaattaaaaaaagattaaatatggaactttaactgtaaaaaagcattttatttcaagcaaattttataggcaaaatttctaggcaacaatgaagtgtattttacatactgacgtaaaacattcttgtaaataaaataggctttcctctcttgaagccaaaacattaaaattaagaaccaaaacaataacaaaaatataaaataagggataaaccaaattaatgaatagattatagtgttaaacagaatgtatttgccttaaatcagattttatatcttctatatattcataatgaaaaattaagaagtcattattaatttataaacagactgctgcaggtttcatttgaattgctaccttttgattatttttaaagtagtatcaattttcaaaatcatttcagagaaacaaattgtaaattcatactgtgtaaacctgttgcttctgaagtacagcactgtgatcagtgctaaaggagtacaaaataaagctaaagacaaagtttcctcagaagcttataatttcactaggaaggaaaaacagacgttcaaggattcagttaatgaaaacacagaataaacagtgtttcagtaactaggatgcctgtgtacactaagagtaattgcatttagaggtcacagctacctcatggtccaggtggaaggaagccacagttggattctgacaacattgaattagaatgtgtgcaagagaatggtgaggatggagggaggctgtgggaaggaccagtgaatgaaaacctcagtggatggttacaactgtaaagggtggagaagagcaaaagattagcttttcttatgctaagggcccagcttggagaaaatgtcatgtgcagggtgctttgctataccacaaaggggagaaacatgggcagacagaaaaggacagtgtgagtaacccgagaacagaaaggagttcttgtgctttagaaaagaggtgtgggccggatgcggtggctccgcctgcaatcccagcattttgggaggccaaggcgggcagatcatgaggtcaggagatcagaccatcctggctaacacggtgaaaccccgtctctactaaaaatacaaaaaattagctggcatggtggcgggtgcctgtagtcccagctactcgggaggctgaggcaggagaatggttgaaccccggaggcggagtttgcagtgagccgagatcgcaccactgcgctcagcctggggacagagcgagactccatctcaaaaaaaaaaaaaaaaaaaaaaaaaaagagttgtgaaatgaatcttaacattttagcaatggtcctttgggactccagagaaaacggagtgaaaaagaggtttggaaaagagaatctgattttagaactagagtaagagaagttgtcctggaaatcctgcctgtctcctctacctttttattgttgttgttgttgttgttgttgttgttttctgaacaaggtcttattctgtcacccaggctagtggcacaatcttggttcactgcaacctcgacgctcaggctcaagtgatcctcccacctcagcttcctgagtggctgagactacaggcatcaccaccacccttgggtaatttttaaatttttttgtaatgatgaggtctcactatattgccaggctgatctcaaactcctgggctcaagggatcctctaaccatgtcctcccaaagtgtgagattacaggcttgagctaccatgcctgtcctctacttcttaatggtaacctcacccagcacatcagctcattcatctttaagatgatgttaactaccgactagttattatcttcatgggtgaagttgaatttaaatgattataccaaatctgtgcgctttttttttttttttttacattttttggttcattctgtatcaatgagcagttgtgatatgacagttatgtgtgaatcatctataacagtggattttggggaaatgaataggccaaaaaggaagatattctccaaactcttaaaatttaaaggttgcagtaggatgctactccagctaattttaagctagccctctgtattcttacagttatttctctctctctttctttcacacacatgtactcattttcttatctattttataacaatttccccttatgctgacttcgaaaacttattatcttaaaaaatctattgcatgcattcctgtaagcagctacctcaaacgctttttgagccaggctgaaaataataaagccaaatttaaaaaaacaaaaacaaaaaacactccaaatcttgccaaactgatgatcaaatgttttttgattgtattttctttaacctttatctatatgaatacataatttaccatatttatagtcaaggtgtttgggtaaaagaacaaaaaatgatttatcctctttcaaaaagaggactacaaaaggactgaaaaatactttgggaggccccaggtccaggatccctggggtagacccctgagtggagcgtagcatccgccaggcagcttgagacacacctatatttaccaaggtgggttatgtgataagagggaggaggcctggccacatgctctctgactcatccctcaagcacatgtgtcaatttttcctacagttgggacaacctccttcagaagacagagctgactgtaactttcctgggctgcaatgcttaacttctacagaacaaagtatagaaactagaagcactgggagtccccgagctttcaatgagccacactagtgataacatcgttattactgctttgagcacccccacccccgccacgcatgtgccttttctctggtttggaactggagttgtgcttctgtgcagtgtctaattcctccccagactccctagcagcctgccaggtcaaaagggcatgttaaaatgaaactgctttaacggctacttcatttccttgcactttgtgttaaagctggcatgtgtaatcctgtgatacacaggactttagattagagctgggccaacacatttttaggatcctttttgaggggagattggcaagagatggaagagagtgcagaataatttgagcatgaattttaatcatttctctacaatgactagctttgtgaccacaggcaatctgcatcccagggcctcagtttcctcatctttgagtatgtctgcattctcctcaagactgtattatcaccagggtgagaagcgtgaatggcacagtgcttggtataagcagtgcatggctatagctgtttgctgatggctaagagatggaaaacgacctggttgtagccgacatcacaagaagagactcttctttctaatgtggataaagcttctcctgtatctgccttcctcctagtacactgactaaaatgtaatgctgactacctagatcacaaagaagaattttctacagaagcaaacaaggccattgtttacatgccacatgtgctaagtctcaatcttgacattccccaaccaacttcctggcaaatattgtttgacttagggaactgagttaacagatattgaacataggctgttgagtaccttcacttatcagtgggccaagaaaaaaaatgccaggaacccaatttatttgaatcagattaaatatctatgttttgatccacatctggtgatatagttataggatttaactttttgaaggactggttactgaaggcccattgggcagctttagaactgcattacttgagaaagtgttgtaacttctgagcgccctcgccagcttgttaatttgaaccataatactgcctcctcctttgcagggctcatatggagttcatctatgtgtatgcaggctctttgaaatagtgaatgtctacaaatataagtgattattattatgctttttatacctcctgtagtgtttgctggtcatggactgattgactttttccaacattatgattcctatgtaactgattcctgaaatatctaccatctccacctataaaggagattaaattttagggagtaaagtcattctcttgctatcctgcttatcattacttatgattaggcagaattctgctggttaagattgattccagggaggcctagaagagtccttctgtgtgcttctttcccaaatatattcctgcaaacttgctaataatgaaaagttccaaaattgggaattcacttcattgtcactattctatggaattacactttaagctctaccatttatatacacgttattatgaactgagttcatcaatcattttaataggttttcaacagagggaagaaaattgaacatgagctaatggtagggccaaagtctcagagaacaagaactctgcaactgctaataagagaatttttgtctctgtactggtgaaatatttgaatgatatccaatgattaatgtttctttaattctctaggtgaccaaaatcacacagaattatctagcaataaatcctctttacataacagccaaagcacttgggttgaggaaagagaagagaaataggtcttacccagcaggtctggtgtcttcaatggctcatccactgggatcaaatcgctaaggtagacattgaagtttccttctttccatcttcttttgcctccttctcctttccatgggggacaactacaggacgcccaaactgccctggagcttggggtcccttggagaaagtgtcacatcaattcttaacacctggtgcgttccactgtcttaggtaaaagggcttttatatgactctggttgtattctgtagagggggctttggcagttagttgatttttgctggctctagccctccagttaaagcatggttagtttgggacagtggcatctatgtggagcaagtgaagaggaagacatctcacttctattcctggaaatgtgtttacttggcttttacccaatactttaggaaatattgttttggttttagaattagagacctcttggggtctgccttttgctcttcctctttggttataatcacaagatggctttcagagaaatgagtttcttcccatgagcccctctagctccatcatcctttgacaaacttcccaaaggtgctcattaatagattgcttccttaagcgatttgaattgacagtgaacttaggaaaaggaaactcgtattggctttgtgtttatttgcattgacttctttgctctgagtcttagttttgttaaggccatggcttccccagacttcggcactgctgtgctggcagggtgtgccctctcgttgctactgcctgtgatcgctgctttggtctatcagtactaagactgatggtcacattcagtccctttcagctgctagttttgatgtgtcactgctgggactatgactcttccggggctctgttttaaactgacacgtcccatgtgtactgatattttgactacctgagttccttttgtgctatgaatgaggtctttggagccccctgagctgtcgtttgctttggtgtcccctggtagaggaggcttcaggtttggtgcctctcccgtctgtcttctgcttgttaggagtcacaggagggtctgcagatgtgcaggatgccacaacggcacaaccttgccccttcccagggcatctgcatttttctttccctctgggtttggtccaagtccacctcaaccttgagcacactctctcagtttttctaacattctctttgccccatgcccctttcccatgtccccttaggggagtttcatctcttttatgctgctgtaaaaaatttttccttggtctggctgaactctgaatctatccgctccctcctcacaatgtcttccttgatgacccgagtgttgatctcactgaatggaggcggagagctgccatgtcaaagaggagccagatgacagaagctacaaagataaatgcaagactcgcccacttcctcggaaaaactttcggatcctgttcatggtacaaagctttcctagcagcctgccctcccttagcctgcttaccttgagtggagaggaagctgaagtagcacagcagcagcagcagcagcagagttgccagaaagtgaccccctcccctgaacacagcagaagcagcagtccaaggggaaagctcagttcctaccgcttgtcagtctctgcctgcgtggatttcatagcagagcatctgtgcctgcttggctggccctggctaagttctgataaacacggccttaggtcactccaggagcagttgattccagccaccgaacagttcaacatatcactgtcttgtctccgggagcccatgtccaccttcctacaagcccaagaaaaggtgggggccaattgagactgccgtttctctcctccccgttctccgtctgcacgctgtaactcaacaccattctcataaggaaaacatttcatgccattacccagaaaacttcattcagctctcacctttgtgttatgtgagagcatgtgtgtttaaacggcaattaaagaggaaaaaaagctatctacttggagggcatgtgttcctggtttgtgaccccacctaccctactcctgctcattaacctgttgtagccaggtgccaatgctctgcctgaggaatttatcactgaagttaacatttcactttaagacataacagcttaaagaaggggcctggtatatcctcacttccagagatgtattgtttaattatttagatcattcattcaaggggtttcaatgtatttctttgtaagccaacatttttttttcactaatccatctgtttttattattacatttgattacaaataaacttaattgtcatactgctataaaagtttctaaacactttgttatggtctgaatgtttatgtccaccaaaattcatatgttgaaacctaatcataaatgtgatagtattaggaggtagggctttgaaggtgatttcattataaggatagagccctcatgaatgggatcagcacccttaaaaaaaggccctattgccttgccattccacaaagtgaagacataatgagaaggtgccatctatgaccaggaaatgggccttcaccagtcaacgaatctgctggtgccttgatttctgacttctagtctctagaactgtgagaaataagtttctgttgtttatgagtcacttagtctatgttatcttctatagtagcctgaacagattaagatacacttactctcagtttcagtacttatctgtcttaaaccagcaagcaacagtttcaggaccacaccaggacttggaccagattttgaggatgctggttgactggtagggtagcagttccgccacaggcttttcattagaaccacttgaacaagatccccaaaactctggtcaattgatgagagaggaggtggagatgacatttgggtgatattgtattaaatatatatatatatatatatatatatatatatatatatatatattttttttttttttttttttttacaaagcttcccaggtctttcaaatgtgcagctaaagttagaaacactggtctagaaaaaaagtctcaattttttgtttgtttgtttttggtttttgacattgcctatgagacatttaattttaggtgtctacttgactgggctaaggaacacccaggaaccagtaaagcattatttttaggtatatctgtgagggtgtttccagaagagattggctttgactcagtgcactgagtggggaggagatgccctcacccaatgtgggcaggcaccacaattggttgagggcccagatagaaaaaaaggcagaggaaaggtggattctgtctctgttgtgagctgggacatctttcttcttctgcctttggactagaactttagattctctggcttggcctctggggcttgtaccagtctgcccccacaacctccacatccctcactaggttctcggcttttgacctcagactgagagtgatgttattggcttccctggttctcaggcctttggctcagaatgtgccatgttactggctttcctggttctccagcttgcaggtggcctggactaggtttctcagtctccataaccacatgagccaattcctgtaataaactgcaactcactttctacctctatgaatcctattggttctgtttctctgaaaaatcctggccaatacagtctcaacttgtgtgacattccttccctgtctaaagtacagtctaataaaatctatgcattccataacaactaaatcagaatacacattttgacattgccagttgtaaagattgtccatagatttgagaagcacttctcgggaccactgtccttctctctgaggaactctgagtgatttgtgacaacactgctgttcattactctagtgtggggagggtctagcttccatgctttgaggtaacttatgttcccaatgacttgggaggggaaggagagattccaaattcatatatatatccaagcactttgctaagttctttccattgactatctcactcaatcctcacaagaatctaagtgaaggagtaaattacaatatgtattttgtagtcagcaaatgaaaccttagagaggtaagcaacttctggtagagattggaggggttgggtcttgaatacacgactgtagtccgtgtcttcaatatcacacaatactgctctctagctgtatgatcttgcaggctagttaattttagtggttactgagcaataaaaaaaaattctgctttgcagattaatgtgagaatatttaaaatggttaaagttattgttatattgaaggtactctttaaatgttagccattcatattgttctaatactttgctgtaataggagtgtcggatgcatgtgggaggcaatgtaccagctcttccaaaaaaacaagtagaaaactagtgactaacatgattctggcaatggggaagaaacaatctgagtattttattttattcttgccattcttatttcctctaattatagatttaacaagccattgttcactgagaactccctacatgcccaaaacatgaagtaggtgacattgtctctcccctaacaaccttaaaactcccctcagtagaacgccaccagtataataataataataaaaaaaaagaacgccaccagcaaaaaacatagcacacatctttagcatccacattcgaaataaagtgagaattttttttagcatcatggataaatggtttgcattacaatattgttttaacatgaaaatagaatactttaaaattattttactctgcatgattcaatcttgtccagccccatcccaccccaaatggcagttggaattactcaaatgtcttttaggaaagtcaacactgttatattctatgcttggcagtttaaaacactgcttgaaatatattcttgtttccatataattttatcaaagagtactgatttctttttatccctctctggtttgtccttgcgaatcaaacacaaattacttgcaacaggagagcaacatgttaagaaaattaaaagggaatcttggttatctatcatgggtaaagcaacacattaactctggcttagtcttcggtctatttgacaacaattcagaatgaaatgtgaagagtgggtaggagagtaaggaaacattgattaaatatctagaaatggaggagtagatttgttgtcagacctggtctaaagtactgacttggccactatagccatatgactatggatgtgtcacacatggaaaagcttgtgtaaggttctcttcccgcctcttcttggtcttttcccttgtgagtttatgataatctgtgatgatggtagaagttgttataagccataccactaattcaacactatgtgtcttcaggcactcagtaataatttcgtggccctcatagctgtacatctttctccttttttttctcttttccgacacacatgctgttcacatctcagatcaatgaattgcataggtaaaaggaatagaaaaaaaaggatattagaaattctaccttttcatcaacacacatattgcccaacacatgacatttgtatattggtaatgacggtgcttctaaaattttagttgtattaatttccatgttaccagcaggaaactaatacgtaagtgggttggttatttgaggtaccccacagttagggagcctggcttgtcatccaagtcgtagaatgcaggtacctttggctggtcaaatttctcaagaatctgtacatacttgttggagatgatatccatctgaaaatctggagttacgaattatccttgggagacatttgaggggttattccaattatcagtctgactccagcttgtactaaacatttaaaaacagatttagtttcttcttctgtaaaacgagcataatagtaggaggacttgccctctactctatttgttgttgtcaggataatcatattaatagcaacctttcattgggaatttactgagggcctccactagtcacttcacggtatctcatttaatcctcaacatttaattttctcagactagacaaaaactgttcagcaaaacagatctgcataaagttagagtgaaaagtatatttgtgtttattctcatggcaaatgtctttgaatcatcctcattgttaatcaagtaggagctcagtaacactgttttatatctagccttaaatctccctgatggaagtacagaatcttagaaacacggttccagctctctggctttgcatctacagttactttatctgggtatttgaagatttctgactatgtgagtatatcctaagtaactaatatctgttttattttatgatatttactcaatactcactcctaagtaaaaagaaagatgtaaaaggaaaattaatttaaatgtatattttcagagaataatgattatccatggatgcatcactgaatttctttttccccagttttactggctataattgactaataaaatgatacatatattaaatatttaaggtgtacaacatgacttggatagccttatacattgtggtatgattgcctcaatgcagctgatctccattatctcaataattatctttttttgtgtgtggtgagaacatttaagatctactctcttagcaagtttaagtatacaatatattattatcaactatggtcatcaggctgtacattagctctccagaattactaatcctgcgtaactgaaactttgtattctttgaccaataccttccaactttctcatcccccaacccgcagtaaccaccattctactctctacttctatgagttcaattttttacttccgcatatgaatgagatcatgcagtatttgtctttctatgcctggcttatttcactagtgtaacgtcctccaggttcatccacagtgttgcaaatgataggattttcttctttttgaggcaaaataacattcttgtgtgtgtgtgtgtgtgtgtgtgtgtgtgtgtgtgtgataatatgtatgtatgttgcactttctttattcattcatctgttgatggacacttaggtgaatccatatctaggctattatgcgtaatggtgcaacgaacatgagactgcagctatctcttaaggtgctgatttaatttcctctggatatatagccagaagtgtgattgctgggtcatatgtaattctattttttagtttttttgaggaaactccacactgttttcgataatggttgtataatttacattcccaccatcagtgtacaagtgttcccctttctccatatccttaccaaccttgttatcttatatctttttcatcatagccattccaaaatgtatgaggtgatatcttatgtggttttgatttgcacttccttactgattagtgatgttaagcattttaaaaatatgctgttggccatttgtatgtcttcttttgaaaaaggtctactcattttttttccctattttaaatccagttgctttcttgatattgagttgagctctttgtcaatcagtaggagcgcaataacatggttatatatttgagatattaactccttattggatgtatggtttgcaaatatagctgtcatccataggttgtcttttcactctgttgattgttttcttggctgtgcagaaacttttagtttcctgcagtgtcatttgtc

SEQ ID NO: 5067 - DNA, 18992 bp, Homo sapiens
ttcagttctggaggtgagaagtctaaaatcaaggtgttggcagggctgcactccacacaaggcttcagaggaaaacatttccttgccttttttggtttctagagcaaagcttgtccaatcattgcctgcaggctgcatgcagcccaggacagctttgaatgtaacccaacacagattataagctttcttaaaacacaaaattttttctctcactcatcagctagcattagtgtatttttttctctcactcatcagctagcattagtgtattttatgtgtgccccaagacaatcctcttcttccagtgtggcccagggaagcaaaaagattggacacgcctgttccagaggctgccacatttgttagcacatgaccacttctcgaattactacaacgtcttgcttctgtgtcacttttctactactctctttgactttcctgcctccctcttattagaactcttgtgattattcattggatcccatcctataatccaggataatctccccgtccttaatttaattaatcccattgcaaagtcgcttttaccaggtaaggtaacaattcacaggttctggggattaggatgtgacatctttgagggtggtcatcatttagcccacaacagtcagctagaggcattagggacctcagatccacccaggtacctcctaatatgcactttccttgtgatcaaaagagactggtacctggtacattgtttaaatctttgtttttgttttgttttgagatggagtctcactctgtgcccaggctggagtgcagtgacacaatctcagctcactgcaacctctaccacccaggtcaagctattctcccctctcagcctcctgagtagttggaattacaggcacgtgccaccaccccagctaaattttgtatttttagtagaggtggggttttatcatgttggccaggctggtttgaactcctgacctcaggtgatccacccaccttggcctcccaaagtgttgggattacattgtgaaccatggagcctgaccttgtttaaatctttggatccaaacaagtacaaagccattctgaatttaccagtcaaattagctattgaattcagtttatgattctttgaattaggttctgtaatctctaacccaaacatgcctgatttgtacacttgcccaaggtcacacaggagaggctgaatctctcctctttaccctatgagggtcactgatgagaatgctcatttgtccttatttgaaggggactcttaactgtcagcactctccctcccagcctccacttcagcccatttggccacagggtcctatgttcagggccacactcttctctaatcctcaccaaatactcacctgtttcttccagtgcttttctttaaaatgatattcactggatcactagaaggccaggtctagatgctagagccacagagatatacctttcctaaggtgtaagaaatattttatattagagggagaacagataattatcccctcccctgcctccaacattgaaaagcatgcttctttaagatgcagttaaattttgaaattctgttacattaaacccttaatactcatgagctaccatagacttcagtattggtttcctgggataaaccattatttacttcaggaaactgtatcttagaatggcagccattattccattcttggcataaaagtaaaaggaaagcatgaacatgcacacgataatcaatttaatctgatttataccaggtggcaggcaattattgttttgtgaataaaatatatggctgttgattgattttgttgtgttatgatagtctgtatttctgtaacgttcactttagctgggacggcccttcaatttggaattttaatccctgaagtgaaccaatgggatgatcctgtctcttcaggcttgtttagggttgcacattccctgggtcattgctctttccttatagaaaattctatgggttattggtaggattgtgactgttgtatgtcagtctgctaggctaaactaaatttccctgaattttctttcctgaatgattcctgaaaaagaaacggagccaaagtaaacattgttctgtgagcttggtggggcggaagtgaagcagctattttgagctggcacacactgctgcccgtctgctgcctcacctggtgcatgggcagcagctgggctgcaactgttccacctccctggatcttcctccagcttctatgatcctgggccgggcttcttgggagggcattccaaccgctaaggtcagaggcactgagagccgacgcgggtttcagttgcccccgtgtgtccagcttatacctgggaacccagtttgttcttgctctccccctttagtttctatccatcatcccttcccaacttcctgccctgcagacttcaggctccagcatcaatgcaacagcagacatatagaggcagcttcactggcacccaccattgtgtaaagtcaaacccttctgattgatcaatcaattgatcgattgatagatggattgctccatctcttagtgttctgcctttcccttccaaccctaattgaaacaatacccctgtcccaactatgtaagtcatgtttgtttaagattggcttcaagctgccaggatcaacatttttcttttaaatgtattcttgtttttattcagtgctctgtgaccatctcttagccataacattagcttgtggcttgcttttcacatatgattaagattaaagatcaagattttatgacttttccccaaatcctgatctggacctaagatagccttaacattaagcatttggtattggacaaatggaaagtgaattttacataattttattttgattctttatattcttatatgaaaatcttttcattacctttttttggctttagatttaataatggttacatttgtacaatgtcctttagcattaagaatataactaggggccaggtgtagtgctttatgcctgtaatcccagcactttgggaggccaagcgggtggatcacctgaggccaggagttcgagaccagcctgaccaacatggagaaatcctcccgctactaaaaatacaaaaattagccaggcatcaaggcgcatgcctgtaatcccagcactcaggaggctgaggcaggagaatctcttgaacctgggaggcagaggttgcagtgagcgagattgtgccactgtactccagcctaggtgacaagagcgaaattcttctaaggaaaaaccacaagatccagtaaactacataaaataaaacagtcatgtttcatacagtgaacattcgcaattgtatttgaagtaaggatgatagtgcaaattctaacatactttctaagtcatagttgttacaaataatgggagacaacttacctctttatgaacaaaatagcctatgttttattagtagttggatagactcatcttgttgctaaatgtgtctcatgttgccgtctacttgtagaaaaaataatacacgttacaaaccatttacccgacctccattattccctagggcagcaaaaagcatgtttttaaataaatgtaaacacatggttagccaaggatgacagaactctggtcatttctctatctttccaaaactgaaataattttaaggccataaaaaatgtcacagcaggttttagaaagaaggcaatccaaaaataaagacacgaattcccataaaagctaggctagggtatgaggtgcccgttgccatggggtaatagaaatctaggagtaggagagacaatgatctgaactgtctcaactttgctatgtccctggattgaggtacttggcagccccgagggacggagtgattggaggcatgacctttggagctaatgtatttctgtactcctgtgtttatccagggcatttggttgaattagtgccacttcctgccctaaggatctcacaatctagtatgccccatttgttcctaagcttggtcttagtttctgcattctcccatatgattccactcaaatcttctcaacagtaagcttgtagttgaatttcttgggaggacgctcccagaacatcatctcagcagctgcagggtgtctctggggcaggtcttgagactgccttaggctctctgctgcctctcctggccacaactgtctctactgccaaggtgctaatgccgaacccctgtgggattctggtccaaggaaacatctgcacacaggccagggatggcgcttagcttcatctgtgctcaaactctcatcagtaggcttgctggctctgtgaccttactagctgaactccttaatcttctgcacttcatttttctagtctataaaatggagataacaacagcacctacctcagaagctgttatgaagagtaagtgtattactatttatgagtcaattaggacagtagcttgcacaaataagtgtgatatgagcgtttgttaaaacagttaaacaatcaaacaaacatagaattaagtgctgactagagaacagctggtgatgacgcgggagggagatctaggatctattagagtgtcttccaaggacaagggagaggggattatacaagagtgaggtgttgtccctgatataacctgaatgggctcagccctagacacacttttaaaggtgatatgcttactacaactcttaacacctattcttcttctctttaaaaatgatctgaaatttattctcttggggataaaattattgtatatattatatatataatataattcttgttatgtatgtgtatatatataattattgtgtatatatgtgtatatatataattatttttattgcgtgctactattccaagccagtgctaagtgctggggacacatgtaagcaagttaaactggcccctcgccagatgaaacttgtttgcagttggtgaaacagacattacagagataattgtgcagttgcttatttagttacaccatgaagaatactctgaagggcaaagacaatgtgtaacagagtcctgtcctaatcctgcggttagagatagtgtagttaaggagatgatatttaagcttaaaaacagaacttagggagctggtcagcccagggcttgggcttgaggaagagaagggcatttcacatagaaggagcgtgtgggcaaaggctctggaaccattttgtactatgagaaatccaaaaaagaaaaagattaaaaaggaaggggtggtcagtagcagtcatttaacataatcacctgtttctcccaaggcagattgcattggtcctctacattttaccagcattgtgtaatatcagtatggaatagaaggattgtaattctgattgggggaggagaaaccttcatggcgataattttattagggtttaaaggatcggctgggcttcagcagacataaactagaggataagaagctatagactaagtaattactctgaaattataaaacttttggtattagcaagttggtagaatttgtttatttctaggtcccttctccagcctgctggaagcacaccatcaaatctgcagccagaaccatttaagtaaagttgtcctgtttataggttttttccataagctgttttattttttaataaataaaaacaatgccattgtcctttacaaaatagctgaggttttacttgaacaaaatctgtttgaaatgttaagctggttacacagaactaatatgcctcaaggtggtcattctctctggattaagctgtgggacaattgtggctcctgttacagggaaaattacaatgggccattatgaaagggacaaaaatctctgttcccagagggggactgacaagctgaaagtccctctctacatgcaacacaaaagcctgattgcttcagattgtttgtttatgtaaatcaaaaggatgcctttactctgccagggaactggcaagcaacaaagaaggtggtgattggctggattcttgctcaggctcctggcagatctgacaaatcctcttgcttttgctctaatctctgtctggatactttaggaaaagaaccttgttattatgtactaaagtgaataatttgtgctcttagagtaggattggaactataggacttgaaggcaagagcaggtatcttatcaaggatctactcactcagttccctaaagctctctctccagatcggattcaaccgcacatcatgacagatgttccggcacatttacccaggctgagtgtaatggggataaaccacctgaaaacggtcaacaaacaatactaaaatcagtgaggaattgactgatgtggacagccccctgccacactacagggtagacccagtctggaaggtgcactcaccaaaggaagtcaggaggaaagaagaaaattacaaggaacatgctgctcaactcatccatggaggacaaaatgctaaaaggtaaagtgtttccctttccttaattttcttgttttgacttataaatttaccctggatttttttgataaactattacgaaatgagctggacaccccaaaaatgtagccctttattctactacgcatagtataaggctaaacctctgcctctggtgaaatccaggctggtctatttgacagctgtgaccccagacactttctgtctcccgaagcctgagtttttttcactagaagaaggcggaataataataatactacaagtctagggtaagtattggctaaatgttaactactgtatttattatgattatgacagccccatattatttgaacaaagagaattcaaaatgttaaaatttccttctaaatatactgaagttctctgaatttatggttctatatcttatatatatatcttatataaatattaaggagagattacaatcaataaagtgatcattaagtaaataaattgaattgataaagaataatccaaagagtgaaatagtaaattttaatgatcagatttaaaattaaagacttctaccagagtttaaattgataacttattaactgttgaacaataaatattttaaatgttaaaatatgattttatatttttttcctagaaaacccagaagagaaactctttattgttcataaggcatcacagatctttctctccaagaaactagtgctgatgaaatgacattcagagaaggtaaaagaactacagttttgtacacagaaattgtttgactgagtatggatgacagtctttccagaaatgttgcatgagcgtggggttgacaaagcaatccaggcaatgacttcaaattttcaagctgctgtaggcagataagagagtcttaacttatctgtgggttccaccttataaagcatccagactgttcaaggctgaggctgcatggaatggcatagctgattggcataccaacgtatgtctatctcttaagttagtccactgagtcaaccctactttttgatttggtgtgtccaatctgtgtgtgcaccttgtgaaaggtaaatgtttcaaaaacgggtctttcctaaaagtcacaattaacatacagcttttttttttttttttgagacggagtgtcactcttgttgcccagctggagtgcaatggtgcaatctcggcagactgcaacctctgtctccagggttcaagcgttctcctgcctcagcttcctgagtaactgggattacaggcacctgacaccacgcccagcattttgtgtgtgtgtgtgtgtgtgtgtgtgtatttttagtagagacggagtttcaccatttggccaggctggtcttgaactcctgacctcagttgatccacctgccttggcctcccaagtgctggggttacaggcgtgagccactgtgcccggccaacatacagtttaaagtaatctacgaaatgatttactttataggcctctaatgtaaatacaaaattgttaactatttcatgcaaagaaagacagggtgataaagttaattttaattgtgttctttaagaaaatggaagaaaaaaagaacattgaagtgattatgttaaattttaaataaacttaatagactaagagacaaaaatcctttagatttttctaagacacctacatttaaacagttcccaaataaagtgtagataaaatctattaattaatcatttctttcctctcttgcagccatacacatcttatgtcaattgaagtcagcttgctaaacctaaccaatttagctttgttaggactttaacaggcaaatattgaagagactattggttgaaatattagaacatcacataaaatagtagatgtcaaggggacaggaatgtgattggctatttcctacatctgctccctttgcctgaacacctctcatctatgtctgcttagcagtgtagcaacacttaaggaaatatgtagcaagcaatagacagttcaagctgtcacattaccagagataatttttaagacttaagacttcacaatatgaacttataacctctttgccctaattattctgcttccaatgtaacaagttctcagaggcagaatccaacctcctatcatctagagcccctttcaaatgtttgatcaggagtccattgcaggtaaagttgtctagatctttcattttcatcaaatggagaatgaaagcaggctgtagttttcagtagatggtctcgctggttaagttttccctcaatgaatcctttcctgtttgatggagtattttttcctccataatagaggcacagattttggtgtgttttatcttcacagtggcaaacactataaaatcttcaaaaagaatgttactggattaaaacatataaagatgctaaaaatatgaggaaaaactataatttaaattcaaggagtaattttatatgtgacaatctcatggctggtcatgaatataaacaaaatatcacttactttggttcttgtggaaaacaaaataaaacaagcataagattatggcaaacattctaatgtgtatttatggataatgttaggaacattgagggacactagcgacctgatagcagctgtgtgtaacaaattagggtgatcacccatctttcttctatctctgtaagtttactatgtattccctagagtgagaaaacaacaaaaaaataaagaactgaacaccttggatgaaaatggaattgtgaacatctttcggagagagtagaatatgtggaggaaaaagacaaagaggaacattgcctctcaccttacttatagactctcacgggtcaaaagaaaatggtgaactcaggcctgacaaggggtgtaacccagacagatttctgattgtgtacaccacagactgaaacttcccacagaagccttgcagggctgaaggctcagagacaacctcagcttccttataattaattcttaccatattcaataaatattgttgagggtagttggtatgatctagctgtttgaaaagtgaccagacatggacagtcatcattttcagtatggaaacgagcatttttttctttctgaagtatttttctaattttccttgaggtgtgtgttgtgtgtgtgtgtgtgtgcgtgtgtgtgtgtatgtgtgagaaaaagataagtccaaacattccttttacatgtgcacgtatccagttgtgactggctagacaagaatttttttttttagtgtgtctcagggaacaccagtctcactaaatacagtagtccacaacagagttccatagcaaatgaagttaggttgttgactttcttacagatttacaatactcgttagcatttcaaagcttgtaaaaattctgaagatgcttatttaactgtatttaatgcagtgtttttgaaattatttggctgtgtagcctgtttgtgcaaaacatattggtaacccacagaatcatatcccaaaaacatgtgttgggaagtgattagcaagaaaaattatttggagaataacagactaatgctgggtattttggaatctctacacatctcatctaccaattgattttgctacagggcatcgtgggagaagattcctctgagtggcagtaaccaggaaataagaagacagaaggagaggatactgagcagcctctcaaagaggaagaagatgaggacaggaagaacaaaggtcaccaggagctgaaattgaatggctgggatttcgaaaacctagccaagctgacatgttacattctaacatgatgaggagcagaaggtttgggatgaagaaattgatgatgatgatgatgataattcaataatgatgaagatgaagttcgagtgatagaatttaagaaaaaacatgaagaggttttcaatttaaagaggaaggtgatgcaagtgaggactccccactgagcagtgccagttcccagctgtgacacctgatgagcagccaaccttagggaagaagagtgatatctccagaaatgttattccagatacaatacaatatcctatcggaaaatcagaaagggaaataccaagcaaaaattgatgaattcgagtctatgatgcatttataaactaactggaactgagaaattctcagcccactaaaggaaaagctaattctattgccccagggtgcatatttctatgccttatttagttatcacttggagggaggtggaagttgactctctttttcactgtagaataatgtggaataaccctagataaaaattcagtctgataacctcaaatcaaaaagctttaaataaattctgggcatttatcttttaaaacttcactaatatagcattgtgtgataagcactaagcagtagtcccctgggggaatctggcataattcggctataaatgtagcaatgcttggaaaggtatcatcaaatgagactatttgaggggactatttgaaatgattctggtatttcttttggtactttcttcctgtacattggagtgatggaaagtctggtattaaaacctctcttacttttaacttgattttgcagactctggcaataagccttccaaaattctgtgccttttctattatcccaaacaatatgttaagtggctttccttggcatctacagagaaaacattctatagccctcttcctaggtgttaccattcactgaatcttctctcagagggagatgagcaattgtcagtaggataattctgtttgctaaatgttgcctttatgctttcaaactgaattaaacccattggaggttgacactgggaggggctagaagattggtgggcagcagactaaagagttatgttgatagttttatttctgtggctgaaaataaaatcttgtctagcacagttaaagtcattaaaataaaaatgacagctttagcacaattttaagaaaatgcccctctctattaccacatttttcttattaacagtatctcagaataattttctttccttagaaacctgagagaatgctagtataactgtactagttactatgaaaatggaaataattatcttagaatattttcaaagtaggcgtgagcatgtatttttagtgggagagctctgatagttgttgggaatatataatttacggacctcagcccaaatcaagatgcttaaaattgtacttgtggagcttcactcaaaccaagtgtcaaataacgtattgaatatttatgaaaagagagactatatttatattcttagatatttgttccacaatttttcatttcatgcttccatatatattaccctgaactttctatcacacagataaagattttgttttgccctgcaaataaaaagacaattccttattgtctgaatgaatacagtcttcattgtactattcaaccctttgtttctttctttttcattttgtgaaaactccatgttagtcctcttagatgactgcttatttatgtgtaacataaatcccacatatttaatgacaacttctttaatccttccgggtcatatattatatttccatagtatcacatacattatttagttgtttacaagactccaatttgaattcaggattacagtgctcctttcatttttcaaacagataacataaaagttctgttaccctcattctatacaacctatggatttcagtgttacaatatcagtttccagaataaagtgagggaaatcaggtctttattgataaagtagggagaagattgatgcaataggacaatttccaatttaatttagatcctctaatctttcacatggacaagctgttttcttttctaggttactgataacccctacaattttcgacttaattcaaaacacagtattgtgttatctatcacataacaggaccatgtttttaacctaccataagagcctgtattttgagttattccaacagagatgatggattcctgtagaactagaggtggtgacctatggttatgtggcacggcaaagcaagtacctcttaagggactctaatatatctaacgctggtcctcttagctctgtgctctcaccagacaatgaatgaactatgaaagattagtcaacagaaactattttagggtatgtttagttggtaaatgcttcatgttcatggatacacaatgtttttgcaaaaaaaccctgaaactattctttggcattggtgtccatggcccataccgccatcttacacgaaagccacagagttgaaagccacagagttgaaagccacagattaagtgacctcaggtaacataatggtgatggttggccatttgagtctttgtaacctagaaagacaaaggtctgattcagattgcatgggggatttttaacatatttgaaactcaggggaacatgattaagaacacaaactggtagctacacatgaaggtttacttgagcttttgtgttcaaagttcaggggtggtaaggactctggtaccagggaagagggagaattaatttatttgcaaatgctggtatttcttacatgattttttgttttcctctgttgctagataaatagaactaataatagctctatttctctgccaatataaaatctacctttcatataatgctacatgaaggcacagaatttgctaccatctctctctccccctacctaccaaactatccacaattaaataaagaactgctgtgtctgacttactctcaataaaagtttgtgtctttatttctggctctagactttattttgtttagctgccttttaaactttagaaagaatccttgtatatcacagctactatgataattaatgaatacctcttcagaaatcaagagaacactttattttagtcatttgcattatttatttcaaaaaggtcttaaaatgattgtatataaaattgtaaaaagatttctggtaggtagatatgtaatatacatgaaaaatttttatcattttttaaggaacgagatcatgtttaagatgcatcttaacacgaacaacttgaagaaatctctgtaatcatcgagtaatacatttaaactatgctgacattttcatagcaatcgtttctgcatatttacatggatcatacttttggcatattttcaaatggagaacggacatttaagtttttcaatgtgaagggaaaacatttaaaataagtaataatagagaattatggagaaggataaagcaccagatataataaagaagaaatatgtttgacagtatgagaaaggcaaccacttctcttaaaactgaactttcatcactctaaaaaacaataggattgtaaaatgcaatgtcaaaaactatattaccaatattaaagtatcagacagaaacataccacaatgaatatgggtttctgataaccctacaatattctacttaacttcaaaactcagtattgtttaaagacaatgaaaatgtgtattagttcatgaagaacatgagataactgagccaggcaatcaatacaaacacaatgacatggtagtagtaagcagctgaactcactcagaacatggcaaactacaaaatcaaatgatgattctagtagctaactgccagcacaggagaattttggaaatgaatttagaaagtaatttggtgtttacctagaatttaaagttacatacttgattccttctttataataacttcagtcgacagatgcaaaagaaaaagtacttaaaaatgtttaattccaacatcctttatactccacattttagttttattctccccttagcaaatgttttcaggcaatctttaacacaattcacttcttaatctttggcttctcttgtttttaagctaatatgtataaaactagcaaatttggggagttgtttgaagcagaagacatgtgtgtaatcttcaactaaataacaagcaccctgatattaagaacttgattactccttcaagtttggaaaatggtatccagagtgtaagttcacttagatacttttgtgcagaaggccagatgcagacaaagctatacacctgaaagagttaaaatatctaaaaacattttattttctttatgttgtgaatagaaactcttgatatttctttctccagatcaaagcatcaaaaaaaaaaatatatatatatatatatatatatacacacacatcagtatatttacaaaaattgctatgtttttgagtggtcacttaaaaatctattcatgcttgaaaaattttaatttaacatctaatataaagggtttattatatagatgcttatgaccatatccttaaactggtaaatatctgtcaatcaataataaaacagaaagctcttgtttttgaaaaaatatttattacttatttgatggtgactcattattagaaacagcatattagaagtgctgtatttgctggaaaatgagaattttcccttgtgttttgtatgtgtttttacaaagcaagattcacataaacttgcaaagcgactctaattgaaatgataactattgttccattagttgaaaacagaggcattaaatctgtttagtgtgatgttatttttttctttctttgagatcagacaccaccaacacctggaatactatccattaagcttcattagggatatataatacttatatggcttattcaaaactgtcaaaaaataaatattttgtacaatatctctggttaattttttttctaattgtaaggcattttgtcttgtagcaactattgagtaacccatgcaaaattgttgcaaaagcacagtagtgacaacctacacaatgagtaggaataaaaagtcatggttgtgttttaaaggactccaactttttaactttttatttctgttcaagatgagcaatctgtagctttgattaaaggttggagggatcaagggttggtaatattaatacaggagtcattaaaatttattttaggccattagaaagggtaaaatagttctcggtggatttttcctttaataaaagcagcccccaagccacttattttctaacaaaaagcagcctgaaaagtcaagttgcagtatagatatgcaagctagaggctcccatatgtaaagctagcagctgtacctggaagcaggcacattcaatatggtgattcctgctcccttttccttgtcaccaggtgtgtgggtgaatggcactggtgaagtgaagccacgtgtgcaaatgtcatggtgacagccaggtagaagagcatttgcataataaaaggttagggtgggagggccagtcttttcaccggctatgtaagtgtatacctggttaaaccaatccccgggccctatgtatatcaatcaccgcctcctcaagctctgtatgaaatcaatcaaatcttgccccaaacccagaaaaccctctcttgagcaactgctttctcaacatgaggaagctttctcactctcttctttatctattaaactttccactccaaacccactcctcatgtgtgtctgtgtcctgaattctttcttggcatcagacaatgaacatgggtatttccccagaaaatggagctttttcaatattattcacagagaaagaatcctcacatgtccacttctttctttcacatttggtccaggagatgaaaaagaataggttctgcagaagtcaaagagatagatcacagcaaaacatgtgggggtagccatgtttatacctacactcaattggttaccacagagagagagagaccatgcttcttttttctgtttatacaacatcaaaagaggccaaaggggtttaattcaatctcatctcaatactgtggcatcagtaatctggaccaagaaacttttaaatgcacccacctgagatgacagccctttgtaaagaagaaaataattatatagcagcatggtatagtgagagaaattttttttgagccagataaaatggaaatgggttttatctcttacttgtgggatgaccttgggcaatttaccaaattcctcatctgttgtgggagttatccttcttgttcatataacagggagaatgagagtcatttgatgagttgacccatcagtgagatgggacacatatagcacctacacaaatagtacctacacacactcatgataattagttcctttcttttttcccatcacccaatgtcatttttttgttttaatccagattttggggctttcttctgaggtaaaaattattattattattttttgagatagagtctgctctgttgtctaggctggagtgcagtggcgcaatttcagctcactgcaacctccacctccgggtacaagcaattctcctgcttcagcctcccaggtagctgggattacaggcgcccacaccatgcccagctaatttttgtatttttagtagagacggggtttcaccatgttgcccagctggtcttgaactcctgacctcatgatccacccaccttggcctcctaaagtgctaggatacaggtgtgagccactgcgcctggttggtaaattttttttcttgtattctgaatatagaattcaatcagagatgttaaaacaaagaaagatggtactctctggcatgtttcaatcttttctattgcatgagtgcctgctagaaataattacaagccattcatgaaatcaaggttggtgggaatattggactcctatatactgtaaatggtatctttgcccctctgcagtcccaaataatactagaagtaaggtgttttaatatctaaaagaatgtttccaaattagtgtggcgagctaataatacattgtgatcatggcacatggtggtttgctgtgaatgacagctgaggggtgtcaacaagcagtattaagcaaatttgatgctggtgatagaacaagattgtaccaacacaactgtgtcagcttacaagagagtagggcagaagcgctgggtaactgttgaaaaggagaagaaattgtgcaaactgaaaagtctcagaagcacttagatggcttggtaagttggttatgctgtcaaatattatcaagaccacccttgtattcaaggtaacaagatgcatagacttttttttttttttttaaagtaaaggcaatgacctaagctaatccagggaaaaatctgtagccctgtaacacagcctcctattgaagaattcagtgctgattaggacctgtctcatccaaagtttatcactagaattaccagaagaccgagtagcatgtatacctttattctaatctcctaaaaaatttagaaggctatgcttaagaaaatgttggtagtagatgtaataataaatcaaacactcaagtttaggcccatatagattcccaactagtgatcagttccttgcttcttagataactgagcaaatatatgatgaaaagcaatgtataaaattctatccaagaacaaatttggatgttcaaaaacaatcctttgttatattgacaatatagatttaaatatagctttatatataagtttgtcagggtaaagtcagaaaggatgtgaactgagaggactgcagaagtttctttaaggaaaaaaatccaacttcctttagttgatatacccaaagataagtgtattcaaaagcaattcattttttttcagaacagagttgacttctttgtggaaactattttcggataaaagagagcctatatacccgggggaaaaaaacctctcaacattttttagttacatgaagaatacatgaggcacctagcatgttcagtttgtcagtaactcaattagtcttttgacaactgcttgcgtccccccatcccccttgccccatatggctctgttttgaaaagaattagagtcagcatcatttaataacacaaatacattctgagaaatgtgtcattaggcaatttcatcatttgtgaatatcagagtgtacttacacaaacctagatggtgtaggtagcctactacacaccaggctatatggaatccctgttgctcctaggttacaaacttgtgcatgttactgtattgacactgtaggctattgtaacatcatggtgagtatttgtgtgtctaaacatagaaaagcacctaaagataccatattattaatataatcttttgggaccaatgtcaaatatgtggttcatgttgactaaaacatcattatgtgtcatataactgtatctcatttcctagtcattctcttctcatctgcagttttcaattatatgaagaaaacatcttaaatatgttacaaatgtgcagaatagttctttttcccattcttagttatagttttgcttttacgtaactcattgggagtcaaattaaatgttaaactaggagtcagaatgaaagatacctagtttcacaatcatctcaatgaacaaaagtttaaatttaaaaaaagaaaaaacatattaacaagaatatagtatggtttcctccagggacccaatcccagcaaagaattgtgtatctctttctaaggaattctgtgagcagatttgttcgggccagtgacctgaggcattagaatgagccctgtctctggaaacctaattctaatcttgattctttgactaacttgcctgggttttaagatttttaggtaatttacctctcagcatcagttttcttaccaaaatgaatgcaaaggctatcctgatttc

SEQ ID NO: 5068 - DNA, 41041 bp, Homo sapiens
gattttataaaatgcaggagcattttctttttatattaaatccagaactttaggacccggatgtttagaagagagcccaagggcactaggattctagaacctggagaggaggcaggactgaaagcaccgatggccaagtcctatcctcccgccagagctccacctggggattggttgtagatgactgaggtcaactgctttcatttgatttattttcaaacaggaaagggaaagatagaagatatattgtgtatcttctcaatgaactctaaaaaaattgagtacgatattcatgaatcaccttatttcaggaccagcccagcagaaatctaggcagtgatctgatgtttattccaatcgtttggtttttatatgtagggattgggatggtcctttgcatttataggcaatacttaattccttttcaaatatcttcatttaacacagctaactgaaaggctcaacactccaggaagaagaaaccacaaatgatgaacaaatgttttgtcactctttcagattcagaaatttgcttgaaaaaagtctgaagaaactaatttaggaaagaaacctctgccaataactctaaaagtttgaattggttgcctttattcctaacactatgatgttttgggataggaactagtagtggtattttttctttcccattggcagtatatcatttacaacagatgttcccgactcaggtaaaatgtaactggcagccagagtcacccaccagcccctgaggaaagggctcaaccttggaacatctggctggcttcaagaaggtcacacaaatacaagatgatgctgaggataagacagtggttttgagagaggaaaacctttaaaaatatttggaagagtcctgaagaccaataaataaagacactgcaatacttcatggacaccagagagcaatttaacactgaaatgaaagcacatgttgcacctgaacactgaaaaaagcccatgtgttaagaggaagaagaaatatgcattcactgcaataaatattgaacctttaaaaaacagaaggaacatgaaaactaaaggacatgggccacagcaaataaggtggcggcagccatcccataatgattacatgatctccatgatgtaaaatgtatatgccacctgaatttattcttagaccttctctcaaagatgtctgcatcaacacaggcaataactgcaggtaatagtgaagaatccttcaggcatgatagaggaacaactaagtgtgggaaaaggaagaactaggccgggcgcggtggctcacgcctgtaatcccacactttgggaggccgaggcgggcggatcacgaggtcaggagatcgagaccatcccggctaaacggtgaaaccccgtctctactaaaaatacaaaaaattagccgggcgtagtggcggggcctgtagtcccagctacttgggaggctgaggcaggagaatggcgggaacccgggaggcgagcttgcagtgagccgagatcccgccactgcactccagcctgggcgacagagcgagacccgtctcaaaaaaaaaaaaaaaaaaaaaggaagaactagtcaaaattgctaataaggccggtgcggtggctcatgtctgtaatcccagcactttgggaggctgaggcaggccgatcactaaggtcaggattttgagaccagcctgaccaataggatgaaaccccatctctacccaaatacaaaaattagctgggcgtggtggcatatgcctatagtcccagcgactcgggagggtgggcaggagaattgcttgaacccaggaggtggaggttgcagtgagccgagatcatgcccatgcactccagcctgggcaacagagcgagactccatctcaacaacaacaaacaacaacaaaacagcaaaaactgctaataaaaattttaacgagaatatttcaggaagtgaatgagttggttcatcttcaaatgtgtgaaaaattattcagtgaaaagatgggcagcttagtcttatgtgctctagacactatcatcaggagcattgggtacaaataggaaaacaatcagagcagtaatacagggaatgtgtattctgcagtcaacataattgttggagttgttagagaggttactgtgtgtggagagaagtatgacgaaagtccagtaatgaagagttttgttttgttttagcaagatgactaagtgataagaaattcatttgatgcctgtgtaatggggcattttgctataagtaagctgttataatcagacttttcttgttcatagattggcaaagcatcatattggatacttagattactgacatcttaaaaaattaatcagcctaatatttttaaatgcatttcttttgagtttacttttagttgaattttgagatttgtttcaatcattattggaattttgtagagtcttctgatttccctagggaatgcctttgtgtccaagaacaagaaacataaccaataagaacaatacatccgtagttttcctatattagtagaaactatttaaaggagatgaaaatgaaagaagatcatgaaaaaaataaaactccaaaaatggagctacaaaaccgacttgtaggccaagatcaatgaaagtagaatacggaagtctggaaggaactatacattgtccctgactacgtaacagagaagaaagttgggaagaaaagtgtgggcaacctccccacaagagaccagttaaaagccaggaagaaggctgggcacggtggttcacgcctgtaaacccagcactttggagcccgaggtggacggattgcttgaggtcaggcgtttgagaccagctggccaacatgtgaaacctgattctactaaaattactatatatatatatatagtaatatatatactaattattatagtatacatactctatatataattgctatatataatatatactatatataattacttacatacagtatactatatatatacacacatactatatactatgtatagagacagtatatatatatatacacacacatacacacacacatacatatatatacacacacatattatataatatatataaactgtgcgtggtggctcacgcctgtagtcctagctactcaggaggccgagcaggagaattgcttgaactcaggagccagaggttgcagtgagccaagactgtgccactcactccagcctgggtgacagagtgagactcagtctcaaaaaaaaaaaagtgaaaccccactccactaaaaatacaaaaaaaaaaaatagctgggcttagcagcagacacctgtaatccagctacttgggaggctgaggcaggagaatcgcttgaacctgggaggcggaggttgcagtagcagagattgcaccactgcactccagcccgggggacagagtgagacttcatctcaaaaagaaaaacaacaacagcaacaacagaaaagaagtaactcaaaatgtttcaaagaagtaatcaaaatgtttttctttctttcttcctttttcttctctctttctttctttttctcctcttttttcttctctctctctttctttctttctttttctttctttctttccttcgttctttcttctgtctctctctcttttctattttttttttttgatggagtctcgctctgttgcccagctgaagcgcagtggcgtgaccttggcttactgcaaccactgcctcccgggttcaagtgatctcctgcctcagccttccgagtagctgggactacaggcgtgtgccactacgcccgactattttcgtatttttagtagagatggggtttcaccatattggtcagtctggtcttgaattctgacctcatgatccacccaccttggcctcccaaagtgctgggattacaagcatgagccctgcgcctggcctagcaccttctagttctaattaggctgcatccatgagggtggaagaatgtctctggaaacaagcagtaattaggatgagaaaagttgtgttttatggggttatgcatggtgagctttgtttgatcgtttaatgggggaaaacatggaaactcatgccccctaaaagtttatataatagtatccccgcactgaatttttctaagtcagacttggcccatacaattagagttgatatcctgtgcttttatgttgctttcccagtttctctatttccatcagcagcgatatctttgtagttgctctagagcagagggctcagtcttttcaatcttgtggtcccttacactcttaagaattattgagaaccaccaggaatttttgttaatgtggatgggttatattagctatatttatatattttaagttaaggctaaggaatttaaaaatattcatttattgatcattttaagatagtgatgcacctatttcatgctaacaccaataacttatttttatggaaaaaaacaacaaaatgaaaacagcgctttagttcacatttttgcaaatctctgtaatactggttgaaacggagacagtgggagtctcctcactgcttctgcatttgcagaaccacacccacactcttgggagcatgagaatgagaagggcaagtaacacagagggtcattagataaaggttttgaccttatggactctctgaaaggaataggaagtcctcaggggtcccctgcatcaggcctccctgatcaagggagccaagctccaagggttgctggggagctggaggaggtgaatggggcagagaggccgttgtcaccaaaagcgtgtttaggctccattcacttcaccccagtggcctactgagcccacatggccaccagcgcaactgaagcagaccccgatagaatccttgtagaattattttaggattcacccatcttggcatgcacaagccatttcaattgaagaagttttctaataacaaaacattgtaaacctaagtatgtggcaatagtaatgattaagtaattatggtttcccgaagcccagtgctctgcagccatcagagagtaaaagcgagaatgtgtcagtggagatagcctcaggatatttaaaagcagagagcacaaagtatagaatcgtgttggtatgttatgacctttttttctgtgcttttgaaaaagagaatacacgtatagcaggaaagacacaccaaactactttatataattggttgtttttgtgtttggtaagatgtatgcactaagaggaaggtttcgattttttttttttttttttttttttttttgagacagggctttgcctgtcgcccaggctggagtgcagtggcgcgatctcagctcactgcagcctcgaccgcccggctcaagcgatcctcccacctcagctgtcccagtagctagaactacaggggcgccacccgcctggcgaattttttgtagagatgggttctctccaggtggcccaggctggttctgaatcccgggctcaagggatcttcctgcttcagcttcccaaagtgcggggattaccggcgtggccaccgcgtcccgcctgtttttaatttttagcagttttaaatcttctggcaatgagtatgttatagtgtcccagatgtttggtcctttaagaaaaggatagcaggacgggttatctcgtgggagcgtgttccacctctgccctccgccagccgccctcgccggggatgcacccaggattttcctccggatgcgtgagtggctcgcccgcggacacgccagccccgccccgcgagccggtttccccgccccctccccgcccacgccctgcgctcccttcctattggtcccatgcccgctttcccgttcaatcgcagcgcttagcgccagaatttgaatcttcgttttcgtttgattgggcgggcgcgccgggctggaagaaggaagtggagggctgacgctgcgggcgggcggcgggcgggaggactcgactcggtgggagccgctagagccgggcgcccggggacgtagccgtagggccaccgggtccccgtcagaggcggcggcgggagcagcggggactgcaggccgggtgcagcgaacgcgaccccgcgggctgcggcccggtgtgtgcggagcgtggcgggcgcacttaccgggcggaggtgagcgcggcgccggctcctcctgcggcggactttgggtgcgactgacgagcggtggttcgacaagtggccttgcgggccggatcgtcccaggtgagctgcggcgggactcctgggagctgtccggggtcgagggctgagccgcggggaccccccgagctctcggggacgggcaggggacagacgcgcggcctgggcccgactcctcctgggctctggcgaggcgtctcggtggaagctcccaggaggcgcaggcgctggcgacaacaccccagctgccgactttggggcgccgggggctgcggtcggatcgtcctggggtccccgctagctagctgcgtgtgcgcttctgtggccggggataggtgaattgggcacggggcccttcttagctcctttctatcagagtaactcgcacctcttttgcagtggaagagttgtaaatttgcttctggcctcccctacggattatacctggccttcccctacggattatactcaacttactgtttagaaatgtggcccacgagacgcctggttactatcaaaaggagcggggtcgacggtccccactttccctgagcctcagcacctgcttgtttggaaggtgagccccgcgggcgcgcgcggacgtttagctgagaaagaggaaaataccttagtcacagaataaagtccagaaacgcgctctaggttgggtcctgccgtcacttttccttggtgcttctcccattcgttactaagttgacatagtgtgtttttttgttttgtaagtataaatttgatgctagtttgtatgtttaagtggttttaaaatcaagccaattaaaaaaatcgatttgctaatgttgcggtaaagaaagatgtagatatcttcatatgtcactggctgcaggcaggcgtctgaagacactgtgcgcccccgggtgctccacagtgggcatccctggccactggggacacagagaatgaaggaaggaagccatacattgcctcttggctccttgtggcaataggaaaatgggacagaaagtcttcctgcctggaatcgagaacgtttcctcttatattgctgtcctgtttggtggtggtaataaccctgtcccttataacaggtatagttgctgacagtgccccatcagcctctgacatgtgtcccactagagcctgagaaggggggtcatttcccgtgtggtcatttcccagaccacacgggattcaggcccaccctgtcctcccaaccccatcccggcctcaccctgtcctcccaaccccatcccctacttgttcctcccgcctaaggcattccaagcctttgttcaccttggtacttcttacacactggaagtttacaatgggaaagttctccccttcctcaagcttgtgtgatttccatcattcagcatcaggtgaaatgtcacctctgaggaagccttgcatgaaaacttgtatttccaacccacagcttcaggggtgagttgtgggtttgtctcccactaggctgagctccccaaaggcaagactgtcttgttactaatcacgtgtgtagggccagggatggtgtctggcatagggggtggatcaatacctagcattctggcaagggtcagtagaaacatgggctggagccatggatttcaatctcttgagaacagtggttctcacaggagggtcatctaaccttccaggattcatttaatttccatgtcacaatataggacaggggcatgcgctgtcatcgcggaggagaggtcaggtgggcatcctaccaggctcagggcagcccccacaatacagaagcatctggcccaagattcaacagtgccaaagctcagaaacacccatctatagtcgtcctcctgccaaacaaattccagttgtaagggatagtctttcctttgctctgatgtcctgttaccttaaaatcaaattatttattggggttaaggaagcttttcactttccatagatacctttctcttgaaaaggaaaatataaacatttcatctccagtggcagtccttttgcttttttatacagtactccttgaaatatcttcatgcaagattttataatttagaaataattcctaagtgtttggtcacatgactgggtaggaagagagattcttagactccaaaggttcagatggagaacagacaggccattcatagtttattcaaatttttaagatcacaggctagaacaggaacactgaagactccaagacctactaacaaactcttctgattattagtttgtataggtttaggaattgtctcttctgtactttgccatggtgttagctttctgtggaaaaacaagttgaatttagatttttttttttgtcgcttgcaaattagtatttttattgtttagagacttgaatctgtcagtaaattcaggtagttttaaaacaacaatgaaaagcttacccataatgagcatttactatgtgctaggcaattagtgacatgtacaaccatttaattgaacatcacatgatgtaggttctaatgtaattctttattgtatatgaagaaactgatgcacagaagtgctagcatcaaataagcacatttgggatgattaaacctctaaacatatttaacattacaaacaaacgtttttgaaaaagcacgagtattaaaaatagtcattatccaaaattgatgtaagtattcctttgtgtcttttaagatagcttttcatataaaaggtaattcgatttgtgttctagtgttttcccttgtttttattactctctgttttaaagatctaatagttacatgtttaatacttccaaaagttctttgcaaatgcaagatcgtttacattgcccattttgtttgttactcctttatgtcatatttacagtcaaacattctagtcaaattgtgttttattttgggaaattgaggtaatcttttaaaaagtgcagcaaccaaaaaaaccttcttcttttgcatgaaggggtattgaatgtgacatccgttccagcttcctgttgtgtcaaaacaacattgcaaaattgaaatccatgagcaggaggtggtgggttttttgaagatctacttttaaagctttttagttcacttttaatctgttcattattacatatttccccttcttttcacttgcaggcaatattacataatttcagttccacaaaccaacacaagtaaatgggtctgttattgatgagcctgtacggctaaaacatggagatgtataactattattgatcgttccttcaggtaggtaaaagctgattggtctaacagtaaatgcatcttctgattaaccataaactagtgtcaaagtcaactgtcattcttctttaatgttctggatgtcaaagtatttcaggttttcattctcaacactaatcttaatttaaaaggatatgatctaggaagatgactaattgggacaaaatgtgatggaattcaaggatttgggtgcaataattatgcagagggaggttgaccttgtcctaaaggagtttgttattttcttccaagtgtttgaaactgcatgagatttttctattcttttttattttaaagcaaaatatacacagagaaaaggtacaaaacaagatggacaggtcaatttatcatgtgaacacccttttgatcacccctattatggactgatttgtgctctcccgaaattcatattttgaattcctaacccctcgaccttaggatgtaactgtatttggaaagagggcatttaaaaaggcaatgaaggctttttagctattagtatgggccctaatctgatgattggtgtcattataagtggagattagggaaacgtgcacagaggaaagcccatgagaagaggcagcaagaaggcagccatcttcaagtcaggagagaggcacagagaaatccaatccagctgacaccttgctcttggacttccagcctcagcactgagaagggcatgtctgtttttcaaggcattcagtctgtgggactttattatggggccctagcagactaatacatcctcagctcatatagaacatttccagaagctttttaaaatgctgttgtctaatcactacttcattccctcagcaagtaaaccaccgttttggcttttggatatcataaacgtctcgagtttcactatctaagcatggatctctgaacacgatagtttgtctgttcttataaaagtccttaacagtgatacaagaatgtatacatttgtgcctggctgtgcttttctgtgtgtgagattcatagcatgttggacatctctgtagtttgttccttccatggcataagtatttcactgaaaaaaaaatgtttaatatatacaataatatacataacatacagaattcattcattcttgatggacatttgactaatgtctagtctttgaaatgtgtaaggtttgctttatgagcagatatggctaattatcttactaatctgccttgtgtaattgaaactgtattctacagtgtctcatatatatgtaatatataattatatattatatatatccttatataatatataattataatatattatatataatcatatataattataatatattaaatatataatattatatagtatatactatatgttatatagtaatatataatataataattatattatatataccatatagtatatactgtatacagtatatactatatggtatatatatacatatacaatatatatacaatatatttatattatataatatataatatatacatataaatatgtaatatatatacacatatacagatacacacactcccgttagattcaaatctatatcttagtaaattttcccctactattattctaagagatatgttcaaatcacctactgagattgattgattgatttgtttttatctctatcagtttttgctttgtatattttgaggctgactatggtgtacaaacttagaatgatgtcttggtgcatggaactctgtcatttagagattcctctgtttttagtagtgctttcttttctgcttaatgtttcctttggatgatgagtatgttaaactaatttccttttgatgagtgcttgtgtagtataacttttccacccccttaatttaacttttcataattgttatggtttaagttgtctcttggaacctgttgtcaggtgacccttgtgtttaactggaatatcttcttgctggattgatccttatataaaatgtccttttttctatgaataacttttgtctgagatgattttgtctcatgttagtacagtactccagttccctctgcttgctgtttgcatggtatatcttttcccatgcttttattttaaaagattgtgctttgaatcaaaattgtgtctcttgtagacaacgtattagttgggtcatttaaaaatccttctgctaaatgaatctctgttattgtcttcatttgtattagctgttttttaatgcacccttaaattccctagtcatttcttttactgtgcttctgggaagtttgccttcatttttaagagtatttttattgaatacagacttctatgtaggaagtttttctttttttctttttcttttgtttgtttgtttgtttgtttttgagacagagtcttgctctgtcacccaggctggagtcagtggtgtgatcttggctcactgcaacctccgcctcccgggttcaagtgattctcatgctcagcctaccaagtagctgggattacaggcacgcgccacaacacccggctaatttttgaatttttagtagagacggcgtttcaccatgatggccaggctggtcttgaactcttggtccaagtgatccacctgcttcagcctcccaaaatgctgagattacaggcatgagccactgccccggcctataggtaggaagcttttgatgtttattggagggctgaactatttttcaaaaaagatattatccaaattgagataaattcagatgattaaagacatccaacaaagatttgaagtgaatcttagaaagagagacttgattccaaactctctaccatgagaaataatatcagtgtgtgactgcttcagatcttacttaggttgcctataaattcaaatcaggtcatttcacgaggccaaaagttttcattatgcaaaataaaggattgcttctatgacttgatcactgagtttgccaggacaattatgtatcttgctaaaggtgatcttcttaagatgtacctgtcttgtcagatacagactgaatgtgtgggaaactgaagtgatcatagtgttctaaaatataggttgtagttaccctgtagtgtaagtgtagctttttatttaccctgaagtatgtaacttcacacgtgagaaagattcagttacctacaggcttcctggctggccttccaagccatccgatgtttccatggacttaaactagaagaaacttgactttgctctcatgtgcattagcttatgtatagaaggtgcttggtaatattgtcaaatcatacctgggctgttcgtcagtgatcagaattaatctgggtccccagcctctgacagtggtatttcaaaacaaactcgatgcaactaatctagtttttagtgtaaaagcacttttctaactctaaatttatttctttgtataaggtgagtcttgaactaaacccaaagtttgttcgttgatccttggacattaagtggatatggagattccgccccagggtataaatttttaatcaggatctttgtcgttctataaactgcaggtagaaaatgaaagtcttcagagtggaaggaagtcaactgaatttccaagaaaaatacgtgacaggtgatagaaaatatccaagtttgggctgattcgtttcgatgatatgaaatcatttagtatgctttaatgatttcttacttgaaatcagttacaaagagggtggttactgttatagaggaaaatgtaactaaagtataaaaacgagttgaacttagacgtattaaaataatctaaatgatatttcctctttattgttcaaaatcagagcactaagttggtcttacacttttagcaaaaagtctattagagcatgttgcgagctttttgcaaacccatgattaggataaccccacacgtagagctaacatttgggaattgcattatctggtggctcattttgtcgcccagtcatgtactcatccgtctttatgtgtctgaaataatcacattatgaaaatcatgagtgccaagatgcttctctattttgatagatagacgacccatgaaacaggaaaagggatcctgtgcttgtcttgtgagagaatcctatagtttgagtgtatcagtgtggaacaggtattccaattgacagcttatgaaaacataattgtcgacacgtgcttcgcaatttagatagtttgagtatacagtgtggaagaggtattttagttgtacagcttattaaaacacagttgtcggcatgtgctggaaatttagtgggatttaggcttaggatgagccctgagaattcatatttttcctacatttagagtgctcctaaagctagtttcagatgagctccttggaatatcttggcttaggaggttatcttaggtgcacctgaaattagcagtaggtactcttgaatttcaacatttctgccttttttttttttttttttctgagacggagtctcactccgtcacccaggctggagtgcagggtgcgatcttggctcactgcaacctccgcctcctgggttcaagcaattctcctgcctcgcctcccgagtagctgggactacaggtgcacaccaccatgcctggctaatttttgtattttagtagagacagggtttcaccatattgaccaggctggtcttgaactcctaacctcgtgtccacccacctgggcctcccaaagtgctgggattacaggcttgagccaccatgcccagtcatttctgccatttaagtactgccttcttccctagaggagcagccttaatgttgaatctatggtcatcagttcccgtgctggaagccagtttctgaggcatcccacactgtagccaccggcaacttgctagtctatgggagtaaataaaccaaaaagccagttgaactgtgggttagtatgtgccactcagcagtctaggaactgtttgttctgttactggtctgtgatatagtgatactgaaatggagtatgtagtaaatatgacagcaattcgacagcaattttgtggctattaatgtaatcgtacaacaaaagtgagattatatactttacatattcataattttattagtgttcatttatattgtttagtcataagattcttgttccacttcagattggaaataaaaaacatccctcacatagatagttttagaagcaaggtgttacgtatcaagaaacctaaaattgttaaggaagttagattctttgcctttgttaatattttttagatattttcttaataatccgatgataagcttttcttcctttggggcatcagacttttataaaagttatatatatatgtattctttagttcttccacccttccggaaataattccatatgaaggaaagttagggcgcttctctggggagccaggtgggggcgctgcgcctgctcccaggctgtgaggttgcagaatcgtgaatataccatgtgtgcctgtaccatgaatttacctagggtgaatctaggctctcagtccaccctaagtatccaccagccaagagggcgcacatgccaagtggagcctcagttcatgacaggtcctatggcccatttgtgagaaaactgatgacgcagtcagtagttctgagctctggggggttacagatcttcagtataggtgatgtttaatattgactttggttcttccgcataggatgttgggaaatatctttaaaggaagttataaaaacacaccgaggtttgattttataattttaagcctcgaatttgtttcctattaatcactcactattttttaatgagtcagcaataagtacttttatcctgaccactagctcccaactgacttgagctcatttctcaaacatctttaaaagtcatatacgagtggtttggtaaagaaaacaattttttattgtttttattttattttttgagacagagtctcgctttattgcccaggctagagtgcagtggtgcaatcttgctcactgcaacctctgcctcccgggttccagcaattctcctgcctcggccacctgagagctgggactacaggcacctgccaccacatccagctaatgtttgtatttgcagtagagagaggttacatcatgttggccaggctgttctcaaactcctgacctcaagtgatccgcccacttggcctcccaaagtgctgggattacaggcatgagccatcatgcccagccagaaaacataaataatattttcactgttgtgactgtcatcatttagaaagacctgcaaataactgttttattttcccaacttacaggagccagcacgtcgtgtctcaagatctagcttctcttctgccctggtgagtagtggttgggttttgttccagaatcctgaaagatcaggtctttgcgaacatattggcaaagaaggggcaacaagaatgcaagtgctaaatgtctagcctgtcagaaaggaggaggtgtcatttaacatgtcaacgacagacagatgcctaactttcccttggtgacgatggtatgctatgcttaggagagactctagatatgagaaaattgcctgttcagctgtcactcagttctcagtagttagatagcatgtgctatttcatactggttattggagctgatagatttatatatttgtatcataatactagtatcataagacttgcaagttttaggcattaataatttgtaggccaagtaaaagctagcttataagacaacctgaaacaattaaaatattgattccacaaatgttaatcattgagaaaatgctgaacttctgtttcttatttcataattcttgccaagatgagaaagctcaagattccaaggcctattcaaaaatcactgaaggaaaagttcaggaaatcctcaggtacatatcaagaatgtcaaagaagacagtaccgcagatgactaaaagacagtgttgctcagggaacaactaatgttcattcctcagaacatgctggacgtatggcagaaatgcagctgatcccatttctggggattttaaagaaatttccagcgttaaatagtgagccgttatggagaattgaagtctgttcccactacacaatgtcttgacaatagcaaaaaaatgaatctcccttttggaagctttatgagtcagtgaagaaagagttggatgtaaatcacaaaaagaaaatgtcctacagtattgtagaaaatctggattacaaactgattacgaacagagaaagaaagtgctgatggtttacagggggagacccaactgttggtctcgcgtagtcaagaccaaaatctggtgggagcggccacgctgtggcagagcctgcttcacctgaacagagcttgaccagaacaaggggaagggaagagacgtggagtctgttcagactcccagcaggctgtgggcgccagctttcctctctatgagccggctaaaatgaagacccctgtacaatttcacagcaacaaaattctccacaaaaacataagaacaaagacctgtatactactggtaaagagaatctgtgaatctgggtaaaagtgaaggcttcaaggctggtgataaaactcttatcccaggaagctttcaactagaaatcgaacaccagctaaagttgaagatgcagctgacttgccactaagccagaaaatctctcttccaaaaccagaggaagtattcctacagatgtggagttctgcctacggaaactgaaattcacaatgagccatttttaactctgtggctcactcagttgagaggaagatccaaaaggattccctcagcaagcctgagaaattgggcactacagtggacagatgtgctctgggttacctggtcttagttcagttgatatcaacaactttggtgttccattagtaagtttatttaattgtaaatttatttttctaaaagatgaacaccttctagtagctgtgagaccttcattctttcagtagtgattagctttgtggaagagaatgtaagccataaggcacagggataagacagacacgcacgctgttttcgctaatagatgaatactgaggcctaggtaattgtaacaaggaatgacagaagagatggaagttgtcaggcaatcatgagcaggggttattgaaggagatagggtggccccaaaaatatttgattctcctccatctatacaaaatagaaaagagaataatcataattgcttttcacatggagtttaattctgaactaaatcaactgtatcatatgagtttggtcatgtggaataaatcactggtaatcattaaacaagcggtagttctcaggtgttgatactctgttttcagagtgtcctacaaacaatttgctgaaacactggactgtacccatgagtccatatgccacatgaacacttgatccttggtgcaaagcagtgcccgtggctaggttgtctttttagagctatgtcacacatgaggaaacgcacacccaaggccagtcaggaagtggcagaggtaggacctttatagcaggtgtggtagctcctgggagcttcctacactcctagggactggctattagaagaaaagttgtctgggccacagagcagtattcgtactccaggctgtgtttctgcaggtggcctatagcggtggggcatgaggtgtcgataaaataaggtttgtaacatcagtctcagtattccaccaagcttcctagtgggaagcatcacttaggcaagggatttacattaactggtggctcaggaaaatgtgtggccggactgggctcctgtgaattgactcagaaccacctggaggagtttttacagctcatgcatttggtcactgggtggctcaggctgagacccaagtgcatgtctttagagagttctctggcttcgtccccctactctaaggtgaaatctgctgctgcagactcctcctttctatgtccacaataatgtttcaatgttttaaagaaagcctctgtactgtccagtggcaacttgacgtcttgtggccactcccgcaatcctttaggaactcttagtagcttagcttcaccaggattgcaaaatagaggcgtgctgtaggtactgtgtttcgatgacttttcacttggtttgtctttaatctaacgtgaaataaatcactagtcttggtatgttttttcattgctctttccacatttgttccgttactttagatgagagtgacggaatacctttgaaaagaaggcgtgtgtcctttgggggcacctaagacctgaactatttgatgaaaacttgcctcctaatacgcctctcaaaagggagaagccccaaccaaaagaaagtctctggtaatgcacactccacctgtcctgaagaaatcatcaaggtgagttgaacaagcagcatcccattcacgcccagtggctcacacaccggtacctattcctttccaaatactgacacaagtagaattatgatgaagacctttatttattattaaagaaacaagtttttaaaaagacgaatgaaagctcattgatgtgggcaccagcaaggagcccctgggtccctgaccgtggtgctgatgcgaccgagtcgggggagtccttgatgtgtccttttcgtgcagaagttcccagacacccacgcttacagcactgcgtaatcacctgaggcaccgtcagaatagccaattacaaagattctggatacattaccacgtcgacccataggattgttttattttcttttagagttacaaggctatagttaaggcatttacctggtgtgaggaaaatcaatggcacatcttccttttacaccttcagctctttagaatatttgcttgctgttcctttgctgtgttgtccttcctgggtttcacacctctgggaagtcatggccctatgctcataacctttgtaatagggcctgggcggtctttctttccttctcttcccagcaggatggaaagtgatgtctggctccctttccattttacactggctcccaggggcaagcagtccccctccatgtggactgccgggggctgggtgctcacagctggtatttactgggactgagacagaccctgcttgtctttcactgatcaggatgttccttccacctttttacctgaaatgactcacttcagacttggcttgcttctctttccttttccttaaatgactgagacagtctcactctaccatagtcttcaaagacagtggcttaagcatttgatgcttcaagatttaaacagtgaaattcttaactgaataggtttttatcagtcattccagagatgttagatccttgttaggcttcttgtaaacaattttgtcttgtcaggaacagcctcaaccatcaggaaaacaagatcaggttcagaaatccatgtggaagtgaaggcacaaagcttggttataagccctccagccctagtcctaggaaaactccagttgccagtgatcaacgccgtaggtcctgcaaaacagccctgcttccagcagcaaatctcagacagaggttcctaagagaggagggagaaagagtggaacctgccttcaaagagagtgtctatcagccgaagtcaacatgatattttacagatgattgttccaaaagaagaagtggtgcttcggaagcaaatctgattggttagtctgacattagatacatatattaaggtgaattttttcatgaatgctaatttttgaaaagtttcgtcttttcctttgacagttgcaaaatcatgggcagatgtagtaaaacttggtgcaaaacaaacacaactaaagtcataaaacatggtcctcaaaggtcaatgaacaaaaggcaaagaagacctgcactccaaaggtaggggcctcactgaatggctgctttacacataccggtgtcatcgaagctgcattcagtgtggatttatgctttaatgtcctgtttacctccttcctgttttctacagagcctgtgggcgaagttcacagtcaatttagtacaggccacgcaaactctccttgtacctaataatagggaaagctcatactgaaaaagtacatgtgcctgctcgaccctacagagtgtcaacaacttcatttccaaccaaaaaatggactttaaggaagatctttcaggtaaaaactagtcttagatcttataaatcttttgactctactgttttttactgtgttaatgtttgtttgctaactttgtttatctgctgtgaaagagattataaaataaacgactcaatcaccctttggggtcttagtgttcagggaagataaagctgttttggcttgcaaagacaagtctctgcaatttttgggatcacatgtcctgcatgaaataggtgtggaaatgtcaaatgcatgtcttaccctggagagcagcgtatacatagaaagctggaaggtgctttacagtgaagagagttacttgttaatctgcaggtacaataatagtttatcccaggtgtgggccagttgttgttgagaacattttgcttcttcaggattgactttctaggtagcttaactttcttgaaagaaagcctatgagaagattcccataaacgattgttgaagaaatatttccattcaattcccactctcgtaaattgtggcctgacttgtgtaatttaaagtggggatggccggcgcagtggctcacgctgtaatcccaacactttgggaggctgaggcctcctatcattccaaacagaatgataatatattagattttcaaaaatatatattattacttgacagtactaaaaatgggcagctcttgtcattttctaaaatgtgggtacgtgttatttgtacttaaaatctagaactgagcacccagactttgagaagcatgaaggcatttggcctctagatcctagcagggaggcctatgggttcaggagcccgtcaccagcctccgtgctccagagctcacgtgtggggtcttgttaggagacccagaggtcagctaacttcatttgtttcctttccaagaaaagcaaagcgaagagcatacatatcttctctttgctctcttttttacaaaatgagtacattattaatggaatcactcttttatgaggcctatgtaccaggatttcaagggaggaatctactgttatttcccaccattgcacgttacatgtgagggctgggatggttgtctgcatgttagcaatatgtcaatcactttcaaatattttcatttaacaggaatagctgaaatgttcaagaccccagtgaaggagcaccgcagttgacaagcacatgtcacatcgctatttcaaattcagagaatttgcttggaaacagtttcaaggaactgattcaggagaagaacctctgctccccacctcagagagttttggtggtttccttgtttcctaacactgtgatgttttgggataggaacatacagtattattttttacaagcagtatgatattacttctctaaaacaaatgttcctggcacaaaataccatttcgtcttctctgttctaattgaaagggagatttcaatcagcagttgaactaacattggcatcattgacttatatagaaagaaagactccgttaatgtgtgtaaatgacctgtgtacactttggcttctttattgtaagtaaccagggtgacatagcaaaaaaatacaatggtgtctcacatatttacatataaattactcatattcaaaattactgccaattacaaaacagaaagatacagtttgtatactgtgcaattattcctgctaaccttttaggtgggagcaggcccggggaagtgtgagatgggagatgagaatctgtctaatctctcatttggcactggtcactgtatcctgtcacagagggaacagcttgctaccctgaagatgtttgcggtaggtaaatatttccgtgtaatatggaccctaaccacataaggataatccatgttattttattggcgatttaagcaagaaacagctgtttgtttctaatgtttgaaggaaaaaatgcctatatttacgtcaatacacagggcatggcaacctttggaggaaccttctgaagcagtatttttaccttctatgacatttcagcatctaactttgcttaatgatgaccccactatagcaccaaataacattattttaattgtgcatggctcttataagacagatttatagacacataagtagcctcatgtcgtcagtgaatacgaagctaaatatttagttttttaccatattttatgaggctgtaatactcattgacatgagacactaatagaatgtttttattgtgtatgtttttatttcaggaggaaagtgttcttcagtgcacagaatgcagcaaaacagccatctgataaatgctctgcaagccccccttaagacggcagtgtattagagaaaatggaaacgtagcaaaaacgcccaggaacactacaaaatgacttctctggagacaaaaacttcagatactgagacagagccttcaaaaacgtatccactgcaaacaggtcaggaaggtctacagagttcaggaatatacagaagctaccgtggaaagtaagagtgaagaaacaaatacagaaattgttgagtgcatcctaaaaagaggcagaaggcaacactactacaacaaaggagagaaggagagatgaaggaaatagaaagacctttgagacatataaggaaaatattgaattaaaagaaaacgatgaaaagatgaaagcaataagagatcaagaacttgggggcagaaatgtgcaccaatgtctgacctgacagacctcaaagcttgcctgatacagaactcatgaaagacacggcacgtggccagaatctcctccaaaccaagatcatgccaaggcaccaaagagtgagaaaggcaaaatcactaaaatgccctgccatcattacaaccagaaccaataaacaccccaacacacacaaaacaacagttgaaggcatcctggggaaagtaggtgtgaaagaagagctcctagcagtcggcaagttcacacggacgtcggggagaccacgcacacgcacagagagccagcaggagatggcaagagcatcagaacgttaaggagtctccaaagcagatcctggacccagcagcccgtgtaactggaatgaagaagtgccaagaacgcctaaggaagaggcccagtcactagaagacctggctggcttcaaagagctttccagacaccaggtccctctgaggaatcaatgactgatgagaaaactaccaaaatagctgcaaatctccaccaccagaatcagtggacactccaacaagcacaaagcaatggcctaaagaagtctcaggaaagcagatgtagaggaagaattcttagcactcaggaaactaacacctcagcagggaaagccatgcttacgcccaaaccagcaggaggtgatgagaaagacattaagcatttatgggaactccagtgcagaaactggacctggcaggaactttacctggcagcaaagacagctacagactcctaaggaaaaggcccaggctctagaagacctggctggctttaagagctcttccagactcctggtcacaccgaggaattagtggctgctggtaaaaccactaaataccctgcgactctccacagtcagacccagtggacaccccaacaagcacaaagcaacgcccaagagaagtatcaggaaagcagatgtagagggagaactcttagcgtgcaggaatctatgccatcagcaggcaaagccatgcacacgcctaaaccatcagtaggtgaagagaaagaatcatcatatttgtgggaactccagtgcagaaactggacctgacagagaacttaaccggagcaagagacggccacaaactcctaaggaagaggcccaggctctggaagacctgactggtttaaagagctcttccagacccctggtcatactgaagaagcagtggctgctggcaaaacactaaaatgccctgcgaatcttctccaccagaatcagcagacaccccaacaagcacaagaggcagcccaagacacctttggagaaaagggacgtacagaaggagctctcagccctgaaaagctcacacagacatcaggggaaaccacacacacagataaagtaccaggaggtgaggaaaaagcatcaacgcgtttagggaaactgcaaaacagaaactggacccagcagcaagtgtactggtagcaagaggcacccaaaaactaaggaaaaggcccaacccctagaagacctggcggcttgaaagagctcttccagacaccagtatgcactgacaagcccacgactcacgagaaactaccaaaatagcctgcagatcacaaccagacccagtggacacaccaacaagctccaaccacagtccaagagaagtctcaggaaagtggacgtagaagaagaattcttcgcactcagaaacgaacaccatcagcaggcaaagccatgcacacacccaaaccagcagtaagtggtgaaaaaacatctacgcatttatgggaactccagtgcagaaactggacctgacagagaacttactggcagcaagagacggctacaaactcctaaggaaaaggcccaggctctagaagacctgctggctttaaagagctcttccagacacgaggtcacactgaggaatcaatgactaacgaaaaactgccaaagtagcctgcaaatcttcacaaccagacccagacaaaaacccagcaagtccaagcgacggctcaagacatccctggggaaagtgggcgtgaaagaagagctcctagcgttggcaagctcacacagacatcaggagagactacacacacacacacagagccaacagggatggtaagagcatgaaagcatttatggagtctccaaagcagatcttagactcagcagcagtctaactggcagcaagaggcagctgagaactcctaagggaaagtctgaagtccctgagacctggccggcttcatcgagctcttccagacaccaagtcacactaaggaatcaatgacaacgaaaaaactaccaaagtatcctacagagcttcacagccagacctagtggacaccccacaagctccaagccacagcccaagagaagtctcaggaaagcagacactgaagaagaattttagcatttaggaaacaaacgccatcagcaggcaaagccatgcacacacccaaaccagcgtaggtgaagagaaagacatcaacacgtttttgggaactccagtgcagaaactggaccaccaggaaatttacctggcagcaatagacggctacaaactcgtaaggaaaaggcccaggcctagaagaactgactggcttcagagagcttttccagacaccatgcactgataaccccacactgatgagaaaactaccaaaaaaatactctgcaaatctccgcaatcagacccagcggaaccccaacaaacacaaagcaacggcccaagagaagcctcaagaaagcagacgtagaggagaatttttagcattcaggaaactaacaccatcagcaggcaaagccatgcacacgcctaagcagcagtaggtgaagagaaagacatcaacacatttgtggggactccagtggagaaactgacctgctaggaaatttacctggcagcaagagacggccacaaactcctaaagaaaaggcaaggctctagaagatctggctggcttcaaagagctcttccagacaccaggtcacactgagaatcaatgaccgatgacaaaatcacagaagtatcctgcaaatctccacaaccagacccgtcaaaaccccaacaagctccaagcaacgactcaagatatccttggggaaagtaggtgtaaagaagaggtcctaccagtcggcaagctcacacagacgtcagggaagaccacacagaccacagagagacagcaggagatggaaagagcatcaaagcgtttaaggaatctgcaaagcaatgctggacccagcaaactatggaactgggatggagaggtggccaagaacacctaaggagaggcccaatcactagaagacctggccggcttcaaagagctcttccagacaccagaccaactgaggaatcaacaactgatgacaaaactaccaaaatagcctgcaaatctccaccaccgaatcaatggacactccaacaagcacaaggaggcggcccaaaacacctttggggaaaaggatatagtggaagagctctcagccctgaagcagctcacacagaccacacacacagacaagtaccaggagatgaggataaaggcatcaacgtgttcagggaaactgcaaaacagaaactgacccagcagcaagtgtaactggtagcaagaggcagccaagaactcctaagggaaaagccaacccctagaagacttggctggcttgaaagagctcttccagacaccaatatgcactgaaagcccacgactcatgagaaaactaccaaaatagcctgcagatctccacaaccagacccgtgggtaccccaacaatcttcaagccacagtccaagagaagtctcaggaaagcagacgtgaggaagaatccttagcactcaggaaacgaacaccatcagtagggaaagctatggacaccccaaaccagcaggaggtgatgagaaagacatgaaagcatttatgggaactccagtgcaaaattggacctgccaggaaatttacctggcagcaaaagatggccacaaactcctaaggaaaggcccaggctctagaagacctggctggcttcaaagagctcttccagacaccaggcacgacaagcccacgactgatgagaaaactaccaaaatagcctgcaaatctccacaaccagaccagtggacaccccagcaagcacaaagcaacggcccaagagaagcctcaggaaagcagagtagaggaagaatttttagcactcaggaaacgaacaccatcagcaggcaaagccatggaacaccaaaaccagcagtaagtgatgagaaaaatatcaacacatttgtggaaactccagtcagaaactggacctgctaggaaatttacctggcagcaagagacagccacagactcctaagaaaaggctgaggctctagaggacctggttggcttcaaagaactcttccagacaccaggcacactgaggaatcaatgactgatgacaaaatcacagaagtatcctgtaaatctccacaccagagtcattcaaaacctcaagaagctccaagcaaaggctcaagatacccctggtgaagtggacatgaaagaagagcccctagcagtcagcaagctcacacggacatcaggggagacacgcaaacacacacagagccaacaggagatagtaagagcatcaaagcgtttaaggagtcccaaagcagatcctggacccagcagcaagtgtaactggtagcaggaggcagctgagaaccgtaaggaaaaggcccgtgctctagaagacctggttgacttcaaagagctcttctcagcccaggtcacactgaagagtcaatgactattgacaaaaacacaaaaattccctgcaaatccccccaccagaactaacagacactgccacgagcacaaagagatgccccaagacacgtccaggaaagaagtaaaagaggagctctcagcagttgagaggctcacgcaaacatcagggcaagcacacacacacacaaagaaccagcaagcggtgatgagggcatcaaagtattgaagcacgtgcaaagaagaaaccaaacccagtagaagaggaacccagcaggagaaggccaagagccctaaggaaaaggcccaacccctggaagacctggccggcttcacagagctctctgaaactcaggtcacactcaggaatcactgactgctggcaaagccactaaaataccctgcgaatccccccactagaagtggtagacaccacagcaagcacaaagaggcatctcaggacacgtgtcagaaggtacaagtaaaagaagagccttcagcagtcaagttcacacaaacatcaggggaaccacggatgcagacaaagaaccagcaggtgaagataaaggcatcaaagcattgaaggatctgcaaaacagacaccggctccagcagcaagtgtaactggcagcaggagacggccaaggcacccagggaaagtgcccaagccatagaagacctagctggcttcaaagacccagcagcggtcacactgaagaatcaatgactgatgacaaaaccactaaaataccctgcaaatcatcccagaactagaagacaccgcaacaagctcaaagagacggcccaggacacgtgcccagaagtagaagtgaaggaggagctgttagcagttggcaagctcacacaaacctcaggggagacacgcacaccgacaaagagccggtaggtgagggcaaaggcacgaaagcatttaagcaaccgcaaagcggaagctggacgcagaagatgtaattggcagcaggagacagccaagagcaccaaggaaaaggcccaacccctggaagatctggccagcttccaagagctctctcaaacaccggccacactgaggaactggcaaatggtgctgctgatagctttacaagcgctccaaagcaacacctgacagtggaaaacctctaaaaatatccagaagagttcttcgggcccctaaagtgaacccgtgggagacgtggtaagcaccagagaccctgtaaaatcacaaagcaaaagcaaacttccctgcccccactgcccttcaagaggggaggtggcaaagatggaagcgtcacgggaccaagaggctgcgctgcatgccagcaccagaggaaattgtggaggagctgccagccagaagaagcagagggttgctcccagggcaagaggcaaatcatccgaacccgtggtcatcataagagaagtttgaggacttctgcaaaaagaattgaacctgcggaagagctgaacagcaagacatgaaaaccaacaaagaggaacacaaattacaagactcggtccctgaaaataaggtagaggaagtattacagcatcactcaatatcgtcttggatagttgtgaatttctgtgttaactttgcatgtaacctgacgttataagtggttatcctttccccagagggtttcctttaaactgaataactgcaggccatggtaaagaatcttcttgggacctatagagggaatagactatatgggaaaagaactagtcaaacatgattaatgcaaacttagaagagtttctcaaaagcaaatgagtaatgttcatcttcaaatgtttaaaaaattgatcagaggataggtgggtggtcagttctatgttctggatactgtcaccaagaccaggactgggttaaaaatcctatctagtcactattttaactatcagaacaatatcaataaggaatgtgtattcttgagaaggggaactgtctggactgttagatagagaggctcccactgcatgcagagaagtttggggaaactcagaaatggcaatttcctgttctgccttagcagtgatggttaaaggaataggaattcattactccctgtaaatgaatgaataacggaccttctttctataatgtaaactgtaaaaattgatttgatatatatcttattaggcattgttattgaaatttatcctgaattccttatttaaatttgtcagcagagacagtcatttctccataggagcaaagtaccaaggcattaccttgctatcctagatgacaagtctcttagacaattcatcagtgtgtgattttcaaatgatttcccttttaggttactgttgattgtgctccctgttgaattttgaagtttgttttactaattttggaattttgtggatgtcttctcatttctttagggaatatccctgcgctccagacgccaaataagactgaggcagaacagcaaataactgaggtctttgtattagcagaaagaatagaataaacagaaatgaaaagaagcccatgaagacctccccagagatggacattcagaatcagatgatggagcccggaaacccatacctagagacaaagtcagtgagaacaaaaggtgctgaggtctgctagacagaatgagagctcccagcctaaggtggcagaggagagcggagggcgaagagtgcgaaggttctcatgcagaatcagaaagggaaaggagaagcaggaaattcagctccatgtgcctgagatcaagaaagacaaaaagccagcctgcagcaagcactttggagacgaatctgtgcagagagtaacgcggagtgtcaagagatgtgcagaaaatccaaagaaggaagccatttactgtttccctgttttaaaagacacagaatgttttgatgtattttttgccaaggttgcaaaggcaaacaaaaagcattatcttcaacagcactctgccagctcccagttcattaatggaaggagcattatgctaagacataaatttggtcattttagttatattttgtgtgtctactttgggaatttcacttcaaatagcaaattcacgttatgaagactttcttcaaaagaaaaggaatttgtctagtggctaatttctgactgcttatgatgtacctcatgataaattgtaggtagatgtcttcagcctttctgtagttcaaaatcacctcttgaaacaggaaattctttttccaaaaaaaactattgaaacagaaaaatttccaaggcattctttggaaagcagaaggaacagaagttgggatgtccctgagacacatgctcactatgtgagagttcctgtcagtgggggatgcgtctgccctccaaccctcctccagccagagactatctaagctaataactttaagtgctactgaaatcacatcaagttgagccactcataattacaagcatgtggcaaatccataagaatgattagattccattggtgttcttctggggaatacttggtttagcaaaataaaaataggttgaattgctccctttttgtgagcaattcacaaaaatataatataatttaattcttagcacacacaaaatttggacctaaaactaccatattctgagttcagcaacgaaactcatgtagcaataacctcttcagatacagaattctggcaagtacagctgtccgacagaccctcttcggcacaaactaggaagcttcaactgccaagaaaaggaaagattccaggtgtccccagtacctgctgcatagccaggcagccagtggagggggagggcttgtgtgctggatggtgggcaggaagtcctagtggggagatgcccatagactgttccagagagggagaggagaggctcaagaagggcactgatgcccacacaggtgtcctaagtcagagactgtattctggggcaggctggaagcagaagacacccgacagtgccagacaaggtcctagaaacccaggcacaccagggacgcaacagctgacgtgggtcagcacgttcacccgtcgagtcttaaataaaacgcaggctccaggcgcttaccgaattcacagtctggaaggtgctgcttcctcgaatgaaaccaaagaagggtgaaagcgaatcttttaactaggatgattcctaaacacaggcaaccaggcccaaggctgagccaggcctggtgtgttctgccgggggcgttccagcctctctcacacacaagcacccaggagacgcccaacacacacatgctcctctttgccgagctctcggtgggtgtcggtagtcctagaaaatgcatatataagatagattttttccagtaagagcttgtagccatgcttttcaccatggttcctctcccttagccaaggggtgagaactactcaagagtaaaggccaaggcaggtcccctgcatgcaagttgggcatgcttctgtctacagggttccttggtttaggagacccaaaagacttaatcctggttggattcactttttctgaggacattttttagtttgtgaaaatgtgtgcatcgatgaagaaattttattatgaattagctaaaaatgcattaggaacttctgtatgaaaagatcacattatttaagtgtaaaaaaactcataataaaagcagttcaagtcaagaaaaacaatgttaatggaatatattttaaaactttttccaacctcaaaattaattttctgcaactaaggacctgcataatacctagtaagccttggggttttgcagaggaggtcgattctaaaaatgggtgtttaaattacttaagagttctttttttttcttcccacacaggctgaggacaatgtgtgtgtcaagaaaataagaaccagagtcatagggacagtgaagatatttgacagaaaaatcgaactgggaaaaatataataaagtagttttgtgataagttctagtgcagtttttgtcataaattacaagtgaattctgtaagaaggctgtcagtctgcttaagggaagaaaactttggatttgctgggtctgaatcggcttataaactccactgggagcactgctgggctcctggactgagaatagttgaacaccgggggtttgtgaaggagtctgggccaaggtttgccctcagctttgcagaatgaagccttgaggttgtcaccacccacagccaccctacagcagccttaactgtgacacttgccacactgtgtctcgtttgtttgcctatgtcctccagggcacggtggcaggaacaactatcctcgtctgtccaacactgagcaggcactcggtaaacacgaatgaatggatgagcgcacggatgaatggacttacaagatctgtctttccaatggccgggggcatttggtccccaaattaaggctattgacatctgcacaggacagtcctatttttgatgtcctttcctttctgaaaataaagttttggctttggagaatgactcgtgagcacatctttagggaccaagagtgactttctgtaaggatgactcgtggcttgccttggtctcttgggaatacttttctaactagggttgctctcaccgagacattctccacccgcggaatctcagggtcccaggctgtgggccatcacgacctcaactggctcctaatctccagctttcctgtcattgaaagcttcggaagtttactggctctgccccgcctgttttctttctgactctatctggcagcccgatgccacccagtacaggaagtgcaccagtactctgtaaagcatcatcatccttggagagactgagcactcagcaccttcagcacgatttcaggatcgcttccttgtgagccgctgcctccgaaatctcctttgaagcccaacatctttctccagcttcagacttgtagatataactcgttcatcttcatttactttccatttgccccctgtcctctctgtgttccccaaatcagagaatagcccgccatcccccaggtacctgtctggattcctccccattcacccaccttgccaggtgcaggtgaggatggtgcacagacagggtagctgtcccccaaaatgtgccctgtgcgggcagtgccctgtctccacgttgtttccccagtgtctggcggggagccaggtgacatcataaatacttgctgaatgaatgcgaaatcagcggtactgacttgtactatattggctgccatgatagggttctcacagcgtctccatgatcgtaagggagaatgacattctgcttgagggagggaatagaaaggggcagggggggacatctgagggcttcacagggctgcaaagggtacagggattgcaccagggcagaaaggggagggtgttcaaggaagagtggctcttagcagaggcactttggaaggtgtgaggctaaatgcttccttctacgtaggccaacctcaaaactttcagtaggaatgttgctatgataagttgttctaacactttagacttagtagtaattatgaacctcacatagaaaaatttcaccagccatatgcctgtggagtggaatattctgtttagtagaaaaatcctttagagttcactctaaccagaaatcttgctgaagtatgtcagcaccttttctcaccctggtaagtacagatttcaagagcacgctaagggtggttttcattttacagggctgttgatgatgggttaaaatgttcatttaagggctacccccgtgtttaatagatgaacaccacttctacacaaccctcttggtactgggggagggagagatctgacaaatactgcccattcccctaggctgactggtttgagaacaaatacccacccatttccaccatggtatggtaacttctctgagcttcagttccaagtgaatttccatgtaataggacattcccattaaatacaagctgtttttacttttcgcctcccagggcctgtgggatctggtcccccagcctctcttgggctttcttacactaatctgtacctaccatctcctgcctcccttaggcaggcacctccaaccaccacacactcccgctgttttccctgcctggaactttccctcctgccccaccaagatcatttcatccagtccgagctcagcttaagggaggcttcttgcctgtgggttccctcacccccatgcctgtcctcaggctggggcaggttcttagtttgcctggaattgttctgtacctctttgtagcacgtaggttgtggaaactaagccactaattgagtttctggctcccctcctggggttgtaagttttttcattcatgagggccgactgtatttcctggttactgtatcccagtgaccagccacagggatgtccaataaagtatgtgatgaaatggtcttaaaacccatggtatttttattataggagagtggggaaagaaactaagtgtgggtggggcagacaggccagtgtaagagagactggtcattacgttccattttcatttctacaaggacttggctggatggtcattttctctcttgccaataagtcatcgcagctgcttttagtcctgcaggaatggcctgctgtatctcgagaatacctgcaaccgcagctgtgcctgctttgttgcaacagaggtgctgagttgagggatgggatttgacccagggctgccccaagtcagcagatgaaaatacatgccctgactttcctctgcaaccctgatttgacatggatcccgggagtgaatttgctggcaagttccaggggcagtgcctgcggtaggtcagttagtcctgaagaagaggcctttctgtcggagagaaaagtttgaggtgggtgcatctaccatcttgagaggctgaggagggagggagagccgtgctcggtggcagtctggtgaaggaagtgggttcagtctgcagcccacatcctgggctgtcatcaagaataacatggcaaacggcgactccataaagtaaactgtagctacttaactaaatgatttcggtggctgagatcctactgtttgctgggtttcctggaaaagtcctctagatgaactgcagaatctcctggcactctggttacagctggagaaactgatttctgtgctgtccaggtgctccagacccccaaggcatctccaggacacagtcaccaaacccccatcctggtattactggcttgagtgccacgtaggcacacagcactccataatttggaaatgtggatttcattgctatgctcttcatgagggaacaaataatatccatgatgtattggcaggaagccacgccccccccccccgctgccacccccacagcgcgcacagtgatttcaggaaggaggtttgattggtttttgtgtgttgccctgcaagggccccaatcagcttcctgctcatcagccccatctcaggcagtcccacatctgtgatgtcaagccctgagccgggtaattggacttggatacctgcttgctcatctttccagtgaggttcctaaggagcatccccaaccccacctcccagggggagcttcgatgtcacctgaagaacaaacaaacaaaaactgtgttgatggtacagtcccagggctcgtgactggacaggctccctgcgtgatacacctgtgtatgtcactacagaaatacagctgtgcaggcctgtccgcctctctcacaggtcagagtgttctaaaatccatcctggcccttttgtctgtctgcttggggttagggcaggtgctcctttatcatttgtaaagtttatgtgagtctggtatgtgttccacacccttgcagagtgtaaattcctagagagagttcagacttcgagtcaaatgcacaggtgcaaattccagcttgtctaatttgctgctgtgtgaacgtggaagtctttcaactttgctagtttcccatctgtaaaatgaggctgttcagtacctgagcactagcattgttgagaagattaaatgagacaatatgtgtaaaacacttagcattttacccaagcttggtaagcatcaatacatgctaattatcatcatcatcagaagatgaatatatttatagatgcctaaaactccaagatatttcccttggctcataaattctttatcactagggattctctatggaagtgaaggaagaatctggaacgtaacaggcctgaataaccaggggcagtgctcacacctgtaatcccagcacattgggaggccaaggctggaggatcgcttgaggccagagttcaagatcagcctgggcaacatagcgagaccccatctctacaaaaaaaaaaaaaagaaaaaagaaaagaaaaaattagcgggcattgtggcacatacctgtagtcccagctactgggaggctgatgtgggaggactgcttgagctcaggagttcaaggctgcagtgagctatgttgtatcactgcactccagcttggtcaacagagcaagaccctgtctcaaaaaagaaaaaaaaaatcctgaataatatgtctatgtcttcatcgagcccacgtattgaaaactacccaaccaccaacaatgcaaagaaacattatttaactaagagtcgagtaaccaaatttcagggtatccaaactgaatatggcctctgcaggagaaaagaatatgtgtgatgtggcagccacaactgataccatattaacactgtcttttatttttttttttttgagacggtctcactctgttcacaggttggagtgtagtggcacaatcttggctcactgcaacctctgccttcaaggttcagagattctcctgcctcagcctctgaggagctgggattacaggcatgcaccacacatactggctaatatttgtaattttttttttaggagagacagggtttcaccatgttggccaggcggtctcaaactccagacctcaggtgatccagccaccttggcctcccaaagtgttgagatacaggcgtgagccaccatgcccagtcaacagtgtctttaaatgacatcagatcgcagaatttgctgagcttggcccagacacaggtctggctaaaacaggtggtgctgggaccaggcaggccaggacatagggaagcacatccctgcatagaaaaggttctgtggattttaatccagtcagcaattagcaaactttttctgtcaaggaccaggcagtaaatatggcggcttcgtggccatactgtctgttatgctgactcacctctgctgttaaagaacagaagcggctgtaggcacacgcaagcaaacaggcatgtccaaaaaatggctaataaaaacaggctgtggggctggcacggtggctcacgcctgtaatcccagcactttgggaggctgaggcgggtggatcacttaggccaggagttcgagaccagcctggtcaacatggcgaaacccagtttctactaaaaatcaaaaattagccaggtgtggtggtgggcccctgaaatcccagctactcagaagactgagcaggagaattgcttgaaccagggaggcggagggtgcagtcagctgagatccagcccacttactccagcctgggtgacagagtgagattccatcttaagcaaaacaaaacaaaacaaaaaagcaagaaaacaacaacaacaacaaaaaccaggctgtgggcccattttgactgaggacttggtttgcatatccctgatctagagaaatgagtgatttaacatatatgcctcctaggaatatcacattgaaattagcagcccttgcaatataacgggtcatgagcagagggtgcattcactttgggctttggggtcttcccgggccctggaacccccaccggctcccagccccaggcgttggaagctgagaggcctggcttccaatcccagccctgtcccttgctcgctgcatgattgggcccattgcttggcctttctgagcctcagtttccctagctgggagagtgaagatgcaatttcttgcctcgtagggttgtgaggacaaaagaagaaaactcgggtggattgtgtacctggcccccattctcagaaggtctccaagcggtgccgtcttcctcttatcccagcgtgcctcagccttcgagaggcctagaactctgggaaaggagcagtcaggactggacacgactcaggcttttcttatttcttgtgtggggtctggaaaaggagaagtgcaattatatccaagcccctcttgggcaggggtctcagatccaggccaggctgatatgagcaaggggaggcgggcaggccaggcagcactgtcaattttgatgttgggagggaggaggggcatgactgtgtatagcaaattcctaaatttccaccctggctcgggagatgcagcttgtgctgaagtgagtcattattcctgggcccctcatctgcctgcttgcttccatgtcccctagagccaaaaacaacataggagcaacttaggggaaaagttacctatatttatatataagcgtatgtatttatattaaatatgataactatagatataatctaatatattgtgtataatataaattaaatatattaatgtaatgtatataacttaagtatattatatattcataactatataaaatatataaaatactaaatattattcactaggttttcatcattggcaacctaagttctatataaatataaaatattatctatgaaaatttatacacaaatatgtatataaaatgttataaatatatactacatatttaagtaaaaataatatatacataaaatatattatatgtttatatagatttagttggcaatgataaaaacttaatgaagaatttttagtgtaataaaaactagtctcgtggagctctttgtgtttcagaatccagctatttggctctgggcccgccctctgttactccgaaaagcactgctttggaggtaacacaacgctaggtggcccctgaggctccctgagcaccgccgatacccctctcagaagcacctctgccccctcctctgtacagcccgctttgctcgccgcctcttcctttggattccaggttggtcggggaagcaatgggccatgtgtgtgcaccgttgtgcctgccttcacccacacgagcctgttggaagacgacagccatacggaagaccgctagctaccccggccccccagcccaggctagttggggttacccaactaccagccaatccccgacgtgaatgtgaataagcccagccagcatcacagagctgcctcgtcaatgtctagctgccccagatgccacctaaacaatttgggtttctcacggcagttctcttcccaacctctgtcccctgggttcctaagaactaagggttgtgcccaccaatcaaagcaagagggaaacgggcttggattttaaggcgttgcactgctgtgacttgaaaagggatatggtttaaaatcattatttaggccgggcatggtggctcacgcctgtaatcccagcactttgggaggccgaggcagtggatcatgaggtcaagagatcgagaccatcctggccaacatggtgaaaccctgtctcactaaaaatacgaaaattagctgggtgtggtggctggtgcctgtagtcccggctactcagaggctgaggcaggagaatcgcttgaacccgggaggcggaggttgcagtgagccgagatgtgccattgcactccagcctggcgactgagcgagactccatctcaataaataaataaacaacaaataagtaaatgattaaaaatcagtcacttaaagacgtattctaagatgagaccccttgctctataaaactgaaggtcgtgtccactaagaagagtggatctgacctcagccctcactgtgacgccacattccattagggcagaggaacagcatctggcaagagaggtcgtccagaattctaaagaggcaggatggccctagtattcaaacttggaccacacagatctgcactctctcatcccagaaaggagaacccaaagtatgtgtctcggttcatgattctgaggatggggaattatggaaggcaccaagtccattcataaaacacaccaccccctccctgtcccggtaatgacagtgggtggtggcttgagcatcaaagtggcccatgatgtcttggttttgctactggttatgccatctggctttcttggtcttcgtccattcatttccctggagtcctggcctgctttgcttcttactaaccttatgcagaagccaaggcaagcgaggacgaggcatacttgagtattcccactggagtaacttctgcaactagaag

SEQ ID NO: 5069 - DNA, 52635 bp, Homo sapiens
attacattcctcactattttcctaaaaccatcattttcgatgtctgcttctataaaaaagaaaccagtccaagaggtgaggagatacaacctataaacattgaaaaggaggttttaaaattcaaatacaaaactgctgggtacaaccataacaaagcatgtgcattcgagtttgaaagtaggtagggcagtattaacatatcctaagtactgtgaacaactagcctgatcattagttaattttcacatccctcagagtaggaggctgtcccccaactcccaccccctattgcttccactatttgtttcaaccttttaatagatacacttgcctcccaccaggacacacagtgtcggtttaaataggtttatctctctccttagcttgtcctggaattacgcctaaagctcaatctggcagcttttaggataagaaatctaattggagagagctcttagttttgcgactccaaacctcttttgaaaatttagtttgaccttccaactatctccaacagatcaaagttaaacatccagattccaaacctagtatagttcctttaaatctgcattgtaaacattgatactgattgctgccaaatctaaaaaagtttcttagctccttgagctaaaatgaaaaaccagtagtcaggaaaacgcaagggtctatcaaagaaatattcttattaatctaaaacacgggtctccaaaggatccctgtccctttcaacttcttgtggagggggaagtgggggaggtttgaagaagcccttccaacttttcacctgaccttttcattaagatcaggaagcccctcgctttcaagaatccacatcagactctaaggaacgaatgcgaagccagcgggccagtgagaagaggtcagccgcgcaggtctcttgatcattccaagatctttgtcctgcagccagccccaccagccccccagctcctccagcccatgcgtttcacttcggagatgtttcatgacataatccggctccgagtccccccggagtcccgggggctcacactccaccctcagggaggtcgctgatgccagccctgggagcacctccccgctccactcgtctgcgctgcagccggttcctatttgcccgagccgcgactgcgacccaggctccccgccgcagccgttcttgggggggctcccgcaactcgcgggcgcgaccccccgcccgctccctcgctgctcacgccgggcccccgctatgtgactggggcccgacccgcacccatggggcaccgctcctccctcggggtccgcgcctgcacccgcgctcaaagcccctctcggagtcccacgctcgcatgcgctgtcccgagccctctgggggcccctcctctcaccccgctgtcctggcccctctcggggtcaccctgctcccacccgctgcccggcctctctctaggtgtcctgctctcagccccgctgtctcagcccagcccccttccggacccctcctcttctcccactgtcttggcccttcctggggtcttctcacactctgttcaagccctctggggatcccctgtcttcacatcccctgaccggtcccctctctttactctgcctggattctctctgggtcccctcccctcacctcggggtctcctctccccgggtgctgtccagcccctctcggggtccccatctctcagactctcagtgccggcccctctcggggaccttcccctctccccgctgtccctgaccttttctgggacctggtccttcaggggaccccctccctcatccccctatcctagtgcctcatgaggcacccacccctcaccccactaccccagccctctccgggtcccttcctctcacgcgcactgtcccggcccctcttggagacccctccctcagactttcagtcttggaccctctcggagtcctctccactcagagccactgcctcggccctctcggagtcccctctcctcacccgctgtcccggtccctcccggggtctcctctcccagtctgcactgtcgagcccgctcccgcaactcccctcactctgcctggggtcccgccgctcggctcccactgtcatgccccgcgccccggtgctctcacctcagacctgctgtcacccccccgggcccggcgccgccgccgccgcttcctctcccacacttgttcctgagtcgctccctgtggcttgttccccggcggatccttgggtccggtcgctgagtgccggatccggctggcgcagcctctgctcgcggtctcggcgttgcgtcccactctccacgcaggaccccgccgccggcgccacaaggaccctcccgcggccgccgccgctgctgctgtccgaggtgcggctctgccaggggtggccaatcgcaccggactgcgccgagcacgccccgccccaccgtctcagccgcccgccccctgccccggaccacgccccaagctcggctccaataggctctctactgacttccctgatcgcggggcacagggccggggccgtatataggtatttgattgatggagccgggaagccgagcggtcgatggaacccgaggattggcggagttgtcgatgggcgggacaggcagggcggggtctcctcagacgcggaagaccttgcaactttagtaacctacgggcccgctggggtgcggtcagtcttgtttgtgctgctctccggtcaaagttcatggcgcttctcccacgcctttacttttcttgggagattcccagggaccaccatgttagagcctttggggagaccccagtctctcgctagaccttgcacagctttcttagtaattctgccatgaactaataagcattaatttgcccaggatttgtaaaaatttcctggatttaaaccatttctttttaaatctcttgcaagggagttgcctctccttgaattgagttcagcagccgtcagtttgataccttgggggaaaaaaaatctatatacagtactaggtgcatactttgcccaactaagcgttcatgcggggcacattttgataggtgcaaggacaaagctttagaaattttcagtttgtaggttttatgacagtaggaagactgtggtaggggaaccctattattagcttaacaaggtttcgcaaagctattcaatataacctttttccagggccacaggttttaatgattctatgtgaagtgtggccaaaggataacgagctttgacccaggtttaacatgtgataatcagagactcccttgatccacgctaaaggatagtgcctgccaggggtgaaagtgcatcatgctactaagaccatttgtgttatttttgtgaaactggatatgctgatcaaatcaacaccggaaacagaaactgctttccttactcttaacgccaaaagtaagtttatggactttagaatttagcatttatgaagaaattgtctcaggaacacattttgatcctaagttttgtcagatgtatacaggcttagttctcagagaaccctcgattgttaactttttaactccagctgacaaaatgtgttttgttctaaacagtatacatgtttcttctagtgttttaagaatcatacgccattcatcactgaggtcaagggttccagacctgcctggccaacatggtgaaatcccgtctgtacgaaaatacaaaaattagccgggcatggtggcacccacctgtaatcccagctactagaaaggctgggcaggagaatcacttgaacccggaggcggaggttgcagtgagtcgagatcgcatcactcactccagcctgggtgaaagagcaaaactccgtctcaaaaaaagaaaaaaagaaaaagaaaaaaagaatcatactccattccaattgtgatgtccccctttaaagtttcagtttgggtttagggtaggcagagaaggcctggaagcaaagaagttgtggaaatggggctggcagggctcgtttcaagtcaagtcgagttcctgagcggtgtggctgagtaccgttttgagaagggaatataaaaagatttcaaggtggtaaaacttgtttttgagggaacttgatttttacaggatatagcgactgtccaaaatcatattaaataaatctaaaggttaggtaagactaaagccaaagagaatttttttgagtaggtccaccttcactaaagagcattttttagttctgcagctgcaatctggacagaaaaaaatggggtaagttttcataacccaagtgctcagttgtgtctttcattacatataaaaaagaaatgcatgaccattaacagatgctgtttgcagtcaagaaacagcagtaaaacataagcaggataaaaatctcagcgtcttgaaaggaaaccatttagcacgaaataaacttaaaaattaattgtatcaatgaactcttgatttctaaaatctttgcttttctgcactatgattactgctactgacaggaacgcaagttactcaatatagttgattgaagtaatttagatgttctccaacagcacaaagaaagaaaatgacttcatcttttggacagagacagttctggaatcctagtttaaatatagatggcagacctacggtgcgatctgagatgattcttatttagaaggggcttcagaagatctcagaactcctggaaagacatcttagcttccattctggaaattctttagttttgttgggagaaaaaatcacttacaaatagagccagattttaattaaaacaaggtagtaaataaatgtcaaaataagtgggatgagaataacgttcattttcagaagagtccatagggaacaattcagagataaatttaatcacaaaaggtctagaatgggaatattcggttccaccctggttttcacatctgttcattttcactactggttcgtttcctacggagactcgggtggaacataaaagtggggctactttggacaaaccattaaaaccttacccttttttctcgctacacacaactagaccacattgctcttagctaaagggcaccttaaatctattcgttcagcaaaacttataacaccgtgttccttttctactcagaggaatcgcacaaattaattcttgcagatactcagctctcctgttttttaagcttccacgtggccttagccaaataacttctggtaggcaaattctccccttcttcagttgagagctcaggcaagctgttggattaagcaaaagcaccttttaaaaaattaatattcaaggcagctgtacgcggagggcctgggtctcggagtctaaaaaatcagactggacgttactatttttttttggcaaacgacagctcgtttctcatttgtaaaaccgggggaacatcttaccgaataaacctacacaaacagaaaggattcctaagggctgggaaaatactattttgctgtccccaggatgaatatcagcatccttgtcttttagctcttaataaagctctaactagtcacaggaggagcaggctgcatgatcacgcacactctggacgtctaggttttccgacctaataagggggcagtcgcgtcgttccctgcttaaattagagaccacctccacctgccaagggcccttcaaacctccgcccctaggtcgctaacgatcaccgctttagttctagctccaggcgccgcctggcgctgtctccggaagtcgcctgcgagcctcggggtcctgaccgctgctgggcctgcccgtgatttgcctgactctagcgaacctggctccgcccctcccccactatacgttgaggatttaagacggcgatgaaagggctgaggttgtggcgacgggggcgtccagcggcatctccactccccaaggatggcggaatcaggccgttgtcgggcagctctcgacccggaagtcgctcgcgcgcgaggcccccgttgccgagcgcgggcgcggggggcggagctcggcggagacggggaggggtcgccgtggctgccggtcctcgagttgggggctgccgcggacactgctaggcagaggcgagtaccgagcgcgggtggccgcggtgtccgtgggccacgctcagctgcggtcagagcgacatgagtgccgcggggctgctggccccggccccggcccaggctggagcgccgccgcccccgagtactaccccgaggaggatgaagagctggagagcgccgaggacgacgagcgcgctgtcggggccgcgagtcggacgaaggtgagtcctgccgctcgcccggccgcccggagggaggtgggaccgctgggggagggggtggggctgttcgggagaggggcggggcggcctcggggcctggggctgcgtggaggggccgccgggagttgcggggctcggggaagttaccccatccgtgctggagtagcggggaagccctgggtgcgttacactcgaccgtgatggggagagggacttagatgttgtcacgctgggggtccctttaagaccccgtcctccctcccagccgttctgattgaacctcactcactagtaggaattagaaactcatttactgaatacatcgaggtagttcgccccttttttgtgtgtgagagcatcagagtccaaagttgcccctccccaccccgaaatgcataagtcatctatactttaggtagtacactattgagaactcaggttggttaaggaaagggacctagaaccagccagatacaggtttaaatttggctttgtcacttaactagctttgtaaacttaagttttccagcctcgatttacccaactgtaatggagctgtttaatcccacacctgccctagaaggcacttcctagggtcggtatagggattaaatgacatgcgataaagtacttggcctggtactgtaaatactccgtaaatgttctccccacccgcccccccccggaaacaggtaagagagggagagatttgcttaatggtccccaggtgttgtgttttcgtcccacgctctttgcagtgtcatcacagagtctcagagccttgcttttcaaactgggcttataatttggcaagtgtgaggaacgctattttggagggatggaggaggaggaaggtgagaaatgtgagagatcaagggaggagaaataggaaacaaagagagaccgatatatgagcgaatattctgggacaaaatcgggccgtggagcaaaagctagaccagctgtttggaatgggcctacgttttattcatctgagtttcccgagtgccaagtaatgtggctgaccatgacaggactcagggaaggcctcttgactgaaggaggggagaagggtttgtggggaattggatctgaacagccttacaaaagacagctgcatatgcatgacatacaaagttgagggactgcattcatttaattccatcagaagacacggcttaaccagagattttgaatgtgaagcacttgcactcatctcatacccacgagggggcgctgtggagccaaaattgagtttttttttccttccatataggggctattaaaattttgtacacaccccagccattagcttgttctaagaacaatgttaagatgttctgaaacagttttcgtttgatcatctggcctcctccttgttccctttagtgtaacttggaaaatatttatttgtgtcagattccccttttttattgtatacagttggcctgcgtatctgtgggttctgcatctgtgaattcaaccaagcgcagctcaaaaatattcagaaaaaaattggatctgtactgaacatgtgcagactttttttttgttattcctaaacaggtagcgtaacaactacttacatagtatttacattttattggatattgtaagtaatcttttttttttttttttaagatggggtctcactcactcacccaggctggtgtgcagtgtcacgtctcagctcactgcaacttccatctcctgggttcaagcagttctcctgcctcagtctccgagtagttgggattactggcacctgccaccatgcctggctaatttttgtggttttatttttgttttgtttattttatttttttttgagatggagtttcactcttgttgcccagggtgggtgcaatggcgcgatctcggctcaccacaacctctgcctcccgagttcaagcaattctctgcctcagcctcctgagtagctgggattacaggcatgtgccgccacccccagctaatttgtatttttagtagagacgtggtttctccatgctggtcaggctggtctcgaactcccgactcaggtgatccacctgcctttgcctcccaaagtgctgggattacaggcgtgagccactgacctggccctaatttttgtgtttttagtagagatggggtttcaccacgttggccaggctgtctggaactcctgtcctcaggtgattctcctgctttggccttccaaagtgctgggattcagacatgagctgccatgcctggcctggatattctaagtaatctagagatgatttaaaggtactgttggcctggtgcagtggctcatgcctgtaatcccagcactttggaatgcgaaacaggtggttcacttgaggccaggagttcgagaccagcctggccaacgtggcgaaacctctctctactaaaaatacaaaaagtagccgggtgtggtggtgcacccctgtaatcccagcttttgggaagctgaggcaggagaatcgcttgaacccaggaggtggaggttgcagtgagccagattgtgccactgcactccagcctgggcgacagagtgagactgtgtctcattaaaaagaaagtatactggaagatgtgcgtaggttatatgcaaatactatgccattttgtcagagattgagcagctgaggattttggtatccacgggaggtgcagtaaccactcccccacggatatgagggacaaccgtgtatcctgatgtaaaatgtgcgaagggttccaactgggtatgtatagaagagaatgtacatactagtttttttctggagcagcgagtaaggcttgactgcctgcgtgtccagtcttacgcctgcatctcctttcttgagttgccagcattgttgtttctgcagagtagcagccttcaccataactgcctgtgcctgagacaccctattctgtggctgcatttaggtaaaggcaagctttttgcataaatctgactgtaagttggaaatggccttttctttttgaagtacggctgtccctcggtatctatgggggactggttccaggacttcatggatactcaacctgaggatactcaaattctttgcattggccttttgtgtccacaggtttcgtgtttcagatagggatggcctactaactgtatgtaatgtttttcattgatggctttgtgcaagctgccttgaatagaaattgattttacgggagtttattgagtgcatactctgtgtcaggtgcgccaactccgtgaattatgattttaactagcccctatttcctaactttattcagacacgaggatgctagtgaaactgacctggcaaagcatgatgaagaagactatgtagaaatgaagaacagtgagtatgatatgcctatgtctttttggaacatagaattgacaacatctttattagattgagcatcccaaatctgaaatctcagatgctccaaaatctaaaacttcctgagtccagcatgatgctcaaaggaaatgctcattgcactatttcagatttcagatttttggattgggatgctcagctggtaagtatattgcaaataatctaaaatttgaaaaaatccaaaaccttctgatcccaagcatttcagataagggatacttaatctgtagtaaccttgtgtgtatagtttgaccatagcgcttccaaagaccatgtatgtttacaatttctccactttaaattattacatttaatcagtcttcccgttataagactttgttgagtactctctagaaagaatctgagggcaatggacccaggggagggaatgaggccgtacaacaggagaggaccttttactattactcttttttttccttgagacagagccttgctctttcgtccagactggagtgcagtgcaggatctcctcactgcaaccaccgccttccggattcaaatgattctcctgcctcagcccctgagtagctgggattacaggtgcacgccaccacgctcagctaatttttgtatttttatagagacagggtttcaccatgttggccaggctggtctcgaactcctgagctcgtgatcccccaccttggccttccaaagtgctgggattacaggcgcgagccactgcgcccggaccttttttttcttttcttttttaatgggcaaaccaatgcacagagagggtaattgttgtcttgagcaattgggttctcaggtgagtgtaaactcactgcactaatgtgctagacaaggtgccgaggcctggagagctcagagaagccacgattgaaaagcaggctgctgactcttatttattatttatttatttttatttgtttaatttttttttttgagatggagtcttgctcggttgccaggctggagtgcagtggtgcaatcttggctcaccacaacctccacctcccaggttcaatgattctcctgcctcagcctcccaagtagctgggattatagacatgcaccaccatgcccgctaatttttgtatttatttattttttttgtgtggagatggagtgtcgctttgttgcccggctggagtgcagtggcctgatctcggctcactgcaacctctgcctcctgggctcaagcattctcctgcctcagcctcccgagtagcaaggactacaggcacatgccaccatgcccggtaataattttcgtatttttaatagagacggggtttctccatgttggccaggctggtgtcaaactcttgacctcaggtgatccacctgctttggtctcccaaagtgctgggattacagggtgagcgaccctgcctggccacatgctgactctcaggccagtgctctgtccacgtttgccctgctctcacccaaaccttctcattgtcttcagacagagccacagccgaacagattcaagaaacgaaaacctcactcacttttagcgtacacccagatggaaaacggtataaagtattttaatgtatatttgttgaatgtgttaggtttttaaagttctttaccttttaacaggatatccacattcatttccctttaggtcctttttgcaaatgttttgtggccatcctctggatctcacattgtttttgtgctttggaactcaaaggggtaattcagctaggtctaaccagtgtgaataaagatggattactttttttttttttgaaacagagtctcactctgtcacccaggtggagtgcaatggcatgatctcgtctcactgcaacctccacctcctgagttcgagtgatgtcatggctaagcctcctgagtagctgggactacaggcatgcgccactacgcctggctgtttttttgttgttgtatttttagtagagacggggtttcaccatgttggccaggctggtctgaactcctgacctcagatgatctgcttgcttcagcctcccatcgtgttgagattacagcctgagccatcgtgccaggccacttttttttgagacagtagccacttttttttgagacatatcttgttttgttgcctgggctggagtgcagtggcatgatagcagctcactgcagtctaacctctggggctcaatccattgatcctcccacctcagccttccaagtagctgggacaaaggcacgtgccaccacgcccagctgatttttaaaatttttagtagaaactaggtctcacgtgttgcccaggctggtcttgaatgcctgagctcaagcattcctcctgtttcggcctccggagtgctaggattacaagaataagccaatgtgcccagcctttttttttttttttttaaagacagggtcttgctctgtcgcccaggctggagtgcagtggcatgatctcggctcactgaacctccagcccctgggttcaagctattcttctgcctcagcctcacgagtagctgggatacaggcgcccaccaccacgtctggctaatttttttttttttaagtagagacagggtttcccatgttggccaggttggtctcgaactcctgacctcaagtgatccacccgcctcggcctctaaagtgctgggattacaggcgtgagccaccttgcctggcctcccttagtatttgatgtacagaaaaaatttcggttaaaatggaatgccttgtgtaattcaaggggaaatctaaaggcatcagaatttgccctgaaagagtgagatgtgtgtgagtctcaaattctgcctactctctccccttacagagggttgggttgtatttgcagcccttatttgagcgctaaaaaggttacacgcccatgtgctcacttcagcagcacatataccaaaaggttattgtgcttgttatatttggacagtgttctttcagatcacaaatcttgtttttatcactgttaaattgagggtgttttcaggtagaagcaaaaatacttgctgaaatgtgatttatatgtggaacccaccttcaaccaacttgctgaagttatgactgcctataatccattaggtgtgagaggaaaaaactaaatgccaaatgcttttgcttcgtgtgtgctgtgtattcccatccagctggggctgccagtaatgctgccttttaacttttctttctgaattactattatttctctgatcctaaaagagtgtgctttaaaaaatgacatgaaggtttattgacttagttcttacactgctaagcatatcgcatagaaaaacatgctgaaggcataatcttactctcctgtaacttacaatctaattgtgagttgatgtaagagttgtgtttaatgccatttctacattgtgtgtgtgcttgcctgttataattgtcatttattaaaatctgctatcgttgcaagttttagacggattctgtaaagagggataacatgggagaatctacaaaattagaataagattgaggaacacagggttctttctgttcctttctgatccctgtggctgctggtgcattttaagccagcaagcagactttacttcctctcttccctgaaggacattaatgaccttcccataacagcccagctaatttctgtggtaggttattttggaattgagtattgaatgtttttatctgttagtgtgactttttttttttataggatgtatcaggacaaactggcttctctcaagaggcagttgcaacaactgcaagaggttggtgtgtgattgaatcctgcatttctaaatatgcttcttaatattacaaaccctgaaatctgtgtatttcacttctctgtgggagttatttaaaacacggtctggctgatcttgctatccagtacattttgctatcttttgctgtcagtaaagtggtgattttccagctcctgattttgaaacatttatttccagtatgtgtgagattctttcttcaaatgaaatctcactgggactttcaatggagcacgaattgaacgccactgtgcctaaagctagagatttttagggagacattgttatcaaagaataaagtttttactgttttttctaaaccaaatgttaatgacttgtggattattcacactgtgttttctcctttttgcttgttacattaaaagtagattgattttgtcaaatgctgctagctgctaaaggcagtgcagcatcagagttaagagtgcaggtgtgaggccaggcgcggtggctcacacctgtaatcccagcactttgcgaggccgaggcggtggatcacgaggtcaggagatcgagacaatcttggctaacatggtgaaaccccgtctcactgaaaaatgcaaaaaattagctgggcgttgtagtgggcacctgtagtcccagctacttggaggctgaggcaggagaatagcgtgaacctggaggcggaacttgcagtgagccaagacgtgccactgcactccagcatgggcgacaaagcgagactcagtctcaaaaaaaaaaaaagagtgcaggctctggagttttgtgagggattggaatcccagtttccctgcttctagtaagtgaccttggacatgccagtttctcttgtttaatctgttttctgatctgcaaaatgaagaagtaagagtagatgtgattatgcatgaggagcgtctagcacagcagtgtgcacactgcaggtcctggggacagttagctgtggcagtgagctcttcggtttcatattgtggagtcccttgtcagtgaaactgtttttgcttttctttttttttttttcgaggctgagttccgctttgtcacccaggtggagggcagtggcgcgatctcagctcactgcaaccttcacctcctgggtcaagcgattctcctgcgtcagcctcccgagtagctgggattacagacgcctgccaccagcccggctaatttttgtatttttaatagaaacggggtttcaccacattggccaggctggcttgaactcctgaactcaggtgatccgcccacctcagcctctcaaagtgctgggatcacggcatgagccaccatgcccagcctgatactgctgtttctactatgtgcttttattgctgtgagtgatccacgcccttggactagcccatggtcaggcattataatcaggaaacacttcccccacaagatgggcccctcataattaactgttttgtgggaagagcaatgaaatgaatacgatttggttagaatctatacctgaattgtttaatgctgtcactagccacatgtggctgttaaatttaattaataatttagttcttcggttccactagctacatttcaagtgctaaaaagccacaaatggttagtgcctgccatgttggacattgcaaatataaaacacaccattgcgaaggttctactggagagcgttgacctagaccttactgaaggagaatgaaccttttccataaaggaaggcccgttgattcagactgttgcagcaactgatcagaatagtgtggagatatggcaattttccactccccctcactcactacagacccttgatccactgggttgggtagatttgaatgggcccctagtggtttctgctgtgtgccttggttaagaaccagagttaacttgctgaggtgtgtcttcctttggtgttactgaaacagtcagtgttgatgctagataataatttaggaagcaaaatgtagagcagatttatattcacaataattttatttttcaaatgttaaaatcaggtacattacaggaatatcagaagagaatgaaaaaactagatcagcagtacaagagaggatacggaatgcaggtaaggctcctttaaatggcaatgaatcatctttcaatgttgaccatttgccgatcgtcggtgtaatgcagccctaagagctattctccaaaacatatccagatactctgtcagggagagttttcagaaaagagacttccaagctgcagttatggaagtggtttcatcttctgcttctgttgctaaggaatggcccagaagtggagggtgtctgagaggctccttggagttaggttgttctccctggtaccccaagagtagtcttgcaccctcttctcatttctgcatggctggcctgatgtacagtcagaagtgcggatgaggaaaaggattgaggttgtttttgtcccattttaagtttttttttttggtattttgtgctaggattggggaggtcttcttgttattttccccaagtattgtttttataagaatttagagaaaacgcacactgattagttgtatacagtaaatgtattcattcaacaaaaatgaattgagcacctgctactctaagcactgcgagcaatataaagtcatgtaacacattgctttgactttaggacacttgtgtttcattgacaaaagataccacatgtataacgtgtaaagttaaggaacaccgagttaagagccatgcagaaagtaagatgtgacaactgtttaaagtgtgtaaacatggattcctaggttacaggaaatcgcgtgtatgtgttgaatttttaacgctcatcatcagccagcagttgggtgccagcagagtccttgttcctgcgatggtagaagtaatgatgggttttaaaatggggttgggtgccactcctcatgctgctgtcatctttcattctgggccagtgactctccacgcttcactgtgtctcctcagtgagaagctgcccagtgcacaccaacagagagaaaagggttgaagtgtgggtgggcgctgagaaagtggagccccagctattagctgtctgcctttcaccttctacctctccctgctgttaccccctttctactctgagttcctgaagcacctcctgagatgtcttgaaaatcctcaaccggttgctcttcctagacttcccttttagcagataaggaggtggcatttgtggaaggaggtcctgcctcctcactttagatctgatcctttaagcgaatatttgctcttgaaacctcaatttctccatctgtagaggggaatattaatacctcaggaactggcataagatggaagtaaggaaagaaaatggatgtgagtcatatttctgaagtagaacagcagagtgagtattgagttgtttttcttcattctgctcagactctcaatcatgcctcatgtgttcttttttttttttgagacagagtctcactctgtcacccaggctggagttggtggcgctatctcagctcactgcaacctccacctcctgggttcaagcgattctcatgctcagcctcctgagtagctggaattacaggcgcctgccaccacacctggctaattttgttttttagtagagataggttttcaccatgttggccaggctgctctcaaactcctgacctcggtgatccgcccggctcgccttggcctcccaaagtgctggggttacaggtgtgagccaagtgcccggccctcatgtgttctttcacatttctctctcctaggtaaaaatgcagaagagtcctaaatcagtcacgacttgagctttaaaaagcacattcttttcagagatgatccaccgctttagtggtgtctggctgctttaactgaaacaactgccacctctaagtgctaattgtattttgacttggtgcaaggcatgatttctcggaatggcacaggacttcagctgtctggccacttgtgcatggtacagatctgaagctgttataggaatgatcacattgggttgggtgtcctgggttcctatgcccagcaattcccagtgccaaagtgggtaggacttctgggggctaaaaataatgagtggcttgtccctttcctcagttaattttctctgtcaacaactgttaactctgggcttttaatctggggttcctagaactgtcagaattctgtggagtttgtatatgtctttgttctggggaaggggtccatagcatttgccaggtttgcaaaggggcccctggtagctgagaatagcacaccctggagaatctttgtggactgtacgcacagccccctgtcacccggaaagagtagaagccatggagcaattttgcttcaagttgcgggtttgtagacaggttttgctctattgtaaatctagtggtgaggggagctgctaggtaacagttactaatcatccgcacatggtaggtgctaactaagttgttgagtgctgttagatgggtgctttaaggcatctaagggcatgatgtgtgaagagtcagcaggaaaggcctcaggagggggctgcattcagtcggaacttgggaatgtgaataggaggtcagagggcattgcagggacagacagcgtgagcaagcttggtggcctgacagtgaagccccaggtgtccctggagcctctgtcctatggattactgtggaggtccttccttaccacatatagcccttcatatagtgctttaaaaaggaggtctggccgtaggcagtggctcacgcctgtaatcccagcactctgggaggctgaggctggcgatcacctgaggtcaaaatttcaagaccctcctggccaacatggtgaaaccccgtctctataaaaatacaaaaatcagccaggtgtggtggtttgcgcctttaatcctagctacttgggggctgaggcagtagaattgcttgaacccaggaggtggaagttgctgtgagtcgagatcagccactgcactccagtctgggtgacagagccagactctgtctcaaaaaaaccagaacccccagaaaaccaggggtctccatccttcaggctgcggaccactgggctgctttcccccactgccgcctgcccccctaccctgccccagcccgtgggagaattgtcttccaccgaactggccctggtgccaaaaaggttggagaccactgctttaaaacatcacatccactctgtttctgagtaattgcattatttcttcttgacccatcctgccactgtggagactgttggcgggtgactgagtgaaagatgggataagtttattttgccaggggagtttggttcctgctgcacgtttttgccctcaggcagaactgccacagctgatatgttcagggccacattttttttttttttttgagaccaggtttcgctctgtcacccaggctgtagtacagtggcacaatctcagctactgcaacctctgccgctcaggttcaagtgagtctcctacctgcctcagcctctcgagtgttgggattacaggcgcctgccaccatgcctggctaatttttatatttttagtagagatgggtttcgccatgttggcaggctggcagggtcacattttaactagacttgagtacttgtatgtcctttcccttcgtgtatatcaacatttcactgatgaaaacatttgctttgtaacagctttcagaaagcaattactgcttctaaatgaatgctaacatcactgtctagaaaggtgcacagcctagcaaatctaattgcactttttatctcttgcagaactcttcctccagctggagtaagtaccacggatcttctgggtttgcaggccctgtctgagactggaatcttgcagtctgatctggtggcttttccttctatcaccaagtagatagtttggaagccttcaccactgtctgtttgacttaaggacatttggtctcagctcagacatcctgtctggtcatttgttgtgcgcagcctctgcttatcacaggggaataaggaatactcatccctaactgcttattgactctatcccgtgttagagctgtttggaagtctctgagttataacggcctaatagtttgatttggtccttgaagcagttcaatctctgaattggctcagcagttctgttttacagctgcactctctgggccagtaaaaaaagacagatttctaatttttcctttcattccatggacaccgagtgctggttctgtgtcagactctgtgctgtgatacagagatgagggcctgaatcttgatgatgtactgctcccagagtggctagcatgtgtgtgggggttactttttgagaaagtctggtttttcagagccacattattggaacccagtttccttaaatcagtgtggtgcccatatcactcagccagaaggatcacgtgatcagcctgaaggtacactcaagtgaggtactcactccttagcccaccataggcccctatgtcagtcaccacaatggcgagatttgaaaagcggggcatatacaatttttgtcttagtataatatcaatatatgtatactttggggttcaggccttactaaatgttgttccattcttttgtcttgctgtatcaaaaataatagtaactttttaatatacacaatttatctagaatctattttcctttgaagctgtaactttatgagcgatttttactacctttgagaaatgtgttttagtataaaatataggatgtggaagcgaaaaaattctgggtagcaagtgaggtgtactcaaaaataagcaaaagtcacatgggtctgattttaaccctcgctggaaagcttgttctcagacacactgttactgcaagtgtgtgtgagggggaactctcacacactttgcagttgaggacagggctagactttgagttggagccctggctccagggctgtgtactcccagcccgtgtttctcttttgctcagactgaacaagtggaacgaattacattaaagaaaagaaggcagcagtgaaagaatttgaagacaagaaggttgagctgaagagaacctgattgctgagctagaagaaaagaagaaaatgattgaaaatgaaaagctgaaatggaactgactggaggtaggaaagccctatggggtgggatcttgggggccctgagcggggggtgtgaagggctgttccagttacttttgtcttacatttcaagagcagagcaaggtgagagtgggttttgacctcatagatcagagttcctcctccaccttctattggctgtgtgccttagtcaagctgcttaacttctcttttctcctctatgaaatggggctgatcatacccctcacaggattgtggttagacatatgagtgcctagtacagtgtcctgtgcataacagatttcaatagttgctagacctttaatagtaattgcaagctctggcttagactctacttaatcctgggtctgctgccatttgtatcttggttatgttcccaaattgcttacgcaagtcccttgtggtgatgggaatccctcgctttgtttttttccagtctgccttaattacagaaaaggattgtctccctttgacctagatgtaagaacaaaggcttttggctatatcctctatgctatagatctctcctgccaggtgttactgaacatttcagaaagatttgatatgattccaacagatagccaaactgaactagtttcccataaaggtaggaaagttacatgagactcagagccatgcctttctaaccttctagaatttagtaatccacatatgggaactcagcaggttgtagcaggtttcagggagaaacaatatgggccaactcttctgttgccatatgtagactgatgatcctagaaggatacagggaattggcttgaactagctattttggaacttggcaaatactgaaggcaagtcagtggtgagtttgtcacttggatatggaggtggcatgcctttctgtacaccccaaatttaactcttacaattcggaaagtgctggggctctggtgtgtctgattttagagggttctgtaggaaatgcatgcagtgtttttgtggacgttctcagggctgactttgaattaaaagtagccagttaagatctttgttcccctctatatattcctggtgctgtgaaccacttggccttctgactgacacagacttctggctccaatcctcatgatacacttaagagaagtggttgtgcctaaggtggggtctgacttttgaaaaatctctcttctgttagcttcctctagagagagttggcaaaagaaatgagctccttgaaggcctctgaaagcagctcagaaattttttttgtgagaatggatgccaaaacagcagctaacagcagcttcaggcagtatagtctgttcttgtgaaagtgcttatttaatgagaccagtagcaccgtggtaccttatctggtacagtctgcctgccggcttttggacctgcacaccattttctctgacagtggctgtgactgcattgatgcctcattgttctctgctagagccaccagatgtttgggagccttcattaggcagtgggaaatattatccgtttacagctgctccctttccgtctgtggggaacgggtatcacaccttacctgtgatttggcgtcctaattattgacaagcgatagacattgtttggccagcagttttacagccagaatcttaactgggacaggaggcatcctcagtgacttgaggctgacctgccagggtagaaaagacaaataaatgtagggaaatcatttgtaacgcaataaaataattacagaagtgtttaaagctagccatgggcattaaaggtatggatgtccttcctcaggcacctttgatacccttggtatggaaagcactgccaaggtaatgatggagtgttggaagaaaggtgctggagctagaagggtaattaacatttccacagatggcgctgctatggtgttgattaaaggcttgatttcattcctctaattgagtgacttagttcatctttgtggattgatcccaatatcattgttgcccagctctgccctgaaaaatactttttaaagtctccttttttgttcaacatgaacgtctcttgaaaagcaaagtaggataagacgctgatgagaagcttagctaaataacccactggaaacgggtgtatttggcgacctgctctttcccaccatgacttaagcgtttataaacctccataggaattggcaggatgtactgttcaccgcccaaacctctttggaaaactgggttgttcaggtagaaatgagtaactgtacatagagaagctaggaagaatataggtcagtgcatcccaacttcaatgtgttaggtcagtggggtcttgataaaatgcaattctgtttcaggggctttggagtggaggctgagatcctgcatttctttctttctttttttttttaaatttaatttttttttgagaccaagtcttgctctgtcgcccaggctggaatgagtggcgcagtctcggctcactgcaacctccacctcccatgttcaagtgattctcctgctcagcctcccaagtaggtgggattacaggcatgcaccaccacgcccggctaatttttgttttttagtagagacagggtttcatcatgtttgccaggctggtcttgaactcctgacctcggtgatccgcctgcctcagcctcccaaagtgctgggattgtaggtgtgagccaccgtgcccggctgagatcctgcatttctaaccaccttccccaggggtcgctgatcctgctggttgtagctgataccacaagtcattacaatgtcaaaatagaagtctgtttcccaagcacttacctgagccaagcattacataaatatattagagctaactttgcaggctgatggtccagggcgaatcctggcactgtcacagatttaaatctgaggtagggttttctcatttggcaaggggtgatagaacctactgcagagggtagatgtgacgtgagatgagataatgcctataagttgttcacaaagtagctggtttacagagtgaacactcagggattgggaactcactgagttccgcagctccctttgaccttgggggtatcgcttctgattttataaatggcagaggtggctcgagaagtggagccatttgctcacagtccctcagtgagatagatagtggttcagccagtgctgtctcactccaagcatattctcttcaccaccactactactgactctctgcagatacctagatacatgtggtggcactaagtgactcacaaaatcaggctaatggataaagtctgtgcttctaggaggctattttctggtagttagaaagctgacacagcttccttgacttccccaggtaatgtgttgagatggagggcccctaaataaaggtaacaatttgacaggcttgttttgactcattgatttatttaaagacagggtctcactccagttgccaagggtggagtgcaatgtgccatcggggctcactgcagctcgacttcccaggctcaggtgattctcccacctcagctcctgagtagctgggactacaggcatgtgccaccttacctggctcatttttgtacttttgtagagatagggttttgccatgttgcgtagctggtcttgaattccaaggctcaagcaactgcctgccttggtctcccaaagtgctgggattacaggagtgagctactacatctggctttttactcattttaaaaccctaagatatatgtggttgtactactataggagcagtaagttcacgcgtatgcaatagatgctaatgagtagctatttgggtgtcaagacaagaggaagagccccacacaaatatctggagagggagaatggaagaggtgacctggattttgggcagaggggcctttcctcaagatgttctttcctggtgctggcattgtggaatcagggtttttttttttttttttttttttttaagacggagtctcgctttgtcccccaggctggagtgcagtgggcgatctcggctcactgcaagctccgcctcccgggttcacgccattctcctgcctcaactcctgagtagctgggactacaggcacccaccaccacgcctagctaatgtttttgtattttagtagtgatggggtttcactgtgttagccaggatggtctcgatctcctgacctcgtgactgccctcctcagcctcccaaagtgctgggattacaggtgtgaaccaccacgcccggccgaatcaggtcttttaatgtgcttgagggtgcagagaggaaggctcgactggctcactgttattgctctcccttcataatggccaactttggctttaaagagattggtccctttattccactctgatttggcctccaaagacctaacattaattcttgtggattgattgattgattgatttgagacgtagtctagctctgtcacccaggctgaagtgcagtgccacggtcttggctcctgtaccctctgcctcctgggttcaagcgattctcctgcctcagcctcccgagtagctggactacaggtgcgtgccaccatgcctgactaatttttatactttttagtagagacggggttcaccttgttggccaggctggtctcgaactcctgacctcaggtgatctgcccaaagtgtgggattacagacatgaaccaccgtgcccagccctaacattcattcttattccccaccccacaaaccttaggcgctcttctgttaccaccgcagcattaatttgtgtcaacattgatgcgccctccatcctgctagagaagggcatgatgtctgctaggattgctctgggctgctagctagcctatgggtccctgccctggtttggaggtaattgccaatctgctataatgtttacctgcagtggattttctttctgccagttatatcccatttctttttaaagaaaatttccttttaaatttaaagtacatttaattttttgagacggggtcttgctctgccacccaggttgggtgcagtggcacgatctcagctcactgcaacctctgcctcctgtgctcaaatgatccactcagcctcccaagtagctgggactacaggcacctgccacctagcccagctagttttttgatttttctgtagagatggggttttgctctgttgcccaggctggtcttgaactcctgggccaagcaatccaccctccttggcccccccaaagtgctggcattacaggcgtcagccattgacccagccttatatcccattttttaaggatgaccctttgaatcactgcaattaatattttcccaatagataaatatgagcttgttttaatagttaaagtatgttgcattgaagcttttctgccgttgtacactataggcaggtatgctgttggaaatgaatgaatgggcctagagaatgcacagcaaaaggccagccagtaaactggtaattgtatgtaaattgcaggtaattaattatcaagaatatctctccagagggactgtgctataatgactctaccacctagcattgctcaacctgagctcccattttttagatgtcggaatctgtgctccctgtggtgaggggtgaggggttcctgtatccatcaggtttcctagtgagtagaacaggaggatttgcactattaaagtcatattgcagggtggtttggagaggagttatatgcctagtcttgttgcttgtttgatttttttctcacataacgctctctcaagtctgctttaagtgcttgatgtttaatgataaatagtatctccactgaagcaaacctatgaggagacctctggatcagagagggtttctaattcagccagttcgagtttttttatggttggtgcatgatgtcggagaggaagcctgactgatccctgctcaggtgtcttctctggggttgtcacaccccagggtctgagcttcagttctgaagtttgatttttgtcagtgtagccagattgagcgtcttgggactcttagagtcccagtataggagattgatggtaaaactcaggataccagctcgttgcttacagtgagaaatagaattccaggtgcactcagacctgggttgtcagactccatccttctatgaaaaatccaccgtaaagccaactagaccaacctggcgttggagcaaggtgacttaagtggataatcttactggtctgttggggctgtgatacatgttgatcatggcctcaaatcatgttttccacctgggcattggccaggactgctcccttctgtctcctctttcctagatggagatggagacatgctgtaagttttaggggcttctccagagtctcttccttctgcaaagcagtcttttggataaaataatcagattgttgctgtgaccaggctaataaaatagatttttttttttttaccatttctaagaatttgattgtattttttggtttgtaagtgatacagttatgattttcagagttcatggccgtgattggcctttacttggcttacatccatcatgcattgtccaccctccccactcccagtcttggcagcctgtggagcagagcacactcagccactctctttggcagacagaaattccataatgttcatgggctatgtgcttttcctttggtgctctcttgggttgggtgagtccctttacactttattttccaaattaggtgtcagtgttgcacagcctcacagttgacacagctgctttcgactatgtaactttttttcagctctttgtgccttgagttttaaaaaggtctttgtatagttttttcctgcctgaaaatataataataaaaactagcattgatagaaccccgttacgccaggcactgtgctaagatttcacacatatcatcacatgtaaccctcacgcgcactgtgggggaggcattattgatacttctattctctagatgaggacacgtgagacaacagcacttacaaacctgtgttaggtcacacagccgttgcagggattcaaacgcacgttgtgtgacactccagctcttaactgtggtgctgtgtcactggccagtaactaactggagagggtggcacctcagcataggataggagatttcttttagggagaagccttcaccacttgttctggtgtgtgtgtgtgtgtgtttatacttccaagtacacttttataaatattcattaggctttggttcttattttacctctattccattcataggaaaaaaatatttaatactgccctttctcttaagagcaacatgcagaagccttttttttttttttttttttcaaattttctgggcacatgtatgacatgctctaagatcctgcacactgcttggtagaattccctgaagctccctgcctgttctgctgattgtgtgcataatcacaaattaacttcctcccatgatcagattgacctcatctacccgttctgcacaaaacattatgcacccctactgtgccagactattctaggtgttggggtggaattcagacatccaaaggggtaggtaatgacctgtacaccgtgcacttggtctacttgaggtttgtatagatgctctggttacttggaggatggaatgagttctgcctttgaaacctgttacagaagggagagggtattaaactgactttcaacgggtatttgtaggagtttgctgggcagaaaagaggaagctagacagaggagagccatgcaaaggctgaaggcgtaaagtctggtgcccttgggtaacaggatagctaaaggcttgcacacggtgtagcgtgaatgaagaagaagggaggaagaccagaaatgaggcctggcttatatcctgtgggagtggtgagccattgaaatatttagtaagaagatggctgggtgtggtgactcagcctgaatcccagcactttgagaggctgaggagggcggatcacttgaggtcaggagtttgagacagcctggtcaatatggtgaaaccctgattctactaaaaatacaaaaaattagccgggtgggtggcgcatgctgtagtcccagctacttgggaggctgaggcatgagactcgtttgaacggggaggcagaggttgcagtgaatgaagatcgtgccactgcactccagcctgggtgagaagtgaggccctgtcttgaaaaaataagaaatatttagtaacaagagtgatacacaaaacatctgatttgtgtctcaggaagatcactttgagggaggggaggatggatgggacatgggaagaccactgaaggccgtggaggtagccagtgaaaggatgaagggatggagtggaggcagaccaacattagttggtgaacctcatgcctggatgaaggaagacaagtcacagatgcagtttgttctcgcatggaaggagggatagattggatgtccctgagatacaggaaaagaagcaccttgggagaggaaacgaggagaactgagtttttgtggggcatggagaatgtgtggtgcaggtatctattgccattcagagggatgtgtggagctggaagtggtgattgcagattggtgggatacagtctgaaaggaactgactggaccccaaagatgatcagtattcagggagcaacaagcgaaccccgaggaggcaggttcacctccttgtgcgccacctcttgggaggagcttttgaaggcgtggggagtcagcagcagtgtgagaccacagagaggagtgaagaagaaggaaagaggcttttattgtgagccctcattgtgtcatcttgatagtcaagtagctacaaaagttatagagaaaaaaaatccgagtctgtaaatgaaaacttcgtataaaaatgttggcacgaggccagtggcctctaaaagagcctttcataccaatgggcttcagcacacccaccctcttgggagctgcagaaattagtcagctgagatgaccttcaggttccttcctatcccgagacctgtgactctgggcttcttaatttgagggagaggaggaatatcccctaggttttgaggtgctggagagatgcccacagtggctgtaatgcttgacggtagggctgcatttctgagagggtgtgcacttagggcagctggtctgaatcttacaagtataaacgctttctaaaatctatggggtgtctggctacgaccatgtgtagaacaaacacccccagtaaaacagttctgattggtggctggggggcagatattcttatactatagaaattcttactgacttcaagtgggagtggatagatttacccattccattcttgccacagattctatggaggtgaaacctatcatgccagaaagttgcggaggcgaccaaatgatcccgtccccatcccagacaagaggaggaaactgctccagatatccatttacatcaagccttaaccgcctttcttttttaagactgtggatcctatgtttatccgtttgctagggtacacatggccgttgtcctacagaaaatagtaactttaactggaaagcgtgtgttaaatgtttgtccacaggtcaggggttgctcattttatctggtagtcctcatttgctactgcttttggtgggagagatgtatagagttgtgatttggaaggtgctttgcatgcaaagttcagcctggttttaatgctaacatcaagattcaggggcactgaaaacttgatgtgccttaattttttcacctgtaattttccaccttccaactgtaaatgaaggcagtaatatctacctttatgtacctctgttatctatgtccataatgtagtggatgcaacctgtttttaaattaaagcaaatgagatttcagtcagacataaagcagccctttatcataaaaatggtaacggaaacaggaaagatggagaagcgttgtttctgttcctttcgggagatggtgaatagctctctgcccaaaatggcttagtcatttgtgtaccatcaggaaaggcataacttcaggttgcttctccttcacaacaggagttaagttgctgagggaagattgccttaccttgggtgagtgtgtgtggaagtctttagatctttggaacaaaagcgctttatcattcatgatgaaattcttattttactgtttcctttgctgtgttattgtagatgcctaagaagctcattccaccttctcatcctagcagtgggggatgtgaattcttttatgtattgagtaccatgacatttagtaggagaatcataaatttctaagaagcaaactgttactgtagaacatcatttaacaaaatcatactttgtaaattctaaaatactggtaccattgtgttgatactctttgcctggaaactgtacttttcacatacagtcctttaactctcaacaccccagcaaactatttgttaacagatgaacagatcatggaggatctgagaacattaaataaggtacgtttgacttttttgatttatttgaaaactcaggcttttgtggttttctgattttgtttgtaacatgttacttgttaatcattatgatacctttgacacctgaagttgcacctgaaatgttttctctaagattttttgttgttgttcttcctacagcttaagtcacccaagagaccagtgagtgcatgatgtgttggcatttgtgcaacctttttatcatgttgttggaaaagggtggaatacctgtcaggaaatggttgcaattttcaaaaatgaaatgttcatcatttgcctaaagtagtcatcatgaaaactgaaggggaccttaactatacccctccctgatttcttttttttcataacccctgctttgttgtttttatttttttcttaggatttatcataaaagagacattgattgattgattgatttccttctgtgtaggcatcaggcataagatttaagtacacatcatttttgaaaatgaaaccagaaggatttttaagtattactggctttctaaagccaagtctaggcagttctgctcccgtggcttttcgtggcctgactctggtaaggcattccaaggcgctctgactcgcagttcatagaagagaccaaccagctcagtattcatagttgttccttcggaacagcacttgagatcatcagtgctagctgccaactagaattctgaattggtgacatttttttttgtttaaagcaccatgattactcgattactcgattactcacacatccctctattactgagtcttgtggaagaaaacaagagtcttctttttctaggtaatatcttcctggggccactgcggtccacagacatcctggccttctgaggcacgatggggaggggtgagggagtgtgtgagtgtaaagttagtagttctttaagtgattccttttttttttttttggattatgagtcttgctctgtcgccaggctggagtgcagtggcgtgaactcggctcagtgcaacctcgactcccaggttcaagtgattctcctgtctcagcttcccaagtagctaggacaacaggatgtgccaccacacccagctaacttttgtatttttactagagatggggtttcaccatgtggccaggatggtctcatctgttgacctcgtgattcacctgcctcagcctcccaaaatgcggaatcacaggtgtgcgccaccgcaccctgctgaaaacgattgcatttttaagagatttcataatacttgccctttgatcaccagggctttagtcctactctaagtgaccttatgtattgcacatttgaccttaatcttcctgaaacccaggtgtctcttccatttgagaggctaattgccttgcctacttcccagggttgctttgatgatcaagtttagatggaatatacaagagtttgctgaaatcccatgcattatcactgtaagggctcagtgatgattattaccacattcgatagtgtttcaattaaagcatgttaactggtagactcgcatgtgtttgttacattcttgtcacgtaagtattggtttcctccagcatctccatcctctcctgagcacttgcctgcaaacccgcggaatctccagcccagaggttcgaagctcggatagaagatggcaaactgtacttgacaaaagatggtatgttatgggaaaacctggactagtaagagtctcatatgaaccactggaaagagggctggggctattgtagttatttcagatcacggctgctgctaaacttacaagtactaaaagtagaaacccattaaaaaatgtattagcagtcatttaatcaatacttccgtggatctttgaaagcagcgtttcccaaaaccatgttctgctccccttccttctccatttggtgtctctgtactagaatttgcaggctggtatcttgtgtggtacccctgccaactgggctggggtgtatgtcccccctctgacccctcttacctctgctcctgtgtgctaaggttataggtgctcttcggattaaaggattttgtggtcaaatcagtttgggggatgatcatgttattaagataagtgggttgctcccttgtagtaccctttgggtcctgcgatatgctaatgtcactgtgaatttctaagatgttattagatgttttttgatgacacatacccttttttcttcatgatccagctgcaaaagtggtcaaggacacttgcttgggggaactgtatcctaaaacttcctagtttgttttttgttttttgagacggagtcttgctctgtcgccaggctggagtgagtggcgtaatctcggctcactgcaacctccgccttccaggttcaagcgattctcctgctcagcctcccgagtagctgggattgcaggcacccgccaccatgcccagctagtttttgttttttagtagacacgaggtttcgccatgttggccaggttggtctcgaactcctgacctccatgatattactgccttggcctcccaaagtgctgggattacaggcatgagccactgtgtctgcattcctggtttacattgaagactctttgaaacgttcagaccgcctagcatttttcttggaaaggtaatggcaaaacagtatgaaagaaccttaaaagctcatacttttgttcatcaacaaacatttcttctgttctgtattacgctttctgctagatatgaaatggatactgcatcatttctcaggtcttttcattctgatatatttctttttattctttatccatatgcagcatagtctattcattctaaggcatagtggacatacggtttgctttgcctttctgtttggtatattgagaatgtttttctgggttactgtaaggtgtctcattatcatttataatggcttataatgaccctttgagtttcagtatctaaccaaaagttccaaaattggggtaatgatttttattttgaattcttaaaaaaacccagcattgtgttaggttggttacccgataacatttacttgtcaaaaatgcttagggttctagtcatggccgaagtaaatcatttccacctattagttgcagtgagttaattgcccagtagatgctggaggctggctttatctctaaggctgacttgatgacttcttcccctctgagttggtgttctttggcattcttcagaaaggtcggttgtgttatatcttaacattatgtctcagaacacatcgccactaggtggcaggctctaacacttaacactgagaagggcaaaatgagatgaaaaatgtttctaataatgaaaaccaaatacctttaaagatcaagcccacacataagaaccatctttgaaaatgatgagatttatcactacatttttacaaatctatgagtcttaaagccatgtgatatttccagtgatgttcatttttaattgtgttgctttgaatcttcctctttctaagcttaatcctcagactttacgagacagtcttgagggtgaaaatgcagtaaaataaaattcttgtttttttaaagaagagatccacatgtctggtgtttcctaatgtaaacaaaatgatcagatttgatgtgttagaactcctaacattttgaaggaattttcaccatctttcttacattaacagcagaaatttagaaaataattcactggatgcattttactttttcagtgaaattgaaattgcttattctcttgttaaataactttgagaatgttgttttttttctctattctgtatacttttcatttttggccttggcatcagagatcataatgcagttgttgaaggtgggtctccctcttccccaatgacaattgaaagtgttcctgggaatactggctgaggtgttcactggtgcagtgccagcctctcccatctaccaggctcatgtttggcttttgtatcagtttggaggttttgtttttctttctttggcaacgtggcctgtggctgagaggtcagctacattgctttatgctctttccagagggtatgggtattttggtgcagccgtatttttggcagaagatgtcttcctgagttttaaatgacttcgcaaaacaaatgggattcaggcatcgcatcttggtgtgaatacttgccaagctccctttattttgaaagataaggatcttccctttgccttggtcttatactgcttttaaggcattcttatcatgctatgtaaatttgcctcacattttgatttggactaatgatctctcaaaaaatctgtgaaaaagtagctgatatttgaaaataactaattgatggtacgggtggacttctgttttctctccttgttttaaatctggggctgcctgtgagtcagaaacgaagccacccacttctcaagagcattttccccttcagccttcggtcgacacaaaagacttaaaacagtgaatattaccagtagaattgggactccttgaggttctgtagctataacgtggactcacttattgggaaataaagtgttaataccaggattctcagtaggatacaaaattaaattaattttcctcctcctcgccccacttttgtgtccaccttcttaagaaattgcttttcgaaaatagtacatagtggtaatttctagttttgttcggtttaatagtagaggttcaaagctttaagaacttattgtagagattcccaggtcagaatttccattagttacaaagtaatagagtcagtttgaatttggggcttagtctttgaggctatttaaatatcttttttcagcagctgagttgcagctgtaaaacaggttaattggcctaaaaaaaaaacgcacatttttactaccctgttgatgtgcttcgtagcacattttatatctaaacatatttttaaatttcttcccccccctttgattttctttagaaattaaaaagtaaattcttatgttaaggttgtcacatacttcttggtttctctttaaccgcccccgcccccccatatgaacacttcattttttatttttttgagacaggtctcactgtcccccaggctggcatgcagtggtgtgatcatagctcactggagccttgatcccctggctcaagcgatcttcccactttggcctcccgagtagctgggactacagtcctcattaccatgcctggctaatgtttttttgatttttagtagagatgaggtcttgctatgttcccaggctgtcctcaaactcctgagctgaagtgatcctcctgcctcagcctcccaaagtctgggattacaggtatgagccctgaacactttaatatctaaggacttatcttttcagagattcaaataatttaatagatttggtatctagggataatggttcccccaagacatcgtgtgtgcatgaggatcccttgaaggtctcagagactgcggttcaggagggacctggtgatcattggtttggaagttggctgctttgggaagcatgttggccacctctactttggagcaaatgggaccaatggtggacattcaggccaccaccattcagtgattccaaaggaggcggatctggaggtggccacattcccaagttccagaccacttcccagaggtaatagaccagcttgcatgtttactctgggtgttcgcttttaagtcagttgaatttcttgggtttgggttctaagtccactgaaggaaaatacaatgcatctcatgagaattgttggaatagccttccagagtcactgttttctttaaaagacctttgtgaggatatgatacatggatacacatgtaacatgtaatgtgttatttttggttttttttttttttttgagacagagtctcgctctgtcgcccaggtggagtgcagtggcgcaatcttggctcactgcagactccgcctcccaggttcaagcgatctcctacctcagcctcctgagtagctgggactacaggcacacgccaatatgcctggctattttttgtattttatttatttatttatattttttgagacagagtctcgcactgtcacccggctggagtgcagtggcgccatctcagctcactgcaacctccgcctcccgagttcaagcgttctctccctcagcctcccaagtagctgggactacaggcacccgccaccacgcccagcaatttttgtatttttagtacagacggggtttcaccatgttcgccaggatggcctctatccctgacctcgtgatatacccgcctcggcctcccaaagtgctgggattacaggcgtaagcactacgcctggccaattttttgtattttagtagagacggggtttcaccttgttgcccagctggtctcgaacccctgagctcaggcaatccacccaccttggcctcccaaagtgctaggttacaagcatgagccaccatacctggccagttttttttttttttttgagacagagtctcttcttccagccaggctggagtgcagtggcatgatctcagcccactgcagtccctgcctctgggttcaagcaattcttgtgcttcagcctcccgagtacctgggattacaagcgcacacaccatgctggctaatttttgtaattttagtagagatgggggtttcaccatgttggtcggctggtcttgaactcctgacctcaagtgatccacccacctcggcctcccgcagtgctgggttacaggcgtgagccactgcacccagctgtaacatgtgtatgttttatcataaacacagaacatagttgacatagttttttttggtttttttttttttacctaccagtatatggagcagtttccacactcgtaatattctacaccacatccatgacctttctttattaaagtgtttaaaagttgtatcagaatgacttgagggtagttgcattttgttttgtgtctttatctctttataacttacagtccctttagaacaactgtgagtattctccctctgtatttttattttaacattactcaagacatgactgtttacataggagagctggctcagatgtgagagagaaacaggggaagtgttagtgttagtatgaacttagccttttcttatgcattgtacagttcggccttgtgataatacatatttagcataatgaaggtcccctgccagtttaccaactaataaaggccaaaagcaactttaaaacttgcatttaaaccattctcgctgttctaattgaatttaaattcttttttttttttttttaagatagagtctcgctctgttgctcaggctggagtgcagggcatgatcttggcttgctgcaagctccgcctccggggtcaagcaattctcctgcctcacctcccgagtagctgggattacaggagcctgccaccactcccggctaatttttgtgttttagtagagatggggtttcaccatgttggccaggctggtctcgatctcctgaccttgtgactgcccaccttggcctcccaaagtgctgggattacaggcgtgagccaccacgcccggccaaaattctgtttcttttaacagtattttcagaaagtacattgacttggaaacctgagtttcagttcataagtagcaggttaaagagaattgagaccctagactggaaaaagctcattagggagtgaagtgcatcctttacttgccatgtcttggcaataggttatttccttataccacaaaacagaataagccatcatgctttgctgggagatgtgttttactaaatttacacgagttatgggtctggttagccagatctttgcagccaaaatgaaccaaagtttatgttattaacgacgtggggctggcccaggccagggttgctagctgcagctccgctgatacttccaactttgtaatccagcaggggctccttcatcctgtggcagctgcttttgtcccatttgggcttggcccccagcaacttcactttcatccttggccttgtctctgaacttgtagaaataagaatggccctacactacaggttgagagtagatgcaggagttgaaaggggagtgtctgtcttactactgtattcaaagcagctttcccaactgtccaggccaaattagataccctttggtatcgtcatggcacttggaactttgcctgattagctgttaccaggtgtggttatttaatgttcttatccccagtgtatttgaatctctgtgatagtggagaacttgtggcctttctcactgttgtccccagcctccagcatagtccgtggtacacagtaagtgcttaatgagtatttttgatgactgactaaagggttaaagtcagccttccttcttgttggtgactgacttggacaaaagaaaataaataacggtggcttatgcctgtatattttgtctgtccaaccttcttcagtgtctggtgtggggtcagaaaggggaaacagagtttttatttaacaatttttaatttacttttgaactgggtcatatagtccaaaaaaagggaaaaatacatagttttccaacactttcccagccttttcccttctgtagagggaccaaggaatataagctttagatcccaaagaagataggtggtcttctaacctaaggatggaagcctttatttatttatttatttatttattttattatttatttatttatttatttattttttgagatggagtcttgctctgtcgcccaggctgagtgcagtggcgccatctcggctcactgcaagctccgcctcccgggttcacaccattccctgcctcagcctcccaagtagctgggactataggcacctgccaccatgcccggctacttttttgtatttttagtagagacggggttttaccgtgttagccaggatggtcttgatctctgaccttgtgatccgcctgcctcggcctcccaaagtgctgggattacaggcttgagccacgcgcctggcctcaggatggaagcctttaaattaagctaaatgggaaatccaggctattctcaaatgtgaattattaagacttctttaattataatttttgttgtgatggtgtttttgtttgtttggtttttacttcctgtctctgtccctccctttttaaaaatgtgtgccttgttttgtcaggtaccacaagagccaggccatctatctggagtcaaaggacaaccagaaactggctgcgtgatcagttctgtaggagccaatgaggtgggaaccacactccctcacctttaggaagcaaaatgtgtactgcgaagtgttggtagggcaaacctgaaatgaaagtgccaccaggaagtacagtggagtactgtcttctatgtgggttagattctaaagtcaggcagaaattcacattgtcaaaatcatccttgaaaagtccttacattcgcttgactacaacatatgcggtttgtctattccatggggtatttgtgaactcccggtacagctactgatttgggaaccacgagctagattccaggaaagaacaaaaagcaagtctgtgtggtgtctgtacattcaactctgcttctttttttttatttttattttttttgagacagagtctcactctgttgcccaggcggagtacagttgtgctatcttggctcactgcaacttccacctcccaggttcaagtgatttcctgcctcagcctcctgagtagctgggattacaggcacccaccaccacgcccggctaattttgtatttttttttaagtagagatggggtttcaccacgttggtcaggctggtcttgactcctgaccccgtggtctacccagctcggcctcccaaagtgctgggattacaggcgtgaccaccacacctggccaactcctgcttctttttaaggtaaccatctactgagaatggagctgactgtggagcatactccatcttggttttgtttctctagaactttcacacataccagtgatttgtttcttgctgtgaggattgaatgaggcacctggcacagggtctagcacccagtagtgctcactaagtgagtgctggcctgaaacgacccacacgccacttgcctgccgtcttcctagctgagatgtcctattgtgcttcaaaacaagttgccagggttatgcccttggttttggtctcctcgagacactcctttaggatggatggggtctggttttaaagtcagctcagaggttatacctgaggatgatatgactgccctctgagttctccaagtggtctttcatgagggtatataagcaatgtgtaacttatgttgttagttaaagttaaaaactttaatagctggatggcttgatcttttatcagtccacaaatgtctgcaaagaaattgatttctatgtgtctgcctctgtaacttattcgtgccagtgcacagtaaatgtaatgaaactggattatgaagtacttaagcctcttctattcttccagcttcctgaattgaaaatgccctgaaatgtgactagttgcaaaatgattgtttacttagaagttagggagagccttctagataaatgaatgccatcttctctgggctgaggatccgtgtgagtcccctcaagccaagtcagaaccagaacagggagctaatagagagacctggtcctcagccaagaggtgtcacgatttcatggtaatcatttcacctggctgtctgggttgttccacaagcacatgtggccttctagtacctgaccctaactcagaaccagtgcattattctcctctatgatacctcaagatttttcagaaaaatataaagcaagttagattgtttttcccctctctctgccgaatattgtcgcgtcttgacataataggtgtcagtgagatctgacaaatggtgacactgaaacacgtcttctggaggggagaagctcagtgcactgaagacatgcaactctggcaatggggaaaccgttctcatttcttgaaagtttccagctcatttttcagatcaaattctaggtgacactggagctacttggctttagcatgcttgactccaagcaggtttggtgggtagctctgagtgtgtggatgactccctgacttacttttcttgggatcagtttttcatttaaaatgattctgcaaggtcccttggaggcttagttcatgtgaggtctttaactttttaaatttttaagccagtgtatttgactttaaagcagagagatactgctgaataatcacattaaagaaattgagatgaaacagaataagcttttttaaacctgaaaactgagtccaggaaggaggagataaatctgtaaacttgtatatttgggtagatgcagacctttcaaaaaactgtgcttttggctctatttaattgcatgttacagaaaacaggcaagaagaagccagagactgctttagtagagaagagccaggggctttgatgtcaacaccagaattcacgtcgtgataagtgactcagccttgctgagctttggtttcctcttcttaaaatggggccaatgatagtagttatttcatagggttgtcttgcgggtgaaaaagctagcctgatcagcatggtgtctggcacacagagctcagtaaccctggctcagggggtcagtgactggcagcagctccccttctcacccatggctttaggatgccccttattgagtgcacttgtcagccctggcagtcccctgttgcaagagttcattctcaattcaatggaagaatgctctgccctgtaaaatgcactgtaatctaatactgtctgtgagagggggatatggtgagggggaaggactctcggaagtgcttcaaccttctcatgatcctaattgggccttagctcatagtgggcatttttctattgttgatattttttccctgtttttctgcacaaccattagcctcattgccaggaaaccaaagtattgaaagtttgtataatatggaagtcccttggagcaagaaaatacttccaaatttgaaagtttgtgtttatgaatagatgtctcttgagtgttgatacacagtaatcaaaccaaatttaaaagcatctttaagatcaaggcagaaatggaacccaaattgctgtgctttccattttcgtaatcacaggtgtgagagagatggctgagaaacgagtcaaggctgatgcctgttcccagcggcatgcctttagatggcccgaggtcaggggtgctttgaagccctcacaagttgagacagtttattccagcaagaggctaccagccttctgcttgatctcactcgtgcagatattttgatggtgtaggagatttgctcttctgtatttaactttcatcttgttccctttcctctcccctgcagatctgggtgaggaagacaagtgacagcaccagatgaggatctacctgggccagcttcagcgcgggctcttcgtgatccgccggcgctcactgcttgactttctacagtgctcttctcttgaccctttttctggagtgggttttattttgttttgtttcgttttctccttaatagaaaaatgttaacttactgggaatagctactcagcttggaaatggagagcactgcagtgaattctttagggcacttttgtggccggatgcttcaactttgtcagtcttttctgcctcaacttcttccagacatcagtcaccatgagactgtttactttcaggcgtattggggggtttgatttactttccttttatttctttattttttgctatacttgtttttgaaaacctcctctgagtttgaagggacagctatttttattgattatcttaagtctctctaccatggagaagagcaggaagggatacactctccagtgcattttcatttttgaatctgattagtggatcacgtagctactttccctgtcgcgtccaattcactattgcccagaagcttggggcagaggtcctagcaggagatgatgaattctcgtggctctcggcttctcagagaaataaatgctttgtgtaacatctgtgcacaccatccattccgctcgctggcgatggaaaagcttgcctggaagactatgtgcactgaagtaaatggggttgggggagggacatttcatatttataatgtgctgaaggtaccatattttaaatgttatttaatgcagggatttattcaaacatttgttctagcttaagctggaataagcagtggtcatttcagaagtttcatttgtaattccttcctctcccttgttcccaagtaggtagtagtaagtatgtgccaaggctgattatctgggtaatcttttacgggtgggaggtgagattgatagtgcaataatcgtgatctatagaccctcatgcacgattcaagtttcactcttgtggctgatgccattattcacattggccattccaaacctgtggagaactttgttgtcaggccctgagcgctcacagctcatttggcccaggttgaagacaaggaaagctctgctgtggctgcctctggactgacacctccctaatgagtcctgatgaaacagcctttcctacatccttccctcactcccatgattgagaaatgattcattgggtgatgagtgttggggttttctatactcatgttgccatcttggatgttcaaaaaatttggggttagagcaactgttagcgtctctatgagcaatcagtagacttacacatcctaggaaatctttctttgtaagtaattcttttggtctcaagtgattctctcatgttgtctcttgatgtacatacccccaagcaagttggggggactgtgatgacaattaatcaccttctctgaagttctggctctgcagagaccaaaccttactgacttgtacagactgtacaagtaaagacttatacagatagatttttgttttaacttacaatccgttttttcccttttttttttttttttctggtgttggagtcttatttagaaaacaggataaatgacgctttatcaaaagttgcctggggttctgtatttcttctctgccctccaatccccgactgctagatgtttactacagtgaacccagcccatggtaaacacaggcttcacctgttcttgtttgtagccttgactgtgaggcaggacttccctcgcttgaactgttacacatacgatgtgtgttcacatcacatattgtgcagctgttggttttcatgtagtgccctgcgatggaaattagaatatttcatgtatttttccattgaaggtggagtttttcaatgatcatgtgttttgtcctctaaacagtataccaaagtttgtttttatagttgaggattgtattgataaccactggggtccgcattgaagcaggaacaaattgcctctttttctggccttctctgtgggacctctgctttgtgaagcaactatttatttgaagaccagggtatgggcacttttgccttctctcctcctgacttttgagggtattgagggcgcccttagtcatagtctcgactccgccattgcctttcctcggcgtcctcacaactcttaattgggcctagtgaaaatgggggcaggtgagaagtcattttgagaatcagcatagtaaattacatttctaatcccagaggacttaatattttctttgtcaccccagaggtgaaaaatcagcagttgaagcctgacaggcctcagtggtgaccagaacagaagcagccttcctgttagtagatgggggtacttctgtggtgggcagaagccttctaaaggggaagacagactttgaagtttctagacgagaaggaggctagcttctagcctggtggccattattccaaaaggtcattgtttctcactagaccccagggcaccagatgaattccaagtttaaactctttcctgcaggtgattactttgaaaaaggttggtccagaccatttgatcaagaacctgtatatgtgttgtgttagaggcatctgcctcaagtctatgtacagtgttgctgcgggtgtgttccaatattcattttacctctgcttgggggttttgtgtgttccctccccccatgccctgcctacccccttttccctgaaccacgtccttttgaataatttccaatggatttctgtagccataccaaagccagggtgttttcattcatgcggatactagtattatagatgtctgactacctaacttaatttttgtttttgaacttctaattggggccagtgtaggtcgatcccagaggctgatctgcaaatcaagctacatgtatttgtgtataagacccttgttcaggactgggtgacttttctaagaaatatggggtttagaatggggttgactgtatttttaacctaattctggagagaagattgtattttttacagttttttgggtttggcttcctctcacatttctttagctttgaatttttactaaataaatttcctcctgattaatttttttttctcatctgggaatttgaaatctcggtgcttactgttacaccaatttgtccaaagagtgaaatcactttaatgccagaacatggtaaatttgcagccatttcaagcaggtgatggttttttttataacatcgttaacgggtaccattaaatattctgagaggtgaatgtaaaataaaaaggtataggtttttttttttttttaaagaaaacaataaactttcaaagagaaaaccgcatgaagtctgtattgtatccattgacttgataagtgatagaaatttattttaggttttgatccattgcttatggggaaaggaagttagggcagaggaagggatattctagacatttattcttagtgaagactaagatacagaatgatgtcaggctaatactcagttttgtaaagacaatctggggtgttgacccttaaatgtttgtgcactcttcttgttgcagataaaagtcataaaaatcaagtgaatagaatggatcttgggtggaaaaacaatcttgaaataaacttgtattgaggatattgttcatttggtgcatgattaaggaggatattgttcctggcttttgagtagtgcctaccaatcttaaccaaacagtgatggtatttgtactgctcccggggtcagccacaagcctgcgtgctgccacaggtgaccgacctgtgacccagttatggcacccctttggaaagactgctttatgctttagatgatggagaggggtggtttctgtttttaaaatgtttgattagacagaaatgtgcacaagttttaattgtagaagttgttgaaatctctcaaagtgattcatccatgtaactattatagcatccagatcaagaaataacattcccagaacccacaaccccttagactttcagctactcctcccaactagttttctctattttaagtaccttaacctcaagctcttgagctgcttccttccatggttgttctagaagagccaggtacctggtatagctagggattgaccaggaatgcaaagagctagcagcaaaggatatgactaattggggagggaaaaacagattcaggtcaacctgctcaccctccccattgttcccaaggcaagtggggttgcccttgatgtcatagtctgccttttcctgagtactttgtatatatgccaggcactgactaaacccctcatgggaggcactttctcactaatcttcacaatctctgaaagagtactactcccaaatttaaggctggctcagtctaagccttgacttaattctagaaacccagagccagcactgtgcctcatacgtaaatactctgtaaatgttagcaaatgatattagggtatgtgtgccaaggcaaactggtgagtaatagtgcatgttctgggtgctggccccttcccttggttacctcatttaagcctcataataaattaaggagagtacactgctgctgtcaccagtatcaattattattttggtcacccatgaagcaagcatctcaccagtttttaaagaaggaaaagactccttgaattagaggaggtgattctccaaggtcacacagtacataacagtctggattaaagtttccaagccaggtttcccctaaccactacactttgcagtccttccccatgttatctgttaaaattacgttcaacatttctgcctttcttcaggatttccctgggaggtttttttgtttgttaaaatacataagctgctttcacctcctatacacacatgctcccagagcaaatgctagaagtacaaacactattatttgcaggaccctttcccctgcctgataactctggtttctctcttggcaatatagttgagagccatggtgaccagccaagagcttgctttctgtgatcctgcatgagtataaccatcctaaaaaggaatggaaacagctcattggtcgtgatagaactgctttatccaataagctacaagagagcctttgggcaaaaacatgtatcggtatttttcagatcacttcctccctccctgccttatcatctatggagttggagccattgaattgtttctaaaaatgtcggtatggagttgggccttcagcatcttgatgctctgatgtcactgacctttccatggcatgccctcctgtagaggcactgtaatggaagaataaataccttagtccatgtcacctgccccgaaactgctcagttctaattggcgacctgcttatcaaccaaacaggagtgtgcagtctttgggcagaggcaggagtagaaccaatttctggcctcttgcacatcatttgaggaactctaagccccatccttgggaaggctaagcacttttcctgcttttaaaagcaccagatggaatgaactagaaacatcatttcactccctttgaacataatatggtaggaatacatttgctttaggaactttggtgtttaccagaatagatgtttttgtgaataatgattattaagacaaaaaagtagatttaggaggatccttagaggagagaggtagataaggacagcataggtaccgagatgcttaatccctttgctcattttctctaatctgtgtttaccgattccctgaaagatacagatctataaaatattcactttactgatacgagaagaccaaaacccgaatcttaaagattcatatttttcagaagtcggagacttagcggtgtgttgtgttttccgtaggctgatgctcagatctgttggcatcacctctctctgccagtggtgtggacggcagggggtacagtaggtggcattcccagagccagtcaggaaaacaatgccccaggtctgggagtcagcaacaccggtacggagcaagcagatactcaacgcaggagtacagtacagttagcaagcccctgcaggtaaccaggaaccccctttatttcaccaccaattattttcatagtgtttgagtgtttactgagatgcagggtggcattatggctaagaacagaagctttggatcaggatttgaatctggctttactgttaagctggctaggtgtgaccttgggcaacttatttctttgaacctcagtttcctcatttgctaaatcatatctacttcagatatgtttttgggattctaataatattaacacagccccaatttccttctggtaggaatacaatttaaaaaatatttaaaacatagcacctactgtgctaagtattctgttaactcactgaatcctcgtacaaccctatgaggtagctacaattatagtccttgttttgtaattgaggaaatcgagaaaagagaggttaagtaacttgctcaaggtcacacagccagtaaatggcaagccgggattctagcccaagcagtctctccagagtccctgccctcattcaccctgctgtactgtgaggagtcataacacagggttggacatggttactgccagtctgtggagactgtccctaccattacaatgctgtggccatttgtatacttctctctttggatgctagtctgactactagatcctaacgatcagaaccatttcaggaaagctacttcagctaacagcagaccacgaaggtaaagctctggctttagagaccatgctcagcatcacctcctacaaatgggtggggactgccccagggcaggggtgagaaggactctgaggcccaagttccagtagagcaagaaacagttgcccaaccattttttctgctgtgagcaagggagtccatttagtgttcctgatttagtttgagccctcatttgaagatgaaaacagctgcagcccagagatgttaaatgactttcctgtggtcttgagctatagtcagtaccacagctgggctatagtcagtactacagctggaatatggttagacaatcatttgaggacctctttatgccgggctgggtgctggaaagcatagtggacagctctgggatatgagactttcaggactaaaaccagaaagtcccaggcacactgggatggaaaaccctaacactgccatcgttctatgggttcatttttgcctctgtctgtacctgcccagtgaggtgatgaaggccctgagttcataatcctggcctagccactcattaaccttgggacatttcttagtctctgtgtgcctcagtgttagggtattcccatcccagtgtgcctgggacttctggttttagtactgaaagtcttgtatcccaggagccctgtcagactggggcaagctggatggttggtcaccctacccagtttccactgtaaaatgggggtgacaactgctgtttttcacagatttgatttgagggttaagtaatttattattgataaagtacttagaaatagtgttgggacatagtcttttctctctccctttctgtgtatatagatatacacacacacacgtaatatgtgtgtgtgtaatataacacatatgcacatgtatatatacacacacatatacataacacattgttagagatgaggtctcactgtgttgcccaggctggagtgcagtggctattccaggcaccatcatggctcactgtagcctcaaactcctggcctcaggcgatcctcctgcccagcctcccaagtagccgggactaaaggcaatacatatttatttttccttgttattcttttttcattattattggaagaaagtgtttccaccacagaacgggtccctggagaccttcatcttatcccaaacaagacagggaactttgctatgataatcttttggtcacctgcagccattgtttggagtgtttcttcatctacttgaaatagtaaataatcataagcttgaggaacaatttgtcattgcattcaattcaaaaaccatttattgaattttactgcatgttaggtagtttctaggctcttttgggggattcagagaaagctaggcaggccttgagcagtgtctatgacaagaatgggaattccatacagaggaaatggcttgagcaaaaagacaagtggatatgagcatgtttaaagtcaaatagtagcgtgtgtttaacatacatcacaagccttgaacttttttcttttttctttttttttagacagagtcttgctctgtcgcccaggctggagtgcagtggacaatcttggctcactgcaaccgccgcgtctcacaggttcaagcgattctcctgcctcacctcctgagtagctgggattacaggtgcctgccaccatgcccggctaatttttgtattttagtagagacggggtttcaccatgttggacaggctggtcttgaattcctgacctcatgaccacccacctcagtctcccaaagtgctcggattacaggcgtgagccgccacgcctggcccaagccttgaactttaaaaccagtttgctccctgtttggttatctttttgccctttccctcgaggactcgccttcctttcctttctgcctctctcctttcttctccccactgtgcctgcctgcttgctcttcttcccctttctgtcaccagtgcagtggctcatggctgacctgcaggatgctttccaatttcacactaacatgctcctgaaagtattaataagctaactcatatgaaaaccaataaagggcaacagcacacattcctgttagacagtaattttacctgattcccttctcctactttgatcagtcctcttctctcaaacatggttctttgaccttcccagaagtaaagcttatgggaattcaagcttggtggagccctgcgggcatattaggaaggaataaggctcaaatttattgagcacttatgatgtgtttgggtgagggctaagtactttttatacatattgtatttaatatactaaactgccctgtgatgtgtgtcttcgtgatttccattttacaatgatgaaaatgaggcttgaggaggggaagtgttcacctctgcaccacgttcacacattcctttcccctttggcttctgtcttcctaatgtagatggccaaagcataaaggacccttattgtcatcttagccaaccccttccatttttcgcttctggaaacagacgccaagctagaatcagttcttgtaactctcaattcaacaatctaaatggagaaaagaaatccagttgtgagctcagaggcaggggcttgagacaggtttgaatctggattgaactctgctgcttacaagcgtgtgaacttaggcaaatcacataacctctcggggctccagtttcctcatctagaaagtggactaataatagcaaggtttattgtcaagattaaatgaagtcatgcaagcaaaacaattaataactattgtgcttcaaacaaactctgtaggtcacttgagtgctttagaaaatatacctggccaggtgtggtggctcacacctgtaaccccagcactttgagaggctgaggtgggggatcac

SEQ ID NO: 5070 - DNA, 47112 bp, Homo sapiens
aagaccagaaagctagaacagaactaaaataagatcatgcatgtcacaaaaaacagaagaaaagaccactgctcacaaaggaactgcaactttagcgatgtagtcctcctgctttgcccattttacacttgaggaaatggaagcttagaatggttagataactgctcaaggtcgcccgtttattagtggtcatcaggattagaatctaagcctcctgagtcatactttggtgctcttccataacagcatagttgtaccgattacattaatggtagtaaatgatactttaaaaaggttccataggcaagaatatttaaatagagtgttaaacaagctttctcactgtaggacttccaatcctgttaaaatgccaatgtatactatgaatctcagaggaaacttagatgtttcccgctcagtgtggtggctcacacctgtagtcctaactactcagaaggctgaggtgggaggatgcttgaacccagtgagaccagcctgggcaacacagcaagaccctgtctctgtttaaattattttaaaatttttaaagaaaaaaatgtttccccaactttggacaattcttcactgtatattctaagtaaaaacgaatataataaactgactttgagctttggggaagtaaaagataaatatgtaaaacatcaagttcatatgacatactcaataaacactggttctacttaaagaaatattgtgccacatttttctcagtgagcctgctgcaatgattttaaaatcagggaaaaaatagtttagtaaagaaatggaaggaatgatactccttctcaggactgtgaattttctggtgtatttcttctaaaaatctaaatgtattcccaattatctcactgattttcccataaagagaatgaaatacacacaaagaatggagaagcacttctttgttccctaagtggcaaagcggcatgtgacattaagccttctgactccacatccagtctctttgttccccaagtctaatccaaaactccaagaagaaaagcttcttaccacctgggcttctgaacacaacaggtgcagtgagttggggtcctggggggtcgcctctagatccatgtcatcactgtcagactcctgagcacagcctcttctgctccctcctcatgctgccagcccctctgccctggctcttcagtctagcatcgctgcctaccaggccagagtgagaggctgctgcttccaggccattactgggcaggcaatgacctgagcactcatcagggcttccatctcttcaaagaaggggcaggtctcagtgggtggccgctcttgactttccgatagctcttctggagacctttgaacttggtccgacctgttccagggtccggaggaagccatattccctgagccgctcagccacagccccatacattggctgttcctatggcagtttctgagagcctcataaaactcagtctggctgagaattggaggagcgttctggtctcttcatagccccagtgcacacctgccaccttctcatcttcaagctccagtgatcctgttccacccagcttcttctatctttcttggatggtaacagatcagatgcactcgtctgtctcctatgtggctgccacttggaagttctttctccttagagcccacagatctgggatccatggctctccttgctccaacctggagaccacaccggatttaggaatggcaatcctgcttgcagggaaacaaacaaaagttgtcatagtttggactgattatcacaaaatcttgaaattcagtcctgcctttttcatccaagaggattataaacaaagtgtctaggaaatgttttcagaaagttcagtgggctgaaaaaggtggggaaaatacaggaaacctcaaagatgagaaatgttttattttccagagcagggtgacaagagaggaaaggattctgtttgtgttcagagcagataattctattccaagctctcctatttgtaggcaggtcctagtacgctgggaataattgttcttcacttggggctacagaattaaactcggcgtgatttcaaggggaagcgagagaagattgtctttaccttatccgtttccttcacagtcagtcaccaggtttaaaggtgttcaccttagtagtccttcctctctattcctactgccaccatccaagtccaactacttatcctctcacacccagataattgcagcagtcactgttctacctaaccgcaggtcttgcttgccagtgcacatgctaccctggtgaaccttaaccttagtgcctaccataccattcctgtcagactcttcccttcagaacacagcacactgttgttcaccactctgtgccttacttttaattccctcctatccaattttagcccatccttcaagaggctgtatttgccaggccctcaagaagccttaccgtcagccctccctcatctcccactctgacaaacccatacgtactcacacaattgggcaagtcattgtctggcactgtttcagttcagttcagttcggcaatacttaagagttagctatagtgttctcaatcatgtttttaagttctttgaggataggccattttcttattgcagagtaccctgcaagatgttgagcaccttgacaggtgttcaaaaatgatgaactctgcaagtctgtgtgtgagattcagggatttcatctgggtgactaaacagccattaccaaactggctgagaaggctattgtcttggatgataagatcagaattcaaaacacctcaacaaattttaagtgaaatggtaacagaaaaaagcatacaacatggagatcaatgactacaaagaagaaaaacaagttctacaaaaatcaagtacaagaataatcaactaggttaaaggcattggggaaagctatcagagtcctggaagttaccaggtgaacaaaaaaatatacaggttgggctatactgatacaagacattgcaagattctgaagtaaaattcttacttacttctaacagactttcaggaaaataataaacataatttagttccccacaattaacatgaatttggagaacttaaaggttccaatagagagcaacagaaacttaggtttaaagaatggacttggccgggcgcggtggctcacgcctgtaatcccagcactttgggaggccgaggcgggggatcacgaggtcaagagatcgagaccatcccggctaaaacggtgaaaccccgtctctataaaaatacaaaaaaattagccgggcgtagtggcgggcgcctgtagtcccagctacttggaggctgaggcaggagaatggcgtgaacccgggaggcggagcttgcagtgagccgagatccgccactgcactccagcctgggcgacagagcgagactccgtctcaaaaaaaaaaaaaaaaaaaaaaaaaaaaaaaagaatggatcttctgggggaaagcttaaggtaacaaatatagttaatttgaagatggaaaacaaccaaaaggaagatgtgccttcaagtatagaaaagaattttatctagaaaataatgacctatactatcatcattaccaagaggaaataaaataattcaagttccgataaaaactagggagccattctcttgtggacttatcaagaggtaatatgaaaccagaggctaaactacatgtcaacaaccacatattctgcaatttccacttactcctgaatccctttcccactcactattcccaaccctacttcccaacttggaatggcagtctatctcccatatgaatctactcctcaccgctcctttgaaaaggtttgagcttctcctttgggttatctgctcctgtggtcccaggtctgggcttcttgccctctctttcttgggtacacccctggctggggttccactgactcctgccgaacacttaataactcttgtgatgatttcggggggtcatcttctccaagcgcacttcctgccccttcacagagactgtgacctagaaacaaccccgttaattgtcactgcaagatcataatgaggggcattcccagaggagagtatttaatacccaaaagagatcatctttcagagccatggccagggttgtaggggtgagggaggttaaccgaacaagggtcttattccattgccattagcttaaagcagttgaaactccagaaggaaagatcaaaatagtaaacccaccttcaggctgaaaaaaaaaaatcccctttcttccctattagaaactataggaaaaactcattatgacagggtaggtgaaggtacacccaggaagcatcccagacaagcactatctgaaaaagttacctataccagaccagaagtataagcctcaccagggagactgtgtccctctttaagcctgtctatatcttaatttagccctccacccagtatacacttttgaatttgaattccccctcccttctcaccgaagatctaggtcttccaggctcctttctaaatcttccacgagagtcactgcctcctctccattttctggacattgttcctgacccaattctggatctccccaggtaagacggtcaggaactgctctagcaccaacagttcacaatctgctccttggtgcgcacctccggccttagccaccgacagcaaagttcccagagtggctgaaagcctcccgcggcccagccacctcctggtaatggaatctcctgaaacgctgcggaaggtctcagagttagtgccattctctcttagagctgatttggccatcattaatagagaatgcagcttcccttcgcttaggagtctgggttccagggcttacatctatcttcccagtccttggagaatcccctgcagatgactgtaagaggtgtttcttcctagggcagagaaaatggcactatcagaaggaatacattcatatgtctaaagtcttgccagagctggcctgccttccatgtgctccgagtggccttctaaggtagcacaatcttcagtaaatagactttgcaaaactgcttttctggttgacttccagggcagccccaggaagcagcagagaataaaagtatgtctgcccctctcccacctcctccaaatccgatcccatttaacttccctggccaatgtgcacagtgagtccgaaccatataggagagctggagttcgagaggatctaaagacaagtcccatcctgcttgaaggcaacaaaaagcctctgtccagctggtcgcagctgatctcccccgtatctccgcagtccttcccgaggccttctgcgtccgccccgccccctcgggctgcacactcccaaagcccaccccaggcaaaaatcacgtccagaatctcgggtctttgttttcccccgtagtagtagccgctcagcaaggattagggagctacctgtcggaaaacctcgcgcaagagagaagctggttttggctccaaagcgaggaccatgggggcttggggagagtcacattggcaggagagacggaatccgaggagcagtagtaacgggcttcctgaggacgggctcgggttcggccagaggctccaggtgctgccggttcgcggacgcagagctctcagcccaaggagcgcggctgcgggattctggcctcttttgtctccgctccctccggccgggtaacccggagcgtcgtgcggtccctccagaggcctctgacccggctaaggcgccctgagggcgccctccacccacccctgggagcgtctccctctcgagctgcccctcaaccccctcgcatccttgcctcgggccagcctcacccactcggggtccgaccctgaccccggccccggccccggccccggcccggctctccagcctcccaagtacagctcccaaaccggaagtccgagcgggcggctcgggcaccgagggcgcatgcgcgagggcagcgaccgcgactcagtctccgcagagcccggggggagtagctggtggaccccgttgagctgccgaacttccgggactcccccgcgacccctcccagcttcccgtccgctccgccgcagcgattgtctcggtgggttgattcggcacaaacgcccgacccaggggccggtgcgcgtgtggaaggggaagcactcccctcgtggtcgcctgaggtgcgctggaggagggggtgacataaccagggactcgaggtccgccgtgggaatgatcacgaactgctcttggctctgagcgggtaccctgggtccattttcacctggaacaagcgagtggcctgcaggtactgtccggcgcagagcgcgggaaccagggagcgcaggaggggggcctgagccagcgcctgggggagtaggctgagggacctagcgagcggggcttccagggctggggcgtatccctggacaggtgactggagggcagccccttagggtcaaggctgatgcgaacctagagaggccgggcctaggctagaaaacggagggcagacctcgaagagccccaccttggcggggcgaggaaagggcctgaggtccaggtgtctgacagttgctggggaatgatatgaagtgtgggaggcactttctcctatttattttcacacgtgcattgtttgagttttgaatactgggccaaatacacagctcccaaacacatggtaagcgctcagtaaagtttgttgaagaaataaatgaaatcgagagcgtgtggtgtttccctcattactcctttaccagaaaattctgcactaggtaaagcacttggtagggggcctttgtgtaaccaggaatgtatgatgttcgtatgcattatcttatttaatcctcacaaccaccttatccattttacagattaagctagtttagaatagttaaataactatcggggtcatagctagtaattaacagagcttagttttgagccaggtctgtctggcttcagtatttgaactacttttacctgcttctgcttccagtaagttatctaatgctctcaataatttagtccacttaggtattgtttctaccagttaacaaagagcaaactgaagctcagaaaactttatgctggccagtcctagtagtggcaagactgaatctaggtccgtctgatcaccaagacatgccgattcttaggagactgtggaagagcagaaaagtacattcttagtctataaaacctataaatcaaacagtttcctttcgttattatttagaacatgtatttggagtttgggagtttaggtgaatttttgaaaaaaacaggtgaagattgtgtggtggagtttgaattgttatctttcacctgtaggtctttgaagactaattcgatgttcacttttctccatagatcttagtacaatgccaggcatataggaggacagtatttaggagtatgtgggtgcctgatggtccaaaataagaagagataacacagtacaggaaagatagtagggagggggtgggggagacaaccacaagtaattcatcttttcccttcctttctttctatgaaaaattctcaatcatgtattttctaccatttcatcctcaaggtctcagctttaaatcactttgtcagaaaaactttctctgagcacatctttaagcatcctcccctgatgccatattctccatcaacttgtttatttcccttgtaggatttgtcacaattcataatgtattgtgttacctgtttttagcctttctcccgcatagattgcccctgggagcgaagaccagtggtttcttcattcatctacccagagcacctagcacagtttctgccacatagcaggtgtttagtattgatggaagaaaagaagacaaagatggcaaatattacataatttctgcagagcagttcttttacatttgagtaaagggaaaagttgtcatgagtgccaagtgttaatgaaaattatttattatattgaatatgtatatacataagctaggtataaactcaagcataatactcttaacaactataaaatcaaatatttttataaattaaaagtaaacaaaactaccaaatcaatagttcaaatgaccattattctaatgcaggatttctcagcctgttcctataactgtgttaatagaatggtatcagtaacttcgagttattatttgctgtttcagaataattagatattgacttttcgaaaactctgccaacaagaaacgctcaaatgccaattttaatagtagtatcattgataactggtagagctgtcttgttaataatataaaattgcttatgtgtattgagcacagctatgtggttgggatatgtgctttacacatgtattaacttatttaatcctcacaattttttcttcagtttataggtatgaaaacaggcacagacaggtatagtaacttgcctaagcttcaagcaagtaagaggcaactcagggattcaaacccaggcagttgggctccagagaccggttctttttttttttttttttttccgagatggagtctcgctctgtcgcccaggctggatgcagtggtgcaatctcggctcactgcaagctccacctcctgggttcacgccattctccgcctcagcctcccgagcagctgggactacaggcgcctgccgccacacccggctaattttttgtagtttttttagtaaagatggggtttcaccgtgttagccaggatggtctcgatctctgacctcgtgatccgcccacctcggcctcccaaagtgctgggattacaggcgtgagccatgcgcccggcaagagaccaggttcttaagcaccgtgttgtgcaacctcttaagttactacttgaagatgtgattagcattgtgtcattaaaatctacattaattggattcctaatcaatttctatggacttggtaacagaaaaattcttcttcgcctatttgttaccacatttactgcatataaaatggcatccacatataatccatattatatatccatccatataatatgctaattcctttggagcagtaattgtatctgattttgttcactcttttatctcaaagtattagccagtacctgggatatagtaatggaaatgtaaaatggtacagccattgtggaaaatggtaggcagttcttcaaaaaattaaataaaggccaggcacagcggctgacacttgtgatctcacactttgggagggtgaggctggaggatcagttaatgccaggagtttgaggctagcctgccaacagagcaagactccatctctacaaaaaaaaaatttttaattagctgggcatggtgaacatgcctgtagtcctagctactctggtggctgaggtgggagaattggttgaacctagggttcaaggttacagtgagctatgaacccaccactgtattccagtctgggtgacagagtgaaccttgtctctaaaaaaaaaaattaaatataaaattcccatacaatctagcagttctattcagggtatatcccaaaagaagtgaaagcaggaacccaacagatatttgtacacccgtttcaccaagcattattcacaatcgctgagaggtggaagcaagtgtcagtgcagggacgataggtaattgagatgtggtatatacacacaagggaatattgttcagccttaaaaaggaagaaattctggcatgtgctacaacatggatgagctgaaataagccagtcacaaaaggacaataatgattccactttttttgagacagagtctcgctctgttgcccaggctggagggcagggtgcaatctcagctcgctgcaaccgccgcctcccgggtttaagcagttctcatgcctcgcctcccaagtagctggcattacaggcgcccaccaccacgcctggctaattttcgtattttagtagagacagggtttcatcatgttggccaggctggtcttgaactcctgacctcagggatccacctgcctcggcctcccgaaatgctgggattacaggcgtgagcaattgtacccgcctgagtgattccacttatatgaggtagctagagtagtcaaagtcagaggcagtagagtgtgtttggcaggggctggatacggagtttcatttggggcaaacaaaaaagttctggagaggatggtggtgctggttgcacaacagtgtgaatgttcttcataccactgaactatatactaaaatagctaaaatggtagattttattatacgtattttaccacagtatttttaaaaagtggttgaaggaatatattttcccactacttttttctacctgaactgctgtgaaaccttttatatagcatattaggctatcatttggctttcatttaaattaaaaatacaaatgtaaattggacactaaatatatatggccagttataaggtgcatttacagataataggtatgcttattttagatttttactggaatgaaaacaatgaaaacttctatagggaatttgtaaatcctagaatatgtctgagaaacccatggagtctgcagacccccatttgagcaatattgctaaaagactttgttgcaaccaggtcaaaacccccatatccttagagaccatccctagaagattcttaagaagcaggtaatagcggctgcttctggggtggttgacttatttttaatgtacacattttatattgtttaaattatttagcatgtgttacctattttaagaagcaaataattggtcagggatagggaacccctttgaagtgctttggaaatacattgttatccagaacttaaccctttaagtggacatcttgagaaagaaaacgataaatgtgtagtatgaagcgtttgaagacctgaaagttggggcagcgactggcggtgttttcggcagtgttcctcttcctgcaggttcgcaggacttccctttcctccaccccagtgagaccagtgtcctgaatcgactctgccgctcggcacagactatattcgcttcactgagttcattgaacagtacacgggccatgtgcacagcaggtgggtcctgttctctgtgggtgtacacctctagagggcaggagctatgtcaactttcacctctagagggcaggagctatgtcaagctttcagtgaatttatcggtaattcagtgaaataagttatggatttctcatcactagaaatattcaagtgaaggcaaggcctctattggtttgtttgtataacttttaaaagaaacaagcctgataatgtctttctcaggtttcgggcctgagctgagaagttggcttctgtttgtttgatttcaggatcaccatccatctcacagggccaaggtgggttacatggaatctacctgcgggccttctgcacagggctggattcgttttgcagccttatcgccaagcactgcttgatttggaacaagaggtaagaaggaggagtataggaaacacctctgggacagtagattagggcatgttcttgaatctgaaatgcccttgataagatcaggtagttaagagtgagcagttgcctgcatggctggaaggtacagtgttcctcagtgattgcccaacctgtgatcagagtggcttacagatcatggcaaagactctttatgagtttataagagccctggcttggtttctttatggcccgaaaatcaggattaataaccgattaaattatcagttctcgatagcctaaaattaacacttaagcccatcatgagattctttctcattttcatagatcaaatagatttgagatattttgtgtggagctctaatcacaaattttttattgcagttcctgggtgatccccatctctccatatcacatgtcaactacttccagaccaggtatgctgcccaaataaccaaatgccttgcaatctgttgatagtgttagaatatctaatttatggtactgtttttgagaactttttttcttctggattcagagcctaacatttatattttgtgcattttgtatgttttactagatcaaaactgtttaaagatttccaaattagttaaaacttaatgtctgatattaacgctaatgttactgctctatatggacatcagtttaacaagtatgccagcctcagaaatagaaactgcttcccgactgggcatggtggtacaacctctaatcccagcactttgggaggccgaggtggttggatcacttgaggtcaggtgttgagaccagcctggccaaaatggtgaaaccctgtctctactaaacatacaaaaattagtcgttgtggtggcgtgcacctgtagtcccagctacttgggaggctaacgttctgaatccagggtggaggttgcagtgagctgggatcctaccactatactccagcctgggtgacagagtggaccctgtctcaaaaaaaaaaaaaaaaagaaaaaagaaaaaaaagaaactgcctctctcgccatcctcttcctatctgcagcgaacctccacatcaaattgccttaggatgctggatctgactgttctgtggtattgccattttatcttaagttgaactatttagaaacaaaagcattcccaagttgattttttttcccttacatttgattacatacccttctaattattctctacttgcagttccagcttctttttccctctgtgatggttgtagtagaacaaattaaaagtcaaaggtgagaactttccttattccttttgctttgctaagcactgagggaatattactaataattttgctttacattatttttcgaagaccctagtttttagtagtttttatttattcatcatttaacaatatctgcttggttatcatgttaagtgtcaggaatgcaaaagtatgactcgcctttaaacacctcctggtccagaaggtagaggaaatgttcatagatgttcccaagaagttgttggggtaagaaaaaaagtgctgtggatgtttgcaggtgagaggaacctgcagtaggttttagaactgttgggtgtgaagcagaaagttaattcttaggaagaaggtaataggttatggttagtgtgctggcagttttctgagaattttgagatcagtgagtgaaagccagattttaataaatatgcctattcttatcacaagtttttatcaggtgtattgagaagttaggaaatgtctttctgggcagagttaataagtctgaggaataaatgctttgagatttcatattgaagaatctgctgtcctattgaattggtccacaattggaccaagtggacaaatggattaacatctttagctcaagtcgtcattttttttaagctctttatttgtgccttagcttattagggtgttcattttcattaatgtaactagtaaaccagttaatctgccacattgctgcatctttttaactgtgtaagtgtagaaacagtgctctgctatgttcatgctgtgccagcaaagcagtggtgggtgctcattggcccttcaaagctgattgtcctcatcaaataacaacatccgcttttactgtcactggctgtgtactaggcactgtgctaagtgctttaaatacattatccacacaatccactaaagggctaagttggttaaggggtgtgcccagtgtcacacagatagagtaaatgggtttatatcccagctctatctggctccaaagagtgtgctcttaaccactaattaaactatctcccaaaataaaaggagacattctaggcaaatagagttaatgaggacacataagggagccaggcctagctgcacgtctcagttggccttcaacttccgctggctatagaaggagagtggaaaatagggggattgcagatggctgaatcttcctccctgccagaatatggtagagaaactagtgtaccaaggctcttcagagtttttaaaatcaggtggtcaaaatctaggtttgggttgagaatggagattgattgcagacaggcacaaaggcgctttttggagagtggaaatgttataaaactggattgtggtaatggttgcccagtgtttgaaatttactaaaattgtttattagtatgcttaaaatgggtgaatttcattgtaaattatacctcaaagtgtaaaaataaaagtctggggaccgggcatggtggctcacgcctgtaatcccagcacttcggaggccgaggcgggcggaccacgaggtcaggagattgagtccatcctggctaacacaggaaaccctgtctctactaaaaatacaaaaaaaattagccaggcgtggtggcgggtgccttgtcgcactactcgggaggctgaggcaggagaatggtgtgaacccaggaggcagagctttagtgagccaagattgcaccactgcactccagcgtgggcgacagagcaagactccgtctaaaaaaaaaaaaaaaaaaaaaagtctgaagaacatagaggcagaggatttttgaaaaagatataccttagaagtagactgaattgggccttaacttgaaataaaaagctttccttggcttggtgttccaactctaaatgattctggttgctttaagtgcagtggttctcacactttatgtgcattagaatcacctggagggcttgtggaaacactgagtgctgggttctaaccaaggtttgcatgtctgatgagtctccaggtcatgctgctgatgggagagaggtccctctttggaaccactatgtgtaaatcttaggagaaagtttatccccagtctctcctagattgtgcctcttggttgaatatggaataagaatgtgtcttgcatggactcttagaatggaatccagttgacaaggccgtattttccacagattcatggttgtcaaatcctggaaacagtctacaaaacagctgtggggggttgcctcctgttcgaagtgcactggaaaagtaagtcatggcttaatgggaattggtggtggaggtgggtggtcaaattatttgacttctcacatgttttattttaggtcatttcaggtttccctcttgggaaggttataaccaggatagaaaaagctccatgacagaggagcccatgtaacctttattatggctcaggccttgcaaaaagggctatagagtgtgagtgacaaagccaggatttaggtgcctggatgaccttgaggcaatctttttaaatgttagatcctgttatccttgcaggaattccattacatgtgccagatgttgcttgctgtgtcaaacatgtgtatttgagtagctggtattttcaaattgaaggtccttaaaaatgtttatgtttataatcccataatgccactcttgggaattttatcctaacaaaactatttaatagaaaaaataactatatgcacaaacgtgttcattgcaatgttgtctactatatcaggaaattaaaaattaccaacagtagaaaaaaatttaaatgatgatatattcacttgatagactataagccactaaaagtgtaggtactataacatgtaaactattttatataaatatgtactgacaatgatacaaaattgtatttatcttgtgattacaacaatatgaaaacatgtagagtataacaaagactgcctgtttgagctttccatttatccattttccttattttaaaaaaactgtgcattcattgaaaaattataatagatgatccctgaggccactcacaactctgttttgttcttttttcttattttattttaattttttgtagagagaaggctttgctatgttgcccaggcggtctcgaactcctaggctcaaccgatattcacatcttggcctcccaaagtgttgagatacaggtgtgagccaccgcacccggccactcacaactcttaatctccactctaaccactgatgagtaaatcctccagaacattccttagggacttaattctctattatacttttgtgtaagaatataaaatctaatgtagatgatactatatatacatgtttgttctgtgtttgcaggaccaaactttacagaccacatactcagaaatgcataaatgtaaatagcttcacatttgactttttaaagagagattccattcagttaaataacacagtcaagttcttgtaatttcttttctcccaaccttttattttgaaaaattttaaacctacaaaaaagttgaaagaaacgtatataaaacacttgtaggctgggctcggtggctcacgcttgtaatcccagcactttggaagctgaggcagagggatcgcttgagcccaggagttcgagaccagcctgggcaacatagcgaaccctgtctgtaccaaaaataaaaaaattagccaggtgtggtgcctgcctgtagtcccactacgggaagctgaggcagaaggattgctttagcccaggaggttgatgctgcagtgagcgagatctcgccactgtaatccagcctggatgacagaatgagaccctgtctcaaaacaaaaacaaaaaaaaccaaccaaacgctagtgtatcctttagtttcaccatttgttaacatttccacgtttgatttctctttttctccttctatacgtatatgtgaaatgcacaaattttttgcagagtcatttgaaagtagtcacagataccctaacacttaaatacttcagcttgtatcctttagaaaaaaggcattcttggctgggcatggtggcacacacctgtattcctagcacttgagaggccaaggtgggtggatagcttgagcctaggagaccagcccaggcaacatagtggaccccgtctctacaaatacaaaaaaagtaggcatgctgtgtgcgcctgtgggcccagcacttaggaggctgaggtgggagggtggcttgagtccaggaggtcgaaactgcagtgagcatgatcgtgctacagcactccagcctgggcaacagagtgagaccctgtctcaaaaaaaaagaaaaaagaaaaaaagaaaaataaaagaaaaagggattctcttatagaacatcaattcatattacacccaagaaagttaacattaattcagtaatactatatccaaatttttctagtgtccctcagaattccttcatagctgttctttttttgcaatccaggatccgatcagtgttacatactacattttgttctcatgtctttttagtctcctttaatttagaaccgtccccctgccttttgttgttcttggtgttttggatgacgctgacattttaagagtcctgaccagcttcctgtataatgtttcacaatctggatttattgtttccctatgattagattcagattaacattttttggcaagaatactatgtaggtgatattatttcccattacatcatattagaagtacagaaagtaactttatcccatcacggatgttatgaagttggatcacttggcttaggtttttcatcacgtcctgctccattatagaggtacattttcccctttttaattaatatgcttctggtgggtgatcctttgagaccatctgaatatcctattccccaacaaccattctgcatttgttttagtttctgaattttgctagataatggtttttcatgtatacctggcactcactattgaatattctctccctaagtgattccaacaaaaataaaacaaatttaatactgtgtagccaaaaagagactccattaagtcgatttttaaaattttttattatttttattttttatgctataaaacagttgtacatatttaggacccatcagttttgaaaattacataaaagaaggaagaaaatgtcttccctaaaataatatcagcacatatactgaacattttagatttcatgtgtaggctgcaaatatggaaattcagtgagttagttcacccacatttaaattaaaatgcacaattatttttaacttaattggttatttctgttatgactcatcaaattctcaggccctgtttatcctgtaacagtttaaagcatgacttctgagcctcttactttctactctgccagaatcctggccgtttgtcatggggtcatgtataaacagctctcagcctggatgctccaggactcctcttggaccagcatgaagaattctttatcaaacaggggccatcttctggtaagtcagtgcccagccagaagaggacgaggaggatctgggcattgggggactgacaggaaacaactgagagaactgcaggacttggtgagagcccaaaaagtagcctagcactctcctgcaggagtcagaaaagcatgcacacaaatgatcttctggtgatcccttcttagctcatagcgagcaccttccatcaatcctttcgatgtaaacattcggctttatcttaactagtgtgagctataaaatagaaaatatgtttgtgatattctttttgtttcctctttcccaatatatgctttgagagattataagtcttacttatgtagctactctaatggagcagctagctacatttagattttaaatacagtttggagttttgtttttttttttaaagacagattctcacccatccccaggctggagtgcgatggcgcaatcttggctcactgcagccactgcctcccaggttcagcaattctcctgccttagcctcccaagtacctggaaccaggcatgtgccaccatgcctgctaattttcatattttttattttcatatttttagtagagacagggttttgtcatgttgccaggctggtctcgaacgcctgacctcaggtgatccacccgcctcggcctgtaagtgttggattacaggcatgagccaccgtgcctggccagtttggtgttttgattagactcctcaagttctacattgtccatattcatccattcatccatccatccattcattcatttatcctgtgcaatatttcattgaatgcctgttatgtgctaggcattgttctaggtgctacaaataaaagtagtagtgtctgtccctaaggagctcatagtttaggggaagagatatagaaaagtaacagttacattacagtgtgctaagggctctgaaaagactaaatatgggtattcttggaactggtcatgggatagggtcttggagtgactagggaaggcttttcagtggaaggtatgtctaattgcaaagagtttgggaggagccatcaagagacatccaggcagaaggaatgatatgttaaaggtacaggggccattaaggacatggttcatttggggaaacagtagtaattcaattaaatgatcaaataaaggctgaagtaaaatgttacaagagatggtgtgagggagaggtggacttgaaactgtgtaagttggtacttgatgaaacttgagttaagcagaggcaagatcacaaggtgcatgtaaacagtggaaatgagtttgtacttgaacctgaaaagagttgggggctttgaattttaagcaagtgggtaccacagtcagacttcatgataaatcactctggatgcttgtggggaatcattttttaaaaatcaagattagaggcaggtcgatcagttaagagagtgtggggagacttaggtgaaaataatagtcccctaaaccaaagatactaacattgaatatgaaaaagagcaaagaggtgtgagagatgtttagagggtggaatcagtaggcttagtgagtcttggaaatgagtcaagagggaagaatcattgatgatacccaggtttctgccttcagcactgggcaagtagtgacgataggggtgtatactgctggtatgcggggaagaagatgggtcaatggggggcatgttgagtttgaggaacttgtgggaaatgttcagtgggctgagcctgggctcatgagagcactccagcttactttaaatctacatatggaatcatcagcatggggctggaggtttttaatctggggcccttgggtggcttcaggaggttcatgaaatgttatatgttgtacatttgtctggaagatccatagcttttatgattgcagagaggtctgtgacctaaaattaaaactatctgttacactgatcagtcacagaagacgatgtgattgtataggaagtgaggctgagaggaaaagacagtctgggacagtgccctgaggagcaccagcagagaagacaagagagaagacctggaaaacaaaaaagaccacctctttcatcgtacaagtaaggaagctgtcgactgtgcaagtttttactcagtagtaaaggcagagtgagggcccaaatcccagtattaagccactcttatttccaccatgccactctgctgcctgaagatgaaatacatctctcaaaatgggtggtttgagaactgtgcaacaccagatttgaagtccctgcgtctttattttaatcatgggttgggagagttactaggtattttcttgttttccttttcttgcttcacactcatctcgatgtgtactctttccttgactagcgcctgattgaggaagagaacatgctggcccatctctgaagcagttttccctacgagtggagattttgccatcctacattccagtgaggttgctgaaaaaatcctatttgttggagaatctgtccagatgtttgagaatcaaaatgtaacctgactagaaaaggtagaaatctccttgtccaatgtaccacaccctcaaaatctctcttccttaatactatgtggccccacagcatgcctggtcagagcgagtggtcgataatatcctatcctgagattgtagcagaatcatgacgtttgtctgagaagcaggtgaagttgctgcccactgagattagccctccccagaaaaccctaactgtcctgggtattctccgtcctccttgacggtgtcttcctattttgcaggatccattttgaaaaaccaggaagacacttttgcgcagagctgcaccgtctcaagcagcagccactcttcagcttggtggactttgaacaggtgtggatcgcattcgcagcactgtggctgaggtttgtgtttcatcgtatatatatatataatatatatatatatatatttttttttttttttttttttttcttaggcaaaattggactatttcctagaaattgagttacttggtcgggcgcagtggctcacgcatgcagtctcaacacttgggaggccaaggcaagtggatcatctgaggtcaggagttcaagaccagcccggccaaatggtgaaaccccgtctctactgaaaatacaaaaattagtcgggtgtggtggcatgcactgtagtcccagctacttacgaggctgaggcaggagaatcgcttgaacccgggaggcggagttgcagtcagccgagatcacaccattgcactccaacctgggcaacagagcaagactcttctccaaaaaaaaaaaaaaaaaaaaaaaagacactgagttacttgacttttgtttttatttgatgtcttgatgagttaagaaccgagcttggaaagaaatgttgcagagagttgaaggagaaagtagaaaagaaaagcctctgttttcattaacagaggcagaactgccttcccatttcctatctaactaaaagacaggtggtttttagttggttagttagttgaataaaggggggtcttggtttaaattctgaaaatcagcattttggatctgtctctatcgtttgcaataactctaggaatcaactaattctgactaaattttgtgtcttgtagtttagtatggctcataactatactttcatttctatacacaatcatcttatgaggaaagcagaacaaatattattttccattcttataaatgaagcaaacactcagcaagctgacttgtctggcttgcctggtgtggacagtgagtagccatagtgaggtcagtgccaggcctccgactcctggtgcacagtcttctcattttgaattgtgctggtgccaccgacttaaattgtgaccagtaatttttcaaaggacatatatgttctgtggcttatattaacatttgtctcatggatatgtgataacacgaaatagacatttagtcagctgtgttgttaactatattcctggctttcaacattggctaagcatgaatcgcatgagaaaattttattttttattttttatctttttatggagtcttgctgtgtacccaggttggagtgcaatggtgtgatctcggctcactgcaacctctgcctcctgggttaagcgattctcccgcctcagcctcccaagtagctgggattacaggcacacatcaccatgccagctaatttttgtatttttagtagagatggggtttcaccatgttggccaggctggtccaaactcgtgagctcaagtgatcctcccacctcagcctcccaaagtcctgggattatagtgtgagccactgcgcctggcccgcatgaggaaattttaaaacctgcacttgcaccaagtcttacttccagagcttctgattcataggtcaggagagggtaggtacctttattttatttatttttgagacagggtcttgctttgtcacccaggctgaagtgcagtggagcagtcgcggtcactacaaactccgcctcccgggttgaagcaattcacgtgcctcagcctcctgagtagtgggactgcaggcctgcaccagcatgcctggcaaacttttttgtattttaatagagatggggtttcaccatgttggccaggctggtcttgaacgtttgggctcaagtgatcctcctgcttggcctcccaaagtgctaagattacaggtgtgagccaccacgcccggcaggtacttcttttaagcaagccagtccacccaccaaagacaaacctctacaggggtttttgaaacagacggactaaaaagcagtgcacttcgttcagtgtctggaactgctaagagcatcaaatctcctgggttagaagcacagtaatctattataaatatggtttccctttctagtcactgtctcaaaactcctggtcatcagaggtagagctgtgatatagacacagaatgttcgatcttaaaaggctgtgaagtatcatttgatttgaatctttctgggcaagtaaatatctaaatgacccagttcctgtcctttcaaaattttaagacattgcttcaaccccgtctataggccaaggcagttctagtctagaggggttggtatcagttcctttcatttttgaaaattgaatctagttctttgctttatcatttttattataaatctttggaaagtataattaatggaagaaagtaaaatgtactgactgaattataaacaatagaaaaattgttttttcttgtgaaagtttgctagaattatatttccaatttgtaaaaatgataagcaaactaaagcacagactctttgaagtttttagaattgtagttaatagactttggaagcattattgcaacaataacagcctacagcaagaaaagctgtgccctgaaggaaaaggggggagtgttttgtaaatatgtgttatatttatccttttgggattctttctctcctttaaaaatttttttctttaaagtgtgtatactatgtaatctatttctgtaaagttcaaaaacaggcaaagtgaatctggcgctagaggtcaggacatatttgcctttgagtcaatgggaggggcatgagtggggcttctagggtgctggcaacatcagttcgttccatttcttgatctgggtgctggtaatacaggtgttcaatttgtaaaaacttcaagctgtgaacttacgacttgtacttttctgtatgtattttggtacttcaacaaaggttttaaaaattctgaggtacttaatagttttcattttaattatgtctttagtttttatgcttacatagagaaatggtggtattactttttgtggttaatcttataacttgcaacgtttgaactctttttagttgtaatagtctgattctatcagttgttctaagtagatgatcatctatctgcaaatgagagaactttccttctatttttatttttattttttgagatggagtctgctgtgttgcccaggctggtcttgaactcctcggctcaggtggtccttctgtgagccacatacccagtccagagctttttatcataagtagatgttgaattttatcaactgctcttttgtgtcaattaaggttcagtttcttgctctgggttatttttctcctttagtctatttattgataaatttctggttagattttgagatactgattcttcctgagataaacactacttgatggatgttttacatctgtattcactagttgtattagtctgttctcatgctgctaataaaacatacccaagactgggtaatttataaaggaaagtggtttaatgaactcacagttccactggctggggaggcctcacagtcatggctgaaggcgaatgaggagcatagtcaggttttagtggcagcaggcaagagagcttctgtaggggcactcccctttataaaatactataaaaaatataaaatatataatttattataaagtaaatcacccctttataagagtgatttattcctctcagaagaacagcatgagaaagaccacccccatgattcaatcacctcccaccgggttctcccacaacacgtgggagttatggaagctacaattcaagatgaggtttgggtggggaccagccaaatcatgtcactatgaaataagactgtacccttcttttcctgtattttgcttagtggttttggaataaagattctacagtcctcataaaatgggctagttaggttttgttcttttctattttttagaacagtttatataagacaggaattcttactgaaagtttgaatttactgaaaaataatctaagctagatatttttaggagggaaaacttacctagttcagtgtattaaaacctattgacataaaacaggtatttcttgtattaattttggtattttctaggaattacctatttcatctagatttaatttaaaaaaatctagtcatttatgttttatttatttaaatttctttttattgtttagtcttattagtcttttcaaagaacaagcttttgtttttaacttttttcttttttcttttttttttttttgagacagagtctcactgtggcccaggctgggtgtattgatgcaatcttagctcactgcagcctccacctcccaggttcaagggattctccacctcagctcctgagtagctgggattacaggcgtgcaccacaacgcccagctaattttgtatttttagtacagatggggtttcaccatgttggccaggctggtctcgaactcctgactcaagtgatccacctgcctcggcttctcaaagtgctgggattataggcgtgagccactggcctggctttttctttaatttaaaaaaaatttgtagagacagcttctcgctctgtcaccaagctggagagcagtggtgcaatgatgagtcactgcagcgcgatctccaggctcaatcattttcccatctcagcctcccaagtagctgggactagaggtgcatgccaccatgcccagcaattcttttcttttttttttcttttcttttcttctttttttttttgagacacagtcttatcttcttactcttcttactgtgtcgcccgggctagagtgcagtggtataatcctagttcctgcagcctccaattcctgggctcaagcaatcttcccttctgcctcagccttccaaagtcagggattataggcatgagcctcagcacctggcctttcattttctttttttcccccagaacagggtcttgttctatctcccaggctggagtgcagtgatgtcatcatagctcaccatatcttgaactcttagggtaaagcaatcctcctccctcagcctcctgagtagctagtattaaggtgcaaatcaccatgccctgctatattttaaactcttttgtagagacggagtctcagatgttgcccaggctggtctagaactcttggcttcaagcagtcatcccatttcagcctccaaagtgctgggattacagatgtgagccacaacacctcagcactgcagttttgacctgctcatttctgacctgggccaattcacccattcttaggcaacctggtggtcccccactcccagtggtcaccgtattgatgccgaatttattgtggacacctgattggtgtagcacactacacccagaattcctagactcaagtgaaacttctgccccagcctcccaagtaactgggcctgaggcatgcaccactgcgcccaccaggctttttctttttttaattttattttttaaatattattttggggtcaggcacagtggctaatgcctgtaattccagcactttgggaggccaagcaggcagatcacttgatgtcaggagtttgagaccagcctggccaacatggcgaaacccttctctactaaaataaactacaaaaattagccaggtgcagtggtgcgtgcctatagtcccgctactcgggaggctgaagcaggggaattgcttgaacctcggaggcagaggttgcagcagctgagatggtgccactgcattccagcctggacaatagagtaagactccgtctcaaaataaataaaatagagatacacacacacacacacacacacacacacacacacacacacacactatttttttttgtttgaattctgtgtttcattgatatctgcctttttctttattagtttttccttcgtgtttttttttttactctttcccaggttgaaagcttgactcctttatttttacctgtgttttctgagaaatatatataaaactttacatattgttttgactgtgtctcacagtttttggcatgtagtgttttcattatattctatataattctaattaattttgtttatattttttaaccaaggaatttgttttaattttattgcattatagttggagaacatagtctaattatattgtttctttggaatctattgcaggtttctttatggactaatacaggtctggttttgtttgtttgtttgttttgttttgttttgttttgagacggagttttgctctgtcaccaggctggagtgcagtggcgtgatctcggctcactgcaacctctgcctcccgggttcaacgattctcctgcctcagcctcctgagtagctggggttacaggcatgtgccactacgcccgctaatttttgtatttttagttgagatggggtttcgccatgttgtgctggctgatcccgactgctgagctcaagtgatctgcccgcttcggccttccaaagtgctgggattacaggcagagccactacacctggcctaatatattctttacttagattctattttgttagttactaaatcactatccagcttcctttcaaatcatatttacctgatacactcttccatcctttatcgcaacctttctgtgtgctttcatcccactcttcctaccctgacagtccccaagcagccatgatctgatctactccctgtcactctaggttagtctgcactttctagagttgataaaaagaaatcatacagtatgcactcttttggaggaggagaccaggcttcttttactcagcatattattttgagatgaacccatgttgcatttatcaatggtttattcctttatattacttacagtattctattgtttataccagtgtgtttatccattcatccttgataaatatttgggtgcttcccaatgtcttttttttttttttttaagacggagtcttgctctgtctccaggttgggtgcagtggcgcggtctctgcttactgcaacctccgtctcccgggttcaagcgattccctgcctcagcctcccgagcagctgggattacaggcacccgccaccacgcccagccagtttttgtatttttagtagagatggggtttcaccatgttggccaggatggtttcgatctctttttttttaattttattattattatactttaagttttagggtacatgtgcacaatgtgcagtttgttacatatgtatacatgtgccatgttggtgtgctgcacccattaactcgttatttgcattaggtatatctcctaatgctatccctccccggtccccccaccctacaacagtcccggtgtgtgatgttccccttcctgtgtccgtgtgttctcattgttcaattcccacctatggtgagaacatgcggtgtttggttttttgtccttgtgagagtttgctgagaatgatggttccagtttcatccatgtccctacaaaggacatgaactcaccattttttatggctgcatagattccatggtgtatatgtgccacatttacgattaacaaaatgtggtttcgatctcttgacttgtgctctgcccaccttggcctcccaaaatgctgggattccccactgtctttttcattgcatgcctgtaatgactaatgaggttgaacattttttcatgtgcctctttgcctatttatactgggtttttgttttcttgttgtcgaattttgagagtcctttatgtattctgaattaagttctttaacagatatgtgacttacaaatattttctcactattttttttttttttttgagacagagtcttgccctgttgcccaggctggagtgcagtggtgcaatctcggctcactcaagctctgcctcctgggttcaagtgattcttctgtgtctgcctcccaagtagctgggatacaggcgcctgccaccatgcctggctaatttttgtacttttagtagaaatggggtttcgcgtgttagccaggatggtctcgaactcctaaccttgtgatccgcccacctcagcctcctaagtcctgggatttacaggcatgagccaccacgcctgggctattttctcacaatttatacttgtcccagaagttgttaattttgatgaaatccagtttaccttttgtttttcttttaggatcatgtttttggtgttatgtctaagaactctgcctaactcaaggatactaagatttctcttctcttttcttccagaaattttatagttttcagttttatacccaggtctatgattatatgcttggacctgtgtccccgccaaaatttcttgagttgtaggggcgtggtgggagagattggttcgtggagcagtttctcatgaatggtttagcgccattccccttggtactgtctcacgatagtaagttctcatgagatctggctgtttaaatgtgtgcagcacctcccccttctctctcttgctcctattcctgccatgtgagacgcctttgccttctgccatgattgtaatttcctgaggcctccctagaagccaagctgaagccaccgtgcttcctgtgcagcctgcaaactgtgagcaactcaacctcttttcttcattaattacccagtctaaggtattctttacgcagtgtgagaatggaataatacattgattgttttgagtaaatttttctatgtggggcaggtatagtcttcttttaatacattgctggatttgtatggaaccattctttgcaggagtttcactgtaatgaaatttgtccctgttttgttggttgttttcatagcatctctggaagttatggtagaagaatccgatttactgggtcagctgaaggtaatggcttagctgttgtaattttacggtgatgctggtaggcagtgacttgcattctctgatgtttcctgagagcactggtgcctatacccagacttccagagtcaactcatttgttcttatccaagtgagcaaactatactaatgccacaaatctacgataatacaaagatttgggagtgtacttttttctggcatattatataattatgttgctattgaataaataatgccaaatacacaccagtcatcctgctatcggaactaagtatgcctctttgaaatgccaaatgcctgtatcttttgtagcttgggctcaattgatgaaattagaaattactgtatacatgtaattcctcaggacagtgaggagctccgccttgctttactgaattgtaaattgaaattctttcctcagatcattaaagacttttacttctgggacgtggagaactgtttcaggccttcattgacacagctcaacacatgttgaaacaccacccactgcagtaactgagcatggtaattgtcagtggccctgagaatgatcaactattgacattgcagggtatttcttggctgctgctgacccttttaaggcctgctccacatagagcagcctgatgagttacagagcagtggcttccagagatggaaggctcttgcaggtagcttcatgctggggtcattgggaacagtgtcttggcctgtgacccttcctggaagagttgttcaggccttcaaaccaggtattttttctcattggattatagccatatatactttatggccatattgggacttagtgctgcttgtagttttgcagtagaattctttaggtgtgaatgaggaaactcacccgaactagcctagttaggaaagggaaatggatttgctattgtatctaaaccccagtgggaaaacttcgattcattctctctctctctcattcactcattcaccacatttgtttgtgtctcttgtgaacactttgatgaccttctggaaacatgatcacagcatctccaggaatatgcctcacagtgtcctctacggaaggaactgaacccagtccctcttgttgcagttagagaattctagggaattatctaggttttgattggcccagcccacatcacatcccatccctgtatcagtcaaagaggtcagacactaggctatgcctagttcagtgaagagtctccccttgacccactgatgtccattcccattcatactgcatgagtagagttgggtaaggaccaaaaaaagaaactgtgagaaagaaaatacatacacacaggctgatcatttttctaaccagtaaaaccatagatgtccactgtacttatatagtacaaatataagtacttgtggttgaaatatcagaaaatccaattcaaactcacttaagcaaagcaaaaggaaagaaataatgtttgattctcataactgaaaagctcagacgtatgatggttttcggctaagtttgatccaggacaggtgtggcacctttaggacttggtctctttccatcttctacctctttcttctcagcaggcctgctctgtatggtagcaagatagtctctagccaagtttacatcctactaagccctgtttatcttgaaaaaagagctggactcttttagagtctgaatagagcctctggattgcctggcttggtcatgttaatatccctaaacaatatagcataacaaagtagagtattacatccatttgatcatgcctacatcacccagctacccctagaatcaggtgttgtctagcactacccactggaaatatgtgaactgtactgaatagggatgattctccaaggaaaatcaagagcagtttgtcagcaagaagagaaggatggatgggtgttagacaaatgaaacagatgtccctgtgtcctgctgttagcattgagcatgttgggggagaagtggaaagctggaggagtctggtttgttatgtagccaagcgtccctgtcagcctgcgtgttctttcttgcagatgtgaagtggcctttcaacagtcagcacacaaggtattgctagatgatgacaaccttctccctctttgcacttgacaatcgagtatcacggaaaggagcacaaaggtttgccattcctccctgcaccttagagttcctgctggtcatcatccattttcccatctctgcttccatcccccgccaagaaaccatatgattttggatcttagaaatcagctagtacagtactataattctatagaaagaaaaggaaagtccagaagtccagagaggctaagtgagatgcccaggccatgttttggggagttggtttttttggtgtttttttttgtcatgctgctggaatggtgcctgtttattccagcccccagattttaaggctgaggaaagaatctctagaagacctcccaagagaacctacatagaagtttccttgcccccttcttagtgtcccctgtaagcttctgacatcgcagacccattgagctctgttgcttttcttttggagacagagtctcactctgttgaccaggctgggtgcagtggcacaatcttggctcactacaacctctgccttccaggttcaaacaattctctgcctcagcccccctgagtagctgggactacaagtgcgtgccaccatgcccagctaattatgtatttttagtagagatggggtttcactgtattgcccagactggtcttgaactcctggagctctagtttcattaatgttattcacttgttgagtctctggttctagattaaccaagtgttatcttttctttttttcttttcttttatcacagcagatgctactcaggcaagagaaggccttctcgggaaacttctccccgggaagcccctgcatctggctgggcagccctaggttttcctacaaagtacagtggccactacatattctcttcaccccagctgtcctggaaaaggagtatttctgagtttctcacaggtaaatatgacccaccttacttgtaagggaagaaacagcaggaacagaattagtgggaaagcaaggtgtggtggcacacacctgtaatcccagctgtccagagcctgagcaggaggatcccttaagcccaggatttcaaatccatcctgggcaaatagtaagacccccatctcataaaaaaaaaaaaaaaaattaatgggagcaagagagccaccaactagtttttaacaatctgtaaatcaaaaattgtaaacccttatgccttcaggggcagactgatcacattaataagtgaagccacagatatgagacacggagttggaatcagtggagggcatatctacttcaaaccatcatttttttaaattgccaaataataagcagtttgttgctgccagtttgtgagctctggaaaataaggtcttaggcaccatgtcgagataatggccttgatgattccatcacacctgacaaggtctctccctcacttttgtaatattttttgttgtttacttgggaaagtcctccagcctacatgtctgctatggatgttagccactggggagagacaaaatcctgtgtcctcattattcaccttcagtaaccagcaacattatactactttttctgtccctcccccacttttttgctagagctgtataaagcaaatcacagtcatttcatttgccaataaacaattgaaaaaggcatatttcaacagaactacaatgccattatcacatcagtaaaattaacagtagtcccttataatcccttataatatccagtctacattgaaattttccagttatctaaaaattatctttatgtttgggtttgttcaaatcagtttccaaacaagtctatcatttcattatgtttgttcctttagaaatagacaattttaaaaaccaaacagaagggactgtcttctgcaagcctacctacaaacaggtaaataaatcctattctaccaggaacagctgttcttcccgtgtgtcttttaagtatggagtctcagcattaagcagttagcaccgaacttgcagggaggcaggagcgggagtctgtctcagagggaagctattttactttcttcggctctcagcgacagagaatcagattcatcataatccttgattcataacacactatttttttgagacagggtcttgctctgttgcccaggcagcacactgcagccttgaaccctgggtcaagcaatcttcctgcctcaacctcccaagcagctgggactataggtgggcaccaccaacctggctaatttttttaatttttagtagagatggcatctcactatgttgctcaggctgtcttgaacccctgagcttaagtaattctcctgccttggcctcccaaagtgccgggattaaggcatgagccaacacacctggcctgctttaagaattatagaaaaggctatatgtaatctttgtgatttacctttttcattcaaaaatcatgtttttgaatatgagaagcaacacgagcaaccattcaaaaagattataagggtataatctaatatccagtccacactgaaatttccaagttatctaaaaaatgcagagatggggtctcatcttgttgtatagctggagttcattcactgctatataatattccattgtataaataaattataatttatttgtctacatctctagcactctttccttactgcctgtttgtgagaggagtgggtggcacaaagtcctagagtctgcgtgtgggggaagtgcaggggatgaaatttttgtcttgaatatcctgttatttctgtccaggtacaatgttgtttttaagtacttactgagtgtgcgccgggtgcaagctgagctgcacactgctgggccctacaaatgcagcgcaagcacctcaagtcgaaccagactgatgcaataagtggcgcctaagaaatcacatggcatttttggtggataatcttcagtactatctccagtctgtgctaagagatgagtagaaggaaggggtacggaaaaacgtctaggaggttggcaggagtattgaatagggactacaagtttctatttgataaaatggtggggtttgggaaaatcaggagttatatcaccaagcatgtttcttaaaataaaaaaagcattttattttattttatttattattttttagagacagggtctttctctgtttcccaggctggaatgcagtggtacgtcatagctcactgaagcctcaagctcctggactcaagtgatccccctgcctcagcctccaagtagctatgactacagatacatgccaccacacccagctggtttgtttttatttttttagagatggattctcactttgttgcccaggctggtctcaaactcctggcttcagcgagggtcatgggtcacgtctgtaatctcagcactttgggaggctgagatgggcggatcacttgggtcaggagtttgagaccagcctggccagcatggtgaaacaccatctctactaaaaataaaaaaaattagccaagcgtggtggcgcctgtttgtagtcccagctacctgggaggctgagcaggagaatcgcttgaacctgggaggtggaggttgcagtgagccaagatcatgccattcactccagcctgggcaacagagtgagactccgtctccaaaaaaaaaaaactccaggcttaaatgatcctcctgcctttgcctcccaaagtgctgggattataggcatgaaccaccgcccaccagcctcttaaaggcattttaaagaatcctcatcaacaatctattatttattgttgcttgccccttatttttattgtttgctataacttctggaatcctgtaggtgaccaagtcatcagtagacggaatgtggccatgagtggattaggatggggcaggggaggctgggcgcagggctcacacctgtaatcccagcactttgggaggctgagccaaacagatcacctgaggtcggagttcgagaccaacctggccaacatagtgaaaccccttctctactaaaaatacaaaattagccatgcgtggtagcgggcacctgtaatcttagctactcaggaggctgaggcaggaaattgcttgaaccctggtatgtggaagttgcagtgagccaggatcgcaccactgcactcagcctgggtggcagagcaagactccgtctcaaaaaaaaaaaaaggaaaaagagaaaaggtggggcaggggagagtggtcagccaggacgttggagggagggggttcagaattatgcaataacttcctacaaggctgggcaatataagggtgtctttggtcagccttaatgtgacttgttagaaggaagatgagtggaggcaaagcattttcatttcaatctgtcaggcatcttaattcttcgagtgcttagaatatgcaaagtgctaaaattttttgtaatgtctatcaggtagagtgttggagtctcagttctcccagctgcttcatcagatcaattctacccgagactttgaagcatccgattggctcatgaccacttcctgagcaatttgctggctcaatcctttatcctttgaaacctgtaagtaaggctcattggtttcctcagactgcttctaccactgaccattccttaggcagtttgagttgacaggatacgaaaccatcattaagcaattattcaagtccatttaaaacattttttaagaatgtgtaaagcggcggggcatggtggctcatgcctgtaatccagcactttgggaggccgaggtgggcggatcacaaggtcaggagttcaagaccagcctgccaacatggtgaaaacccgtctctactaaaaatacagaagaaaaaaaaaataataggtgggtggctcgcgcctgtaatcccagctacttgggaggcctgaggcaggagaattgcttggcccaggaggcagaggttgcagtgagccaagatcattccactgcactccagcctgggcaaagagcaagattctgtcttgggggagcagataaaaaaaaaaagaatgtgtaaagcaaaacaaaaaggcatgttaaacgggacctaagatgtctttgaatttctgaaatacagggtgtgggagcagctacagatgaaagaattatgtgcttaaaccctcaggagttaaagaaactcaaattcttgctgacaatacagaaaaaccaatgaaaagcatatagagttcaccttcttagaaacttttggaccaggatggatcagtcatttgaaagttcttttcatagacaactagagtagttttctctctcgatctatgtatgtgtttctgtaagtacatatatgtctccttcgtggcagtattttcaactttggctgcacattggaatcatcgggactctttaaaaaaatctaggtgaagagcacttaaattagaatccctgtaatagtgggacccaggtactaattttttttaaagtcacaagctagttccaattccaggataaagaacaggaagactgaaatgatctctggtagttctaatggaacggttatgcctcctctgacatgagctggttgttattcctcagtgtgctcagcacagctgttacagactttttaaaaatgttctggtgtttagggctatttctgctgtccaggaagagtaagatatatattaatagatgccactccagagggctggctgaaaacaacaagaactactgtgatgggtagatgctgtccttatgtggcatagatgtatccatagggaaagcagaataacagagcaggtcatcatcattaaatatttattgagtgcttactgtatgcaggcactggggatacaaagaggtataattcatggctctgcccttaaggagctcacaatctgttggaaaaacaagacatatatatatatatacatacaaaaatcagtaacaacacagaggctgaacaattgccaagtggacaacagtacagataataaagaagcaagaaacgagggttcctaaaggctatagtggggaagggagtgcttcactgagagagtgggacttgaactggtataaaaacaagagcatcccgggcaaagggaacaacactcacagctcagaggcaggaagacatctgcgggtctaagaaatgaagagttaaatgtggctagattggaggtttggtgcagggcaagagagtaatactcgcttagccaggaaaggatgcatttgttttacgcattttgtgcgttgaggggctggcaggccttgcacgtggcagtgtctatcctgtcagatttgggaggtcagtattaattagatcagctattaatcagactgttctcctaacactttaacttcatggatgtccttccttcctttcctaatgccaactctgtttcccgggtaggtgtttcactgcctgaataaatcctagatctctgtcacagtttttgttcgctggtcagtcagaacctaggcccactgatgagcgtggagccgcccagctgagcattctcgtgaaggtgcgtctgcctggaagtatgagccttgccgaaaggacagaggtggttttgccaatggagaattcatgatctttcctctggtcagtaaagcatttcctcaatacacacacgtacagagataagatacaaagataaaaatttggtatcagttgattttgaagcaggtaattactgtgccacctcacagtgctcaaaaatgttcagtcctgaatagtttattcagcccatcaaataagcattgggttgttctaacttcccacatcctcccccctccttacttccttgaactaacccccatctcactgagataattatcgcttgtaatcaaaacgggttctccccaaccccagtacttgacaaaatacattaactggaaccagctactaaattcctactgatgaaagagtactttcataggaagtcatgcatgtatgatttggtacaagtcattttaggaactaatagaaataggaatgtgggaaggccaggtggtctgtagaattttgaacaaggcttttccaagaaactcctccctccgcccccatcctccattggagagttggtgagctgaagtggaatgacagctgagtccttctctctgcagggctttaccgccagtcttcactcctgttcaagattctctccagtgttcggaatcatcagatcaactagatttggctcaactactgttacgactagattataacaaatactatacccaggctggtgaactctgggcaggtaggagcaacccttgggtaactcagtagactttttaaggtggcttttaatgagttgtagaattctagaactggaagaagactttagtccaaataccctcattttaaagtaaggcttagagatagaggtgtgaccatctttaataattttaatggaggttatttttagtagaagtcatcatcatcataaaatactaaaaaacctgacagtgagataggtgttaatcctttgctaggttatgtattgctatgctgggaggcagtgggccttccactcccaattcgatatgaactagctgtgcagccgtgggcaccccgccttgctggtccctagcttccgcattgtgaaaggaggcgaccaccccttctaactctaaactttaaaaaaaactgataccgagatcagtggtagctggcttcccagaggtctgtcattcccattcagaaaatcacttcattgtctttctctctaaaatgtctgcaagcagatttttttctaagctattgtagcagaagagtcaaagaaactcttcagttttaagatgacattatttagatcacaggttatcctgattcatattctttgaaggtagtcttgggaaagcatgacacttaataaggctctttttctcttttgtgtttcgggatgtgaaaatttctggctcataaattgaaataacagccacgttcccaaggtgtaacagaagattcaaaacatcccattctagccacacacaaataaatatctgcggcttatgataggactctaccttttctcctagaagcagttactgaacatccaggagtacaactcctcccatcattcccatgtggaagggtctctcccatcaaggagaacatgtggcatctctgacctttacattgagaacatttgttggatatgttcatttattcaatagtcatttattgagccctactacgtaccttggtactgttcaagctgtgggagatacagcggtaaacaaacaataagagcagaaagttaaatattttatggttcatatgtgaaaaagtaattatgtttataaatgactaactgctggatgttaccaccaagtaagaaagcaacaggtaagataggctttctcttccctataccaagtaatttatacctacacagattgggcaattctagctaatgaaaatatcttaaaagtatttcttaggccgggcatggtggctcacacctgtaatcccagcactttggaggccgaggcgggcggatcacctgaagtcaggagtttgagaccagcctgaccaacatgagaaacctcgattctactaaaaatacaaaaattagccaggtgtggtggcatgtgcctgtatcccagctactcaggaggctgagacaggagaattgcttgaacctgggaagcagacgctgagtgagctgagattgtgccattgcattccagcccgggcaacaagagcgaaattccgtctaaaaaaaaaaaaaaaaaaaaaaagtattattctccaagaaaaaggtccttaagaaaaaatgagatcaagttgttagatttttaaatactgaagattgcaggcccaattacccatcttaacaaaccataggggttgaagttatcttaatatggcccagccatcactggtaatcaatatcatatcagtgtaagtaaaaagaaatattcactgaacaacgccctccaaactgaaaaagatgcagtgttctggcatcaggttatagtcactgcatctggttttcatcactacatattctcacacactgggaagctctgacaacttattccctgctattatcaactaaagatcacccttccactgctgtctctggagcaggagctggcaaactatggcctgctgtctgtttttgtacattttactgaaacacagccgtgcccatttgtttactcattgtctatggttgctttcatgcctcacagcaaaggcgagtagttgtgatggatcaaatggcccacaaagcctgaaatatttctctttgaccctttacagaaaaaaaccttgttgacccctgctttagagaatgagaagcctgcagggatcagtgatgccagaggaagggaaggaactgcttccagctattgtgacaatataataataataatattgggtctttgactagaacgtgtaacatttccaggtgttctcactgtgcttcccatgtttatcttacggaaggtcattccatcaagcttatggtcactgtccctcatggcagttggtcctttcgttctccctttagctctaagagttggggagtacccacagggagctgtgatctcagctcagagagagagcatgaggtcttttttaactgtcaggaaacaggctgtgcccaattccactcaacttttggcacaactgttaatctgggccttcacctacctaaactgagtttctgcaagcatagcattttagacaccctggaataaccttttgggaatgagccacagaataaagttcactcttaacttttcaatttccttggccagctgtcctccgtaatgaataagcctgttgaaagactcagagaaagtactatgtcttgtcatttgttctgagataagctcaaaaaaacagatgaagaaatcccagttactacaaccaaagagattcaacatttttttatcataaaagttcagcaaataaaactatatacaagatccatgcaaggaatccagtacacacaagacacatttaaaacctggttaaaacacaatctccacgatagcagggaataaaccagtaagaccaagtatctttagtgagaaacataatcgtgtttatattttggatgctgttgaatccaattctctccccaacaatgaggcactggatcacccactcttgtgacaccacggcagctgcaatgcttcagcacacttcagcaccgaggctgggcatgaggggtccgtcacaccacatcaaatacccctaaagcaatatctgcaaggagcaagggaaagtgaagaaggaaggacactcaacttagccctccattagaaagagagatttgattctaaccaatacatcccatctgcacaaaccaaagccctattatgtcaaacacactgctactgatcatgaccaaaggcgagttataatcactatgtgctgaccttgtagaaatatttaacaaatatacgtccagtgctcacttatgttgactcacctcttgaaggtggtacttttcttctctaagaaacatggataggtcaacctattaggcctgagccttggaccacaaggcctaacacctacaggtctaaggaatccctggaacaaagacactacacacactctttcaggtacctttgttatgggcacttgatggtgctgcttcacagaggctgcaccaccagtcatgaggatctcagaccagagctccagaagttctgctgttggtctgataccaagagtaccttcagattctggaaaggattttcacgggttgcctatgaaggagacaggaaaggaccttagcatgacaagtaatatccaacaaactcctttctgcaaagggactcatgtacatctgaatgctttcaaaaataaatgccccatcagcatagtgtctcaagcctgtaatcccagcactttgggaggctgtcgtggttggatctcttggcctgggagttcgagaccagcctgggcaatgtggtgagaccccatctctacaaaagacacaaaaaaattagctgggtgtggtggcgagtgcctgtagtcccagcagcttgggaggctaggtagggggatcacttcagcctgggaggttgaggctgcagtaagtcgtcactgcgccatgtactccagcctaggtgacagagcaagacttcatcttaaaaaactaagccctatattaggtcccccttctcttccttctttctatgaatgatctgtattccttgcattcctggcttttaatttccatgtttgttctggggctgagaataatccaaatcatgctcctgagcctatattttttaatgcttgcttaaaacttagttctctgactttacaggttgagaatattgaaccttatacaaatcttcacacatttgcaaaaggttcctagccaatgtaacctagggaaataaatagataaactcctgaagtcatttcaaacccactcaaatttatcccacagacattccaattctagaaagctttactctctcacctagattctcttccctccaaagcttgctgtcctcctcctatacaattctggatgggcttcaaatacttaccagtccagaattctttgctcctcaagctgtacccagctggcaacagataattacggtagttctggagctggttggcatggcaacatcatggacccagacatgagacacacaaggaatcccactggcaaggcacaggaagtactccgggttcgacaatgctgatccgcaattagaagacactggtaagctgtgttacactgcagaaaagaagcagagccaatgggtttggtgacttctgtggaaagctcctaagcagcagcctaatgagccatgaagagcagatctgaagactcccaactactacccaaaatgtgatttagctatcctgcccaaggccactcttctcactggaaggcccaagtaatttccatagatgttcctctgcctcacctgcagcatactgaggacctaaatcctcaacggacaaccaaaacctataactcagcctttcaggctaaaaatcagcaaccctaataggggtttctactactaaacataacatcaatcttcttttgtcccagcaacagaaccatagccattaactaacccaaggtccaccttctcttccctatacacaacaaaaattctatttcatgcaaaaacattttggcagttctcagttcctgaaatctctggctactttatccaggttccccaacccctcccaggcctctctcaacacagcaagttggctcttatcattgccactatattaggttacacaaagaaactctcacctgggcttcattgaaatcttcaaggatatagccagctcctgctcgaagctgggatctgtatactgcttgttgaaaggaggaatttccaaaaattctatattaaaaaaaaaaaccagataataattactgagtggttttcttatttgctaccttatgcctccttcttactgccccttttccactccccagctatccacaacagtgtgtccccaaagacaggccaagggcttcccatgggtcagaaagagatcttgaggcctttaaaatgctgccaaaagaagggacaagagtggagggaatgggaagatgaggactggaggtaggtcctagacctaaaaacatcaaaggttctgcaccggaccgttgatagggatgggaacacaatcatttcccacagtgacatattccacttgaataacccttaccatcaggaagttccctttgtgtctatcctaaatctttcctgttaaaactaaaccccatttcctctagttctgccttctgtggagatgaatagctgatgaacatttataagttatatatgaagggtttattataaaccactgcatcagcctttttaccccctgtacaactaaaactttaataaaccagaatgctcaatgaaatatggttttaaaattttaatgattaagtgaaggttagaaaatcctgtttcaacctttttattgaaaactatctaccttgatgatcttgaagtacctcaggacactgaacaccaatgactgctctatagtcttgagaggaagtagaagatatgagagatgaggctgaagctgtaatgaccctaggcaattagaaattcttcttttgaccaaatatctaatttgagcttgttttcttgtcatctgctcctctcatattaaataacacattaaaaaaaaaaagaaaagaaaagcaagacattagagattttagttaataggagttttgggaaattaagttctaattaactgaaatttttatcacaaattttaaaaccaacccaatccagtgcataaggttcaatgccggtaccactccccttccccttcacacccgtagtaaaacttagagcagatcccttatgacggctcccccttcagtgccctcgttgtctctggaggagctcaggcaccgccgaggccccaggtcaggggtctccatctccacttagtttgactagccaacctattcacttttactgctcttttcttgattcagcattctccacattctctcaaattgaaatcccaaaacagaaactctaaatggttataagaaactcagaatacagagggctatttctcagctttgtcatagcacccttttgctatctcaatatagcatgtcacatcttcagcaccaagattctactgctgagtcactgccaacaccccttacagtcctgtattttctcaagacttctactttatgtctgcttaatccaggactggtctacttagattttaatcctaattatatttccttaatttgtctaatgaagtattaccctgtctaggcagtgtgttttctaatttttctcaaatagtctgggttccaatttcttcatttttgaggtataagtgcccgcccagccagatgctaaaatgaataggttgttaatcgtgccatctaaatcaagtatgaagtactaaataaacccaactccagggtcaatccctgtgtctgaaggatctctgatggtgtccacccaacaagattaggtaccaaacttattaataaatatatctcataagatgaatttaatattttactgagctcctgttgtaagctggtgtctaagaattcctatttatctgtaacactaccaaacagtttcttaaaaactataattctgtagaggattgttttagtattagatgtttccgccttcttgagattgagaaacccccaagcattctcatacactgaaaatatcaaggttctggtactgttgggctgcgcccaaggatgaaggcaccaacataaagacacattcacctaaccacactgtctatcagaaacctgaagatcccttcaaaaacactgtccaaatgcctcttttatttttatgagtacagttttattacatctcacgcaggcacacggattttaatgaactggacagcctgcatctcataccagtcagctttcttgactatgctgaaccaagcaacaacaaaacatctatacagctgccttgtgaagtcctggtttcaagtccagcaatattgtaaagggggaaaaaaaaacccatgaccatgaccactgttttaatgccatgacacacctctatgagaatcctcaaaagactcccaattttcctgtccaggaaactcttcaaataccttattccactgtgcctatctgattgtttgacaagctaggtgttgcaaacactggaccttgaaatccaccacaccacatctactcactcccacagcccaactctcccaaaccaaagcctgcccctgtcatcccttccatgtccttgtacatatctacacatggctgcagtcggtgagatatagtttggttaattaggaaagagtcatccacacacctgaaatgccaaccctcacagatgtccagggtgcaaattatgacaaccatgttgcctaattcaattccctcttgcaagacaacattagcagaactctaacttgtacaacatcattccatctggacctttagcctttacagacacattagatactgctgtcagtcacatttacagtgtatacatttatatctgctcattccctctccagatcactcatttttcagacctctacccactgcagccttccttcaaaaactaacagacacacagaaataaatgcaatgtacagatttaatttaaggttaaagagaggtataagagttgaaaggcctagaagctgtttctttgcaatcaccctgaggaaccaggcaccccacagtcccgtcttagacctcaggagaatgaaccttaccctccacatgggtttgctctagcagatgccatagaacgcaaatggggaagatggcagggcattcagacctgattgacttggatggttgcgtaggctaaaatgacagagctctagtcacaggtttgtcattattgtggacaaaaaaaaccaattatttaacctttaacctctccaaacttgtttcctcatccataaaatagataagattatctcccatctgcctcacaggattgttttcaggaaccactcactgagaggaattttgtaaaacagtctagaaactgttaaaaagcagg

SEQ ID NO: 5071 - DNA, 32038 bp, Homo sapiens
taaataaaattttaaaaataaaataaaaacaggatatttgcaggaggtaatgttggaaaggaagttagggcatattatgaaggatctttgagaaggaactgatgagaagaaagacaaatatttgtgattttgtgatattgtaaagggaataatatttcttcaacccaagcattccttaaaggaaataactccattctatgaatactttggggaaaaaaaagatgcaaaatataattacacacaggtatggcctgaaaactaagttatatagttaggtttgaatcctctttaccacatcatctctaccaccacaaagaaaatccttaagagatccctgcagtaagaggtagctttctcagattaaaagaaaagatggtatcagaggtcacagccaaacactaccttccatttcaaggctaatgaaatggataagggaagatggtattgataaattatttttttcgcttttgggatcactttcttaaataaaagaatgtgggaagtgagggaagaaaaaggggaaatttcttcttgtcctttgcaatgctctgcagggggaaggtaaacccagtcccattgctctgcccattacttaatgtgaacaaataataattagaaaaatatttattgtgggcctcctctgtggcccgacatagtaataaatgcagacttcttccccatctcaacctttttagatattattttactagtgcctttttaaaggttattttactccatgcctttgcagacaaaccagctgttcaggcgaggtgaccctatggctgctggtatgcattatgatcatagtatttcccccaaaagccaagataagcctctgacacagcacttctgtaatccaacacgcctctctctgggtaagaatgcttacaggcagaactgagtgcagggaaggaatctgagctgtatgcagctcccttggatatttggtggataaaaccatgcaatccagcagagcagggctggagttctgccaaatgagctcgacccccagaaaaactaatgacattcatcaggctagaagagaaggcccagcatcttttcttatgaattgccagagctgccttaaatcttatggagactttaagcattgaaagaattatatgttcttctctcctatgaacacctaattcaagatgagtgcaactaattgcaagtaaagtctgatttttcatggggacaactttaatactttaaatgccaaatatgaaattatttccaaaaaacttagagatgcccttcccactttgttaagagtgtgcttaatttacctattggatatttatcactatacattatgaaggcctgggggttgagaattccctaactggtttaaactagccgatacttttcaaaccatttgagatttatactatcttttgccttgtgctgactccatgcataaccaaggaaacagcctataatagtgccttcctcttgcacctcttctaacctccctttcagtggtggatccttagacaccttcgacaattcaagggtccttcatcacagttcaaagcattggtgtgccactatatctgccaattttgcttgacaagactgtggaagaagctaagaattggagagctcccaaaagatcatacttggtcattccagggggtcaatagttaaataaacaaaacaggaggctccatagccatcaaacactactacctgtgtctgacaatcatgctatcacaggtccctaataatccccttgaggcaggagaatagtgtctggagacagggagcttcacttcagcctctgattggtgggagccaagtcttcatttgcaaagggtgtaacttcattcagcctctaattggtcacaggccaagccaccacttcagcctccaataggtcgcaggcaagtcttcatttacataggatgtaattaataggaaacctctaaagggtacttaaacccagaagatttgtgcaactggggcccttgagccacttactcgagcccactcccactctgtggatgtactttcacttcaataaatctatgctttcatcttccattggtttgtttgtgcatttgtccaattctcttttttttttttgagatggagtctcactctgtcacccagcctggagtaagtggcacaatctccactcactgcaacctccacttcctgggttcaagcaattctcctgctcagcctcccgagtagctgggattacaggcacccaccaacacgcccagctaatttttgctttttagtagagatggggtttcaccatgttggccaggctggtctcgaactcctgacctcggtgatccacccacctcagcctcccaaagtgttgggattacaggcgtgagccactgcgccagctagtccaattctttgttcaatatgccaagaacctggacaactcgtagtcaagacctccactggtaacacccttggaagggcctttgaattgcatcgttttactaccaggcttctccatagcacacttcctaaattcaatatagatttttaaatactttataattcatatatgttttaattttttatttagctttctaagtcttatacatatgtatcagagcattttctgtcttgcttataaaattctgggacacagatgctaatgctccacagttttcttttttctttttttttttctgtttgagataagaggcttgctctgttgcccaagctagagcgcagtggcgagactcggctcactgcctcctgggctcaattgatcctcccatctcagcctcctgagtagctggactacaggcacacaccaccacacccggctaatttttgtattttttgtaaagatggggtccattatgtaccccaggctggtcttgaacttctgggctcaagcaatccacccgcctcagctcccaaacagctgggattacagatgtgagccaccactcctgtccagttttctttataggcactttggacaagtgctatgtgcaatttaacacttaaacatattttctgggccgggcaggtggcccatgcctgtaatttcagcactttgggaggccgaggtaggtggatcatgaggtaggagtttgagaccagtatggccaacatggtgaaaccccgtctctactaaaactacaaaattagctgggcatggtggcgcgcgcctgtagtcccagctactcaggaggctaaggcagagaatcgcttgaacccgggaggcagaggttgcagtgaaccaagatcacgccactgcactcaacctgggcaagagagcaagactccgtctcaaaaaaaaaatttctgggctgggaacagtgctcacgcttgtaatcccagtcctttgggaggccaaggcaagaggactgcttgaggccagagtttgggaccaacctgtgcaacacacaaagaccctgtctctgtgagaccctgtctcaataatcctagctactccagaggctgaggtgcaaggatcacttgagcccagagtttgaggtacagtgagctacaatcatgccactatataccagccttgctgacacagcaagactctgttctaaatatatatacgtatattttgacaatataatcatactggaatcatcacccagtggatggctggaatactgttaaccaaggaaagaggaggataattaacagacacctatagccatctttctgtgacattgtcagactttggcagtgagcctgcaaaatactcatccagcacactaagcaattttagtactatcataatctacatttgcactgtaattaataaaacccaatttagcagggcctgagatcacaaggctgagtttctgcccctaccatctaatcagtgtgtgatcttccctataccattcagatctattgtctagtctctttgtgagacttgatgaaagcagatctttggttaactactgctgacctttatactgagaccctgtgctagttagcggcctcattctgcagttgctatggaaactgtccctttctccccacaacctattctggctctctgcctcacatggtactcttactgattgcagaagaggaggcctgtaaatctctccaagctcttttcagattcagatccacaaacggggggggggggggcagaggtacagcggaacaccgtctcagtgtcatagtcatgagactagagggtgaggcatccccagcatctgacattctgccagtatcttattttcccctttctgtgcaaaaaggattttcagggccatgtccaaattggttgcaagtggactggctgttttcctgtaacacatgctccatggtagggaccaggattgctgtaagttttttgttttgttttgaaacagagtctcactctgtcactcaggctggagtgcagtgggcaatcctggcttactgcaaccttcgcctcccgggttcaagtggttctcctgcctcagctcccgagtagctgggattataggcgcccaacaccacgcccagctaatttttgtatttttatagaggcagggtttctccatgttggccaggctggtcttgaactcctgacctcaagtgaccacccactttggcctcccaaactgctgggattacaggcgtgggccactgtgcccggccctgtgaagtatttaacatgcagacactgcccaatcagaacgtggctcacaggcagccttctgaatctgatactgtgttcctttctttcctgtactatctccaaagcaaaggcaaacggacaaaaaaaaacccaaaaacccaaaaaacaaaacaaaacaaaaaaacaaaaaaacaagtctgctggagccctagggtgaaagataggcgctcccatacatacatgtacagaatgattcgtatcctgggtaaaagactactctggagtgtggagtaggtggagacacactgaggaatggggaggctagactaacagcacttttttacaaagatgttccagtcagtcataaaacagtgaaggcctcctcagtcctttcccaacctctggttttgatcttagaactgtcaaccccttcttggtgcaaacactgctccttctgttttaagaactcccggggggtgggagggggggaagaatacaacagtctcctgagggagacccatctcactgtcacatcacttgaagatgggaagtctttcctaggttttactcaaatcccccttgctgcagtctgagctcattgcactcgagtctgcactcagcagagatggaaactagccagccaactgctatcttcagaataacaactcacagggactcaaggccggaaggtcattctgtcccctccaatactgcgcagccttccagagactcccagggcccggggcaaggacagggaaaccgaggatggagacctcgggcaggacccggcaggcagtgacaaaaaacaaaaaaaaaaaaaaacacgccaaacaacgataatacagaacacagacacagatggaggcaacgatacaaactcggaggcagagagggacaagatggctccctcagttcgggcgaggctgcggaattgccagacagtacttatcagggatacatcttactagaagcttcttccggcgccgaggcaaccgcctcgccccaccaatgggtcccccagagccccacccccgctcaagtctaagtggaagctcccgctggtactggggagggcgtggtggaggaagggggcggccaccaccctctagcctggcgagaccgcagagcacgagcttccagcccggcccgcccctgcggcgcctgtgccacgccccctgacaggcagcagccaatgaactgacctgccgccggcctttaagagccgcgcgcactctgcctgcagcggaagctgccggactacactccgcgggtgtttccatggagaccgaggccgagcctgcgcggcctcacggcgttgcatggagacaactccggggctggggctccgaagtcccggcgcaccgctggctcagaacccgcggagctgctgtgcgaggccggagccgcggtggcggctgcacgctgggacctgcagagcactctttgctaattgtgatcggcgatatcggtacagagagtcagctgagggccgtgcggcccaccttgaacaaggtgagccactgttctggctgtgcttcaggcatctctaccctggcttctccgccttctgcattcaactaccaatgcatacgtctgcatctccatccctagtggcacttcctgagatctgcgcccttgtcacctgcatcttccatgccatgtgtccgtatccctcgctctactaacatctcgcttgcccatccttactgcacactccatggcgttccgcagctccctgaggcagcggagctctatgcagcccctggggcccctctggtcacaccctccacgcagtgttttggaccaggtgtcctgaaagtcctcaccatccctggagaatccacgtcccatcttgctgtatcttctttatggtccctgaaccagcacggggagctttctgaacgcccctacaaatctcaaatctctgaatgccagtagccaaccactaagtgaccttcgtggctaccgctcctaagtcctcacctccttccccagtgctgtgcctgtggctgtggtgcagtgctgcgagccacctgcgggtggaagcaagctgtggagggctggggacaaggaagggaacacagaggcgaacctagaatcctacttagctgtaaatgtggggaaggtagccctcagtatctgggataggcccttaggtgtcacttccaccacaactggggaaccttacaagaaaattcctaccatagactcattaatgaccgagtttagtctaaactctgtccttctccctctggctcaggcaagcctagaaaagctgtaaactgggagaaagacaccattactagccacctttctttgagcatcactgaggctgatcatggcaactatccatataccctccctctccttacctgttctggaacttgaaagtgttcctgcagtctcaccaccctacaacctgcaaccttatccagaacctctttgtttttctcccacagggattctctcctggaacattgacctgtcatcctttgactgaaccaacagttgagactcttcattacccggcacctagctcacttctcctcagaggtcaaggttaggactaatgttttatttcagtcctttgggtaagagctggtcacagaggtccagctccctgggagaagtggccttgcgggaggtttgagtggaggagaagggaggaactttatgaggaggaaaatcatggaattccatagctgtccccacataccaaatatactttgcagactggtttgatactggagggagactggagaacataacttctccttgagaagagggttgttttggatagctgttgacatgcactaaagaaatgagggactcctcttagtgatcaatcatcttcacgcaaaaattcactctcttcatttgtgttcccctttctgcataccccgggtctcccgcttccctttacagacaccccagaatcccccattcatcttccttgacccttgtttagcattttatttaggctgcacaggtttcagggtttctggttcctgcttcggcttagccaacagtctccagggcagagcagaatcttggtacttacatgatgatgggcaccatcaaatccagatggaaggaggggctcctgaatttactgctacaagatcaagttgtactctgagatttggccagatcaaagctcacataatgcagtttcccattctgctgggtgggaggaatgggtgggtagagatttgagaaaataagatgttaggcactaccattccatgacagatgtctgtgaggtactacggaaagctctacatgctattataaaagaactaaggccgggcacagtgctcacactgtaatcccaacactttgggaggctgaggcggggagatcacctgaggtcgggagttcgagccagcctgaccaacggagaaaccccgcctctactaaaaaatacaaaactagctgggcgggtggtgcatgcctgtaatcccagctactcaggaggctgaggcaggagaatcgcttgaaccgggaggcagaggttgcagtgagccaagatcgtgccattgcactccagcctgggcaacaaagtgaaactccatctcaggaaaaaaaaaaaaagaaaaaggagctaggcatctagtcagttactggaaaatgttgacacaccaatccatcagcttagtggaatataaaatccatccagtcaacagccactgcaactgaatgattgaattcatgtcttatacagataattctcaattctcagtatagtagtcacctttccttaattatctctcctccttttccactgctcctaactccaaatctttgatcacttcctgatcactgatacttatagatgctgctaggaagttggagaaataaggctaatatgactaaagctccattagcctaggaatatatacagcaattttatataatatatgtgaggctgacatcttcctgatgtgactggcttcctgtaaagcaggctactactcttttgagaatgtttctgtttagaattactcatgtcatggcttcctccatttatcctaatgatgaaaatcggcagttttaccacttagtactcctaggagctttggtgaaaggccgatacagggatgacagaggatgaaattaatgactgaacagaagtttggggattatctgcgatgttaataattcacactgaatgctctaaccttgtccttttggctacagagacttgaggtaggctgctttctggaataatgtaagaaatgaaaagaagttaaaccaaagtacttagcattcttcagattaagatgcagcgatacttgggaagacacttacagagagaacatagttatctcaggcacttcttagaaatgagcattgatatataaacacctactaggccctttccataaagagtttgtctgtggtgtcctcaaggagcttagggccatgtaccctagatcagagctactttggcatactgcatatttttaggtttggacatttttatcatggtctgtctatgtcaaggagaatagtagagaatttcctggaaaaacccacacagctcaagacagccacagcccccccctgctggctcctctttcagctgtccccacaaacaacagtcagcccagagcagctgcgacactgcccctccctccagccttctgttagtgaggacgcaaaggggaccaggcagctggatgagctcaaggggatatgctagtgccttatggcttgactaccccacaggctgggccacattcctatcacctatcctcaagccctgggccaaaatgctgagaaagcagacaaaaatgatcctacagtgacaaggagagtgcacttattcctaggcactgccccctccacattgacaacccacacacagaaaagaagggaccctctgataaagagtcagtggcccagctccttctatggtcaagtctggtaaaagctttcaaaggtgatttttgcaccaggtagtctctccagtgtgactttctaacccctacaaaaaatctggatcttccgagcattctaatacaaattcagaacaattaggacagtggaaaactgagtttcaataactctctgattcttttactattggatcctataggaaatagaagggggcttataattcataactaatattctaagactctaaaaaaacagggccgggcatggtggcttatgcctgtaatcccagcactttgggaggccgaggtggtggatcacttgaggttaggagtttgagaccagcctggacaacatgttgaaaccctcttcactaaaaatacaaaaattagccgagggtggtggtgcacacctgtaatcccagctactcggaggcaggagaattgcttgaacccaggagacagaggttgcagtgagctgagatcatgacttgcagtccagcctgggcgacagagctagactccatctcaataaataaataaataaaaaacaggctgagggaccagtctggaggccttcggtctgactctccatttccactgacggactaggaagtgatagctctattacttctaccaatacaacagttaccctgaattaatacagcgctcattaacccctggaaccggggtctgcattgctgtctgaaatgggaaagcaaggacagaataggacttcaaatctcatactgcaggcatctttagttctgggtttacctgggagctagagtactccagagttgatctggtctgagatcctgatttatgatttccttgatcacctaatgacctctcagaaatcttccacaaaagggagaaagacttccagtggcatttgtacattcagatttggaagtctaggaatgaagaagcttttttttcatcttttatacaattcaaacccacagcattatcggaggatggtactaatattatactcatttcatagtttatgaagtaggtctgagagaggttaagtctcttgtttagcagcatgattagtaaaatggtggatcaagtccaaatccagggtttcatatcttactttgtagctcagctcaagcctctctttcttctttgcatctcaccatttcattgcagcagagcctaggaatacagcaggtggagagttggttgtgtgggtagctgttcagagggtgaaggctgaaggaaaactccactgtgagttggcaccatgccagggtgtggcccttgggggtggcagctgagaatatgggtgggctctgtattggtctggaaatgttattttgttcgtaaactaaatgtctacttaagtttccctcctaacacactccgaaagccctagaaagcagggaggagatagaaggcttgaggtgggaggaaataagaacgagaagttgcagaagaggggtatttcccttttgtgatgctcagaactcagcctggttttcctgtgtatctctgcagatggccgcttctacccaaacggggttgttgccattgtcgcagattgcatccccggatctaagcaaggattgctccccttttgtcccctcaacccccaagagtatagtgactcagctcctcctctcctctggctgcaattaaggggggatgggggatgctgaggcacagactattttggcttctctgaccttcaaaagtaactcttggcagcctggggcaaggtggggctagtgtttgggtgtgagtgggtggctgtgattgtgaggaaggccttaggagcggccaaactggggagggtggatgggaagagggcagggaaggactatgtaagagcatgagatcctcgggttggaaggaagtgctaccactctccagattcttcctttgagtcctagagcctttactaaatctgagatggaggtagagactaagggaaacaggatcaacattagaaagaccaaataatataatatagaaacagcaaagagacaaggagagagcaagaacccaatcacctacaaagtcattatagggtttttttaatctaaagagtacttctgttacatttaataattgcctacaaccttgcttgggccggaggccctggtgatccttcttggtccttgttaactcctcactgtaaggcagaaagctccctgtcccttcagggacttgtctcttcatatccaatgatcaagaatcccaagaatcagtgcctgtgtggttactgtgttatgctgcattcccatgaacttcatgtagctctcagggtccctgtgccccaccccaacaggctagggaccatgtgtccctccggaatttcaaactaccctctaaccctaaaataagacttatttctgccctccttggttctgtagtgctgaggttcagaagaaggcagcacatctctgcatccccaacctttgtctaagcagttccccacacctaccccatgcttttgggcccccagcctttgtctcctgctcctcagggactgaaggtcactccctggatccatctgaggagagaggcagcagatggtttctagagaagggggagagcccacgcagcccatgcctcctatagcctcgctctgtgccctagcaggggctttggtcttttggctgatgccaaaagaatatttcctaactaagcagggttgggaagaaaggtcctatgggccataggacattgcagaggctccttgagctgctagacaatccccagccccacagagccaagcaaaagcactggagctcagacgtcgtgaaggcaaagaaacattaagtctccagtgcctcgtcacggaccagcccctcttccccgccctggcgccgccctctcatcaagcacccccctcccccccccaccgcccgccccactcccaccctaagtgctgcaactcttccctgaagctgccggctgaggccggagctgccgcctccatgagaggcttcctctacaccccagggtaagaaccgaaccaaagggcttggcatgtgggggtacactgtgataggaggtgggatgggggtcatggaaagggtgctggtacctaatctggcacatctagaactacccagtggcagtaggcaggatggggaaatggagagagaagatgaacgttactggctgtggcccagcctggacccagaaccagaggccaccaggggctgtgacagtccacctctccagcgggcggggatgggagaaatcagcctgggacagcagcagagggtggtgccactggctctgctgacagcccaggatgctggaggagtttgggggctatgtttctggtcagaggcagaagatctgagagaaagggggatgttatgggaatgtgcctaataggagggcccctgggtgtcagtgctggattgctcagctgctcctatgctgggggtgagcagggcagtgagtttttgccaataagggaaggtgggggacactatggaaaagaagggaggaaagggtcactaagacgtggccgcgcctccttacagaccaaccggtttgcagtgggctcccccaccctattccctgcggcagctttagaatgggactctaaacccccctttctggccctgccgaggccactctggagacgagaactccctccccagcggctgccctgcatttccagtcgtgtcaaccccacaggttccagtctcagccctacccccacctcatctctgcttctcttcccaagatgggggctcttgaaagaggagccagtttcttctctctctctgcatccccccatccccaccccccatgcagaagagccaagaaaatgacttgtcatgctggggtggggggtgggggcggagctggagccggagtcagcgcgcacactcacacactgcggcaaactgcagctgcccaaacggtccccctcccctctgcctcactgcggagacacctgccctcctgcctgctcagcctctgcaccgcagcccaccccccccgcaactccagcactggctgagcactgtgtgtccctgcctcacaagatggtctctctaaagaaaaaggaaaaaacgagtcagttcccttcagtgagagagccaggggagcaaagaaacggctttctcccaggcctgaaaaagagaggcacaggatataaaccatgtaattcaagtcagaaccactcccagggatagagtgaggaacaggaccttatgccaggacaggaatgggatcatagaagtcttgtggtgataaatggggaccgtgaggaatggttgggggcaggaggggtagatagaaagcaaatcagtgtgtgctatagatatttgtctttctgaccctcctcctcaaatttatgaccttatttgtgtggagggagctcttgtctttctaaatctgaacgattaaggctggcagcttcccgaaccttgatatccctcacctgccccaagccctgcccttgctacatctgaggtggctcttgtcctctgaatttatctcaaatgttccctcaattctcaataaatagaagggaacccttgaattcccctttggcccaacccacgctgtatggggtttggcttctgacaccatcgttcatttcccccacagctgcatctgcagccctgtgctgccagattgcctgatcctggcaccatggctctgcctcttaacaaaggccctggccccaggcttctctgtccaagcaccagaaagaagagagagctgggtcacagaagagggtctaagggacaaatatggaccctcccaccagtatcctccagacagcccactgccatctgttggatgctctgtgggttaatgccactatgtactgcaattggaaaggggatttggcaaggaagggcgggtgcagggatggcagcattcttcttcagcatcttctgtctcatttgccactttctttctttgctaattgtttggtgtttcatgtgaggctggagaagggaaataggggatttggggatgcctttctttctccatggcctggggaacaccctgaatctctccttccttattaatgtgtttcttttcaagaacctttcactccccatgcccgtggtagaggcccctaggagcggggcaaagatagagaagaaactgttcacaatgaataggttgtggggtagtgaatctggcctctctgaaatttgggacatgaagatcaggttggagagggtgttgtgaaaacttccgagcaggaacaattgattgtgtgcatgtgtattagtgcgggcttggcctctgaggaaccagaggacagaaaagaagttatagtcctatgtccattctttgaatcataaaaccccaaaaatttagatagcacggcttctccgggtcttctggaacaggaattctggccttggatggcaagaagggtggggatctgtaccacacagaagctcctatttccttatttctagacactctgcgggcaggaaagccagggcagaggcaagccaggaaggagaaagggaagtgagggtcatcatcccaggggcccctctccagctgagccccccatccccaggcagcaccaggagcttagtgctcgagaaggacaaagcttcttgtcaatagggcagtctgaggccatagttccaggcagagggatgggggcaaggcagcagagggtgtggtagatgaagggaaggagaggacagccagtgtgggagaggggggtggaaaccctctaagggaagggctggatgagccagttcctagaccttactcagcagttccaaggtggcagggcctaaggataccttctctttcgtctaagccccatttcctgatagacattctttcctctcctgcaccacaatttctatacctattctcaatataaattcctacactctccctcaggccagaggaccctttgccaccagagtgagatcctagagaccatcatccggtaaatcccagtgcagacagcatcagctctgaggtaaggccagggcctgtgccttgccaacaggcctggtgcaagtgctatacccacccttgccagtgctaccactattaggccaagattcctctctctgccatctaagctgacgtattgtctccagcccactctggaggtgttatagggacataagttgggagcatgttcttgaggtactgaggggccattcattgcctttcccggatttcctatatctgtgaccactccccttcttccattccaggttcatcatcttcttagagctcatcagcttataaactactaatcttgagtgggcaaagtttagagcctgggggagactcatcctacagagtggcacctactcatatgaaaactttgcccaggtccttcacaacccgaggtaagttccatgccagagtgtctgggagaaagggtagcactagagctgtgggagggtctaagggaaagtctcatattgcatgaccatggggggccctggcagaaaggtaagagtcaccttggaaagaggtgaagattagggtactgaatctaagtcagaccaaaacaactctaggacctgatcaggtttctatctcctattcttctagatttcccaattgctcagcaatagagccctgggatacaggccttccttaccgtgtcctgcttaggggaaggtgattggagccaccgggattatccagttcccaagagaccctgcacctccggctaaaccctgagcccactctgccaccatggacggcgtggctgagttctccgagtatgtctctgagactgtggacgtgccatcccatttgacctactagagccccccacctcagggggcttcctcaagctctccaagccttttgctacatcttcccaggtggtcgtggggactctgccctctttgctgtcaatggtttcacatcctggtggatggtggctctgatcgcaagtcctgtttttggaagctggtacggcactggaccgcattgactcggtgctactcacacacattggggcagacaacctgccaggcatcatggactactgcagcgcaaagtggcagagctagaggaggagcagtcccagggctctagcattacagcgactgggtgaagaaccttatctctcctgagcttggagttgtctttttcaacggcctgagaagctgcggcttcctgatgcctcccggaaagccaagcgtagcattgaggaggctgcctcactctgcagcacttaaaccgcctgggcatccaggctgagcctctatatcgtgggtcagcaataccattgagccactgaccctcttccacaaaatgggtgtgggccggctggcatgtatgtcctcaaccctgtcaaggacagcaaggagatgcagttcctcatgcaaaagtggcaggcaatagtaaagccaagacaggcatcgtgctgcccaatgggaaggaggctgagactccgtgccctaccttacctctatcactgctctggtggtctggctaccagccaatcccatgagaagattgtgcgtgtgctttttccaggaaatgctccccaaaacaagatcttggaggcctagaaaagcttcggcatctggacttcctgcgttaccctgtggccacgcagaaggaccggcttctggggctgtgcctaccaacctcaagcccagcaaaatcaaacagcgggctgatacaaggagagcctcaaagccactaccaagacggccgtgagcaagttggccaaacgggaggggtggtagaagagggagccaaggaggcacgttcagagctggccaaggagttagccaagaagagaagaaggcaaaagagtcatctgagaagcccccagagaagcctgccaagcctgagaggtgaagacagagtcaagtgaggcactgaaggcagagaagcgaaagctgatcaaagacaggtagggaaaaagcaccttaaagaaaagatatcaaagctggaagaaaaaaaagacaagggaaaaaagagatcaaaaaggagaggaaagagctcaagaaggatgaaggaaggaaggagggaagaaggatgccaagaaggaggagaagaggaaagataccaaacctgagctcaagaagattccaagccagacctaaagccctttactcctgaggtacgtaagaccctctataaagccaggtccctggaagagtcaaaatagacaggagccgtgctatccgtggggagaaggagctgtttctgagccccagacacccccagcccagaagggaactgtaccactcccaaccatcagtggcacagggagctggtcctatcctcaccagaggacctcacacaggactttgaggagatgagcgtgaggagagggctttgctggctgaacaaagggacacaggactaggagataagccatccctctagacactgcagaggagggacccccaagtacagctatccagggaacaccacccttgttccagggctgggacaagaagaacatgtgatgaaggagaaagagcttgtcccagaggccctgaggaacaaggcagcaaggacagaggcctagactctggggctgaaacagaggaaggaaagatacctgggaggaaaagaagcagagggaagcagagaggctcccagacagaacagagccagagaggaaagtgaacctgaagtaaaggaggatgtgatagaaaaggctgagttagagaaatggaggaggtacacccttcagatgaggaggaagaggacgcgacaaaagctgaggtttttaccaaaaacatatgcaggaacccttgaaggtaactccaaggagccgggaggctttgggggtcgggaattgggactccagggcaaggcccctgagaaggagacctcgttattccaagcagcctgaccacacctgcaggagccactgagcatgtctcttacatccaggatgagaaatccctggctactcagagactgagcagaccatctcagatgaggagatccatgatgagcggaggagcgcccagctccacccagatttcatacaagtacatatgacctgcccgggcctgaggtgctggcccattcgaagccagccaacctgccgatagtgctgttcctgctacctctgcaaagtctatggaacgccagagactgaactcacctaccccactaacatagtggctgccctttggctgaagaggaacatgtgtcctcggccacttcaatcactgagtgtgacaaactttttcctttgccacatcagtggctgaggaccaatctgtggcctcacttacagctccccagaagaggagacaggcaagagctccctgctgcttgacacagtcacaagcatcccttcctccctactgaagctacgcagggcttggactatgtgccatcagctggtaccatctcacccacctctcactggaagaagacaagggcttcaaatcaccaccctgtgaggacttctctgtgactgggagtcagagaagagaggagagatcatagggaaaggcttgtctggagagagagctgtggagaggaagaggaggagacagcaaacgtagagatgtctgagaaactttgcagtcaatatgaactccagtgtttagtgcccctgggcatgccctacatccaggagaaccagcccttggagagcagaggagcggtgccttagcccagatgacagcacagtgaagatggcttctcctccacatctggcccacccagtgccacccacacaccctttcatcagtccccagtggaagaaaagttgagccccaagactttcaggaggcagactcctggggagacactaagcgcacaccaggtggggcaaagaagatgctgctgaggagacagtcaagccagggcctgaagagggcacactaggaaggaagagaaagttcctcctcccaggagcccccaggcccaggaagcacctgtcaacatgatgaggggcttacaggctgtaccattcaactgttgccagcacaggataaagcaatagctttgagattatggaggcaggagagcccacaggcccaattctgggagcagaagcccttccggaggtttgaggactttaccccaagaacctggcaaacctcagaaagatgaggtgctcaatatcctgaccgaagcctctctcctgaagatgcagaatccctctctgtcctcagcgtgcctccccagacactgccaaccaagagcctacccccaagtctccctgtggcctgacagaacgtacctacacaaagaccgttggccagaggtatctccagaagacacccagtcactttctcgtcagaagagagtcccagcaaggagacctccctggatgtctcttctaagcagctctctcagaaagccttggcaccctccagtttggggaactaaaccttgggaaggaagaaatggggctctgatgcaggccgaggatacctctcaccacacagctcccatgtctgttccagagcccctgcagccacagcgtcacctcccacagatgggacaactcgatactctgcacagacagacacacagatgacagccttgacaggaagtcacctgccagctcattctctcactctacaccttaggaaatgggaagtacttacctggggcgatcacaagccctgatgaacacattctgacactgatagctccttctccaagagtcctgagtctttgccaggccctgccttggaggacattgcataaagtgggaagataaagttccagggttgaaagacagaacctcagaacagaagaaggacctgagccaaaggatgaagttttacagcagaaagacaaaactctggagcacaaggaggggtagagccgaaggatacagccatctatcagaaagatgaggctctgcatgtaaagaatgggctgtgaaacagcaggataaggctttagaacaaaagggcagagacttagagcaaaaagcacagccctagaacagaaggacaaggccctggaaccaaaagacaaagacttagaagaaaagacaaggccctggaacagaaggataagattccagaagagaaagacaaagccttagaacaaaggatacagccctggaacagaaggacaaggccctggaaccaaaagataaagacttggacaaaaggacagggtcctagaacagaaggagaagatcccagaagagaaagacaaagcctagatcaaaaagtcagaagtgttgaacataaggctccggaggacacggtcgctgaaatgaggacagagacctagaacagacagacaaagcccctgaacagaaacaccaggcccaggaacaaaggataaagtctcagaaaagaaggatcaggccttagaacaaaaatactgggctttggacagaaggatgaagccctggaacaaaacattcaggctctggaagagaaccaccaaactcggagcaggagagcctagtgcaggaggataaaaccaggaaaccaaagatgctagaggaaaatccccagaaaaggtcaaggccatggaagagaagttagaagctcttctggagaagaccaagctctgggcctggaagagagcctagtgcaggagggcagggccagagagcaggaagaaagtactggagggggcaggatgtggtccaggagtggcaagaaacatctcctaccagagagggccggctggagaacagaaagagcttgccccggcatgggaggacacatctcctgagcaggcaataggtattggaggggcagagaggatgtggccttggaacaggacacatactggaggggctaagctgtgagcggaaggtctggttccctcacgagctggatggccagggggcccgccacactacactgaggaacgggaaagcactttcctagatgagggcccagatgatgagcaagagtacccctgcgggaacacgcaacccggagcccctgggcctcagacttcaaggatttccggaatcctcaccacagaaggggctagaggtggagcgctggcttgctgaatcaccagttggttgccaccagaggaagaggacaaactgacccgctctccctttgagatcatctcccctcagcttccccacctgagatggttggacaaagggttccttcagccccaggacaagagagtctatcccagaccctaagctcatgccacacatgaagaatgaacccactactccctcatggcggctgacatcccaccctgggtgcccaaggacagacccctcccccctgcacccctctcccagctcctggtccccccacacctgccccggaatcccatactcctgcacccttctcttgggcacagccgagtatgacagtgtggtggctgcagtgcaggagggggcagctgagttggaagtgggccatactcccccctggggaaggactaccgcaaggctgaaggggaaagggaagaagaggtagggctgaggctcctgacaaaagctcacacagctcaaaggtaccagaggccagcaaagccatgccaccacggagcctgagcagactgagccggagcagagagagcccacacccttcctgatgagagaagctttcagtatgcagacatctatgagcagatgatgcttactgggctggccctgcatgccccactagagagcctccacttggagcagctggggattggcccccatcctctcaaccaaggaggcagctgccggccgaaacacatctgcagagaaggagctttcattcctatctcacccaagagcctccagtctgacactccaaccttcagctatgcagccctggaggacccactgtacccccaaggccagagccagggccaagtatggagcccagcctcacccacctgcagttcccccccgtgctcctatcctgagcaaaggcccaagcccccctcttaatgtaacatcctgagctgcagcccagataggaggtccccatcccccaaggaatcaggccggatcactgggatgacagcactagtgactcagaactggagaagggggctcgggaacagccagaaaagaggcccaatccccaagtcctcctcaccccattcctatggggtcccccacattatgccagaaactgaggcacatgttagccctcccttggactcacacctggggcctgcccgaccagtctggacttccctgcttcagcctttggcttctcctcattgcagccagctcccccacgctgccctctccagctgaaccccgctcggcaccctgtggctcccttgccttctctggggtcgagctctggctctggctccaggaccccccaccagaacccggcatgatgaatacctggagtgaccaaggcccccagcctggattcctcactgccccagctcccatcacccagttctctggggcccctctcctctccaatctgccacgacctgcctcaccagccctgtctgagggctctcctctgaggctaccacgcctgtgatttcaagtgtggcggagcgcttctctccaagcctgaggctgcagaacaggagtctggagagctggacccaggaatggaaccagctgcccacacctctgggacctcactcctctgagcccagcacccccagcttcactggacttggccctagtccagctccaagcctgcctggagacatgggtgatggcatcctgccgtgccacctggagtctcagaggcagccacggagaagccaagccccttccaggttccctctgaggattgtgcagcaatggcccaactgaaaccagccctaaccccccaggccctgccccagccaaggctgaaatgaagaggctgcggcttgccctgcctgggaacgtggggcctggcctgaaggagctgagagagctcccggcctgacacattgctctcccctgagcagccagtgtgtcctgcagggggctcgggggcccacccagcagtgcctctcctgaggtcgaagctgggccccagggatgtgccatgagcctcggccccatcgtggggagctctccccatccttcctgaacccacctctgccccatccatagatgatagggacctctcaactgaggaagttcggctagtaggaagaggggggcgcgccgggtaggggggccagggaccactgggggcccatgccctgtgactgatgagacacccctacatcagccagtgactcaggctcctcacagtcagattctgatgtcccgccagaaatgaggagtgtccgtccatcacagctgaggcagccctcgactcagatgaagatggagactcctacctgtggacaaagctgggggtgtcagtggtactcaccaccccaggcctggccatgcccacctcctctcccacagccagacccccgcccatcccctccccgccctgatgtgtgcaggctgaccccgaggggctcagctcagagtctgggagagtagagaggctacgggagaaggaaaggttcaggggcgagtagggcgcagggccccaggcaaggccaagccagcgtcccctgacggcgtctggatcttcggggaaaacgctcacccacccctggtaaagggcctgcagatcagcatcccgggccccacctcgaccacgcagcaccacaagccaggtcaccccagcagaggaaaggatggacacagccccatgtccaaaggcctagtcaatggactcaaggcaggaccaataagtatatcatgaaacttggcagagagtgtgggttagggctgggtgtgggctggtcagcttcaggagtgggacagaggggaaggttgccaaaagggttctacttttcctctacaatgatcctggcttgtctctacagtggccttgagttccaagggcagctctggtgcccctgtattgtggatctcgcctacatcccgaatcattgcagtggcaagactgctgaccttgacttctccgtcgagtgcgtgcatcctactatgtggtcagtgggaatgaccctgccaatggcgagcaagccgggctgtgctggatgccctgctggagggcaaggcccagtggggggagaatcttcggtgagtagcaaaggacaccaaggaagtagtctggtcaacgctcactcagaggcagtagggaacacagtccctatttattaaaggatgggccttttctaagggcagcagagctgcttcgagaccatgaggtgccccttccccctcacctaccttccctttatgttctcacatcagactatcttatctcccttctaggtgactctgatccctactcatgacacggaggtgactcgtggtggtaccaacaaactcatgagcagcagcaacaactgaatgtcctggtcctggctagcacagcaccgtggtgatgcaggatgagtccttccctgcctgcaagattgagttctgaaagaccgccctcccttccccaaggatccactcccccagctcctttagagaatggctactgctggtcctttggggttgagggagatgggagctagggggaggggagggagatgtcttgttgtgggacttgggctgggctaaatgggaggggttgtccctccccatcatccattcctgtgagggtctcaaaccaaagttaacagggagaggatgggggaggggacaaattagaataggatagatctgatgcctgagaaccctctcctagcactgtcaaatgctggtattgaatggggactgggatgggtctcagagagcaacctcctccctcgtagagggagattatatccccaactccaggacctctttatctcaatctatttatttggcatcctgggaaggatttccaatagtaattatgtgacctggggcaggataccgtcagtgaggtgcccagagctgcaccctttcctccattcccatcccccatctcctcaaccaccagggtctgagttctagcagggtcctgggggtatccactgctatactgttctactgcttccctcagtatctgaatgtctcaatttaaaacttgagctctttagaccaatagactggtgagaggagaaaggagcttatcccccagaccctgcttataccattcacatcccagggctgtgtccagacagcacaaaacggcaaggagagcccaaccccaatgccagaattcttccaaactccctgactctttgaagtttttactcaccccattcaattatcctgatcccttctcatcccctgcttggcttctctgcatgtggtcatctgctgggcttggtgtttaatgggttaaaaataagccactgcctgacatcccaacatttgacacccagcaatgtgtgactcccccaacattccactatgccatcctgcagctgaaatgggaacatggctgcctctccaaacccgctcttggacagaggatctgggaggtggaagccaggccagggacttggggaaaatgagatggaggaaggaaaaagggagaagctgagccacagcttaaccctacagagtgaaatgaaaacgggctgaaaataccaccccaggagaggacctcgccccagcaagccagtgagcagccctgccagactactgccagactgagaaacccagaagctggtatcatgtgggcttgccttctctgccaaacgactgggaaaccaaaatgagcccaccttgtgtcttcctagctccaccctccccgtgctgctgtgttctgctcctccccacgcttccctgcatagttcccagctgctgtaacggagccacctccaactctaacaataaaccaagttcattcagatagtgtagtgctgcttaggctttttctgactccatacatgcttagttactgggcctggcttctacctctctgcttcaaccagtattgaatttatcttggaagactccaatgctttgattactggaaacacttgtgcctgagtatgaagaataggagcctagggtggatacataatctggtctgggggagggaagaggggcagaaggcctcctgggaaggggatatgcattcctggggtcaagagttgaggaccaaataaccaggatcagctaccctggacagcctcttgggtaaaggggtaaaaagctgaaggaccctaagagatccagagcctaatgaggttggaaacactctccttgtgcagtcaggatttccatggagtaaaacggtcgactttcctcctccatggaaccctttatagtcctaagtatgtcagaagtggccaggttatgaatgtgtatatttgggaggggcatattctagccctcccactgttctgggctctctcatggtaaagatgtcaaagggcagagaaagggcatagcccctttatataaactcctcctgacactccatcagagtgaaaattaacaggatgattccaagaacttggtgagaaggcatgtaccctctggtgcttcacaggagggaacctctttccagtcccccatccaacactctacttactcaataaagaccttttgggaccgggcgtggtggctcacacctgtaatcccagcactttgggaggccgaggcgggcaatcacctgaggtcaggagttcgagaccagcctggccaacacggcgaaaccccgtctctataaaaatacaaaaaaaattagctgggtgtggtgacgggcatctgtaatcccagctactcggaggctaaggcaggagaatcgcttgaacccaggaggcggcagttgcagtgagctgagacgcaccactgcactgtagcctgggtgacagagcgagactctgtctctaaataaataaataataccttttgagatagtgggttaactgccataggctcctcttgggatgcctgatctctttttttttttttttttttggagacagagtctcattctgtcaccaggctggagtgcagtgcgcgatcttggctcactgcaacctccacctcctggattcaagcaattctcctgcttcagctcccgagtagctgggattacaggcatgtgccaccatgcccagctaatttttatattttagtagagatggggtttcaccatgttggccaggatagtctcaatctcttgacctcatgatcacccacctcggcctcccaaagtgctaggattacagacagatgtgagccaccacgcccactgatctctatatttttatagtctatttttggatgcctgatctctgtatttttacagccattcctgctcaactataatggcttttgaccgattcagattaatcagttacagacacaatgactcatagtcgtattcctttttttttttttttgagacagagtcttgcatttttgcccagctggagggcagtggcgtgattttggctcactgcaacctctgcctccagggttcaagtgttctcctgtctcagcctcccgaatagctgggattacaggtgtccaccaccatgcctggcaatttttgtgtttttagtagagacaaggtttcaccatgttggccaggttggtctccaaccctgacctcaaatgatctgcccgccttggcctcccaaagtgctgggattacaggtgtaaccaccgtgcccagcctatattcattcttgaattcacaaggacatcaccatcatccatcacaccattctcattagtttatatttattgagcactcataatgttccagcccccgactccatgaccgcattacccctcctacccactcccattcccatccctggatctttggaaaaagctcataatcatatctggccctcagacacaatgatataaggacaaatttcttggggaccctgagtgtttggtctttggccagtctgtccctggcacaactacagaaataaatatatatataatatttattaaacctttgcttgtatctgtacaatattgatctctgctgattgcttaaaaagaacctgattatctctactactacagcatctcctaagccaaacagccccaccacagagaggcccactttcacagactggctaagaatcctctagagcattttaagtagttgctctgattttgcacagcagtctaatacctacttttccctagagctattgcccagaggaacaggacgaggcagaaggggcacttggggatgatatggaaggatctataaggcaagtctaaagattagtggccatgtcagatgtttggggaagggactctattttccagacatttcagatagccacccgggctcacctgaggagtgctggcaaagacaagagtcccctgaatgcacatatggtcaagcgtaccttgagaagtcgtgaacatttccccagaaaagtgaagaccctagagtcccccttttgcatttgctgtcgccagatggtgtcttcagcagtgaagcggcatttcctttaacatctgtgatttcctaggatgctcagagaaggctgggtaatgacagaccaacccaccccaggaaatcctattcaagtctaatggctaagtgaggagccaatggcttcttcgaacctaaactggctcctcctcaaccacagctctggcacaggtatgcttcatacaaagagaactacttcccagacaccgctggtgagagctggccagtgagttagccaacagaaaaggttgctggctaaatggctggtatagtgtgataccactaatgagaaaattaatcacatgttgctggtggaggggtgagtgctggtcatgggctagagactggctctgagggtttggatcaccagatggagctgggcttgaggaataccctctccaggcagctgatcaatcacttcagggaccacccagacttctaatttatctcctcagggacctcctgggcctgcagatcaatctcctcagggaaccttgggatggtttatcaatctcagggatgccctgagataacagattgatcgcagaagtccctgggccagcctgccaacctccacagagaactcctggtatggctggatgacctcctcaggatctcttcagctgggctgccaacttctacaagggtttcctggaccaagctaccaaccctacatggaacttatggaccagcttgccaacctccacagagaccccctggcatggctggtgacctcctcggagttctccagacatagctggcaaacttcctcagagactttctggcacgttggctggacttctggcatggctggctgatgtgagggacctcctggcatgtgtggttacattgtcatggttctcctggcattgctggctgatgtcagggaccttctgacatggctggtgagcgcctcagaaatgtcctggcatggctggctgatgtcagggacctcctgacatggcggctgacctcctcgtatggctggctggtttccataggtggcacctgtggggactgatttgttcaaaaagctcttgctccccttctatggagagctcttgtgctccactcccaggggtccctggagcagcccaaggccttgatgttcttcagccacgtgtgaatttagggagggttgacactgaagccaaattgggagttaccatctactgtagtaggggaagaaggaccagcactgacacagtgctagaagggccactgctgtctgtaaagcaaagtcaagagatcaagttagagagctggaagagtaggctctaccctgtgcagatagttcaaatgctagaattgttggcctagctacttatgtcttgagggaagagtgtccaaattcttcctaagttaagcagagactcctagtttgcttacctcaggaactgtcaccctggcctaatgtatactttgagagtaacaataggtacatctaagacttcaggagagagtgctaagacccacttcatctggttctttcacaatacactcccatcccaattccaagttcccaaggcctctcattcctactttggaagcatataatactttagcccagtggttcataaacaaaatcatgaaaaaattttttaaaatactaattccagttttcaactccagagattctaattctataggtttagcgtaaaggtgtagtttggggagggaggaggaagaaggcaatataattttgttggaacactctcatttgaatctgatgacaccttctgttaagaatcattctttaaagcaatcaatgtatttctggggcagaggtaacattatttatagcccaaatgataagttggcagaagaatgtagaaaaaccatgtaaatcaaacaataggaaagaaaatggtttacctggctgggtgcggtggctcacgcctgtaatcccgcactttgggaggccgaggcaggcagatcacttgaggtcaggagctctaaaccagcctgccaacatggcaaaaccttgtctctactaaaaatacaaaaattagccaggcgtagtggcgctgtctgtaatcccagctactcaggaggctgaggcaggtgaatcacttgaaccccagagtggaggttgcagtgagccgaaattgtgccactatactccagcctgggcaacaaagcaagctctgtctcagaaaaaaaaaaaaaaagaaaatagtttacccaaaaatggaagatggccaggaatttctacatggcagttcttaacctttctaggggtcagtggcccctttgaggtactagtcagatatcttccaggaaaaatctatataagaatattcacactaatctttacatgtgttcctgaagctcacagaccctaccctgaaaccacatctatggatccagagttaagacgctgtaagtcttgggacatacaatgttacaggcttgtgcatattatatacacggaaaacattaaaaactgatttcctacatcctgacagtagtgtaataaagacctcagagtcttcaattcactgtgggatgattcctactccatcctctactgcttcatcgccctctagtacttgactacctacttttcccttggtaaacatcatttttgttgataatattataacgatatattaaacactatggtatcaataatgacagattctgggaaaagggaacatcagaacatattgccatgaagaaaaccttgaaaagttggtaaacctgagcctacaaaggctcaatccatcattgagtgaaggtatgctagttatctctcttctgtaaacaatcaaaggaggggctggacacggtgctcatacttgtaatcccagcactttgggaggccgaggtgggcagatcacaaggtcaggattcgagaccagcctgaccaacatagtgaaactcctcctctactaaaaatacaaaaaaaattagccaggcatggtggcgcatgcctgtaatcccagctacagctactcaggaggctgagcagaagaatcacttgaacccaggaggcggaggttgcagtgagccgagattgcaccattgactccagcctggatgacagagcaagactccacctcaaaaaaaaaaaaaaaaaaaaaaaaaaagaatcaaaggaggcatgcttcaagcagaaaaagaagccagacgcggtggctcatgctgtaatcccaacactttgggaggctgaggtgggtgcatcacttgagatcaggagttcgaaccagcctggccaacatggcaaaaccccgtctctactaaaaatacaaaaattagccaggatggtggcacgtgcctgtaatcccagttactcaggaggctgaggtaggagaatcacttgg

SEQ ID NO: 5072 - DNA, 100000 bp, Homo sapiens
ttgggaggctgagccaaacagatcacctgaggtcaggagttcgagaccaacctggccaaatagtgaaaccccttctctactaaaaatacaaaaattagccatgcgtggtagcgggcactgtaatcttagctactcaggaggctgaggcaggagaattgcttgaaccctggtatgtggagttgcagtgagccaggatcgcaccactgcactccagcctgggtggcagagcaagactcgtctcaaaaaaaaaaaaaggaaaaagagaaaaggatggggcaggggagagtggtcagccggacgttggagggagggggttcagaattatgcaaataacttcctacaaggctgggcaattaagggtgtctttggtcagccttaatgtgacttggttagaaggaagatgagtggaggcaagcattttcatttcaatctgtcaggcatcttaatgtcttcgagtgcttagaatatgcaagtgctaaaattttttgtaatgtctatcaggtagatgtgttggagtctcagttctcccagtgcttcatcagatcaattctacccgagactttgaaagcatccgattggctcatgaccactcctgagcaatttgctggctcaatcctttatcctattgaaacctgtaagtaaggctcatggtttcctcagactgcttctaccactgaccattcccttaggcagtttgagttgacaggaacgaaaccatcattaagcaattattcaagtccattttaaaacattttttaagaatgtgtaagcggcggggcatggtggctcatgcctgtaatcccagcactttgggaggccgaggtggcggatcacaaggtcaggagttcaagaccagcctggccaacatggtgaaaacccgtctctctaaaaatacagaagaaaaaaaaaataataggtgtggtggctcgcgcctgtaatcccagtacttgggaggcctgaggcaggagaattgcttggacccaggaggcagaggttgcagtgaccaagatcattccactgcactccagcctgggcaacagagcaagattctgtcttgggggacagataaaaaaaaaaagaatgtgtaaagcaaaactaaaaaggcatgttaaacgggacctagatgtctttgaatttctgaaatacagggtgtggtgagcagctacagatgaaagaattagtgcttaaaccctcaggagttaaagaaactcaaaattcttgctgacaatacagaaaaacaatgaaaagcatatagagttcaccttcttagaaatcttttggaccaggatggatcagtctttgaaagttcttttcatagacaactagagtagtgtttctctctcgatctatgtatgtgttctgtaagtacatatatgtctccttcgtggcagttattttcaactttggctgcacattgaatcatcgggactctttaaaaaaatctaggtgacagagcacttaaattagaatccctgaatagtgggacccaggtactaattttttttaaagctcacaagctagttccaattccaggtaaagaacaggaagactgaaatgatctctggtagtttctaatggaacggttatgcctccctgacatgagctggttgttattcctcagtgtgctacagcacagctgttacagactttttaaaatgttctggtgtttagggctatttctgctgtaccaggaagagtaagatatatattatagatgccactccagagggctggctgaaaacaaccaagaactactgtgatgggtagatgtgtccttatgtggcatagatgtatccatagggaaaagcagaataacagagcaggtcatctcattaaatatttattgagtgcttactgtatgcaaggcactggggatacaaagaggtatattcatggctctgcccttaaggagctcacaatctagttggaaaaacaagacatatatattatatacatacaaaaatcagtaacaacacagaggcctgaacaattgccaagtggacaacgtacagataataaagaagcaagaaacgagggttcactaaaggctatagtggggaagggatgcttcactgagagagtgggacttgaactggtattaaaaacaagagcatcccgggcaaaggaacaacactcacagctcagaggcaggaagacactctgcgggtctaagaaatgaagagtaaatgtggctagattggaggtttggtgcagggctaagagagtaatactcgcttagccagaaaggatgcatttgttttacgcattttgtgcgtctgaggggctggcaggccttgcacgggcagtgtctatcctgtcagatttgggaggtcagctattaattagatcagctattaatcgactgttctcctaacactttaacttcatggatgtaccttccttcctttcctaatgccaatctgtttcccgggtaggtgtttcactgcctgaatgaaatcctagatctctgtcacagttttgttcgctggtcagtcagaacctaggcccactggatgagcgtggagccgcccagctgacattctcgtgaaggtgcgtctgcctggaagtatgcagccttgccgaaaggacagaggtgttttgccaatggagaattcatgatctttcctctgagtcagtaaagcatttcctcaataccacacgtacagagataagatacaaagataaaaatgttggtatcagttgattttgaagcagtaattactgtgccacctcacagtgctcaaaaatagttcagtcctgaatagtttattcacccatcaaataagcattgggttgttctaacttcctcacatcctcccccctccttacttcttgaactaacccccatctcactgagataattatctgcttgtaatcaaaacgggttctcccaaccccagtacttgacaaaatacattaactggaaaccagctactaaattcctactgataaagagtactttcataggaagtcatgcatgtatggatttggtacaagtcattttaggaataatagaaataggaatgtgggaaggccaggtggttctgtagaattttgaacaaggctttccaagaaactcctccctccgcccccatcctccatatggagagttggtgagctgaagtggatgacagctgagtccttctctctgcagggctttagccgccagtcttcactcctgttcaaattctctccagtgttcggaatcatcagatcaactcagatttggctcaactactgttacgctagattataacaaatactatacccaggctggtggaactctgggcaggtaggagcaaccttgggtaactcagtagactttttaaggtggctttttaatgagttgtagaattctagaacggaagaagactttagtccaaataccctcattttataagtaaggcttagagatagaggtggaccatctttaataattttaatggaggttattttctagtagaagtcatcatcatcataaatactaaaaaacctgacagtgagataggtgttaagtcctttgctaggttatgtattgcttgctgggaggcagtgggccttccactcccaattctgatatgaactagctgtgcagccgtggcaccccgccttgctggtccctagcttccgcatctgtgaaaggaggcgaccacccctttaactctaaactttaaaaaaaactgataccgagattcagtggtagctggcttcccagagtctgtcattcccattcagaaaatcacttcattgtcctttctctctaaaatgtctgcaagagatttttttctaagctattgtagcagaagagtcaaaagaaactcttcagttttaagatacattatttagatcacaggttatcctgattcatatttctttgaaggtagtcttgggaaacatgacacttaataaggctctttttctcttttgtagtttcgggatgtgaaaatttctggtcataaattgaaataacagccacgttcccaaggttgtaacagaagattcaaaacatcccttctagccacacacaaataaatatctgcggcttagtgataggactctaccttttctcctgaagcagttactgaacatccaggagtacaactccttcccatcattcccatgtggaagggctctcccatcaaggagaacatgtggcatctctgatcctttacattgagaacatttgttgatatgttcatttattcaatagtcatttattgagcacctactacgtaccttggtactgttaagctgtgggagatacagcggtaaacaaacaatatagagcagaaagttaaatattttatgttcatatgtgaaaaagtaattatgtttataaatagactaactgctggatgttaccaccagtaagaaagcaacaggtaagataggctttctctctccctataccaagtaatttataccacacagattgggcaattctagctaatgaaaatatacttaaaagtatttcttaggccgggatggtggctcacacctgtaatcccagcactttgggaggccgaggcgggcggatcacctgagtcaggagtttgagaccagcctgaccaacatgatgaaacctcgattctactaaaaataaaaaattagccaggtgtggtggcatgtgcctgtaatcccagctactcaggaggctgagaaggagaattgcttgaacctgggaagcagacgctgcagtgagctgagattgtgccattgcttccagcccgggcaacaagagcgaaattccgtctcaaaaaaaaaaaaaaaaaaaaaaagattattctccaagaaaaaggtccttaagaaaaaattgagatcaagttgttagatttttaatactgaagattgcaggcccaattacccatcttacacaaaccataggggttgaagttatttaatatggcccagccatcactggtaatcaatattcatatcagtgtaagtaaaaagaaaattcactgaacaacgccctccaaactgaaaaagaatgcagtgttctggcatcaggttatgtcactgcatctggttttcatcactacatattctacacacactgggaagctctgacaactattccctgctattatcaactaaagatcaccctttccactgctgtctctggagcaggagtggcaaactatggcctgctgtctgtttttgtacagttttactgaaacacagccgtgccctttgtttactcattgtctatggttgctttcatgccctcacagcaaaggcgagtagttgtatggatcaaatggcccacaaagcctgaaatatttactctttgaccctttacagaaaaaaccttgttgacccctgctttagagaatgagaagccatgcagggatcagtgatgccagaggagggaaggaactgcttccagctattgtgacaataataataataataatattgggtctttactagaacgtgtaacatttccaggtgttctcacttgtgcttcccatgtttatcttacggaggtcattccatcaagcttatggtcactgtcccttcatggcagttggtcctttcgttctcctttagctctaagagttggggagtacccacaggtgagctgtgatctcagctcagagaggagcatgaggtcttttttaactgtcaggaaacagagctgtgcccaattccactcaactttggcacaactgttaatctgggccttcacctaccttaaactgagtttctgcaagcatagcttttagacaccctggaataaccttttgggaatgatgccacagaataaagttcactcttacttttcaatttccttggccagctgtcctccgtaagtgaataagcctgttgaaagactcaagaaagtactatgtcttgtcatttgttctgagattaagctcaaaaaaacagatgaagaatcccagttactacaaccaaagagattcaacatttattttatcataaaagttcagcaaataaactatatacaagatccatgcaaggaatccagttacacacaagacacatttaaaacctgttaaaacacaatctccacgatagcagggaataaaaccagtaagaccaagtatctttaggagaaacataatcgtgtttatattttggatgctgcttgaatccaattctctccccaacatgaggcactggatcacccactcttgtgacaccacaggcagctgcaatgcttcagcacactcagcaccgaggctgggcatgaggggtccgtcaccaccacatcaaatacccctaaagcatatctgcaaggagcaagggaaagtgaagaaggaaaggacactcaacttagccctccattgaaagagagatttgattctaaccaatacatcccactctgcacaaaccaaagccctattagtcaaacacactgctactgatcatgaccaaaggcagagttataatcactatgtgctgacttgtagaaatatttaacaaatatacgtccagtgcttcacttatgttgactcacctcttgaggtggtacttttcttctctaagaaacatggatacggtcaacctattaggcctgagcctggaccacaaggcctaacacctacaggtctaaggagatccctggaacaaagacactacaccactctttcaggtacctttgttatgggcacttgaatggtgctgcttcacagaggctgcacaccagtcatgaggatctcagaccagagctccaggaagttctgctgttggtctgataccagagtaccttcagattctggaaaggattttcacggggttgcctatgaaggagacaggaaggaccttagcatgacaagtaatatccaacaaactgcctttctgcaaagggactcatgtaatctgaatgctttcaaaaataaatgccccatcagacatagtgtctcaagcctgtaatccagcactttgggaggctgtcgtggttggatctcttgggcctgggagttcgagaccagcctggcaatgtggtgagaccccatctctacaaaagacaacaaaaaaattagctgggtgtggtgcgagtgcctgtagtcccagcagcttgggaggctgaggtagggggatcacttcagcctggaggttgaggctgcagtaagtcgtcactgcgccactgtactccagcctaggtgacagagaagacttcatcttaaaaaactaagccctatattagggtcccccttctcttccttctttcatgaatgatctgtattccttgcattcctggctttctaatttccatgtttgttctggggcgagaataatccaaatcatgctcctgagcctatatatttttaatgcttgcttaaaacttattctctgactttacaggttgagaatattgaacctatatacaaatcttcacacatttgcaaaggttcctagccaatgtaacctagggaaataaactagataaactcctgaagtcatttcaacccactcaaatttatcccacagacattccaatttctagaaagctttactctctcaccagattctcttccctccaaagcttgctgtcctcctgcctatacaattctggatgggcttcaatacttaccagtccagaattctttgctcctcaaggctgtacccagctggcaacagatattacggtagttctggagctggttggcatggcaactatcatggacccagacatgagacaccaaggaatcccactggcaaggcacaggaagtacttccgggttcgacaatgctgatccgcattagaagacactggtaagctgtgttacactgcaagaaaagaagcagagccaatgggttggtgacttctgtggaaagctcctaagcagcagccataatgagccatgaagagcagatctaagactcccaactactacccaaaatgtgatttagtctatcctgcccaaggccactcttccactggaaggcccaagtaatttccatagatgttctctctgcctcacctgcagcatactgggacctaaatcctcaacggacaaccaaaacctatgaactcagcctttcaggctaaaaatagcaaccctaataggggtttctactactaaacataaacatcaatcttcttttgtcccagaacagaaccatagccattaactaacccaaggtcctaccttctcttccctatacacaacaaaattctatttcatgcaaaaacattttggcagtttctcagttcctgaaatctctggctatttatccaggttccccaacccctcccaggcctcttctcaacacagcaagttggctcttacattgccactatattaggttacacaaagaaactcctcacctgggcttcattgaaatcttaaggatatagccagctcctgctcgaagctgggattctgtatactgcttgttgaaaggagaatttccaaaaattctatattaaaaaaaaaaaccaagataataattactgagtggttttttatttgctaccttatgcctccttcttactgcccccttttccactccccagctatccacacagtgtgtccccaaagacaggccaagggcttccccatgggtcagaaagagatcttgagcctttaaaatgctgccaaaagaagggacaagagtaggagggaatgggaagatgaggactgaggtaggtcctagacctaaaaacatcaaaggttcctgcaccggaccgttgatagggatggaacacaatcatttcccacagtgacatattccaacttgaataacccttaccatcaggagttccctttgtgtctatcctaaatctttcctgttgaaaactaaaccccatttcctctagtctgccttctgtggagatgaatagctgatgaacactttataagttatatatgaagggttattataaaccactgcatcagcctttttacccccttgtacaactaaaactttaataaaccgaatgctcaatgaaatatggttttaaaattttaactgattaagtgaaggttagaaaatctgtttcaacctttttattgaaaactatctacctttgatgatcttgaagtacctcaggacctgaacaccaatgactgctctatagtcttgagagtgaagtagaagatatgagagatgagctgaagctgtaatgaccctaggcaattagaaattgcttcttttgaccaaatatctaattgagcttgttttcttgtcatctgctcctctcatatataaataacacattaaaaaaaaaaaaaaagaaaagcaagacattagagattttagttaattaggagttttgggaaattaagttcaattaactgaaatttttatcacaaattttaaaacccaacccaatccagtgcataaggttaatgccggtaccactccccttccccttcacacccagtagtaaaacttagagcagatccctatgacggctcccccttcagtgccctcgttgtctgctggaggagctcaggcaccgccgagccccaggtcaggggtctccatctccacttagttctgactagccaacctattcacttttctgctcttttcttgattcagcattctccacattcttctcaaattgaaatcccaaaacagaactctaaatggttataagaaactcagaatacagcagggctatttctcagctttgtcatgcacccttttgctatctcaatatagcatgtcacaatcttcagcaccaagattctactgcgagtcactgccaacaccccttacagtcctgtatttttctcaagacttctactttatgtcgcttaatccaggactggtctacttagattttaatccctaattatatttccttaatttgttaatgaagtattaccctgtctaggcagtgtgtttctctaatttttctcaaatagtctggttccaatttcttcatttttgaggtataagtgccctgcccagccagatgctaaaatgaatggttgttaatcgtgccatctaaatcaagtatgaaggtactaaataaacccaactccaggtcaatccctgtgtctgaaggatctctgatggtgtgccacccaacaagattaggtaccaacttattaataaatatatctcataagatgaatttaaatattttactgagctcctgttgtagctggtgtctaagaattcctatttatctgtaacatctaccaaacagtttcttaaaaacttaattctgtagaggattgttttagtattagatgtcttccgccttcttgagattgagaaaccccaagcattctcatacactgaaaatatcaaggattctggtactgttgggctgcgcccaggatgaaggcaccaacataaagacacattcaccataaccacactgtctatcagaaaccgaagatcccttcaaaaacactgtccaaatgcctcattttatttttatgagtacagttttttacatctcacgcaggcacacggattttaatgaaactggacagcctgcatctcataccatcagctttcttgactatgctgaaccaagcaacaaacaaaacatctatacagctgccttggaagtcctggtttcaagtccagcaatattgtaaaagggggaaaaaaaaacccatgaccagaccactgttttaatgccatgacacacctctatgcagaatcctcaaaagactcccaatttcctgtccaggaaactcttcaaataccttattcccactgtgcctatctgattgtttgacagctaggtgttgcaaacactggaccttgaaatcccaccacaccacatctactcactccccagcccaactctcccaaaccaaagcctgcccctgatcatcccttccatgtccttgtacaatctacacatggctgcagtcggtgagatatagttttggttaattaggaaagagtcatcccacacctgaaatgccaaccctcacagatgtccagtggtgcaaattatgacaaccatgttcctaattcaattccctcttgcaagacaacattagtcagaactctaacttgtacaacatcttccatctggacctttagcctttacagacacattcagatactgctgtcagtcacatttaagtgtatacatttatatctgctcattccctctcctagatcactcatttttcagacctctcccactgcagccttccttcaaaaactaacagacaacacagaaataaatgcaatgtacagtttaatttaaggttaaagagaggtataagagttgaaaaggcctagaagctgtttctttgaatcaccctgaggaaccaggcaccccacagtcccagtcttagacctcaggagaatgaacttaccctccacatgggtttgctctagcagatgcccatagaacgcaaatggggaagatggagggcattcagacctgattgacttggatggttgcagtaggctaaaatgacagagctctatcacaggtttgtcattattgtggacaaaaaaaacacaattatttaacctttaacctctcaaacttgtttcctcatccataaaatagataagatctatctcccatctgcctcacaggatgttttcaggaaccactcactgagaggaattttgtgaaaacagtctagaaactgttaaaagcaggatacagagtaatttctgtgaccaagatcccagttgctacttgccttgcctcctcacatacaacagggggaccaccagctcataagtgactggaaaagaaagaagtgcctatgttcagagctcccagggcttcctaaggccttaccctcctcttcttcactgcttcctgtaggccatctggcagtttggagcggctggccaacttgtcactggttgtggccatggtaaggagaatgcgtagcccagaaacaaggtcttgttgagaggcaaaggccctctctgctcttccaggcagagggttcaccggtgttgtctccactctcacaggggctcacaaactctcctgccccactgcacctgggaaggacaggggcacagttactagagggatacacaccattgcctcagcaaagccttaacaccaaaaggccccagcaccaagcatgacctgatgggcaggcactgtccgatgaacttatctgagccagaaaccaaagaccattccaatggccaaccattctaaatggcgacagcctaggataaaatttacaacaaagagaaatttacatatttaaattttacacagcatgataatgtatacagtgttttcataaatgaaaattaaccaagtattgttttcatataccacaccaaatacttctgaggtcatctgaagaaagaggtggttctaatacaaagaaatataggtgagagtgaaaaatgtttggaaatcttcagcccactttctctgtcccgtgctctgtttcccccagggtatgagatattttgaagcagcctttggaaaaaaaaaaaaacccaacattttttattatcaagaaatgccccttgtagatagatcctcccaccccatcactgaccgtaccagaatggtgcagagaatacttggtaataaagtgtttttacacatagatggtgccactcaaaatagcctgcctcaactgaattagttttcaacacctgggtaagtaagtgaaccagcagccagaacacccatgccaagagtgcccccaataagtccttgagaaaaaaaacagatactgacctggagaagctgaatcgtaggttcattaggaggctaagatgacagacaggtcatcatgcctccctaaaataaaaccaggagcaagaaaacagtctcagaggcaatatgacgtttatgaacgaggctggaattagaagtgaagaccaccaaagtttgaatcctggcttacttttcatcttgggaaagttagccaacttttctgtgcctcaaagtcttcaactggaaaactcctctagcacctatacttcataaggattgtatgtgaggtattatgtgtgaagtactgagtgtatgcctcatacagtaaatattcaatgaactattgtttttaaataccctgaaacacagcgcagttgggtagataaggagatgacacaattcaaatacataggaaacaaaagaagctctgtgccaggacaatgtaacaatcaatggagtttcatcagtttgctagcctgagaaagttcaaaagggaatagactgattttacctctgtaatctcctgaacccatagcagctgggcctggtcacagtagggactcaatgaacaacagatggaatgaactcctttcttaattattgaatctagggactggaaaggggttgtttcggggataatggggagagggaagagcatactgaaaatgactttttttttttttgatggagtctcactctgtcacccaggatggagtgccgtggctgatctcggctcactgcaacctctgcctcccaggttcaaatgattctactgcctcagccccggagaagctgggactacaggcatgtgccaccactcatagctactttttttgtattttagtagagatggggttttgccaggttggccaggctggtcttgaactcctgacctcaagtgtcccccaacctcggcctcccaaagtgctgggactacaggtgtgagccaccatgcccagcatgtttcaataggaagtctgagaaagctagagggcctaagcacaagagagaggggagcaaatttccaggaagaagatggtgcaggcaaagagaaattacacctattttgaatctgcttcatttcaatacttctcctttccctcctagaacccacacagtagtcaaagaatggtgtgacaagtcctggccttctttttttttttttttttttctggagaccaagtttcactcttgttcccaggctggagtgcaatggtgcaatttcggctcactgcaacctccgccttcctgggttaagcgattctcccacctcagcctccccagtagctggtattacaggcgcccgccaccacatcagctaattctggccttgctatctacccgcactagagtctgtaggggatgggggaggaggatacagtgagctgtccctgaatatcacctgtgggcttgggcaggaccccgactttatgcaggacagaagggccactgccacatattaagctccatttttccagcagctgaccctgcttctgccatggtctgaaggaagaatgaggcaaaaaggagcacttaccaggttttactgtgcagacttgcgacctcgcttggcaggggaccgttcctcttcagaagtgataagttttctttgcctgagagaactcccatggaggcacgaggactttctgtgatctttcgggtaggggtgtgctgctgctactggaggcagtaggggtggctggggagctgacgttactgcgccgtttcgcttcccttccaccaaattgtctatggcaggataagccaaacaggttggtcaaactcttggtatgaggccctgaactccaagaaactgggcagaccctgattcagacaccacagtgtccttcccccacttcccatgaggccaagaagcttctttttaaggccatattttttatctatctttgccatgactgaaatgtgtttagtcccctatagaactgaggaggccagaaaaacctaaggactttctgtttggtactaagaaggaaacaggtaaggcagcagctctagaaaatgcagctcatccaccatctgagaagccacacataggaataataaaagttagggaaacattatgacaggtccagaatctcctcccactgtaagcagaacaggagcccaaaagcagctgttcggaagcaaaagtcttacctaagctgatatctgctgcctttgtaagaggtgttactgcttataggggccaagcccatactgctctctcagtctgtttccttgctccaaggacaggatgaagccattcgcttataccactttctttggccttctttttcaatgctgtagtacagttcccagactccttcctatgtcctttcaccactcctggggggtggaaagcataaaagaagcttgtgttgtcttaggctccttagcaccctctcacaagggctctgtaaagcaggcctgagttaggaatttagagatccaacagtggactgaagttaggacttaacaaaattccagttgtcaacccaaacagtaacacttaggatatatgtagctactacactgggattaggacaaggaaagttcttgacagaaggtagcctttagttataaaataaagcttcccaaagacagccattgtgattgctggtggttcaaatgatttccgtgaagtgaaatggcatgtggtttcctaacaattcattataacttctaaacatttccttcttggttccctgggaggctgagtagtaagtcttggttaagctgtaggtgaaaaatgacatcattctaagagagacagcatgtgtgtgttttcttctgtgtgtgtagcaaaattagagagcaaagaaaggaaaaaacagatcctgcctctcctcctaatcttcctctctattatctactttcctgctctgattcaaaacctgataaggccttatgttaaaaggaacaaaatgtgggatgtaaaaggaaactaagctataattcaggagaacgagcctaggcctaattctgctgccaccaagctgtgtgatcttgggcaggacccattactagcctgtgaaaaagaacacttcttcctatcaatgaataaacaatttacaacacacacactactatagctatagatacacacccccccacccccacacacatatacaatacaaaaacaagcattactatgaatattttttcattcctataaacagaagggtccaatttcttctcacccttagcctatgcttgaatgaagagctaaaagaaacccagagcctaccccacccaaggaaataacacagagaaagcaagccttggttctctatctatcctgtggaatcactcccttttccttacttgttcatctcctagcttaaatctctatccccaaactaagtcacaaagactccctaaaaacacaaagaagcccaaggccaacaatatacttcacactaatgaagagctactagactagaagtagtctagtgttgacatgagcaaacagcctcaagaaatgggacacagaatcccacaccttgatgccacagttcactcttgttacagaactccgtctttaaaaggccaaatagaacccctaagagtagctttacacctgaaagaagaacgaatgcatttgatacatacaaatatgagtcacaataaaagaccccaatccatgtgctactcccaactgatcccatatatagtaacaatgttatccagaactagaaggtgaagtggcccatttaataatgaacaaagggcaacaacaattactcagaggattccaaatacaagagaagcctggatggactccaacagaaaccatttttccagccgggagcagtggctcactactgtaatcccagcactttgggaggctgggcgggtggatggcttgaggtcaggaattcaagaccagcctgaccaagatggcaaagcctgtctctactaaaaatacaaagattaaccaggtgttgtggcatgcacctgtaatcccagtacttgggaggctgaggcaagagaatcacttgaacaccagaggcggaggttgcagtgagcaagatcgtgccattgcactccagcctgggcgacagagcaaggctctgtttttaaaaaaaaaaaaaaaaaaaaaaaatccattttttggctgggcatggtggctcacgtctgtaatccagcactttgggaggctgaggcaggcagataagttgaggttgggagttcgagaccagcctgccaatgtggcgaaaccccatctctacgaaaaacacaaaaaaaaattagccaggtgtggggtgcgtgcctgtaaacccagctactcgggaggctgaggcacgagaaacacttgaacccggaggcagaggttgcagtgagccaagatcacgccactcactgcactccagcctaggaggagagtgaaactgtgtctcaaaaaaaaaaaaaaagatagaaagaaagccattttcccccatatatgccaatccatgttcaaaaagtcctcagaaagatgtttttaaatgacaaactcaaacaaataggtatcttcaaattatttccatagaaaggagacaatatattcaaagaactagacatgaaacaataacaacaagcataaccacaagcataaacctctcactatcaccaatatacctacttcaaaaataaaaaggcactgttcttcaaaccagagaataagtggtagatgtgagtcatacagacacagcactaaaaacttctccctaagcaaaaatatctcaatatcacctctgggttccaatcaaagcaggtagctaagctttaaaaaagaagagagtatggaaagggaaaacactaactttagagaaggccacctgtccctctcttgcagtggctcacgcctgcaaaccagcattttgggaggccaaggcaggtagatcacctgagctcaggagtttgagaccagctggccaatatggcgaaatgccatccccactaaaaatacaaaaattagccgggtctggtgggcacacctgtaatcctagctactcaggagactgaggcaggagactcacttgtacccggagctagaggttgcagtgagcctagattgcgccactgcactctagcctgggaaacagagtagtgagactgtttcaaaaaaaagtgaagaaatctggcaaatacaaccttaaccagtgataagattaacatcctgcatcagtgatgtcatgtggatacatcacaaaccttcccaggtcctatatgataacatgagaagggcatttcacctctgtggcatatttttttttaagagacaggtctcactgtttcccaggctggagtgcagtgtcatgatcatagctcactgtggactcaactcctgagcttaagcaatccgcctgcctcatcctcctgagtagctacgacaacaagcattgcccccatgcccagctaatttatgttccttttttttttttttttttttttttttttgaagacagggtctcactatgtttcagcctggtctcaaactcctgacctcaagtgatcccccgctttggcctcccaaagtgctggaattacaggcatgagctaccacacccacccatctattggcattatttttaaaatatcccataactccagtctaatgagaaaatattagacaaatcaaatggagggacattccacaaaatacctgaccaggactccccaaaactgtcaaggtcataaaaacaaaagactgagaaattgccacaaatcagagcagaccaaagggtatgtgatgacaaatgcaatgttggatgctggaagagaaaaaggacatgatggaaaagctagtgaaatccaataaagtctaaagttttgtgaatagtaatacaccaaggttggatttttagttttgacaacgtcccatactaacaccagatgtcaacaatagggaaagctggatgaggggtatacaggactctctgtactagcagtactttgtacttcgcaaattttctgtaaatcatctaaaatatccaaaataagtttattcaaaaacaaatgaacaaacagaaaagtcagtggcaagagtaacaattttgtaggaatgaaatttctgactttagagacactggaaaagtaccaagtaatgtctggtaactactaacataacagagtattattgccccaaggcacaaaaaaatctctacaaatctgcttctttcattacctgcactgaaatactcatcctccgagagggccgtcacttcaggtccagcgggatggggtcacataacagaatgtctttgcccaacacatcacattcgtaccatcatcaaagagcaatttatacttcccagctccgacatctcgtgtgattttcccagagtaaagtagccattggatgaccacttggctacaacacggagccctacaaagctatttcctgagaggaggcatctaagccatcagaagggccagcagcagcctggaaaggaatttctggaggtcactacgacgcaaagcaccagcacccacatctgttcgtctggtggagtctggcactcgggcacgacacggctgaaggatttatcatctggtgacaagttaggtgaaatgtcctctagcccaaggggccaggcacagctgtttctctaaagagagataggggataggagaagccgggagaacaagaacacagaagtatatatctaccaatttttccactcctttgtccatgggtccctcagcccattctttaaaaaccccatcacaggcatgagcctggtctctctgtggcctcctctgatccctgcccactccccagtcagtatggcccctcttctccctcctgacaccccaaaactctctactcccctctcctccattcccttgttttctgaacaacagactaagtatatttacactacccaggtacctggttccagtggtccgagaaggtgggcggccccttcgcccagcccacgaggcgtgactggagccttccctccctgtctgatgccaaggcctgcatcaccacctcctcacacactggcgtccctgtctgactgaccccttttctaggactagagaatgaaacaagttagtctgatagcacctgctactgaatcttttcttcacaaagtctccccttggcctcagactacatgacaggcctacatgtgctgagcctttggggcagcaggaagctggttccacacccaccaccaaaatctcatgcagggagtggggagcgtgggataacaagtaaaggaattctccttcatgtaagtctattccctctgacaaagcttcctactgctgctgcaaaaacgcacacccaatttctgctatgccttctcctctactttaggctctggacacctgcaaagataacaaaaagctaggagatgcattaagtttgggctactatcccaaacttcctgtactccaactaaatcatataaaggctgtggtagaagcagtgcccaccagatgataaattcccgaagtcccctcccctgttacctacattttctcaggggctgctttgccaatgaagtctacctgcacagggctccaccctacttcccacacaaacccaaaacaggaagagagcaaatagtgaaaggggtagttgatttatctttaatggaggatgggggatttcccattactccccttttccgtgatattaaaatgtcagcaaccctgcccctgctgtggctctctctctctggagacccttctgcacctcagttttcctgggcctcctcgggagctgggtaaggcaaaatctgcgggtttgtcccgctggttttccctctgagtggtccggctcctttccctgagcttccactgctgtcatagctgagagacttgtcccacttgatgtgcggtgtaagctggatgccttggaggagaggagctgatatcccccaggtcacctgaggagcccccagtctgtgaaggggaaacttcagttcacactcctgacactctacaattggctcttcagtctcctgcaaggaaaaaatagataagaagataaaagatgccataataacacaatgctaatatgatggttggaaaatcctacagtggcacaaaattataattcaaaaaggtgagaatcaggagactttctggaataatgggaagttctgtatctgttttgagtagtggttagataaaattttcaaaagccactgaactgaactttaggatctgttcttttttttttctcccccaggtgattctgagaagaattgttcattcaatgggactatactgtatctcaataaaatataaaataaacatggtactatattggtaagaagagtttatctttttattggataagttcacaacctctggctaccagcaaagattctaactagacgacagaagtaaattcttatctgagagaagacagggaaggaggtaggcaggtgaaggagaaaatgagtggtcaggagcccttctaggtacttcattaacagtggacagcattaatgttttgacattggttattttacattacctttcaataactgatcaaggcaatagaaaatatatgcaaaaataggctaaaaggggtcaggtgtggtggctcacgcctgtaatcccagcctttgggaggccaaggcagaaggactgcttgagtccaggagcttgagaccaccttaggcacatagtgagaacaggtctccatatgaaaataaaactattagccaggcgtgggagtgcaacctgtagtcccagctacttgggaggctgaggtgggaggatcacttgagcttggaagtcaggctgcagtgagccgggatcatgccactgtactccagcctaggtgatagcatgagacctgtctcaacaacaacaacaacaaaaaaggctaaaatagtattaccatttggaaaaatgaggacaaaaaggttataagtatctatagactacaagaaagtcaaactggctttatctcggtgcctactttgataaattggtagtagctgcctggtgctcagttttaagaagccttctggggctaaatcccagacttagtgggaaaagattctaagaccaatcagcaatgttcgctatggcacagcatagagaaattatagcatgagtatgacacatctgccttcctagtctagaatgtcacgcaatattatgttaattgccagagaggatatggagatgtataagatagatccttcctcaaagagtttagaattccttttgggaggccaggcatggtggctcacgcctgtaatccagcactttgggaggcagaggcaggtggatcacttgaggtcaggagttcaagaccagtctgccatcatggtgaaaccccgtctctactaacacaaaaaaaatagccgggcatggtggtgactcctgtactcccaggtactcgaaaagctgaggcagaagaatcacatgtgaacctggggatggagctgcagtgagctaagattgtgccactgcactccagcctggacaacagagtgaactccacctcaaaaaaaaaaaaaaatccccatggggagactgtatataatgacacacatcatatacatttagataatactataaaatgatgaaataattatctctgatccctcccttctgaaaatctctcctcctttaaaatccataaaagtacttttctctttctttcagtctaccttttggctacttctatttatgcttctttgggttcctctttctctgtgtgttcctttaaatcggtatttcccaggactctgtttttattccttttctcactctcacatgctttccctggcagtctcaccacactcatccttacctcgctaccaagaatacaatgatgactcagcttatcaaatttctactagtcttccccttggatttaccacaaacacctgaaattcaacagatccaaacaatctgtgatcttccctccatttctctgccttcaatgaataaatcctagatatcccagtgcatctcacatctcctacagctctttctagcagagactggtttctttcagccgaactccattcaagaattttgagatgagatacctccttgctccccactgccatttacagacctttctatttccccacctcctctccttcaaaaccactatttgccactttcttaaaactatttcaccccttccctagttgttatccactaacattctccaaatcaccctctctcatgcataagaccttagcttcataacctctctaccttccccattcctacttctgtcatcattctcatggcctattttaactagatacacttgtgttttcacatctgcaaaatgagaataataactgatctatcacagaatagttgttaagaattaaataattcactaaagtgcttagaataatgctggcacatagtatgtgctcaataaacgctagtcactatcattatttaagtttagtagtcttcccaaactatcttccatagggaaaaaacaggtattactttaaaaaatgctaatggtatgtaagtttgggaagtgctgggttaaacagaataaaataggtatccttactagaggactcttagaacttttaatatggtaatatgtgaattttcatgttagtggggacagggattaaggcgtgctatggtttgaacgtctgcccctccaaaacacatgttgaaatttaatacccaagtaacagtaccaagaagtaagacctttaagaggtgattgagtcataagggctctgccctatgaatggattagttcattcatggattaacggaattacgagctaacagattaatgagtttcacaggagtgggttagttatcaccagagtgggtctgttataaaaactaatttggttctttttgtaaggcccctggcaatgtgataccctgtgttgcctcgggactcttcagagtccctccagcaagaaggccctcaccagatgtagccccttgaccttggacttcccagcctcctaactaagaaataaatttcttttatttataaattatccagtctcaggtgtttaaatatagcacagaaaacagactaagagagcgtttcatgtttctcaggaccatggaaccttttccctcatcaaactgtctaagaggcctgctgtttccagaaatatactttagaaagcaccatataaatactaaatgggcctagcagcacagtagctcatgcctgtaatcccattgccttgggaggcaaggcaggaagatcacttgagaacagagttcaagaccagtctgggcaacacagtgaaacccatctctacaaaagatacaaaaattagcagatgtggtagcgtgtgcctatggtcccactactcagaaggctgaggtgggaggctcccttgagccaggaggtcaaggctgcagtgagtgtgatcataccactgcactccagcctgggcaaaagagcgagaccctgtctccaaacataaaataaaaaatatattttaagaaatgaagtaatgtgtttaacacttaatgtagtgtacaggcacagagtttaatgtggactacaacagttacaaaaattttcatgaaggcaaactgctttcataatttctccaaaatagtaataacatgaaaaaagttccacgaacaaaaatcttttaaaacatttttaatcgggaggctgaggcaggcggatcacgaggtcaggagatcgagacatcctggctaacacggtgaaaccctgtctctactaaaaatacaaaaaattagccgggcgggtggcgggcacctgtagtcccagctacttgggaggctgaggcaggagaatggcgtgaaccaggaggcggagcttgcagtgagccgaggtagcgccactgcaccccagcctgggccaagagcgagactccgtctcaaaaaaaaaaaaacaaaaaatatttttaaaatgaagataaagagtattttaaaagaattatttctggtatttggtatacacaaagaataaaaaacaggccggcgcagtggctcacgcctgtaatcccagcactttgggaggccaaggcagatcacttgagtcaggagtttgagaccagcctggccaacatggtgaaatcccatctctactacaaacacaaaattagctgggcatggtggcacacacctataatcccagctactcaggaggctgaggcagagaatcgcttgaacccaggagacagaggctccagaaggccaagatcaggccactgcacccaacctgggcaacagagtgagactctgtgtcaaaaaaaaaaaaaaaaaaaaaggaataaaaacaattactcaatgagtgtctgtaaaaccaatgaaatctgaataatctgtggatagaaaacaaacaacaattcctcaaactaacatcaaatgttatctgacatgagggccacaatgcccactgaaaaatagtaataatatgttctatttaataaaactatacactagagtttaatctccctgagtacaacctcctacacggccagcagatagaattaaaggaaagtatctgggaaaggaagaaaacagttgtgccttgccgggcgcggtggctcacacctccaatcccagcatttgggaggccgaggcctgagcacaaggtcaggagttcaagaccagcctggccaagatgtgaaaccccgtctctactagaaatacaaaaaaaaaaaaaaattagccaggcacggtggcggtgcctgcaatcccagcgacttgggaggccgagccaggaaaatcacttgaaccaggaagcggaggttgcagtgagctgagattgcaccactgcactctagcctgggcaacagagcaaactctgcctcaaaaaaaaaaaaaaaaaaagaaaatagctgtgcctcttaccaaccaataaatggttcccagatcttaacatataccaacaaaggtcccagatctttaattctagaaaactgtctaatctctctcattattagatgtaaacaaagtcagcatagtatgccattcaagaaacaaacagtcactaaatgccaatactgagctgacatttgtaatgagtctataatgaatccactaaaaaataaaggtgcatttcttaccaacaggtctatgaccacacacagatagtgcaaataaagaacagaatgagtagacatgaaaatatgtgagaaaacacaggtagtttgaacggagtgttctaaactccatttgagtttctaaggatttaaaataatacatacaatcttttacatgagagagatttatcagtctgttctttacagaaaaggaaagcatgatgggatgcataaataactaaccaatggtcaaacagcaaacctatggctggggaaagctttagaaagcagaagtctaacttctaaccctgttcttctatctctggtaataaaaagatgaagaaaaacaagtgttgcacaggaaagcgggatggggtagaaagtcaagagaatttttctatagaaagaatgtggggtcagggacaatagctcatgcctgtaatcccagcactttgggaggccaaagcgaaggatcacttaagcctaggagttcaagatcagcctgggcaacacagtgggaccttgtcatccaaaaaataaacaaaattagccaggcttggtggttcatgcctgtagaaccaactgaagggaggctgaggcagaaggatcacttgagcctgggaggcagaggctgcagtgaaacaaatcacgcaactgcattccagcctaggtaacaaagtaagaccctgtctccaaaaaaaaaaaaaaagaaagaaagaaatttgccacacagactcagagtatgtattacctcagttactttctttctacttctgttccatccacataatacacatctgtaatgacacgagtgacaagtggcgtacttcccggattgttctcatgtgacgatgtaagacatggccatgtggaggctgagcatatcaaactcttcttctccctgtgacagaaaatacagaacataagcacaggtctcacgcaagctgtcaaaatcacaaatcttatgcttcatgatgagaactgtttagaggctccataatctagtgtgacagaatcttcctactgttttgttttatccacctataggtaagaccaggatggatgagttatatagccagaggctaagagaagtttatatgagcatgacctaataaatgacctattcttgtctaaatcaaaatcattacatctagtacttgtatttacggacatttggtgaacctttgacccctaaaagttcattatttttaaaccgtatttcttctaattctgagctatcttgcaaattagtaaacgagtttacatttgcaatagctctttagataaaaggaagcactctttagtcctttatataaaaccagaatgatgtatctgttaatctcagtttatcttttttcctgtattaaagtgaaaaccacagtttattacctaaaacaatatacactgatcttcctagaattaaatataaaatatttcatctattccaaagaacagattatgactaaagagtgagctagtgtccagaaatggaaaaattagcaaattaagattttatatctagttctactcaagaataatgtagggctaaataagaccctactttttatgataactattaaataatattcttaggaggattgagcttctttcattcaaaaaacattaagcaaatatttatcgaataactaagggtgccaggtactatactagacaaataactgctggaaaattcaggacaggtaaaatcattcaacactgaaaaaattcaaatgcactatttcttatttacaaaaatacaacaaacaataacaactactgctattcaaaagaataactgagttaactaacatagcatccagcttcttatttcttgttcataattttctatttacagacagcccgagttcatattttagtcagattgaataatttttaaaagataacttcttagcaaattaggtcttaaagccctatttaccactcgaatcattagttagtttgagactttcggcctttattacctaggacctgcctgtggctaaaaaaagtgctagaatttcagtcctgcatttctgaaaaaatacatgttttctaataacactatatcacattttttcacatctttatcctccctcctacaccccactaactccgtaatctgaagagaaaatgcacacttttgtctctcaccttatctcccctatggtaggctgatttactttcagcattcagtatcaaagtagccaagtctttaaaaagaattacatatacaaatgaataatggtaattctgcatttttttcctgacatgtggtagtaatttaccaaaagctttcgtaatttctccgaataatccccactccaattccaacttggaaactggcagaggtgaaattttactaaaatggagatatgtaaattatgtgactagttataaataatatcaaaggcatgaacgctactcatccaattatttaaaatacttctacatacttctacacagacacaactcttctaatgaatggttaaagcacaggtctgtcctacctcaatcatcagggtacccatgcatagaactatgacagcctgtacttcctgcctgcacacacaatcagactattccccactaaaagaaagtcagtctaaaaggtttcagtgctttacatattcctgaaatgcagccaagaagctccctgtattcttccagttacaacagccatatgaatgatcacttcaagacagacacttagcgtgtctgagagaataaggagaaaaggtaaagagggcagacagaaaactatgtttactacttcaaatactcttctgaaaagaggtgtctgtaaaataaataaattgatgatcttaccccattaagggaaggaaacaaaatgaaaataaaaccacactttcccttccacctggttcccgtcctttttgacatataaatgaaaatttcaggagtgtcaaagtaggctgcctatgctttccactagcactagcctatgtcctatctacactgaaggggatttttaaaaagcaccgaccctggaaaacttgcatacagcctttctcatttgctaacctctcttcaaaagatggcacacaatttcaatttctgttattctatacaccatctatatatttttactatggtaaaatctgataacataaaatatatcattgtcttgaacacaatgctcatatcccatatgtgccacagggttcaataaataagaactgtattttatttttacaaaacaaacaacttggacaatcaaaagagaggtatatcaataatgaagatttcctaagtagatcccaaatgaagataatctaccaagcaactgaaaaagcaatttgaccactacaatatctcctttatctgagggagatatgtgcaagacccccagtggatgcctgaaactgcagataatatcaaaccctatacactatgtttttcctatacatacagacctataatgtttataaatcaggcacagaaagattaataactaaaataagataaactataacaatatactgttcacaatttcatggatagatttgttcttacccagattttagtaacttcagcatatgattttttttctttccttattaagaccttttacctttcacttagaggaagcactttatgacttacttctctggcatattcagattgccggcatcctactctcaaactttggggtgagagtaaaacaagggttacttgaatgcaagcaatgcaaaccatgagagttgatctgataaccaagacagctactaagtcattaacaggcagggagcaatatagcatatggatatgctagaaaaagggaggattcatatcctagccaggactaagaggacagcactttatcacattactcagaacagcacagtatttaaaccttagtatttctagattttccatttagtatttctggactgcagctgaccatgggcaactaaaaccaccaagaaaagaaaccactgataagcagagactactgtttactagtaacttccaaattttctctgccaagatcccactctgccactcaatgaaatgttgtgaacttctacgtatttgttaacacataatttctacgacttcttttcatctactcaattttttttttaagagacaaggtctcactatttgcccagtctagtctcaaactcctgggctcaagtaatcctcccacctgagcctccaaagcgctgggatttcaggcatgtgccaccaggcacagccacctacttaatttttactagtacgacacttccctactctattccctggaacctgatactcctccagcctcgttttcatcagcccaatccttttcttcacattagcttctagtctagcctctcttctgcagttcttggtcactggggacttttccccatctctctctctattcctgttaccattctttctgtttcatatatgaaatacactattcttcgtgctgcttctttcccccttaccttctactctctgaattccgagaaccatgatgaaatagacttaagggagagaaaattagatctgatggttagaaggcagataaaaagtatggagaaggaaaagagtgaatgtagaagagtattacaggacccaggcaaatctctggctttcttctccagtaaagacctacctaaaaaactgtagcaatactacatttccctaaaagactatctaatggctatagctacccacaatttcactaccatatctgtatctagaaaagttgtttttgtcttttaaccactgttctgtacaaaactgtcaagaattgtcataggcagacatgccacaacttaaattctctgagaatcctgaaagttaaaaacaaggccttgatgcaccctagtatgttctctcacctggctatggagcgactctgtatcatccccagggcactgactggtttctcaccactccccctctcagtctgaactgtggcatcttgctttccaagttctggtccactgtactggtcccctgctcacacacattctttatagtctgggttgcgctgaaacagtttctgggaccctcaaggaacactccatggtttggattcctatgttatttggctgggcctttcaatcaaggccttactaggattttccttattagtactccgtccttcttctggtcttctagcacatctgtcaccattgcctctccttgaggactggatggcccttgatgaccatcttctgggaagcaggagaaacagggtccttgacaggactaatgggcttcatggctgttgactctgcctgattgtatggtcaccctccaatttttctttctcctcttctcctgagaacttggaaagtggagcaagttccccctgaaaatgcaacatataaagaagccatgcaattaagcaagtgtatgtgtgaacgtgtgtgtgtgcgtgtgcatgtgtgtgtgtagtgcaaggggggagccatattttgacaatttgagaaatgtaaggaagggagaaagtcaggtatcaagcattatcaccttgggaggcctctcattataatttcactcctgtaaaaaaaataaggtagatagaacaattccaccatgatgataaaagagtcataaaatttcttcccatcactgctatgaactctgaaacttgatgcaggaaaatgaagtaaacaaaaagatgtaaacccatactgaagtcatagacaatgaagggcaacttagggatctattttgaaaaaagatcaattagtcaagatgtcttatctggccttatgatggttctaacattccttaactgattcctagcatctagatactgtttatccccacctgagcaatatttttaggaaagaaaatctgacttacaaggataaagctgtaggtagattctagttttgtcagctatactgatatatctacaactaacatttcagaatgaattggtttctcaaagacagttcttaagatacagcccattttttttctaagtcatcccatttgggtatcagtgattcgttcctttattccacaagcatttgctgaagtctcctacaaaccacataccacgatttccgaagtgactaggagctttcttaaatatcctaacaattctccagaataaaaacgtccaggctaactccaagtcaacagaaatttgacatcatgtcttatctatctttatatttaaaacacctaactcacagcttaatataaaatagatcttaatacatgtactttgaacagaagactgaatgttctctgaatcaattaattgcaaaactactcagattaaatcaacataatgcagttttaggctccattacacgcacaatagccagataaaaataaaaggaatccattctgaactgaccatgctaagaccacatctggaatatcttttcagttctcggcatgacagtttacaaggcataaactgtagataaactcagaaggtaaatgaaggacgataaggggcctagaaactatgtcatatgttgatttaagtatgtggccagaaaagagttagggctgtctcctatttgacagaagctcttatccttaggatctcagctttctacgtagacagggtaaaggaagcaggaagtgctcttcagggattgctctgctctagatttgaaggaaaaggaaaaaagaagtttctgaggtttctatattgtttagctcagcctaccgaacaggagctcaaagagggatttcaaatagagttctagccaagaagagcttagtataatttggttgttatagtgtgtgtcctatctctcaggaacctcaactgaatgagaatatatgtccaatgaagaagaagtaagaacaagaccaccaggagacacctaccatgagtagcacttcctcttatgaggtttataaatgttcatatatgtaaaatattgagcatagcagatgctcatcaatattagatgcataagacaatgcaattaaacagactcagttcaccttcaatatcaataaatattcatatttaaatctttaagacatctaacataccaatggctgagcaagaaggaaggattcaaaagccagaagagccaggactcgattttaggaattcaattattgttgtttctatcctaaacaagcttataaattttatctcatgctacagactaaatgtctatgtcccctcaccccaagacttacattaaatcctaaccaccaaggtgatggtattaagaggcagagcctcatgaatagggttagtgcccttataaaagagacctcagagagctctcttgcccccaacgccatgtgagaacagctgtctacaaaccaggaagcaggccctcaccagacaccaaatctccagtgctttgatctagaacttctcagcctccagaaatgagagaaataaattcttttgttataagctatctagcctatggcagtttgttgcagcagcccaaagagactaagacacctcgaagctgtttattcaggttagaatacctgaattgaattttacttctacagcaatccaataattgtaagaagtgccatacctctctccctctccattagttccagctatgcaattctacctggtcactatatgccagacttagaaactgatgctaagaaagtaaattttaggctgggccagtggctcacaccagtaatcccagcactttgggaagccaagacgggtggatcacctgagtgaggagttcgagacctgcctggccaacacggcaaaaccccgtctctactaaaaatacaaaaaaatagccatgtgtggtggcatacacctgtagtcccagctacttgggaggctgagcaggagaatccctcgaacctgggaggtggaggttgcagtgagccaagatcgccctactgacttccagcctgggtgacacacagaccaagaccccatctcaaaaaaaaaaaaaaaaaaaaaaaatccaaattgaaatagggaagaatacatctccatatttaacaaatgtctaactatctattctgagtgtagctctgtttatgaggcatctagaatcaaatccagctagattcccaatctttgctccaccaaggttaaacaatataaccaacatcttggcacctctattttaaaagctttaataaaaaagcaaggcaatacaatgacatcaataaatttagtaatagctgggtcttactacaccactgttaaaatcacatgatttcaggatcatctgattcccaagaatatcacaagctcacacttattcagaatgcccatttaatgcactgacatatttattttaaatattctttcaataatgagcatagaaatttagaaattatgctacctattaatttttttttttttatggataagacataactctcactctctcgccaggctgtagtgcagtggcaccatcttggtcactgcaacctcctcctccagggttcaagtgattctcatgccttagcctccagagtagtgagactacaagcgtggacgaccctgcctggctaatttttgtatttttagtagagacaggttttaccatgttggccaggctggtcactaactcctggcctcaagtggtcacccctcctagcctctcaaagtgctgggattacaggtgtgagccaccccatccagtcttttttttttttttagacagagtctggctttgtcgcccaggctggagtacagtggcacaatctcggctcatataacctccacctcctgggctcgagccattctcccacctcagcatcccaagtagctggactacagggatgcaccaccacacctggctaattttgtactttttgtagagacgaagtttaccatgatgcccaggctggtctccaactccagagctcaggccatccacccacctcggtcaccaaagtgccaccgcgcctggctaaatcatgctacttatatcactgttactgatatactactgacaaaacattatcacattgtctaattacgaaatcactgaattttagaggtgaaaatactcacttcataatgaaaatacaggtccttttccactgccattacttatttctctacctaaatataagtatcatatattccatataagatactatttatttatttatttattattatttttaagacatggtctcactctgttccccaggctaaagtgcagtggcgagaccacagcccctgcagcctcgaccacccaggttcaaccaatcatcccacttcagtcttccaagtagcgggaccacaagcgcatgccaccacatccggcttttttttttttcttttttttcttggtaaaatagggtctcactatgtcacccaggctcatctcaaactcctggcctcaagtaatcctatgctttggcctccaagtgctgggattacaggcgtgagccaccgtggccagccgcttcctaattatttaaatagagataaaggcctgtaactcaaaacttttttcctgcctcacgactttctaagagattatggagtaaagaaattatggggctaagcacagttgctcatatctgtattctagcacgttgggaagatgaggcaggaggatcacttgagcccaggcgtctgagaccacctgggcaacacagttgaaaaaaaagttgaaaaaaaaaaaaattagccagacacggcagacatgcctgtagtcctagccactcagggggttcaggcaggaggattgcttgagcctaggatttggggctgccgtgagctattactgcaccactgcacctcagcctgggtgacagagtggaccctgtctctaaaaagaaaaagaaattatggaaaaattaattccattaagtctgaaaactttaaatttgggatgttaaacatctcatattttgctctgtgggaaactaaggagaaaaaaaagtctgttaaaagtaaacatgattcccaaaataagaaaaactaatctaagaaatgggaattatataaattattttcaccgtagggcacggtggctcacacttgtattcctaacattctggacgccaaggtgggaggactgcttgatcccaagagtttgaaaccagactggacacacagtgagaagccatctctacaaagaatagaaaaattagccggtatggtggcgcatgctgtggtcctagctacttgggaggctgaagcccaagaggtaaaggcttcagtgagccatgtcacgccacttcactccagcctgggtgacagagtgagaccctatctcaaaataaattaaaaatacatttatgaagtcagtcatttcaaattgatacaactggcagataaagacaaaaagtgtatctataaaatatttaacaaaatttctcatgacagctcatcaatctatccagaatcactatagtccctcaaggtataaaaaaataaggtaagctcaagctcacaaaacagtagcgtacatcttagtctgttttctgctgctataacagaattcccaccagactgggaaattgaaaagaaaaagatttacaggatttggctcatggttctgaatgctgaaatgtccaaggacaggcactagcatctagacggccagctggtaagggccttctagctgcatcgtaacacggtgaaagacatcacatggtgagggtgcattcaagaaggtggaaagggggccaaactgcccctcagccttttataattaacccatgctcacggcaacagccttaatgcatacatatgggcaggcccccacgacctaattacctcttttttgtgtatgtgtggtcaacttctgtagctttatccaataccactaattacctctcaacactgttgcactgggggttaagtttccaacacatgcacattcaaaccacagcacagtacatattaggatttgggcactaaccattttgtgaaccatggagcccaaaagattctataaaaataatgcttacctgatgggtgtggtggggggatctcacttcgagcctcattctcttgcctggcttcacagatacagctcaacacagacatggtttctggggactaagacaatatattaaagcaatatattgttaactttgaaaagaaaagtattttggagattatccttttatgcacagaggaaataaaatgctttctctgcatatcaaacccaaaccaccttacaccaaaatgcaaattctccatacttgttttgaattagcataatttaaattctcaaggaagattcactggaaataaggtggacagaggactgtattaaataccataagatgcgatcagcaaaatccagaatgtagaaaaccatacaacaatctgtaccttcaacaataatttgcaagcaagaggcaaaaaaaaaaaaaaaaaaaaaaaaaaaagactggagggtactctgtattttaaaagacttaaagagatataatcaaatgcaatatgcagaccttattagatcttgagtcaaactgtaaaacaccatttatgagacaatcagagaaatctgaacattaatatttcatgatattaaggaaccattgtcaattttttaaagtatgataatagtaatacgttaagtttaaaataagaatccttatcttttggagacagcactgaagtatttcagataaattatataatgctgaaattatcttcaaaataattcagtagggaggggggtgctggaaattaaatgaatcaagactggccataagaaatttttggaactgggtgatgaatacatggcagccattatactactctctctactttcgtatatgcttgaaaccttctgtagtaaaatgattagaaataaggtgacagcaagtaatttgaacagagtacagttacaaacaacacttaaaagttcatgtacgctgggcacggtggcttatacctgtaatcctaccactttgggaggccaagcaggtggatcacttgagcttcaggagttagagactagcctgggcaacatgacgaaacccatctctactaaaaacacaaaaattagcccctggtggcaggtgcctgtagtcccagcacctgtggggttgaggcaggaggatcgcttgagcctgggaggtcaaggctgcagtgaactgtattgcaccactgcactgcagcctggttgacaaagtgagaccctgtctcaaacaaacaaaaaaaaatctccacctaaatgcagatgaaccaaggaccacttccaatattgtgacagagctactttagatgatttgttagagtgaacacaatagcaaacaagtcgaatttttttaaattagattcttatatagaaaaatttattcacaacaatatcaaaaatttcatctcattctaggtccaccattccaaccctctgctcaaagtttttccttattttctcctctctactttctacctaagagttctagaagcttcagcaacatactctgttccctctgaatatgcacaagtacaactaataacaacttattcctggccaaaaattctgttaaagccaaatggaccagatacacctccactttcttcagcttctaagactatatatcattaagggatcttcaaatgaaaaaggctctacggtacttatgtttcagattaaatatactaatagcccaatgaggaactaatctcctaagacatagctaagaacagatcaaaagactttgaaaaaggtcagaaactcacaagtgggtcacatttagtccacaggcctcttttatttgatattttatttttaaaaatccagattctttctaaaaacaaagatgtggcaacaagaagtttgcagtttcacatgacaactactggtggagttgagtggggcacaccctttcacatggaccatacattcagtttgccattgtcctaacactctgtcttgcgggcggatcacgaggtcaggagatcgagaccatcctggctaacaggtgaaaccccgtctccactaaaaatacaaaaaaaaaattagccaggcgtggtggctggacctgtagtcccagctacttgggaggctgaggcaggagaatggtgtggacccgggaggcgagcttgcagtgagcggagatcgtgccactgcactccagcctggatgacagagtgagacccgtctcaaaaaaaaaaacaaaaaaaaaacactctgtcttgtacctagccactttagttttaacagtacccgcctagcctctaatttaagaattcttggtggggcatggtagctcacactgtaatcctagcactttgggaagtcaaggcaggtggatcacttgagcccaggagttcaggccagcctgggcaacatagtaaaatcctcatctctacaaaaaatacaaaaattagccaatgaggtggtacatgcctgtagccccagctactcaggtggctgaggcaggaggatagctgaggtcaggatgttgaggtcacagtgagccatgatctcaccaccgcactccagcctgggaacagagcaagattctgtctcaaaaaataaaaaagaaaataaaagaagaattcttgccttgtttcaccaactgctattagcgttttcaggctggatgactcatgcctgaaacaattgtttctcacagccaccagatggcaaagcttaccaaccaaaacctcagtatggggtcatactgtcctcaaagcattacaacatccatgacaaagcaaaaataacagctcaacatagtagttatttggcaggcagaagagaaaatgacctgaggctgcagctgagtatgcgattgcagaagaacaaggtctgtagctatctcttgttaatccttctttttctcatcaattggatcaacaacctgagattgtggagactcttgtatcagcaacagaaaaaaggggggaaaggaactctcaatgaacaaaagtaaagacatttcaattatcttagttctaggtgtagaaaaaagcttcacgaacttaaaaaagtattaactaaaaagtctatgatccattcaaaacattgctaaatccttatgaaagagtctcattttaactttctcattttaacttttttcctttgttgataaaccactaccctcatcaccagtagctgtgtattaaactctaaatagcatccagctttggttaccggcaacagactcagcaacagcagtagatccattttttctttcaccagttgcaggctctgataaaaacaaaaccaaggagagaaaggaaagagaaacagaatttagttagtatcacaccaaaccttcactctgctctactagtatttgcaaaaaataacaaaaagaaataaaaataagaaaactagtaagtataaacatacaaacatttcttgtaattttatttatttatttctttatttgagacagtctcactctatcacccaagctggagggcagtagcgtgatctcagctcacgcaacctccgcctcctgggttcaagcgatctcctgcctcaacctcccgagtagctgggatacaggcatgcgccaccacgtccagctaattttttgtattttttaggaaagacagggtttgccaagtttcccaagctggtctcaaactcctgaaatcaagtgatctgccagatttcttttttttgtttgtttgttttgagacaacagtctcgctctgtcacccaggctgcagtgcagccagatttgttttaatttttttttttttttttttttgagacagagtctcactctgtcgccaggctggagtgcagtggcgcaatctcggctcactgcaagctctgcctcccgggttcacccattctcctgcctcagcctccccagcagctgaaactacaggtgcccgccaccacgcccgctaatttttttgtatttttagtcgagacggggtttcaccgtgttagccaggatggtctaatctcctgacctcgtgatccgcccgcctcggtctcccaaagtgctgggattacaggcagagccactgtgcccggctggctatttcttgtaatttaatggtacaagtttttctcacttcaccaatcaattttctttcaaacttcctataaaagactaataagattggcaagaaatacatacaatgagtaactttttttttttttggagacagagtcttactccgttgcccaggctaagtgcagcggcgtaatctcgacttgctgcaacctgtgtctcctgggttcaagcgattctatgcctcaccctcctgagtagctgggattacaggtgtgcaccaccacacccagctaattttgtatttttagtagagatggggtttcaccatgttgaccaggctggtctcaaacttccgcctcaggtgattcacccgcctcaggttcccaaagtgtgctgggattacacatacgagctcgacacctagcccttagcagtaatattctttttttttttttttttttttttttttggagcagaatctcactctgttgctcaggctggagtgcagtggcatgatctcagctcactgcaactccgcctctcgggttcaagagattctgctgccttagcctcccgagtagctgggattacggtacctgccaccatgtccggctaatttttatatttttagtagagatggggtttcaccacttggccaggctggtctcgaactcctgacctcaggtgatccacccacctcagcctcccaagtgctgggattacaggcatgagccaccacacccggccagcagtaacattcttaaatgaaattaaacttctgaatccaaattcatctctgcccatataagaagttaaaaaagtatgtataatacaaaattaaaaaccaaaaactttttaaaatttatatcatattaaaaacaaattaaaataaaagaacttaataaaataagtagaaaatattttaggttgatgaactaattttaatagtttttagagcacccacaaatagaaggtacccaagttcttcccaaagtgctttaggaagacacttcaaaaacaaagggtggccaggcacggtggctcactcatgtaatcccaatacttgagaggccaaggcaggaggatcgcttgagcccaggagttcaacaccagcctggctaaatggcgaagccccatctctataataaatacaaaaattaaccaggcatgggtggtgggcggcctgtagtcccacctactcagggggctaagatgggaggatcgcttgagcctgggagatgaggctgcagtgagctgagatcaccccattgcactccagcctgggtgacagggagaagcctgtctcaacaacaataacaacaaaaagaaacaaaaaggacattttcaagaacatgcagaacagattaaaggtcgtactgaaaaaaatcccatattctcacaacaatgtcactaatttaagggattaaaatttgttcatttacaatttataccagccttagagaaaacaacccttaatggtttttaattatttctaaaatattcatgacccaacataatctaaacagtccatcaggaggcagctgaaattcagttggagccctggctctgaaatagaaacctggctcacaccctgctattgcacttaatagtccaacctaggagtaaactactttgtcattttgagtctcagtgcctcctctataagataaaaacacaacaaacctaaaaagtttgttgtaaggatgaaatgagtaagtaacactgaatacagtccttgatactatgctcctggtattaggaaaggtagtaaatttactgatataaccatccttaacacttcgctagttgtaatttcagatccaaaggtaagtaagatttaaggctatcacatactctctctcttgacaaaccctttttaaaatttttattttgagatgagatgtcactatgttgcccaggctggtcttgtacttctgggtttaagcaccctcccacctcagcctctggcattgctgggattatagaagcgcaccaaccaccatgcctgcaataagcccttatttattccggaaaagatgatagtaaggatggaaccatgtaatacttaactcagtctactgagttgctaagattcaaatcagtaagtaccacagcatcaaagattggaaccagacttcctggatttgtatcccggctactccatttactagctatgtttagggaggcgctcaaccttcctgtgcctcagtttcctcatctgtaaaaggaggataataataggactagttcatcggcttcttatgagatttaatgagctatacatgtgaagtacctggtatacgtaagagctaaaaatgtattagctaaaattacttttctctggtctcagggaagaagaagcctgcttatccaacctattctgtgtagtcttcaatagcttcccctcccaacttcttcaggccttaattcatcaactgtttcccccaattccctcgtctttaatctatgcctccctctttggatccttccttaacccatttatgctggaggttgcaaatttttttttgtgaaaaatcaaccttggtgatgaccttgagcagcaggatataaataactcccgcaagcttagtgttccatagtggaacactaggcataaatgggttaaaatctgtaaacttgctcaggcctctcccagctaaaataacaaatcctctctcaaccctgcatttccctctaactcaccatattttctctcttctctcacataaacttctcaaaagtagagagtacatttgcagcctcatctcctcttctcatccttcctcaattactttcagtatagctcccaccccaactgctgcactgaaatggccttgctagagtcaccaaatggatcctaattgcctcgccgaagtcaaagtatatttccagcacatcttactaaacttgctcctgtgcctgacatgatcttcttgtaactcccctccccaaggcttccatggcttcatataccctcctagttctccttctctctgaacgttcctttatatctcctttatgagatttcttcctcttctaatcccccttaaacagcttttacaaattaccgaaatgaaaaaattataagcttcagagttaggtctgactcaaattccaactccacctagaccaattattgtgaccttagacatgtaacttaaaaacctctcttactctgttttctcataataaaatgaaaatgcagatacctacttgggagtactattatggaaatgagatcatacatatatgtgaagagtcattctctctttttttcctcccccttacttccatattcacctggcccatcgttctgcctactcgctcctcaaattcatccctcatctccagccccactaccaatacctcactttctggttaaagactgggtagaatttaccaggcaggagaacagaatatgggaatgcaaggaaaggaatcatcatgcacaaaagcacaaggttttgaaagactcagctgatcttttttttaaaggcaaatctgatcatattactcccttgcctaaaattcttcggcttctagcatgatgtaaaaagcctttcagcatctggtccctactttgcatccctcccttgtatctctctttattctagccctaccaaacaacttctaattcatgtgggaaagaatcaacattatctgcaatgtgaatccacagtcctaaagttttctaccctattctgaagtctttctgaatgggaaaccaattacataggaacagacttaacagaaacaagctataatatggagattataaacagagtatctttagtaacatgacaggctggccaaaagcaaagaattaaatctatgaggtaagactttacaaatacatttataaatatagaagtatcaattattataactagattatatcaatactccccagataatctgcagctactaattacccaagattaacataaaacttacttccaggttgaactgcaaagactcttcactcgcctcagtctcaggactaaccagtttcatcttagacataatttatcatccacgtctggggcagccccagaatccccttttccactccaagtatgggatcatgggtctccaccatgctttcagacatgacatcactggttgctatgggctttctggatagttgctaatacctgaaagaagtgaggcagggaggaagaaaaaaagaaactaaaatacaaacacaaaaaacagcaattcaaggtcatcaatttgcctgtttggctcccagctctgcaggattgaaggaggttcctaggatagatccctgtcataagtatcaacaacacgaactagtattgacacctggtcttaagaggagcaacaggattcagttccacttctgctctggacaaaggatgctgcatgagccctcagccaacccacatctgccagcatcaggcatggtagcaggagactccagacggcatgattgttacctcccagcactgactagagaaaacaataggttaatgtagaagactactggctgcttcagggaaggaggatctaagttttcttgcctgtcaagcagcagactgactaattagccaaggtactgaataaatagtacttctaccttcttcctgttccatccttataaaacatctctacatcactacttagcactcagattctactccttgcaagtaataagataaaattcttttaagtattctctttctttcttacttccctccccctttctttccttcctctctttacccctcatctcctagtagtaaaatcacagaaccagcttcataaccctattttccctaaaacaaaaatcaaccttaccagccagacccaactcctagatctaaaatatcacttgtgtagagaatgatatctcagaaattctgccttaaatatcatactttttattcactcaccaataggagtactgtgtctcttgggctccaattttaggtgccaataagaggtggggttgcaccagtcaatggtgggatgatatcaccttctttaggcaaatgaaatgaaatggggtttctgaaaaaaaaaaaaaaaagaaaaaagaaagaaagaaaaaagatttaaaaaaaacagaagtataaaataagcaaaaataataagaactgcaagaaatattcaatcactcttttcctttgctcccaaattctgtctcattgccaccaccctcaccaggcccctgactaactcccttctatcgtctctgctctcttcacagccaacaactatagtactgaacaaagtagacaaccagaggacaggcaaatagagaaagcccgaagtctgcaagacctgagaacctggagtcaaatggaacacaaacatttgatctccaagacagtacatcaggggatattagcaatacaaatttggacagtttcaaatcagaacaacataattttgtgcaatgctaactaaggagtttgtttataagccttaatagtctgtaggattctccaaagcaaagtttgaattaatacttataatgtacaatctaatcaaagagatgacagaggatctcacgggttaaagacttcaagatactgactggttctagcatagaaatccaagggtttcatggttcagcagtaggaccagcattcactctaggcctaagtgtaatgttcatacctaaatctctgcacaacagaaatccctcatatataagcatcaccagtgtacacattttagttattaaattattataaaagaaaatatttgtcaagacataaagctactttctacctaggtctcagttccaaatttttctaatcagaactagaaaaccgtcaaaaaatcacattttctaatttcctaatttatctcttttataaaatgatacatttgggagaaaataagaattgcgccagactgccctcttaaaacaatatatgaaaatttcttcttactttcctgggatggctcaaaataactataatctggcaacttggacactactacttatgaaagtagtttgcttctttcatctttttccactcctatcttaatagcaagcaccgtgataattttttcctttaaaacaaaacaaaacaaaaaaattttttttttttttgagacggagtctggctctgtcgcccaggctggagtgcagtagctcgatccggctcactgccagctccgcctcccgggttcatgccattctcctgcctcagcctcccaatagctgggactacaggcgccctccatcacgcccagctaattttttgtatttttagtagaatggggtttcaagagaaaatgaattagtaatctgaggagataaagagagaaaaagaaatgtctttagaaataaaggattaaagtacatatgctcagctaaagaaactgtaaagaggggcaggtaccatggctcatgcctgtaatcccaacactttgggagacgaaggcggatggatccttgaggtcagaagttcgagaccagcctggccaaaataatgaaaccctgtctccactaaaatacaaaaattagctgggtgtagtggcaggtgcctgtaatcccagctactcaggaggcgaggcaggagaactgcttgaacctgggaggcagaggttgcagtaagccaagatggtgccccgcactacagcctggatgacagagcgagaccgtgcctcaaaaaaacaaaacaaaacaaacaaaaacaaacctgtaaacagtatggatgaagaatctcaacattacatctaactgacaacatccaccatagttacagaaaagagaaatgggtcaggtagataagcattcattctgtgtagccccttataaagcaagttgttctaataaagaacttagaagagatacagaaacttaaaaacaccttgcaaagcctcatatattccagacttctgaaaatgtgcatgaaatctttaacagacctttctatgtgacatactatattacgcaaatgcaatatgcaagcattaatcgctaaaatatatccctgtaacaaggtttcctttgcacagtattacataaaacttatggaaagaattttagcaccatttatctaactgcattactataacctaatggaaaattgagacttttcaggccctagggacagcactgccactactctcctcaggtctccaatgcctcattcctggttattaccatagcctatcaatcacttcctctgcctaaagtctcccactctccctaaccccattctttctgcacactttctgcagccttcctagaaaacatggctttgttagctcctggcaaaaaacttcaaggttttcactagaagacaaattcccaactctatagtcagcattcaataactagtagcagcctatatctccagtttttctttaattattcacgttcataaagcttcattcaatgtcctccaaaggtttcccatttctatgcttttgttccctcatctggaaaacacacacatctactcaaactattgccaaatccttaaaaatacatttgctggtatattttatcttttaaacttacggaattttccacatattccattatttctctaacatttagcaatcctcattctttaaattatcaaatcccttcttgtttttccagataatcatgggctatcatgtttaggtcagcataccaaacaataatgaaggatatgaatgaggaaacaaaaggaaactcaaactaattttgaaaccacctgagtgggagtatgtgtcctttaaggactttagagaataacccaaagcaatatttaaaactctaaatgttaagaaggtctctcctaactttctgttatagtttaaacccatttttcttctttgttcttaaaagaactggttacccctaagaatttattaaagccatctagttaaaaatgtaagaatttatatatccggcgatatcatgcatgaagtctccccaaaagtctgcctctgatattaatagccaattaagatggcattctatcaagtaagcaataaaggttatagctagagcctaaaacacatctagatcccctgatcattattaactatacagactattacttatggatttaaagacttactgaactccttacagtttttcacatcataacccaccaaatatttgttctgtgttgaacaagattgggcttccaagtaccatcttgctttttacaggtttaacaggagctctccatagacagatacttgaagaggtctccaaactgtaacagtgacaagttatctataaatggagacatttaaagtaattctctctctccctctcttactcactctctcttttccttccaactccctctctccccacaccctccccactcagaattctactttgtattgtttgaatgtttttcaaaattaagcatgcattatttatttacttattatttgagacagggtctcgccctgttgcgcaggctaaagtgcagtggtgcaatctcagctactacaacctccgcctcccgagttcaagtgattctcaagcctcagcctcctaagtaacggaattacgcgtgcacgccaccatgcctggccaagcatgtatctttttttaaaatcaataatctattaacaacaaaaaagtgctcttctaatagtagatgaacaaatgcaaaactcaccaattcacacctttcattctgtcttttcagactgaagaaccattactttttttcttttttttttaattattatactttaagttttagggtacatgtgcacaatgtgcaggttagtcaccacgtatacatgtgccatgctggtgtgctgcacccatcaactcgtcatttagcattaggatatctctcaatgttatccctcccccgtccccccaccccacaacagtccccagagtgtgtgttccccttcctgtgtccatgtgttctcattgttctattcccatctatgagtgagaactgcagtgtttggttttttgtccttgcgatagtttactgagaatgatgatttccaatttctccatgtccctacaaaggacacgaactcatcattttttatggctgcatagtattccatgtgtatatgtgccacattttcttaatccagtctatcattgttggacatttgggatggttcaagtctttgctattgtgaatagtgccgcaataaacatacgtctgcatgtgtttttatagagcatgatttatagtcctttgggtatatacccagtaatgggatggctgggtcaaatggttttctagttctagatccctgaggaatcgccacagtgacttccacaatggttgaactagttacagtcccaccaacagtgtaaaagtgaagaaccattactttttagattactatcatttaatttggccaggcccagtggctcatacctgtaatcccggcactttgagaggccaaggcagtggattacttgaggccaggacttcgagaccagcctggccaacatggcaaaaccctgtcctactaaaaatacaaaaattagccaggcatggtgacatgtgcctataattccagctactaggaggctgaggcacaagaatcacttgaacctgggaggcggaggttgcagtgagccgagtcatgtcactgcactccagcctgggcgacagagcaagactctgttccaaaaaaataaaataaaattagtctctcaacatttagcaactaaacaactatatttttaagtacaaaataattttttctgttctttttgcaacgctcttctgaatgatttattttatacaattttctaagtaaaaactattgttctcggctgagcacggtggctcatacctgtaatcctggcactctgggggccaaggtgggtggattgcctgaatccaagagttcgagatcagcctgggcaacatggcaaaccctgtctctacaaaaaatcagccaagcatgctggtacacgcctgtagtcccggctctcggggcggggggctgaagtgggaggatcacctgagcccgggaggtcaaggctgcagtaacattgatggtgccactgcactccagcctgggcgacagagtgagaccctggctcaaaacaaacaaaaaaaaagacaaaaagctattattctcccttcatgttctaatttgtagttaaattatttttatttaacttctcctcataaatactattttccaaccactgtcttcattacttttgttgtttgcccaagaactaaaatcatgaaataaacacgaaatcactagcattttcataatctggatattaatgttaataaaataataagttttactacggcaaaaaaagctgacttgccaattaacaatgtaaacaagaattcatgaagaatactattaaaataatagaatatccactgttttagaagcttcttttgcatttaatttaaaagtactccaggccgggcgcggtgctcacgcctgtaatcccagcactttgggaggccgaggcgggcggatcacgaggtcaggaatcgagaccatcctggctaacacggtgaaaccccgtctctactaaaaatacaaaaaattgccggacgtggtggtgggcgcctgtaatcccagctactcgggaggctgacgcaggagaaggcatgaacccaagaggcggagcttgcagtgagccgggatagcgccactgcagtccagctgggcgaaaaagtgagactccgtctcaaaaaaaaaaaaaaaaaaaaaaaaagtactccaaataactatattaaaacaatcaaagagacctgatattttgttggcacaggtcattagcatatttaaacataatacaattagaaaaatactctactacagaattttaggttattcacatgttcttcactacagctcttcagaatcaaataatctgtattaagcagttttacaggaagaaaagcacagctgggatcaggagacctaggttctagtctcacctctatcattaactagccaaagacgttaagaagagactaaatccaataacccctcacttcctttttagctctaacattcttattcttaagataaaaaaaaagtgctaaatataaaagctaataaatagggacttttttttttttgaggcggagtctcattctgtcacctaagctggagtgcagtgatacaatctcgcttctcgtgcctcagcctccagagtagctgggactacaggcacccgtcatcattccagctaatttttgtatttttagtagagatgaggtttcatcatgttggcaaggctggtctcgactcctgatctcaggtgacccgcccgccttggcttctcaaagtgctgggattacaggcgtagccaccgcacccggccaatagggacaatttaaaaactaaaaaaaaagtactattaatatcacacttagacaatgggtataaaatgggactgttctaggctgggtgcagcggctcacgctgtaatcccagcactttggaggccgaggaaggcagatgacgaggtcaggagattgaaacatcctggccagcatggtgaaaccccgtctctactaaaaatacaaaaattagctgggcaggtggcatgcacctgtagtcccagctactcgagaggctgaggcaggagaattgcttgaaccgggaggcagaggttgcagtgagctgagattgcgccactgcactccagcccagcaacaagcaagactccacatctcaaaaaaaagggactgttctacgcaaaccaaaaaatatggtcctcatactatcatatgtaaacctgccaaatactgttttttcatttcatcctaaaaacttttttcttaagtttgtgtcttgttattttgtttttggagcttgattttacattataataatctttttttttttgagacagagtttcactcttgttgcccaggctgtagtgcaatggcgcatctcagctcatcgcaacctccatctcccgggttcaagtgattctcctgtctcagcctccgagtagctgggattataggcgcctgccagcactcctggctaattttgtgtttttggtaagacagggtttctccatgttggtcaggctagtctcaaacttccgacctcaggcgatctgtggcctcagcctcccaaagtgctgggattacaggcgtgagccaccacgcctgacctacatatactaactctaaggattcagaaagattgaattattttcagctaatgtcatactctacaattattttattttatttttgggaaacagagtctcactctgttgcccaggctgcaatgcgtggcgtgatcttggctcactgcaacctctgcctctcaggttcaagcgattctcatgcccagcctcccgagtagctggaactactggtacacacgacacacctggctaattttttgtatttagtggagatgggtttcaccatgttagccaggctggtctcaaactcctgagctcaggaatccgcccaccttggcctcccaaagtgttaggattacaggcgtgagccactgcacccacctgtacaaatactttagaaagtaatctacgttttcatgctgaatttcataaaataaagacaagaactaatacattttccagtttcaggtttaagagatatgtattttttgaactaagttagaaactttacctaatgcccataaaaaggaaataactaattaataggatactcatcacagttctgaatgtgattttaccacacagagttaatcaaaaaagatccttctacttcaagcaactgtcaaaatctatacacagagagcaaggatacaatctaagtaaaaaaaaaacagatggtacaatttctaaatattttttaccaactagtcccgagttacaaagctgataaacctaaatatctttaattgcacaaataattatagctattaaaaaaatacaatccaggttgggctggtgactcatccctgtaatcccagcactttggaaggccaaggcaggtagatcacttgatcaggagttcgagactagcctggctaacatggtgaaaccccatctctactaaaaatacaaaaaattagccagatagtggcatgagcctatagtcccagctacttgggaggctgaggcagagaaatcacttgaacccgggaggtggaggttgcagggagctgagactgcaccactgtatccagcctgggcaacagagcgggactctgtctcaaaaaaaaaaaaaggcaatccaaaaatttaatttcccaattattattggttgttcataaacataaaccaaagatagtgttcactctgacataagcatgcagttctcgccaactttccattccagattataatttaggtggagacagaataatctacaatcacactcaccactagaactttcacagaagctttgtgaggcatggcagagggcttccccagcttctgggcctctgcatctgagcttagctgctttgcattagcctttttgagtcttctgttaatgaattacttgttttctcctgagtttggggctgctgcaaccctggtcaagtcttaaaggatcatctgctctcactaaaggtaaggaaggctgtgaagaacttgctctacaggttctgtttctgcagtccctgatttcagatctccttcatattctacatcttttcttccttggtgtctaatctattctcagcacatggttctatttctggagcaatacctcccatgactgggaatctgagcacttctccactccctccaaaggttcacaagaaacacaactctgggagatggctctttcacatctacaatgacaacactggagtcctctgaagtacttcttcccaagcttcctgttccttatgttccaattcttggtcaagtattgccaactttgaggggaatcaatactaatcacactggtttcaacttccatagcttctgagcattcttttttggcatttccttttgaagacacaacccttgggactgagtttcagtcagagaaaggtgcacggaacactctccatattttcttctttgagttcctctccttgactttcacaaggtgtccagggatttcttccacctcagaccctgaagacccctcctctggatggtgttctttaattccatagcttcctcctgatctaacacactagaaagtgcctcagatcgagtagctggtgacgaactgcctgactccccgaatcacaagtgagatcaatacaaacatcttctgctaccgttcttctctgcccttgcaaccagtggctaaaatactaatgtcatccctggtgtctgtatcactccctttgttttgtcatcattctgactcagttgtacttcaccatcctgtgctggattctcaggatactatcattttcagcaggaacaaatttagaattgagaactggagacatgggtccgtatcctcaatctgtgtgttttctccatcttcatcaattctgtgagaactcaagctcccatctttggggactgactatattcacttgtagaaagcatcaacttgcaagaatccccttcaaagatagcccaagatcctcaggggaattctttggttcaatctctgaagttttagaaactcaactgtcaaagatgaactatgcatatctccatctttcttcccatcatttgattgtcttccagacttggggaaggaataaaaatgtcctaaggaagaacagaaagagacaaattgaatttgtacatgatcatatatcttttatatcgaatccttggattcatataaaatttctaaatcaaatttctaaatcaaatttttaaattcatataaaatttctaaatcaaatttaagattaaagaactctagtatagccaggagcagtggcacatgctccagcccatttcagttctccaaagtggggatacgtactcattttacttcacgatttcaaaatgtgctagcattcaacaggtgaaaccctgtctctactaaaaatacaaaaaaatcagccaggcgtggtggtgggcactgtaatcccagctacttgggaggctgaggcaggagaatcacttgaaccttggaggcggagttgcagtaagccgagattgcaccactgcactccagcctgggtgacggagtgagactcctctcaaaaaaaaaaaaaaaaaaaaaaaaaaaaaaagctagcattcataaagcaggtattaaatccagtggccaggtgtggtagctcatgcctattatcccagcattttgggaggctgagcaggtatatcacctgaggtcaggagttcaagaccagcctggccaacatggcgaaacccgtctctaccaaaaatacaagaattagccgggtggggtggtgcatggctgtaatcccagcactcaagaaactgaggcagaagaatggcttgaaccgcggaggcagaggttgcagtgagcaagatcgtgtcattgcactccagtctggattacagagcaagactccatctcaaaaaatataataataatactaataataataaataaaatccaaagcttacaaaatatcaatagtcaaagagaaatacaaattaaaatcacaatgaaataccactacacgcaacaaaagcaactaactaggccaggcacggtggctcacacctgtaatcccagcactttagtaggccaaggcaggcgatcacctgacgtcagaagttcgagaccaacctggccaacatggtgaaaccccatctctctaaaaatacaaaaattagccgggcatggtggcgtgcacctgtagtcccagctactcacaggctgaggcaggagaatcacttgaacccaggaggcagaaggcagaggttgcagtgagcgagatcgtgacattgtactccagcctgggcaacaagtgagactatatctcaaaaaaaaaagcaaactaatgttaaaatagttcacaaaacagtcaggcatcgtggctcagccagggatgtggctcacacctgtaatcccagcactttggggaggctgaggtgggaaaactgcttaagccaggagttcaagaccagcctggacaacatggctacaccccatgtctacagaaactttaaaattagccaggcatggtattgtgtccctacagtcccagctactcgggaggctgaggcacaggatccttgagccacaggagttcaaggctgcagtgagctattattgtaccactcacttacactagcctgggtgacagagaaagactctgtcccaaaaaaagacaaaaaaaaaaaggtcacaaaacccaggattagcaacgatgttgaacaactgcaactctcgtacattgctgctggaatgcaaaatgttacacccactttggaaaaacagtatggcagtatcttataaagttgacattcattactatataacctaggcattctgcttgtaggcatttacccaagaaaaataaaatatgtgcccacagaaagatgtgcatccaaatgatcacagaattattattcgtaagattgcatgctggccaggcacagtggctcacatttgtattctcagcactttgggaggccaagcaggcagatctcttgaggccaggagttcgaggtcagcctggccaacatggtgaaatccccccctactaaaaatacaaaaattagctgggcatggtggtgcacacctgtgatcccagctcccagaggctgaggcacgagaattgcttgaacccaggaggcagaggttgcagtgaggcaaatcacgccactgcactccagcctcagcgacagagcgagagtctgtctccaaaaaaaagtgtgcaaatgatcataggattattattcataaattcatgggaaattattcatatattcatcatataatggtcatatattaattataattgaatagattattcaaaataaccaaaaactgaaccaaatgtcctatcaattggtgaatgaataaacaaattgtggatacacatattatgaacactatccaacaatataaatggaataaaatatgaatatgtataatacaagcaaatctaaaaatatgctaagtaaaagagctcaaaaataaaagaccacacacacttcctgattccattgcatgaaattcttttttttcttttttttttttaaagacaaggcttcactctgttgccaggctctggagtgcagtggtgagatcacagctcactgcagcctcaatttcctgggctcagcaatctctcacctcagcctcccaagtagctgggaatacaggtgggcgccacaacacccggtaatttttaaaatgtcttttagaaatgggatcctgctatattgcccagacttgaaacactgaaataccaaaactatactgacagaaagctgatgtgtgattgcctagggcgggagagggagtatactgggcagcagggagatcaaccacaaaaggttataaggaaactttttaggtgagggaactgctctctactttgatggtggtgatggttacacagctgtatacatttgccaaattcatcaaaacatacacgtaaaataattttattttatgtaaccaatacttcaatattttaaaaagagaaattaatacaaaacttagctgtttttataagagattttacatttagttgttattttgcctaatgtaaatgatgtaaaactcccaacatagatggttaggcattcattcctatgttttgttttgttttgttttgttttgagacaaggtctcgctctgccagccaggtggagtgcagtggcttaatcacggctcattgcagccttaatgtcttggactcaactgatctcccacctcagtctcccgagtagctggaactacaggtgcgcaccaccagagccaggtatttttgtattttttgtagagagggtctcattttgttgcccaggcttgtttcaaaatcctggcttgagcaatctgcccagcttagcctcccaaactgctaggattacaggcatgagccacacgctcaggctttttttcctatgatttttaagggaatgaggaatcaaatgggtagtaagcattctgtatattccataacttctgatatttcaatgtctggtattattgtttatcctacagattgtaacaatgatcctaagtttgaatctgttcatatactctcagacatgactgagataaactggttcaagccagatgcagtggctctaacttataatcccaacactttggaaggcgaggcagaaggattacttgagcccaggagtttgagataagcctgcgcaacaaagtgagccctgtctctaccaaaaaaaaaaaaaacattagctgagtgtggtggcacacgtctgtggcacagctacttgggagcctggatggttaaggctgcagtgagcagtgtgattgtgccactcactccagcctgtacaacagagtaagaccctgcctcaaaaggaaaaaaaaaaaaaaggtcaacatttctaaatggcaatttagcaaaacacaacagccctgaaattctataccccatatccaataattccatttctgggaaattaatcaatgaaagcacactaatacttagctacaaatggttcactgctatattattatttagaataggaaacaatatgaaataccttaaatggtacaaataggaattttattttattttttttttgagacaggtcttgctctgttgcccaggcggagtgcagtaatgcgatcatggctcactgcagtcttgacctcctaggctcaagtgatttcttacctcagcctcccgagtagctgggaatacaggcacacaccaccacacctaatttttagtattttttgtagagacgagattttgccatgttgcccaggctgatcctgaactcctagttcaagcaatctgcccacctcgaactcccagagtgctgggattacgggcatgagctactcgtccggccaagataataatttttaaattgtgatctatcacatgatagaatgttttgtgtctacataaaagtatacagtagaagaatactaaaagatcaaaaaacatttgggctataaaagaagtttctattttagtaaaaaattatgtggatatacattatatttttttttttttagacacagtcttgttctgtcacccaggctgaagtgcagtggcaccatctccgctcactgaacctccacctcccaggttcaagtgattttcctgcctcagcctccagagtaactgggatacaggtgcccgccaccacacccggctaatttttgtactttttagtagagatggggtttcccgtgttggccaggccggtctcaaactcctgacctcaagtgattggtctgcctcggcctccaaagctgggattacaagcgtgagccacagaacctggccattctactctttttacacatttataatatataatcttcatgtaattttagttaataaacatatatcaaaaaaagctaaagggccaggtgtgatggcttacacctgtaatcccagcacattgggaggctgaggcaggtgatcacctgaggtcaggagttcgagaccagcctgaccaacaaggtgaaaccccatctctctaaaaacacaaaaatttgccagacacgtggagagcgagacttcatctcaaaaaaaaaaaaaaaaaaaaaaaaaaaaaaaaaaaagctaagagttgttatttctgaggtagaataactatgatcttatcttctcttttttcttttcttcaagatggggtcttgctttgtcacccaggcagagggcagtggcacaatcatagttcactgcagcttcaaacacctgaactcaagcaatttccccgctcatactgctccccagcaccaggagctgggactacaggcacacgtcaccactccggctaattttttttttcttttggtgggtagagacgggggcctcactatgttgcccagctgctgtcacactcctagctcaagctatcctcccaccttggcctcccaaagcactggtttacaggtgtaagccaccaagcatgaccacatcttctgcaagacatatgtattttttccttgttgcaaaaaataagtcattttacaaagtctcatagataaaacatcactaacgtaaactataaatacctttttttaaatgaaactcacaatataaaattaacccattttaaactaacaattcaggccaggcgtggtggctcatgcctgtaattccagcactttgggaggccaaggaggcagatcacttaaggtcagaagtttgagaacagcctggccaacatggtgaaaccccactctactaaaaatacaaacattagctgggcatggtggtgtgcactttttgtcccagttattggggtgctgaggcaggagaatcacttgaactcaggaggaggaggttgcagtgagctggatcatgccactgcactccagcctgggcgacagagtgagactccatctcaaaaaaaacaaaaaacaaaaataaaataattcaatggcatttggtgcatttacaatgttatgccaccacaccactattctagtttgaaaacatttaattgtctaatttgtcctcaccaaaattaatactatatcaagaatgagaaaatgttaactatcaaactgtgttctactaatcctctccccatcctcatatcttggtaaagggtcaaagaggctatgcaattgacaagtttattaggaaagaagaaaaaaatagacaaaattacctttatcccaattttctcttgaatagtactaatctcttacacatatttaaatcttacaacatcaaaattaggttgacttggactccagtaaccaagtacaaaagaaataacagatgaacaagggttacccattaagaataacaagaataagtttgcatataatgaaaaaagtagggaacttaatagaaatggagaactaaatatacacatattcgagttttctgaaatcccattaagtaatggtaaagggatttttcttaagcacaaaacttcagaaaaagagaacagaagaaaagagaactgcaaaaaaaatctggaaaaggtaatctattagcagaagagtgaaagctgaattcctaagccagcagtggagaaagccaacaaaccaccaagttacaccacagttccaacacccataatctcaccctgcccctcctctgccctggagaggtaaaacagagtgtcccaggactggcagacaagaggcacagttatcaggaagtacaatatgaaaatacggagattaaatgaaaatctacatattgaatgaaacctgcacctgcctcccaccccccttcccacccaaagcccgcttccattaatagacctctagtacagccaggccaaaccctgcaaataggagatcagacattttcctaagggatctgaccgggccaagatgaatcagatactgacattatgggactcccaataaaatgtctcagcggatcacattacagcaaatccaaaaacaataagacccaaccacccactcagaactactaatcatctgtctgatatttcctcttgaacatcagcaaataatcaaagattaccagacatctgaggaaagcctctaatttaaagagatcaaaacaaacaaaactaaagtccacctggaagaaataggactattccagacgaagaaaactgttattaatactgttacagagataagatagtatatcaataaaacaagagaatggtatttaaaaatatattctgaaaaaagaatttagaaattaaaaacccaagagtagaattaataactaagagaagaattaaaagatggttgaactgggcaatggcacctgtaggttacataagagaaataaaaccatgttcacacacaaacttgtccataaatgtacatagcagattattcacaatagccaaaaggggaaacaacccaaacgtccatcaactgacgaatccatagtaactgtggtatatccacacaattgtattattcagcaataaaaaggaatgaaggccagcgtggtggctcatgcctgtaatcccagcactttgggaggccgagacaggcggatcaccgaggtcgggagttcaagaccagcctgaccaacatggagaaaccccgtctctactaaaaaaaaatacaaaatttgccaggcatggtggtgcatgcctgtaatcccagctactcaggaggtaaggcaggagaatcgcttgaacctgggaggcgaaggttgcagtgagccaagatcatgcattgcactccagcatgggcaacaagtacgaaactccatctcaaaaagaaaaataaataataaataaataaaaaaggaatgaaattcttttttcctttatattttttatagacaaggatgatcaatacaaaaaaaggaatgaaaatctgatacatgctacaacacaggtgaatcctgaaacattatgctaaatgaaagaagccattcacaaaggctatatattttataattccattttatgaaatgtccagaataggcaaatctatagagacagaaagtagactggtgtctactttcatttgtagactggtgtctacaaatctatagagacagaaagtagactaccctcgaagggcgagggtagaagaaatgttgagtgagtgctaaagggcatgggttttgaggaggtgatgaactattctgaaattagatcatggtgatggttgcacaactctatgaatatactaaaaaccctggattgtgcactttaaatgggtaaactgaatggtatgtgaattacatctcaatatagcactgtttttttaatgattgaagaaatcacccagcaagttgaactaaaagagacagagagatcaaaagtaggaggcaaaataaaattagaagactattctaggagtttcaacatccaacaacagatagtccattaaaaaaagaagaagaacagagaaaacaaaggggaagaaattaagaaataaatttctttgaactgaaggacctgagtttctaaattgagagggcctgccaagtcccaatacaatgaatgaaaatagacgtatcccaaaggtctggaaatttcagaacactggaacgaagagaaaatcctacaggattccagtaaagaaaaaccagatcacctattaaaagtaagatcagactgccttcacactgttttgttttttgttgttgttgttgttgttgttttgtttgttttggtacagacagggtctggccatgttgcccaggctggtctcaaactcctggctcaagtgatcctcccaccttagcctcccaaagtgctaagattacaggcatgagccaccatgctgacctgaccctcacacttaacagcagcactggaagttggaagacaaaagagcaatgcttcaaaatctttaaaggaaaattatttccaatctagaattctatactcctgcaaactaaaatcaagtgtgatagcagaataaaggctactaaacaatgtcccccaccaaaatgaggggtaaaccaagcaagaagatatgaaacccaagaggtatccaacacagacaggtaaggagatctccacggatgacagtgaacggaggttaacagttatgcaccaggcatagagggcaacatacagattagaaatcaggagggtccaaaagaggtttctccaaaaagatgaaacagaaagctaaggctcctcaacatcctgaaaggagtttctgacaattggtggagaatctagggttgtttaatgagagtcaaagaaaactaaacaaataaaaaaagacaattacaatttcagagaaagaaacatgaaaaactattaataatatgtcataggctctgctgtgaattgtttacatagtataatgtaaactcagtaataatctaaacaaaattacgatgtaactatacttggaaaatgctaaaatttttttatgaaaataggctgggcacggtagctcacatctgtatgtaatcccgcattttgggaggccaaggcaggaggtctgcttgagcccagtagttcaagaccagcctggcaacatagtgaggtcccatctctacaaaaaaatttttaattagccaggtgtgatagtggtgccactagtcctagctactcaggaggccgaggtgggaggatggcctgagtacagaagtcgaggttacagtgagctatgattgctccactgcattccagcctgagcaacaggtcaagccctgtgcctaagaaaaagaaaatataatcatgctatgtagaattatggaggtaaatacaaaagaaaaagcataaagaacgaaaagtggttatctttgggtaggaagaggaagaggcctgttttaactatctgacttatttttggggttttacacatgcttattaagtaaaatcaaactttaacttaaaagctatgttgtaaaggtattcttttttttttttgagacaaggtctcatctgttgctcaagctgagtgctgtggcatgatcatggctcactgcagcctcaacttcccgattcaagcaattctccaggcaattctcctgcctcagcctcctgagcagctgggactacggcacacaccaccactcctggctatttttgaccatttgtagaaatggggtctcgctatgtgcccaggctgttctcaaactcctgggctcacgtgatcctcccacctcggcctcccaaatgctgcaattataggtgtgggctactgcgcccggcctactaaaggtattcttgagagactttcaggaggcatggactgcactggctaaggcatcttataaaatatgagttcaaagaaactgattagagtcatcttaggttccaagaatctctgaactatgttcagaatcactcattttctcaaattttcattgctgattttttagctaattctgaaggtctttggtaaatgttgaaatagagcaattccttcaacagtgccttgtttttcaaaacgtccattctccctttgtggcaggcattatctccacccccccaaccagcaggaatacctttccaaagaccataaaagtctgtttggtcactgataaacatctgtaaccattttctttaaatcagtgttggaagaatctttcagtgctctgtgtcagtgtttatagctcattcttaaactctttttttttttttttaagcagggcctcactgttgcccaggctgcagtgcagtggcgcgatctcagctcactgtaaccctgcctcctaggttcaagcgattctcctgcctcagccttccaaatagctgggactacagtgcgtgccagcatgcctggctaatttttgtattttttggtagagactgggtttcactgtctggccatgctggtcttgaactcctggtctcaagtgatccgcctgcctcggcctcccaagtgctgggattacaggcatgagccaccacacctggtcagatttataacttttttttttttgagacagggtcttgctattttgcccaagctgttctcaaactcctaggttcaaatgctctcccacctcaatctcctgagcagctgagattacaggcatgccccaccatgcccagctatttcacatataacttagaaaaataaaagctaaagaaggccaggtacggtggcccacaccttaatctcaacacactgggaggctgagagaggaggattgcttgagcccaagagtttaagacagccctggcaacatagtgataccccgtctctataagaaaaattaagaaattagttgggatggtgccatgtgcctgtagttccagctacttgggatgctgaggtgggaggatcacttggactgggaagtcaaggctgcagtgagccatggtcgcaccactgcactccagcctgggcacagaccaagatcctgtctcaaaaaaaaaaaaaaaaagctaaagaaaatgatgtatggttgaacatccatttcacctctaggtaaccttgtttttaaccctttcactgccaacaacagcacccttatatgcagtaccaagtgcaaggcactagtctaagcattttatatatattaactaacctttcataaacatcctacgaggtagacagtatcaatatccccatcatttgactgatagcaaactaagattcaatttcaattggtcacaaaggtagtaatgacagagccaggagcggtccaggaagttctgactctagagtcctcatttttaataacgctaccaaattctaatgactgcataaaatgaaatcctttaacaaaacaagttttaaaactccagaaaacaaatcaattcttcctactgtcccctcctcactaaatttacagttcattactattcattttcaaatttacttttaaatacaaactcttgttataacacctgcaaactgaaaggggtaaaataagttgcccaataaaactacaataattcccccacttaaggtcttataagaataggtatttagattaatatataatagtcatttagatttaaggattttcaactcagtatgaaacctgaatttcattctttaaatatttaaatttaaaattatacaaattaatagttttccctcgcttttagaaaaaatacacattggaaaactaaaaaccatcttgataccctaagtataggatgatcctgtctgagatcacatctacttagagaaataatacatgacttttgaaaggataagtgaagacatataacactgagaattattacgacacaacattaactggaaaaagaaaattaaagttgtgtatataaacaccttttttaaaaaacataagcatgtgggggcacatatcgtcaggacctctgaggctgtgtcataggcaaaaaaatttattaaaaaaaaccataagcatgtagaaagacaaaattacagtaacagttgtgttaaagtagaataatgatttatgtcacttcgcaattttcagtaacattttcaaaaagtttaaagacattgtaaaaagtttaaacataaaaaaaaatcagatgttaggtgactttggaactgttctaaaactgctttgtgacgacagcttcacaacttgtaaatttactaaaatatcacaaaattatacatttaaaacgtgtgaattttatggtattaaattataccccaataatgctgctttaaaaaaatatgttaggagaaacaactctttttcaatactcacatgagaaaactgaggctgggatgggataggaagtgacccaggagggaagctggtgtgctctgagatattggtgttgaggcttgtggtgatacagtggactcaggcagggaggggggttttctaactccactggttcaccactttgaagtttcttctgaaaaggctctctccttcttcagataacactgacgtgtccattggcttatctggtttaaaacaggagaaaaaattgagaaatatcactcatcaatattactcatgttccaaaaccactaagaacaattaactacagacattttcactctaaaaaaatagtgacgtaatttttcagaaaagctgacagataatagtagactgggtcctagcaatctaccaatacttcctttggttggcggagcagtccagctcctatttttaggtatagatcaaaactggatgcatctggggctacccacccattcaaaaaaatgttaaattaacttggctcctttcctgattttatagctcagtttttcacatttctgtagaaaagcccaaactactggtacctaatttaaccatcatatattctaccacaggcttgaaagacagtgaatttgtcaccactttaggtaaatacagtatctataattcatatttcgaactgattatatttgcattaacaattgctaactgcagagagatggatgcctgtacaatacagatgaagaaaaaaaatctatcaatgccaatcagcactgatttatcaaagaactaaaaagagaagacactaatcctgacacacattaggagggaacacacacacacaaaacacaaacactgctttcccatagtatactacccacctgtaggctatcaggaacttgcttggagtcgcccagctagctaagtatttgattcatcatttgtatcccctatcttacaacttgaccccaccaggcttcctctagaccactcacaaactactaacaacatttaccttttccccataatcacattcatgctaccagctacccaaactgcaacctcaatacccagctttgctgcttagctagtctcaaccttaccagtctacacctaatttgggatccagtgctacaggcctttaataactaccatagctgtgctaagtatttttgttgcaccttttgaactttcttgccatgacaagcacattaaaaacctgctgttataggcactacatacaaaaaaggctttaggttaagagaaagcaaaaaaacaaataaatacaaaaagcacatatagtttcacaaacactgatgtacatcatattaagcaaatgcattaaatctaaaatataactgacaagggaaaatacactgttactaaaaaaaaaaaactgagtcatatacacaacatgccaattatgtaaaactactttatgcttgaaaactgaaatatatccaaatatactagttgtagctatatctggagtgtagtatcaaggtgatttttattttcattaatttcctatatacttaacaaactttctacaataaatatgactgtttacaatcagggagaaagcttttttttttttgagacagggtctcgctctgttgccaggctgcgacgcagtggtgccaccttggctcactgcaacctccgcctcccaggttcagtgattctcctgcctcagcctcctgagtagctgggattacaggcacccgccaccacaccagttaattttttatatttttagtagagatggggtttcaccatggtggccaggctggtctaaactcctgacctcaggtgatctgcccaccttggcctcccaaagtattgggattacagggtgagacaccgtgcccagcctgagaaagtatatttaatataattatttttatattttttaatgttcacactacagataaaagataaaagaaactgttttaagaattaaccaaacttcattgtattacctgggtttttgtagaattaattcacctaatcatgttatacttagattgattcagtcactaatcatgttatgcttagattgatattagtcaatttggatacctacaactgttttaagagaaacagccagagacaaactttgtagcagaagaaagcctaagatcaaattcatcactgataaattacatttgaaaaactgttaaatgtctatgttttatgttactcaagacagagaaaggatataataggaggcatatacatgacagatgaaggcacaggctctggaggagctgcctgagttcaaattctgcttctacatctcattagttgaaaaatctctctatgccccatttcctcatctgtaaaatggggataaaaataacacctccttcttaggatgtttgtgggattcaatgagaaaaaccacagaaatgcccttagaacaatgccttgcctatactaagtctcaataaataaaactattataccattacttgtatatgaaagagtgaaaagatgaaaatatagaatttattagaaaaagctttgtagaaatcgtaagaacttagaaacatcttgaatgctggataggagactaggtcagagcaaaagaagcttaaataatgagataaattaggtaaggaaaaggaaagctttcttgtgaataaagtaatataaaatctctaagtcgtcaaaggagtaatgaatgaagttaaaatttttaccacctactcttaaccattcttatgctaaaactatttaatagcaaaaataacctataaggaccacaagaaacaattgctggttccttctcaccagaatgtgttcacgtgttgctagaaacaagtaggccattattaataagtccagttcttcccatactaattcatttcagttcaactttaaaaacaaaaatttttccttcagagcctttttaaaattgagccaatacagaaatctcaatagaattagtgctagaaaagcaaagaatgggggtggtgtgtccagaattggtgggttcttggtctcactgacgtcaagaatgaagccgcggacctcacggtgagagttacagctcttaaggtggcgcgtctcgagtctgtcccttctgatgtcagatgtgttcggagtttcttccttctggtgggttcgtggtctcgctggttcaggagtaagctgcagaccttcgcggtgagtattacagctcttaaggcagcgcgtctagagttgttgttcctcccagtgggctcgtggtctcgctggctttaggagtgaagctacagacctcgcatgagtgttacagctcataaaagcagcgtggacccaaagagtgagcagtagcaagatttatgcaaagagtgaaagaacaaagcttccacactgtggaaggggacccgagcgggttgccatgctggctcgggcagcctgcttttattctcttatctagccccacccacatcctgctgatggtagagccagtggtctgtgctgacagggggctgattggtgcatttacaatccctgagcagacacaaaggttctccacgtccccaccagattagctagatacagagtgtccacacaaagttctccaaggccccaccagagtagctagatacagagtgtccattggtacattcacaaacctgagctagacacagggtgctgattggtgtgtttacaaaccttgagctagaaacagaggccgattggtgtatttacaatccctgagctagacataaaggttctccacgtcccaccaggcagccagatacagagtgtggattggtgcattcacaaactcagagctagacacagggtgtgactggtgtgtttacaaaccctgagctagatacagagtgccgattggtgtatttacaaccctgagctagacataaaggttctccacgtcctcaccagactcagcagcccagctggctcacccagtggatctcgcacgggggctgcaggtggagctgcctaccagtcctgtgccgtgtcctgcactcctcagccctttgggtggtcgatgggactaggtgccgtggagcagggggcgtgctcatcagggaggctcagccacacaggagcccacggagggggtggaaggctcaggctggcgggctgcaggtcccgagtcctgccccactggaaggcagctaagtaaggcccggcggaaatcaagcgcagcgccggtgggctagcactgctgggggacccagtacaccctccataccgctggcccgggtgctaagcccctcattgcccggggggccggcagggccggccggctgtccgagtgcaggacccgccaagcccacacccaccaggaactccagctggcccgcaagcgcgcgcacagccccggttgctgctcgcacctctccctgcacgcctccctgcaagctgaggagcgggctccagccttggccagcccagaaaggggatcccacagtgcagcggtgggctgagggctcctcaagtgccgccaaagtgggagcccaggcagaggaggcgccgagagcgagcggggctgtgaggactgccagcacgctgtcacctctcaatggggttagacaaaaaaaaaaaaaaaaaaggaaggaaggaaaagcaaagaactgaggacagcactttacagtaggtcacatcctaaaggttagacaaacatgagtcctaccgaattgtgtaggtcacaagcattctaaagacaaagaagtagtacattttgcaaggcagaaaaagtgttgctcctcttctaatctgagacaacagacagatcaagagagctcaccttgtctcccttcttgctctgtgggactgctaggacgataaaaggagtagatcggaaagcatcaggagaaggagcaacaagatctgaagaattctttatataaagagagaatcacaggttattttaccatagccacagttttgcatttctgttttgcttttactttttaacaggaaaaaatatctaaggcattcagataaatacttatcagacttttccccaacagcaacctgaggctggtggaagaaccaaaaatacttcaataactattcccacaccagacatttctgttgtaaaataagaactttttcaaaaagagagtaagggcaagtgaatgatcagacacaaggacatcatgatttaaaagcaaaatgagcagtgctaggaataaattcatttgcagatttgagacataaaaaaaattattccatttttttgcctaataatgtcagaccatgaacattttcatcagaaaactaaaactaaacaaaaaaaaccaacaagcgacctctttgccctaacataaagaaatccaactactgtcaacttaacaacctattctccacctctgctattaaatgagaagaattgcaagtaaaacagaggagcagaatgcttgttttgatgtgtaacattttctaaataactgcgccttttctttcttagtgaaacgtttgggctacattataaaattttcaaatgggacaacagatttatctgccttcaacagttcttcatccccaagctctaatgcataggttctaccatttggtttcaaaaagaattctagactagcagatagtttagcctctttcagccttagcctaagactctcaggcacatactgccttggcataagcattttaggcttacttacgtggaaagactgtcctgaacaagggacctctgaccagagagcgcaggagatgcagagtggtggcaggagtggaagccaaagaacacccaccttcctcccttaaggagtagagcaaccatcagaagatactgaaaaaaagaaattccagttgcacttctcaattgacactactgagctgccaaaaaccattcagtactgcaaagagtaatatccatatttcaacatatttccatatttccaaaagggcagaaattgttttctaattatagtacaacgaaggactactacaatagcacaaatcttgagtgaacattaaccacccccgcaatgggcttctgaataaagaactgatgaagagttccttagtcctttctgtcatgatctaagcttggagataaaagccagaatcctggatgggcgcagtggctcacacctgtaatcctagcactttgggagctgaggcgggtggatcatctgaggtcaggagttcaagactagccagaccaacatggtgaacctcatctctactaaaaatacaaaaattagctgggcgtggtggtatgcgcctgtaatccagctacttggaaggctaaggcaggagcatcacttgaacctgctaggcagaggttgcatgagctgagattgcaccactgcactccagcctgggcaacagagggagactccgtctcaaaaaataaataaataaataaaataaaagccagaatccttatacttctgcttagctgctctctttcttgtgatgcttctattaaaaaacagcaaatgagccttttattccaacgtctacctaggtgaagtcaagctcatgccatgatacagatgggagaagtcaaaaaaatgcacatgaacttgatgttataaatgcagcagttttcaagatttgggcctgctcaaaggagtaaaaggtttatgagcagccattactgttttatactatgaagagtctcttgttggtcccttcccctagcaatagatggagtatcaactatattaatcccagtgtaaaagaatttcttaaataaaacttacaactttagtaagagaccaacaaaggttcctcggtgaccctctgaatgtcttgcaagcaacctgtatcacagcatagcaaaggaagatagccttcttcccttcccgccttacaacaacataatatgttttgctggtaattaactcaagctttctagctctctgaggctgtggatgaaagattggtggaggttaaagaggtgtgaaacaaattatatccttttaagttttatgcctttccgctagattttaaattcctatctgtgtcagattaactaataaacagattaagtagtaaactgttacccagatgaatatgaaaaacctaggcttaatatcatattgaagatttaagacatagtagccatgtaacagaaaatggcagccaggtgtggtgactcatgcctgtaacccagcactgtgggaggccaaggcaggcggatcacaaggtcaggagatcaagaccatcaggctaacacagtgaaaccccatctctactaaaaatacaaaaaattagccaagcatggtgcgggtgcctgtagtcccagctactagggaggctgaggcaggagaatggcatgatcccggaggcggagcttgcagtgagccgagattgcgccactgcactccagcctgggtgacagagtagactccatctcaaaaaaaaaaaaaagaaaaaaagaaaatggctagtatccataatactaatttactgtattagctattcttcaccatctcatttccaaaagagagaaaattatgtcaaatattaaatggaaattattcccaaaaagcccttctcactaattactagaaacacgtttccttccatatcacaaacaagtctgcaaacctataaaatgctttgtaacttaaccagtagctcagaactaaagtaaaagtttagatctttggagaagagctgtaacgacaaatcactctggtacctgttttattgctctggtcaaacaagtcttcctgagttgacaaaacctcaggcttggtgacttctgaatctgcagtccactttccataagttcttgtgcagacaactgttctttgcttccatagcagcaacagatgctttggggctaaaaggcatgtcctctgacctaggaattcatatcaccaggagaaaaagttcctaagttcaaatgtttttaaataaaaagcttttctgttttgtgtgtttttctttaataatttcaaaaattccagtggctctaatttacataatatatattaaaaaggaaataaactactctttatagtgataaaagtcctcagcccattttaaacctgtctcactctctctcacagccaatacctgtcttcaactctgctcaatactgtgctcatgctttctaagatttctgatgagtaacttggggaatttttgttacatataatgttactagacctgtataaagaattctgatccagaccccaatgatgccagtaaggagaacagtcaaaccatgacattccatggaaagcatttgatgtcaattatcctccttactagtgccacaacatcttctgctgaccttttccatttgatgtacccaaaccccaaaccaattctccttcaatcaatactaacatgtataagacattcatccctggcccctttccagagacttatgaggtcacctgttctaccactccccagggtaaacagaatagcataactagatggaaggcagcattaaaagaaaagcctaaaaagtcactgttatgctgagtgttttacattagaaagacaattctcttgatattcaactttgcttaggacactctctccccactctttccattgaaggaaatacaaaacaatactgtttatttatcccctatcccaaactggaagcatcccagttttcttcgccatattcaaacttcacttactggccagaggtaatgaagctttggttataaaaatcacagagatgaagcagaggcacattccccaattcctaccaagttaagagcctaaagaacctggaaaatccctacatctatcgataccataaaataccagatgcaggatacctaagaacccaagcaatctgggtgctcctcaagtatagaaacagtaggctttcaaataaaatagtcatgtactcttcataacaccagagaggctaagaagacctcccacagacaagcagtgtctctgtaacaaagatcacaaaggaggagtggcaaccaaagattacggagtcatgcttatagttagacagccttaaaacatcattgcaggctaggcagagtggctcacgcctataatcccagcacttgggaagctgaggcaggaggattacttgagcccaggagttcgagaccagcttgagcaactagcgagactccatttctacaacaaaaaaatttttttaatcaacaaaaaaaggtctttgagaatgcctaaagataagattagtagtcaagtgtggccccagtacttgggaggctggggagagaatcacatgagcccagggcaacatagtgagactttgtttcaaacagacagacagaagacagacaaaaaacaattcttgagacttcataaataatcaacgtttccaatggaccacagtatgcccagtacaaggggaaaataatttaaaaatcaacaatttctaaaaatgttttctctggtaaaatgacattagtataaccctacagcaaaactcgtaaatcctttttagaaagtcggcttaccttgcaggtggtggattttgctcttttacaacatgtacatccttactgggtgtgctgtcacagggatgtccttgctggactgttctgctatggggatatcttcgttggatgttcttcatgcttaattgctgagagttttataaaatgacaggaaggagataattaagtttcaaaatactagatacagtcccagatgttttttaaaaagcaaagattttaacagaagtcaatttaaaatatatacaggcatcagtctataaaggaaagtaaccaataacttaaaacccagcccacaaaccaacaattgacaagtatttaccagaaaactcttcaaccttactaaatacttagattatattaatttggatagctgcaaaacttatcaaagaaaaaataactacctcaatatgggagaaaacacaacaactccaaatgccagaaaacatgtttcataccagtattacatccacatcagacagcctggtataaccagagttggtggttactgattgtagctgctcttgtccacttcatatggcacagtattttcctcaacatcctggctctgggagagttccagaccccaaaacccaactgtgatgaggcagtatctaggaacaaaatgccaagaaattaggtacatcccacaacattatgcaatgtacaagctgctgtcctcagcaaaggagggtcccgttagtccttcacatcaaagccctgtgcaccccccaaatttttcaaaaataaaaaataaatgtgccgagcacggtggctcacacctataatcccggcatttgggaggccaaggtaggtgaatacttgaggtcaggcggtcaagaccagcctggccaacatggtgaaaccccatctctactaaaatacaaaaattagccaggtgtggtggcgcacacatgtaatcctggctactcgggaggtgaagcacaagaatggcttgaacccaggaggcggagcttgcagtgagccaagattgcgcactgcactctaacctgggcaacagagcaagactccgtcgcaaaaaaataaaaaataaattaaaaaaaataagtgcattaaagatgaagggggaaaatgtgtaataaagtaaaaatactcatactataaaatcttataaggagactacgtctgctttctaaaggtacatcataaactaacccacagtcacagcaattcagactgtacttacaccccacaaagtacacattacaaaaaatttgaaaaacaaatgaatacaagaggaagaaaactcaatatgcagaaaggggctaaccatgaactacaaattcctgaataccaaatcaggtggaacattttaaattactagcaaattcttaatgactctcaatttaattatgagaaatctgcaacctaataaagaggagaaatttaacatctgcacaatcatgttaaagggaagttagaacagtctattattctgaaaaaagcacaggctaccttcagcaccaagggaatgtgtagtattgcctgaagtatcttcttccttctcttctccttctgttccaactcttctcccttctcttcctccacagcaggagcagattccacgacattcccagaacactacacagcagaaggatataatcatgtgttcccagatagtttggacactttaatcagagcactctgacccccaacacataccaaccatctcttagccaaacttaaaaagtaaaatacctcacctttatagtgcttctttctacaaaaagcacctaaaagattacaattcaacatcctacacagaattaagtaaagaaaaaataaggcaccaacatactcgattttatatttttgagaagaggcagaaaaatcttgcattcaggagaattactgacaagtgcaagagaagatatgcattggatgagcacagaaagggctcaaaaaactttttaaaagttccagaagtattttagtaaaaaatcttaaaatacatatatagaaccacagagtccaaacaaattcaggtaaggagcttatatatgtatataaatacacacacacacacacacacacacaccacacactttttattttttacttattttttttttaagagacagagtctgggccgggcacgtggctcacacctgtaatcccagcactttgggaggcagaggcaggcaggtcacgaggtcagagatcgagaccatcctggctaacatggtgaaaccccgtctctactaaaaatataaaattagctgggtgtggtggcatgcgcctgtagtcccatctactcaggaggctgaggcaggaaattgctcgaacccaggaggcggaggttgcagtgagccgagatcgcgccactgcactgcgcctggtgacagagcgagactctgtctcaaaaaaaaaaaaaaaagagagagacagagtcgtctcccaggctaaagtgcagtagcacgatcacagcttactgcagccttgaactactggcacaagcaaactccatatatttttaaaataagttaacaccgaccaggcacggtggctcagcctgtaatcccagcactttgggaggccaaggagggcgcatcacgagatcaggagatcggaccatcctggctaacatggtgaaaccccatctctactaaaaaatacaaaaaaattagcgggcgtggtggcaggtgcctgtagtcccagctactcaggaggctgaggcagtagaatgggtgaacccgggaggcagagcttgcagtgagccgagatcgcgccactgcactccagcctggcgacagagcgagactccacctcaaaaaacaacaacaacaacaacaacaacaacaagaacaacctataaattcagcattaaggaaatgattacataatttcacaatctattaataacaatatcaccgttaaaaatgtttgaaacaaggccaggcgcaggggcttatccctgtaatccagcacttcgggaggccgaagtgggcggatcatttaaggttagttcaaaaccagcacggcaacatggtgcaaccccgtctctactaaaaatacaaaaattaggctgggcgcggtggctctgcctgtaatcccagcactttgggaggccgaaacaggcggatcacaaggtcaggagatcagaccatcccggcgaacaaggtgaaaccctgtctctactaaaaatacaaaaaattagccggcgtggtggcacgcacctgtagtcccagctactggggaggctgaggcaggagaattgctgaacctgggaatcggaggttgcagtgagccaagatcacgctactgcactccagcctggagacatggcgagactccgtctcaaaaaaaaaaaaatttaaccagtgtggtgtcatgtgctgtagtcccagctacttgggaggctgaagcaggagaatcgcttgaacccaggaggtggagttgcagtaagccgagactgccccactgcactccagcctgggcaacagaaaaagagtcttctccaaaaaaagaaaagtgtgaaacaatcaaatacaaaatgtgaacctgaattggatctagatgctatcaaccaaccaatcaataaaacaagacaaaagacatctttgagacaactggaaaatctgaactgtatacttaaatattatggaattattactttaagtgtgataacggtctatgattatatagaataatgtacttattcttaggggatgaatgctgaagtatttaagggacattatattaaggaaaaatctgatgtctgcaacttaaacaattaatcctccccaaaaagtacagaacacacacacacacacacacacacacacacacacacacacacacacacacaagaacaaatgtatactctttcatttcttctgtgggcttaaacttttaaaataaaaaactggggaatatgttaagttttaattgtcatgagaaaaattttcatgtttttaagcaaaacacagcaaacatacacttttactttccacatgatgtcaaccatataaatcaaatgaacaaaaaagagagaaaagatgccaaaatgtttacagcaattagcctctgggtggcaggattacaatgacatctttgcttccttgcaactttctacacaactaatatttcataaaaagagcattagcgtaactgtaataaacacaaaagaggtgaaaatataaatttgcaaagttgggaaccggacccaagcaagtgaaagaagactaagtaaagatttttacaaaagcaaaatagaacatttctatataactggaaggaccagataaatgactttgggaaacagagggaaagaaagttcagagcaaatattgcaaatggtagaaaagaagcaatgaaggacgacagcacaaaacaacacctttgagctcttcttagtttcttttggtgtttttacctcatgtccctgatctctaaatgtggtaggctccgtgagtccttggacctcttttctagctacattcacccacttaatgacccatccagactcatggtttagaatactacctatctgcttatgagtctgcaatttaaatcttggcctagacttttccctctgagctccaggcctccttgtccaattacctcctcaacacaccagctggttgttgaaaagatagcacaatgtttcatatgtttaaaactgaacttcccctctgcagtcttctctatcttaactgtcattccattactctagttgctcaaatcaaaaactggaatctgccaggcacggtggcatacatctgtagtcccagctacttgaagcaaaacaaactggaataattattacttccttcttgtctctcacactccacatctgatctgtctttgaaccccttttcaaatactcagaatctcaccattcttcatctgcttcaatcctggtccagccctatcaccttttgctaaattatgtcaatagtttccttgttggtcttcctgcctctagcctgtcctgctttcagtctattcttaatcaagcagccagagtgactctgttaaaaatctaatcagatcatgtccttcccctgctcaaaacccttaaatgtcttcctatctcactaaaaatagagccaaattcctcacaatgccttacataatctggttcccttctgacttctctgacctttctctcacttctcttagtcactccactacagccacactaacctccctgctatttctcaatattccagggacgctcatgcctcagggtctttgaacttgccattctccatgcatggatacacttatcccagataacagcaaatacacacttacttgttttttgttttttttttttaaatatggtctcactctgttacacaagctagagtgcagtgaagcaatcatggctcactgcatctcaacctcccaggctcaagcgatcctcccacctcagcctcccatgtagctgggatcaaggcgcacactaccatgcctggcttactgtgtattttttgtagagacagggtctcactagttgtccaggctgctctcaaactcctgggctcaagagatcctcctgcctcggcctcactagatttttaatcaaatgtcctatcaatgaagcactccctagacaccctatgtaaacttgaaccactttgttgcttcctctccccttccctgctatatttatctcttcagcccttatcacatctaacatactacatattttacttatttatcatatattgctataccctacacaagaagtaagctacattaaggtctaggatttttatttcttctgatcactttgtatccccaaaatcaagaacacctggcacacagaaaatactcaatagaaggtactttggccgggcacggtgggcatgcctgtaatcccagcactttgggaggctgaggcgggcggatcacgaggtcaggagtcaagaccatcctggctaacatggtgaaaccccatctccactaaaaatacaaaaaattaccgggcgtggtagcaggtgcctgtagtcccagctacttgggaggctgaggcaggagaatacgtgaacccaggaggcggagcttgcagtgagccgagatcgtgccactgcactccagccgggcaacagagcgagacgccgtctcaaaaaaaaaaaaaaaaaaaaaagaaagtactttggaggccgagatgggcagatcacttgaggtcaggagttcaagaccagcctggccaacaagtgaaaccctgtctctactaaaaatacaaaaattagccaggcatggtggcacttgcctgtatcccagctactcaggaggctgagggacaaggatcgcttgaactcaggaggtggaagttcagtgagccaagatggtggtgccactgcgctccagcctgggcaacaaagcaagactccgttcaaaaaagaaaaaagaaaatactcaaaaaaatttgtagaatgattagacaaatcagaaaagcatgaaataattcagattacagacaaaaaacagtactttagttaaacttttctccctgtctaaagttgatggaaagagaaaacaaaggtttaaatatattatttagaagtgtaacggagccagaagaattaaaataattaccatcaaaaattgagagggtgaaaacaaacaaaaaaaaattgggagggccgcggaggtgcctcacgcccgtaatcccagcagtttgggaggcgaggggggtggatcacctgaggtcgggagttcaagaccagcctgacgaacatggagaaacctatctccactaaaaatacaaaattagccgggcatggtggcacatgcctgtaatcccactacttgggaggctgaggcaggagaatcgcttgaacccaggaggcggaggttgccgtgaccaagatcatgccattgcactctgcctgggcaacaagagcgaaactcggtctcaaaataaacaaacaaataaacaaaaattgggagggtgttgctgagttaccccatctttcattatcgaactcaattgtattactttacatataaaacacatttatagttttacaatagtattagagtaggaagataacctcccaaagaagtaaaaccataaacagttaaagagagttgcctttggaaaagggagcaagggtgaggaaggactctctgcttttcattataagccctttttactatatttatttatttgtttttgaggcagggtctcactctgccacccaggctagagtgcagcgtgcaatcacggctcgctgcaacctctgcttcccaggcttaagcgatcctcccacctcacctcctgagtagctggaaccacagatgtgtgccaccatgcccagctaatttttttgtattttggtaaagacgggatttcaccatactgcccaggctggtctcaaactcctgagctcaatgatccacccgccttggcctcccaaagtgctgaaattataggcctgagccactgcacccgcctataagccctttttaaagtaaatgacttatattattctgttaaaaatatttaacagtctcaccaaaattaaaaattgctccgtgaaaaaccctatgaagagaaagaaaggatagatgggagaaaatatttgcaaaatacatattctacaaaagactagtatctagaatatataagaactctcaaaacacaatagtaaaaagacaatccaattagaaaatggacaaaagatatgaaagacatttccctgaagaaaatgacaggcagcaagtaagcacatgaaaaaatcctcacatcattagccattagggaaatgcaaactgaaacaacaatgaggtatcactacagacttgaatggctaaaataaaaaatactgaaaacaccaaatgccagtaaggatgaaaaaaaattaatcactcatacattgctggtgggactataaaacagtacggccactctagaaaagtttggagtttcttaaaaaaacaaacatgcaactaccatgacccagcaattgcaaatctgggcattatcctagagaaatgaagacttatgctcacagaaaaacctgtacatatggccgggcacatgactcacacctataatctcagcactttgggaggctgaggcaggcagatcacctgaggtaggagttcaaaaccagtctgatcaacatggtgaaatcccgcctctactaaaaatacaaaattagccaggcgtgatggtgcacggctgtagtcccagctactcaggatgctgaggctgagaatcacttaaaccctggagtggaggttgcagtgagctgagattgcattccagcctggggacagagcaagactccatctcaaaaaaaaaaaaaaagaaaagaaaaacctgttcataaagcttataacagcttctcaatagtagtcaaaaacaagaaaaaaaaatgcagatgtccttcacagatgaatggttaaacaaactgtggtacatccacggcatggaagactactcagcaataaaatgaactattgatacatgcaaaaacatggatggagccccagaagttatgctgattgaaaagccaatcccaaggatgggcatggtggctcatgcctgtaaccctgcattctaggagatgagacaggaggattgcttgagcccaggcattggagaccaccctggccaatacagcaaaccccatctctacaaaaagttaaaaaattagttgggtgtggtggcatgtgcctgtcgtccagctacttgcgaggctgagatgggaggattgcttgagcccaggaggtggaggctgcacaaccatgaccttgccactgcactccagcctgagcaacagagtgaggccctgtctcaaaaaaaaaaaaagccaatcactaaaggttacagactgtatgatcccattttatatagtatttgaaatgacattttacacatgaagaatggattaatggctgccaggggtttgggtgcaaaaacggaggtaggtgtggctataaaagggcaacaataaacatccttgcagtgttagaactgatcttgactgttgtggtgaagacacaaacctacgcaggtgataaaactatgtaaaacttatacacacacgcatacacacacacataaaaagaagtaaaacaggaaatgtgaataaattggtggatttggccaggcaaggtggttcacacctgtaatcccagcactttgggagactgagcaagtggatcacttgaggtcaagagtttaagaccagcctggccaacatggggaaacccatctctactaaaaatacaaacattagccagcagtggtggtggacacctgtaatcccagcactcaggaggctgaggcaagagaatcgcttgaacctgggaggcagaggttgcagtgagcaagatcacaccattgcactccagcctggggaacaagagtgggactccgtctcaaaaaaaaagtgttttgaagagatttcattcttttggaatcaactccaaattctttccagcttcatgcctatgcacacacagttcattctgtttggacagctcctcctttcatactgcacatagaatgtgcagctcttcaactatgccctccaagcccttcaactatgcctaacaaattcatattattgtttagattgtattccacaaagaggtgtccccttatccttctgattacgttatattattttttctcctctttgcaatgatcacagttgtaatggaatagctactgatgtaatgatcatttaacatctgtctctcctattaaattataagctccacaatggcaaaagcccctttaagcacatgccacagtgcctgcacatttatttaacatgaaaagaagtagcatgaaactttcaaatagcattgcttcattcacaatgagggacgtgcatacttcctgtccccactggctaaaccaggatgctgagccacaaaaacatagataagcctggcacatgttcttaaagaggtccataaacttaaatgcccacagaaatcaaagcaagataacatagatgagtgaagcagctggtgtaagaacaaaagcacaagcactatgataaatgacaaaagaacacctggcctcagttccaagtacaataatgaattgtagtgactatggcaaatcatagcactaatgctccatctagcagaggctgactgctactcataactccagccaactgttgccaacagaaacaagaaatccagaagctggaagtctaagttttatgagaaatttccccattctaaaattctgtcaattattcaaatatattaacattttaccacctatgtaggccaaataaaacacttctgcaggcccaatgagcccatcggtttgcaggttgttctaaagcatttattttacttgatgatttgtggaaaaaaaaaattacgtacagacacagagtgtaaaataaaacacacctccaaaaaagctttctttttgagacagggtctcactctatcaaccaggctggagtgcagcggcacaatcacgctgactgcagcctcaatcttccaggctcaagtgatccttctatctcagtctcctgaatgctggggctacaggcacggaccaccatgccctgctatttttttttttattattttatttattttgagacagagtctcgctctgtcacccaggctagagtgcagtggcacaatttcggccactgcaacctctgcttcccaggttcaagtgattctcctgatgcagcctcctgagtggcggtattacaggtacccgctaccacacctcgttaatttttgtatttttaagagaccgggttcaccacgttgtccagactggtatcaaactcctgacctcaggtgatccgcccacctcagctcccgaagtgctgggattacaggtgtgagctaccacacccagtcctttttttttttctttgtagagacagggtctcactaggttgcccaggctgatctcaaactcctgggctcaagtatcctcttgtctgagcctcctaaagtgctgggattacaggtgtgagccactgcgcccagcaaaaaccatttctttttaagaaaaaacaatagtctttaaccatctcaagctaacattccctctctaaccacctcccctttctaccaccccaaaactcctgaagttctctacattctcttggaccttagaaatattggggcggaagactgagaagcactgattagttagaatgaaagggaggcattagagtcattaggaccaggttcaaagccagctctgccacttactagcaatgactctaaagcaagttatctaatttctttgtccatcaattttcccgtctatacaatggaataatgtaatgtcttcatcgtacagctgctttaagaataggattaaataacattatactaatgccaaacgtccaatacaggacctaacacagagcatgaactcaaaaaatgggtattataagatatgcaaaagacatggtaacaattgaatcttgtttagggtaagaattaaacattcagatctaaaactggtggggtacttcagttgatagatggaaaacatgcctaatagttctgtaatactcctaaattttttttttttttttgctgagacggagtctcactctgtcactcagctagataaagtacactggtacaatctcagctcactgcaacctccgcctcccaggttcaacaactctcctgcctcagcctcctgaatagctgggattacaggcacgcaccaccaggcccgctaatttttctgtttttagtagagatggggtttcaccatgttggccaggctggtctcaactcctgacctcaagtgatccatccgcctcagcctctcaaagcgctgggattacaggcagagccaccatgcctggcccctaaatactttttaataatttttttctactaggaggaatgttattttgtttcacatgcacaagacagatcatgatttgaataatgtaggtataaaaattttaccttcacaaaacagtttccagctatcagtactattacaatactatctaatacaacctcaagtcccatttcctaatccacaagaaagagattaatccttttatccttgggatgaggaacaggtacagataaaagaacaaatctgataatacatttaaataaaccccttcaaacacgtatacctgcttgtcctgtttggctgaggtaactgctcaatgacctgactgatggaacccatgtgtccaagttagaagaatccacagggtctgaaaaaaataactggatattagcatgaagacatttaccaacaaactttaatacaaaatcaggaatacagacaataccaatctaatagtgacactagcacatcaacttttgagtgactactacgcagataccacagtaggcttcctacatacattcgacacaaccacataaagtttaaatccacccagcaccaacaagagcaccaaaaaatgcaaaggggacagatagctttaaacacctcacctgcaaccttgttttctttcaatgttcattgaacccactattaccgtctcctcgttcttctccagctgtttgttcaggatggacacaacatcctagaaaatacacatacaaaatatccccattatatatgaaatagttaaaatgaaacctactatttgtgaacaatttttccaatcaactttattgagaaggtaatgtcttctaaatacttatgtttgctggttttcggtttaaaaaaaaaaatctgctcaatcttttcaaacaaggtatcactcaccaacacaggattttctttgtgcgtctggagattaggaagtgtcgagatagcatactgaagtgagaaccagaatcatcctctagaacctggctttcagctgagaatcttcaattatcaggcaaggagtatcttgctgagagaaatctgaatccaactacttccagtagggtccatctgctcccctggaatggaataacaaaagatcagttccgtgtacctactagccttgctcacgcagtctaaacctaaataatggggcggaagtacaagagctggaaacgggaccacttcaggactcctccaattagaatattatatttataattgctgcaacactttcctatcatgcctaccaagtcaccattcctcgttatttacaataagcctgactaccctccctatttttcatcaccttctcgtagacaccctttcccctccttcctaacctctttctccccgcccctttttccatcccccccgccacgtccttctggcgcctctacctcccccaaaagaatgttttctaaaatctgttcgccagaggccccacagcctttcagctttcctcagaccaccaagccttcttagctaacgtttccccaccccctccttagggccctccaacccctccccgtcaccgccgccatgcttgccaccccgccccctccggtcagccatcccttcagaccgaaatccaggccttcagagcccactgcactcccatttctctccaaacagtaccaggctcccggcgggaggtccctcgcgctcgagctagaggtctctgcacgctccccaagtccctcagatcgatccctaggtcgccgctgtcgccaccgccgccaccggccgcgaactcccccttcccgtcacgtcacacaatatcggatcgtccattcgctgccgccgcccgccactcaagaatcccgtggatgataggtagctgcggcagagtgccctgccccacgtaagaaaaaggaaccggcggcgcgtttccatggcagcatggacgttgcaggccctcccctttagtagagccgggaatgacggtatccttgaaccgaagggaccttgagagggcgtgaaataccttcccctgctccaggacgattgcatttaccactactcagacatttcagtacctctacctgctttttctgttcacgccccttaatccccgtccctcaccctctttcctggaaaaggagagagtttcccgctttctcataacagggcaaagaagaagcggcttgaggatggctaggtacttcagagctgtgaacccaacagaagagactctttcttctttgacacagggttaacctgtgtcaatcagatcccttttgtgggcctctaccctgaatccaagggcctgacattacatctctgccaggggtttttagtatttgtttgtttttacattgtataagggctccagtaagccatatttcttccattgcccttttccgcctaggacgtatttcaagcttcacacttgtttatcgttgccttacttttatgggattgcctgcagagactacagccccagacatattttgcacctcccattgaagaattgagcactgtcattctcaaactccatggtaaagagaacagctgccaccccttctactagatgacctcaaagatacttccaaacccagagattctattatcctaattatggtgcagggtcttaaagagggtgtggcagctgtgacgagtcttaatgaactaagccccatgtggatatgtgtttgttttgttgttgttgttgttgaggggtgggggtatattatttaagtggcgttggatccaggatagaattctagccagagcagctgtcaatagggaaagcacctagcacgtgccaaacatatacatagtaggcattcaatatgaggcagttttctctttctaccccagctcagatttatttcggcacagcccaaccatgattctccatttctgtaaatgcccaattcgcacgtgatataggcaaagctgaagtggagcttcctaccagtcttctcactgctgctataattacagtgatcctattttccaaaccaaattcaaagcatgttgtctgaatacacgttattatgggaacaaaaggactgactccttgaaactgtcctgaaaaatctagaatctattacgctataactggaatataattatggtcgccagtatgttttattagtggagctaaaatgaatggaccacacagagatgcatctcacttcttaatcttaaaatcatttataattgactctttcatactccactcctaaagctgcagaacaccagtgactaaacaaatctaatacttaaagccaggttagagcaatactaactacactagctggacaaagtgagttcatctgctctatttagagggcacaaccaaccaggtcctgttatgagtaaatcatgaccttgagtcccataaaatcccccaaaagttaccatttttttgcttttcttctccagcctgcttctgcttcctccccagtgaggcacaaataaacagatctgtttgattacttgacaagtgtgtttgtcgaaacataaatggctgggcgcagtggcttacacctgtaatcccagcactttgggaggcagaggcagtggattacttgagcccaggaatttgagaccagcctgggcaacatggcaaaagcccatcttaaaaaatatacgaaaaaaattagctgggtgtggtggcatgtgcctgtagtcccagctatcaggaggctgaggtgagagcatctcctgaactaggaggcacaggttgcaatgagccaaattgcaacactgtgctccagcctgggcaagagagtgagaccctgtctgaaacaacaacataaaaacctaaaaaccgccaggcgcagtggctcacacctgtaatcccagcactttgggagacgaggcgggcggatcatgaggtcaggagatcgagaccatcctggctaagatagtgaaccccgcctctactaaaaatacaaaaaatcagctgggcatggtggtgggcgcctgtagtccagctactcaggaggctgaggcaggagaattgcttgaaccctggaggcgtaggttacaggagccgagatcgtgccactgcactccagcgtgggcagcagagtgagactccgtcacacaacacacacacacacacacacacacacacaaaagccaggtgcggtagctcacgcctgtaacccagcactctgggaggccaagtcgggcagatcacgaggtcaggagatcgagaccatccggctaacacggtgaaacacggtctctactaaaaatacaaaaaattagccgggtgcgcggcaggcgcctgtagtcccagctacttgggaggctgaggcaggagaatggcgtgaacccggaggcggagcttgcagtcagcagagatcgcgccactgcactccagcctgggtgacagagtagaccccgtctcaaaaaaaaaaaaaaagcctaaaaacctcagcctgactaaaaatagataataaatgagtgagccatttgcattactaaacaagaatcttaaaaaaaactgttaagaaaactattaattccttgttaggcagtgtggcaattaaattaatcattaaattatccagaaaataaactacaggcagaatggttgcagctagatgagccaaaggcctttattgactcctaactgcaaaggaccaacagcacatctacctgtctacaggtaacatcttttcctaaaccacttagacagagaaatctaacttacctctaaagccctcccagagaaggctcatcagatcttggttaacttgctttaaagtttaacaaacctcattgtcagaaatttttcttctaatattatcttctaatcttctaacctaaatcctttattatagaatttaaagccatttcctctcatatgtctttaactgctatctttaaaacctagatagatgtcattaagttgggatcatctcattggtcctataattatataataaatttcaaaccatcaaacaacaaatctaaatactatatacttagtttgtgagtatttttctgaagcctcctcaaagacttcttaagcaaaagaacccagcccagcttattcttccctcacaggtattccaccaacctttaaagttgcttcacgatctatgaaaactcatagttttggagctcagtggcagagtactctactgaggagaattgacagtgccaaatttaatgataggaaaacaatcatatattccttttttttttttttttttgagtggagtttcactctttttgcccaggctggagtgcaatggtgtgatctccgcttacggcacccctgcctcctgggttcaactgattctcctgcctcagcctcctgagtagctaggattaaggcatgtgcaacacacctggctaattttgtatttttagtagagacagagtttctccatttggtcaagcaggtctcgaactccggcctcaggtgatccgcccacctcagcctcccaaatgctgggattacaggcatgagccatagtgcccagcctctcccctctttgtatagaagtatcaaatcttcacatccaagtatcatctcctgtccactctacttctctacgtttgcagtcggcttcaacctccataaatctaatgcctagcacaatgccagacacaaagtagttactctaacatgttaatgactgattctaaaattttcttgtcaaattacctcattatcagccaggtcggtagctcaagtaatcccagtactttgggaggccaaggcaggctgattgcttgagctcggagttcaagactagcctggccagcatggtgaaaccccgtctctattaaaaatacaatgtggtgtgcacctgtattcccagctactcaggaggctgaggtggaagaatcacttgaaccgggaggcagaggttgcagtgagccgagatcgcaccactgcaccccagcctgggctacaggtgagactctgcctcaaaaaacaacaacaaattacctcattatctttgacgtctgtagttctgatgctgttgccattccctcctcaaaattctcatcctgtgactcgataaatcctggtcttctctaccatctcagctttctttccaattcctaacttcctggaagccagtactataaataaaaatcgagagtgatatgaacatgctcaacacagatgaaccttgaaaacattatgtaagtgaaataagccagacacaaaagaacaaatattgtgtgattccacttatacgaggtcctagagtaggcaaattcagaaagagagaaagtagaatggtggctgccaggagctaggagagggaggaaagggaatttattgtttaatgatttacatagcttcagtttgggaagatgaaaagttctggagatggatggtggtgatggttgcacaacaatgtaaatgtacttaatgccctgaaccatacacttaaaaatggttataatggtacatttatgttatgtgtattttactaagtaacaaaagtttttcaatgagactaaactttaatatttaaagatgtgtacttagatctaaaaaattttaataacaggattgcaataaaagaatgtatggttaattgtataggtaacgtggggttgtaattcattaagaggcatgtgaggtgcttggaaatgttctattttttattccagaggcattacacaggtatactatttataattcataaatttgtacatttatattttatttattcactttatgtgtgctatgtttcacaataaagatgattcaaaataaatatcattatgctaaaactcataatatggtgaaagagggtatatacatgatctcaaagtatctccctaaatgtactgaattattacaaagagaaaagtggtaaatttgcagtgaagaaacctggtatcaccaactcaaccaagtgatctcagttaatataccagtaagggaacaaaaagccatcttgtcacttgatataatgcactgaggatatatcacactttaattgtattcttgccaaaaactataacctgaatctgatcatgagaaaaaatcagataaatccacattaatgggtgctttcagataaacagcccatattctccaaagagaaagagagagagagagaaagaagtgctgccaggtcaagaatgacaatcaaagtctcaagaaatgttctagatttgagaagactacaaagcaaaaccattaaatgtaacagatgatccagaactgaatcctggacaagaacttggtttccttcttctataaataattctaatgggagcactgttgatatctgaataaggtctgtagatagtaacgaatcaatgttattttcctgatcttgataattatactctggttattaaataaaaataaagaaagagaatggtaccaaattatccaagattggagctgggcagtttggtactagcaaaactaaagaaaagttaacctgcacctgacataggaacagcatgaggacaagagaagaatatacttagagactatggaaactgccagaaatcagacccaggatggtagaaggtgaaaaagttcattttgcaaattaaaaacaacaacaacaaaaaaaaaaaaacaaaacaaaccgttactcctaaactcttatgtttcaatggaaagaagggagtttttatgtcctggggctggaaatctaaaaagaatataagagaagacttcagtggacaaggacaccactgtgtcctagggctgagctgtgaaatagttactcatattctgaggtagtgtgtgtacataaagtaacgttacgtacaaagaagggaacaacagactctggggcctacttaagggtggagagggggaggggatgagaatcaaaaactatcagttactatgcttgttacctgtgtggcaaaataatctgacaccaaaccccgtgataatgcaacttacctatttaacaaacctgcacatgtacccctgacctcaaataaaatttaaaaaataataataaataataaagtaaaagtaacatagcatgacacagtgcctactcttggatcctacttcctgtgtcattattaccctttcccattctacttgagcatatcccttctgcagtgtcttcagtacagctaggtctcaaaggctgatctggactgtacagagctagtgtgctaactaacaagtggcaagaatagcagtaatgcatcttggcttactcacatataagcacatcacacagagtctcaagaactgaaagtcagagcaagtcagaaacccataaaactgaccaaaaatttcttcacaaactcaggttcatttattaatttcaatcacttaaatgcaaggtaccattttggctccatggtggtggtggagagagagcagtgtataggatgagtaatatctagtttctagcttcaaagaatttacaatctaggaaggagataagcatagaaataatgatagtacaagatacaataaaagttctgtaggaattgtgagacaaatgaaataattttagtcatgtggttataatgaatacttcttgagcacttactatgttctaattctatttactctcactcctttcttgatttcatccagtcacattgctataaatacaatcatatgccaatgactcctaactacgtctttgacccacacctctctcccaaattaccaattatgtatctaactgcctattcaatatcttcattttgatgtccaattgacatctcaaattcacatgcttaaaattgaactcatctcttctaccaagtctactccacctgcagccttcccctctcagttgatggcaacttcacccttctggttgcttataacaaaaagcttgaagatacttctttttattaacagaaaaaattttaaaagctatgtacttatataatacaccttcaacattagcaacaaatgctcaatcttcttttgttgaaatttttttttttcaaacaaatgctcatcttatttcatctatatccacccacttcccccaaactgatttctaaacaaatcccagactcatataattttaaccaaaatacttctgtgtctaaaatatagagaatattttaggccagcttggtggctcacacttaaaatcccagcactttgggaggctgaggtgggtggaccacctaggtcagaagtttaagaccagcctggccaacatggtgaaaccccatccctattaaaaaaacaaaaattagctgggcatggtggcgagcacctgtagtcccaactacttgggaggctgagcaggagaatcacttgaacctgggaggcggaggttgcactgagccgaaatcacgctgctcactccagcctgggcgacagagtgagactctgtctcaaagaaataaaataaaataaagaaatattttaaacataagaacaccgtcaacacacccaaagaaaatgaacaggccaggcatgtggcttacatcccagaactttgggaggccaatgcaggaggatcacttgagctcaggagtcaagtctgcagtgagcagtgatcatgccactgcacaccagcctgggtgacagtgacagctgtctaaaaaacacatatatataaagttaaattactgtattttaaaatcacttaaaacatactaccaattcaatagttaggcttgtttctttcattttgttttttatttttagtgacgatatttttattgaggtaaaatttacatacagtgaaatctatagctcttaattgtgtaatttttttttttttaagagacagggtcttgctctgtggccgaggctagagtgcaatggctgatcatagctcaccacagccttgaactcctgggctcagctcctgggctcaagcaatcctccagctcagtctcctcggggctgggactacaggtatgcaccaccacacctggctaattttctttcttttgtagagatggggttacactatgttgctcaggtgggtcttgaactcctggctcaagcaattctcccacctcgacctcccaaaatgctgggaacacaggcatgggccacctgcttggccagtaatttgatgagctttgacaaacatatacagccatgaaacctacatataatcaatatatagaacattgtcatcactccagagagttattcatggtcccttccagtcatccccattccacaaggcagtcatattgtaacttctatgaccatagattaattttacctgaatactattttatataaatggaatcacacagtacgtggtcttttgtgtccagcttctttgctcaacattttgcatgttgctgcatgcatcagtacttcattctttttcattgctcagcacattcaattgtatgcaacacaacttgttttattaattctcctattactgcatatttggtttagactattataaataaagttgctatgaacatttataaacaattcgttttgtgaacattgttttcatttatcttgggtagataactagaagtggaactgctgggtcataggatgtggctcctttcactttataagaaactgccaaaaacagtttttgaaaatgactgtaggccactgcagtggctcgtgcctgtaatcccaacattttgggaggctgagttgagaggttcgcttagccagaagttcaagaccagcctgggcaatacagggaggccttatctctacaaaaaaatttttaaaaattagtcaagcatggtggcaccagcctgtagtaccagctactagggaggctaggtgggaagatcaattgagcccaggagttcaaggttgcagtgagctatgatcgcaccattgcactccagcctgggcaacacagcaagactatgtctcttaaaaacaaattaaaaataataaataaaatgattgtataattttatacttccactaacaacatattagtttcaggtgcccacattctcactaacatttggtttgtcagtgtgaagtgatatctcatgtttgtttttttctcatttttttttgagtctcactctgtcacccaggctggagtgcagtagcgcgatcttgctcactgcaagctccgcctcccgggttcacaccattctcctgcctcagcctcctgagcgctgggactacaggcgcccgccaccacgacctattttttttttttttgtattttttagtgagacggggtttcactatgttagccaaaatggtctcaatctcctgtcctcatgatctgccaccttggcctcctaaagtgttgggattacacgcgtgagccaccgtgccctgccatttgttttttcttgaggcagagtctcactttgtcactccagctggagtgtgatggcatgatctagctcactgcaacctctgtctcccgggttcaagcgattcttgtacaacctccca

SEQ ID NO: 5073 - DNA, 25891 bp, Homo sapiens
cctggatattacatgtaaaaaaataaatatagacacagaccttacactatacacaaaaataactcaaaatagattatattttggacctaatggacctagacataaaatgcaaaactgtaaactcttagatgatacagaagaaatgcaaatgaccttggatttgacaatgacttcttaataaaataccaaagaaattactgataaatgaaacttcattaaaattaaaagcttatgcttatgaaagacactgtacaaagaattagaagatgggcagcaaattgggagaaaatgtttgaaaagacatatctcataaaggactataacccaaaatacacaaaaaaatcttaaaatttacaataagaaaaccaacaacaatatttaaaaatagaagatatgaatggatctcaccaaacacatacacaggtggcaaataagcatgtgaaaagctgctcaacatcatgtgtcattaggacttgcaaattaaaagaaaaatgagatatcactacatacctattagaagggcaaaaatccgaaactgagatcaccaaatgctggtgaggatgtggagcaacaggaattctccacacttctcttagccaaaaggccaagaagtgatagcagcaggaactcttattcactgctagtaggatgaaagtggtacagctactttggaagacagtttggcagtttcttacaaaaattttatattgatccagcaagtatacttccttgatacctatgcaaatgaattgaatacttagttcacaaaatccttcacgtggatgtttctaccttctttatgcataattgccaagacttagaataaccaatatgtccatcagtaggtgaatggataaataaactgtggtatacccatacaatgaaaactatggttattcaacactatatgaaaagacatggaggaaactcaaatgcatgtgagtgaagaaatcaatcagaaaaggttacatactgcatgagtccaactgatgcaggacaagcagccccagtattaagtcttagccagggaaggtttttggcttcacccagaaaagaattcaaggtgggctgggtggtattaaataacaacttttattgacatggcagaagtactgttcctttggagcagggttaccccataggcagtggtgtgcagggtagcagctcagaggcaggtttgactcatattcaaccccacttttaattatatgcaaattaatggtagattatgcagaaatcataaaatgagggtggtaacttctgggttgatgggttgttgcaatggaaagggggcagtacttctgggtgttgtcatggcagtggtaaactgacatggcacactggtgagcatgtgttaggggaggtgcttctgcccagacctgttttagctagtccttaatttggtccaatgtctaacccacctccagagttgagttccccttcctacctcacaacaatatgacattctgggaaagcaaaacaatggagtcagtaaaaagattagtggttaccaggagttctggggaggggtagggaataagctgagcctaaaggaattttagagtagtggaactattctgtatgatacaataaggtggatgtatgtcattatatgcttggcaaaacctacagaatgtatgacaccaagagtaacctcatgtaaactgtggactttgggtgatgatgtgtcagtgtaggttcagtgatgtaaaaatctaccactgtgctacactatgctgataagtgggggaggtggtgtgggagaaggggtacatgggaactccctttactttctgctcaatttcgctgtgaacctaaaactgctctaaaattaaaagtctattaaaattaaagtctaaataaagcctattaaaaataaatatatatattaacaatgctgcacctcttattttatttgcaagaaaaagtaataggccttggggaataaaaaatatactaacaagatttgaactaaaacttttgcataactgaaaaatgattatcaaattcagtaagcttggccaatgacatgattcttctatttggacccctgtattatttaatctataattttggtgaccattaatggtggttattaatgcaggatatgcaggtcatacaatgccattaaaaccaaatatcaaaataaactgaattttgagccagatcttcaaattgttacatttcataaaccatgatttccaaaaggaataaagcctatttgaataggcacatttaaataaataagatgcacgcttaatttaaaaatgaatgacatacattttgggggtatttggggcagcatttttaaccctttttgggagtgtgtgatcaaaaaatttgtgagctattgattcagaggccagacgcactagtaactaaatagtcttattgtcgagatcaatgacaaagacatgaataaggggcatttggagcccagcaaagggtcatttcttgtttttgctctgggagacatcacagcattaacatagagcttttatttacttttattttaaatacaaaacgttcatgggccacaggaaagcacgtttgcctaacaatttgaaaatgcccacattttggaattgaggtcttttcctgtatataatgttctttactttttgcaacatgtggttaatgcaaaaataatatttactaagggacaaaaattctttcagctatgccttcttggctggtcccttacccagcctttaaatttattcctgtctcccactttctgtttatttcccccagaaacaaaaggaaaatctttccatccatctgtataaggggcccctgataacacattaggcagtcactctcttagggagagagaggacaataaactagaaaatagaattgccatgtggaatagtgctgatgcatcttttcttacattttgcaaaggttgtaaggtactaaaatcgtggatttttagcccagggagaaacatctaatctagtctccttattttaaagatgaggaaatttagtctcagagagttttagtgcttagccatagaaccatcagtttgatgtagctcatggattatagtctaacactttcactacaactggggacactcaagctcaacaaattaagggacttttctaagattacacagccaatggggggtttaagaggagaccccggtgtttggacactcagaaccctgtgctggactgaagccccttaatgaggtaagatagttctgtcaaaagaaatgagggctgagaagaagtagatggtgagatccatcaggtcatgaagtctcagttcgcatttcctcattgtatgaaaaagatttggctggcctttatctcaccgtacctgggaggtaacctctaggcccttgaaatttcccagtgatagcagtgtccgttactcatggtgggcccttcagactacatctgatactttttctaagaggtcctgttcctgtcttatgtctcttaacataatgtccttcagttctatccatttgcagtgagtgacaggatttcagtcttttttatggctgagagtattcttttttttttttttcccagttggagtgttgctctgttgcccaggctggagtacagtggtgcgatcttagccactgcaacctctgcctcccgggttcaagtgattctcctgcctcagcctcctgaggaacgggactccaggcgcccaccaccacgcccggctaatttttgtattcttagtagagacaggtttcaccatgttggccaggctggtctggaactcctgacctcgtgatccgcccgtctcagctcccaaagtgctgggattacaggcgtgagcctctgcgcctgctatggctgatagtatttattgtctttatccattgtctttatccattcctccattgttggacactgaggttggacatttggttattgtgaataaagctgcaataaacatgggggaacagatgtctctttgatatattatttcctgtcctttgaataaatacccagtagtgggattgctgggtcatatggtagtttatttgtagttttttgtggaacctccatggtattccccatagataaatgtttgagatgaggatatgccaatcttgatctgatcgctgtgaattttttgtatgacaacatcactatgcacccataaatatgtacaattattacatgtccattaaaaaaatttttttttcagttccagtagctgccctgtttggcagttttccacactatagtgagaaggttacatctttggggatgaagaagcttcaggtggggaactttcccagacctcaccctatgcttctccctttggctggtttgatttttatcttttggctaaagtaacattgtaataataagtacagtactttcctgagtctatgagtcattctactgacattacatctgaagaggtagtgggagcctctgagtttgcgccagctggtgagaagggagtgtgacttgggagctctgggacctgtggctgctgtccaagtgaggacagttttgtggagggcagtgcaggtaacctgcaaagtttgcttaaccttgcaatttgactttagaagtcattggactcgtgttcctaagattctaaaactttggggagtaagacagaaatgagtttgaaaatacaaaggttaaaaccgtgagatattttgctttactttcccacagaaactcattttctctaaactccagcctttaccgcctcacgccagctgcactcaaacagtttcccaaggctcccagccatgacctgttctttgaaacatcccagtgcagaacaaacacagacttgttttgttttgttttctgctggggcagaaattgggcaagattgattattagaaagcaagataaaaatcttttagtaacttctctcacgtaggcaaaaaagcaagccaccagcaagcaagcaagcaagaaaaaaaaaaatcacctaatttcttatcttgggtaactgtggtttgctttttgccagacaaattcagggattacttgaacgctgggttgagttcacagcaggttgtctggcactcccctcttcaggaaatcagtctcgtcctgctttaattacctcttggaacaggcaatttttgtgcccaggcatgaattctggaagacagagagaatggaatcatcaagataagccgaactaggatgttgaaggcaggaaagtgcaggcgtgtagcaagaaccagttttacaggaaactaaaggttaatattattgtcactgttattagttttgttttacttgttttgtttattgtgttggatttttttttttttttttgagacagagtctcactcttgttcccaggctggagtgaagtggcatactctcggctcactgcaacctccgcctcctgggttcagcaattcttgtgcctcagcctcctgagtatctgggattacaagcacgcgccacacaccagctaatttttgtattgctagtagagacggggttttaccatgttggccaggctggtttgaactccggacctgaggtgatccacccgcctgccaaagtgctgggattataggcgtgagcactgtggtttttttttgtttttttttttctaactttagatgggagtcttgtcatcaaaataaatacaattgcgtggagctgcttaaaatctgaaaaccaaaaataggaaggcaggggcaaaaagttattttaagaacccccccaccccctccgcctccctgccgcctcccaatcacatcactcctggggctcagcggggagcaggaagcacgtttggttatgccatcttggaataaaagccatggctggatggatcggatccgcttatgatgcatgtagagccgaacttgaacatacaccagctgggggaggggggaagagggggagggggggttgctggggaggcgccgcactattgctgctgctccttcgttctgtagagggcactgccggccctgaaccactcgatctcctctcgttgaaggtgtggttcaggaggttgatttcctggggtgcttgacgatgtacttcagggcttgccagcgtcaagtccttcaggctctgaatggtcagcttgtccacaaggtgaatttgttgtcagctgggtcagcgaaggtcaggggcagcaggccctgcctcctcaggttggttcgtgaatcctggcaaagctcttggtgatgatggcccggccccctgaggtggcgaggctcagcgcggcgtgctcccagcttgagcccttgccatagttctagtccccaatcaccacccactgatgccatatttcttgtagcgggcagtgtcagggaaggggccaaactcgtgggtgaagcatcgtgcacagagttggccttgccattttcaatgttgatggcaccactgagcaagtgttggagatggtgtccaagtgcccacggaacttgagtcaggggccggcagctgagatgtgtcagtggtaccccatgcgggggtgctggtaggtgtcctgccctgggccaaactctgctggggaagctcatctgcatccggagcctccagcttgaacttcttgccatccttgcctgtcggtagttggtctctgggttgaacttgagggttcccacaatggccagggctgtgacagtcctggggatgtgatgaaggcatgggtctcggggttcgtgtcattgtggcccatgaagttctgttgtaggaggtgacaattatgttcttctcctgcttgttgatgtcctttctgtgcaacgaccaatgcaggggccacaagcattggccaggacgatgccacccacatccctcaaggtcgtgcatagccatcctgctcaatggaggcacggatctgctcggagcatggagtaatagtgactgggacttgcacttgaggccatgggccagtgcctgcttggccacacctgctgagcacccatatcttcatagcttgaattggtgcagctgccccacagacccactcagatgtccagagccattcttccttctctgccaccttgcccacttctgccacagggtgagccaggtcagggtgaagggcccattgatgtgcagcttcagttcactggggttaacttcaattagttggtcaaatggcacccagggtcaggcaccaagtgatctttgaattcatcagctagattggcaatgctgcctggcaggtcttgctcatgtacttcttcatcctgaggttgtaatggaacacggaatggttgtcccaatttctaagcccatgttgcagactgtcaccatgccagtgcaggagatgagtctacaacaggcccgtggtattccacgattgcacctgtgccacctttcatggtgaggtgcctgccaccttcaggatcacatctttgggtgaggtccaaccagagagggagcccatcgcttcacgccaatcaccttggggcacttcagctcccaggggatcccagtcatgacatcccagctcggcacccccaactccaatgcagatgccccccaggctgccaccattgggggtgtggagtcagtgccaatcagaagaaccccaggatattcatagttttccagaataatctggtaatgattccagatccaggcttccagaagctcaagccatatttgacacttccagttgccagaaattataaacttcgtggttgatgtccttggcctggtgcaggtctttctcactcccgactgggcctcaatcagatggtcacagtggatggtggatggcatggtcaccttgggagcctctgctgatgaactgcagcatggccatctgggccgtccatcctgcatggtcacgctgtccgccactgctgcaggtacgtcccgccccgctcaatttcctggctggtggggtcatccggggtctgtacacgatcttctctgagagggtcagaggccggttcaatcatttgcaaacaatgtaatgttcttctctagcaggtcatagtggatgtacttaggctcaaagggtctcatcgccccttggcccgttggcacaggactgatgccacatggtactgccgcacacccagagctttcgcagccaagtaaccagtaggctgtagggcaccattttgtgcaaagatcgggtcacattgcaaagacgggtcacgtctgtgtttgttttaaaagagaatatattgtatctacaaggtctgaaaatgcagtaagaaaatggggtgaagatgcttccagcatctggaagagggtaaatcttggaatcaggcactcagccagcactcactctgacttcatcacctctttcagctggatttctgagctcttccctggcaggccaaacccatgaaagcagacggcgccttgggagcttgattcttccaactgtcagggcatgggagtcattctgccattcttgtctcacagcaggagtactgaagagaaccctggcccttttggggaggggggtttaactaggcttgttcttacagaaataatgggctgataggggagattctcttcttcttcacaatttatgtcagatgtaaccctaactctctgaaagataacaggtttggtaattagagatgaaggaatttaattaatttctaaagtatttatggaacaggtactatatatctgacagtgagctgagaatacagaacagagggagaataagacattgctagcagagtgatagtcaagcaggtgaataattatcatctcatatataagagctatagcagagacatgtgcaggtaccatgggggtagaggtgaatgtccgattcacagaacagagacaatggagaaagaagagaagaaagcatctggactggagataatctgcaacgtggaaagggcagggtttttaaagtccatcagattaactgcaaatccctttatccactctgtgtccctgggaaaatcacttaacctttctgagtccctatttaatcaatatgatgaaagagtatactcacatcataagattatgatgaggattagatgagatcttttagactatcatctagagcactgccaggcccatggtcactccccagcaaatgacagctcagtggctaaattaatgtcaaattggattttgtcatttcagtggggaaatggagctgtgggctccattagtgggatgtaaagaagcaagagatgactcatctctcatttgaacaatcaggcagatacgaggacaagcacaattaggtttggagaacaaagggggaacatcagtgtggtttggaatcgttgcagttaacatgctgtgggatgtcacagtaatcacgaaggaggaaaaggaaggagggtcagttggactgccccaaggcaacccttgagccatcaggacagctcaacacctcctctttttcatctttgtacttcctgtcagtcaggcagaggaccgttccttcccatgattcagatgtatcccgcctcatctccctgaactttttgaggacagctataggcaggtacaagccctattggactcattacctcaatcattcttttaattcgatatctatattgaattacctacttatgccaagagctgacctaggacctgaaggaacaattgaatggaatagttgagttccctgtcaataatcttaaatgtacttgcatgtatttgaatattaggcatctctatgaccttcctacgtgcagacagtttaatttgaatagaggagggcatttttccctctcatatcaattctaatacctttatggcaacaagaaaagaaaaaaccatcctgaaatgtttcttagaaatatatgtccaatagtcctaattcaatagatatttattgggtgtgtattataaccatacaccctttctttatctttcagatgaataaaagaatcctaagggaggtagtatggcctaaatgtttggtcctcccaaaatttcagtgtctaagccctaacccctggtggggttatatttgaagatagtcttctaagaaagtaattaaggttaaatgaggtcataatgatggggccctgatccgttggattagcatcccatttccaagtagacacaccagaaatcttgcttctttgctctttctcgaatgtgtgcactgaggaaaggccatatgagcatggagcaagaagccagccatcccccaccacaaaaacagctctcaccaagaactgaattggctggcaccttgatctggacttcccacctctgcaactctgagaaactacatttctgtttaagccacctggcatatgatatggcagcagagctgactaagactgaagggccactgtatcagttagctattgctatataacaaaccctccacaactcaaccacttagacatgaatcatttatgattcataacaaatctgcaggattggtggctcactcctgtaatcccagcactttgggaggctgaggcaggtgggtcacctgagtcaggagttcgagaccagcctgaccaacatgggaaaccacgtctctactaaaaatacaaaattagccgggcatggtggtgcatgcctgtagtcccagctactcgggaggctgaggcagagaatcgcttgaacctgggaggcagaagttgcagtgagccgagatcacaccactgcgcccagcctgggcaacaagagtgaaactccatcaaaggaaggaaggaagggggaggggagggaggggggggagggagggagggagggggagagagagagagagagaaagaaagaaagaaaactgcatgtttgtcaggggttggctgatctaggctggtttccactgtggttagtttacttatgtgtctctcatccttttgctgggatcatcagggaaagtccttctcatggtgatagccagttaagggaacaatgaaaacatgcacatggtcttggagctggcatgtgtttacttcttctcattctattggacaaagcaaatcttttaactggaacgtggttacttttgcctcatttattggctaacgtaggtcaaacagatgagcccaggatcagaacaggaacatgctgtcaatttaaggacaaaggtgtgaatacatggaagggaagaaaattgggatcattaaggcaatcaacacatccaggattcaaatgcaggtctcccttgggccctggctagggttattttcacctgacaaattacttttttgttttaatgtgaaacacatacacagacatgattgctcttagcatctgaagtactgagcctcagcgaagcagaagataggcaaggtggctatcacagccaaccttccagtgtgctttactcccctaaatctcccttatacccttatacatattgtccattcccatgccgcaggctatcgcccctacaccatgactaaggtcatcctatacttcaaaacttgggtcctgagttttcatagtcttcttccaatttcatcaaaacctgctctcaggaggcttgctataagaaaaaaaagctgatccctgaattctggtaacttttactaaaacaaatagctctgagtatttaatctatatgtggctctgtgcctggtgttgggctgctggtattagaaataatcatagaactaattgttaaggagcatacactccagaaggagaaataatgcatgcacaaattaattgtttttattccctgtgcaaaaaaaaattgaatatagtgccaagcattatccagaaaggtggattacagtgataaatcagacagagccacaggccctactctggcagagttagagtttactaaggacccgaggtagatcagagaataccaggaaaagatgacatttctgtagttgagaagaactaggtgagaaatcagagaagggtatggggtgtaggacaggtaacaataagtgggttcatgaaacacatactgggttgtttataagcagtatcagtcttctcggaagtggttaatagaatcgtcgctggagttaatggctgagtttgagtctttgtcttaacactagagggaaggccatggacaagttacttaatttctctgctcagtagtgtgctagtaaatgttaaaaccagttttccaaaaagagggagaaaaggagatggggaagaaggaaggaagcaagaagcaaggaagggagggagggagggagggagggagggacaaagggagggagggagggaggagggaaaccaagctagctctgcctagtagcatcttctattttccatgatgtaaatacttcactatggcctactttaaaataccaacatggtatcagtgagaagtgatgtgcagtagataccattttctagtatttttaccacacagacacagttaacataaatatcctcaaaagctacgtaatagtgaaatgtagtaaaataactagaaagttatgagttttgaatacttggttcgttttaaatataattcatttaattgaaagtttatataacttaatttgtaacaagagctcacttaacaaccaacccataaaatttctaaaactccgtcagcttgctttggctcttgcactcagtgtgagccatcaccaggacagcatagattctgtgtctcaatgtctcatttataaaagaattatatttatttataaatagctccataggtttccctttttttttggagatagaactcgctctgtcaccaggctggagtgcagtggcgcgatctcggctcactgcaacctccgctcctgggttcaagcgattctcctgcctcagcctcccaagtagctgggactacaggcatgaccaccatgcccatgcccagctaatttttgtatttttagtagaacggggtttcaccctgtggccaggatggtcttgatctctcgacctcgtgatctgcctgcctcagcctcccaaagtttgggattacaggcgtgagccaccacgcccagcccatgggcttcttttaaggattaaatagatggttcatagaagacattctgcatctagaaaatcataaacactcagtaaatgttggtatcatcattatttttgctatcattgagtttatttatatgtaaagtatgaatagtatgataccaggaaggattcatggatgagtggggcacttggagatgagaccagccttgtgagaactggtcagtagccatagcctaccattgatagtacaaatgcacattatccccagatatgacctgttcgtcactgtagccttaggacatggcaattgcacacactggcacatgagttctttgtgcggaattgggcatgtggctgaacctaagctggggataacccattctgcacactcaactggagatcgcctcctggctcccttctgtcctagtactgctcatatatctggtttcttctctctcagagccatgggcaccccagaactctgccacctttttctttcttctgtcccatgactctccgggaacagagggctcaggaataaagctgacatttaactgtaagtactgccttaccagacatcttttttttattattatactttaagttctagggtacatgtgcacaatgtcagttttgttacataggtatacatgtgccatgttggtttgctgcacccatcaactcgtctttacattaggtatttctcctaacgctatctctcccccagccccccaacaggccccggttgtgatgttcctctccctgtctccatgtgtattctcattgttcaactctcatttatgaggagaacatgcagtgtttggttttctgttcttgtgttagtttgctgagaatgatggtttcagcttcatccatgtccctgcaaaggacatgaactcatcctttttaatggctgcatagtatccatggtatatatgtgacacattttctttatccagtctatcactgatgggcctttgggtggttccaaatctttgctattgtgaatagtgccgcaataaataggcgcgtgcacgtggtccaggcatttttctaaacactttacatagattcagtcatttgttcttcacaaaattggagaggcaggcacaagtatcatctccattttatggataacaaagacatgtccaaaatcagtctcaagtgagtgaaagagctagaatttgcacctcactgttggtttcaatacccacaccctccttccctacagagctccactgttgccgagctactgtgcttgtcatcgcatgctttcacatagacagcagcagcatcgaagccaagaagataattattttatggtttgggattttaaatatttttggcagcaaagcaacttgactctcttaattgtgctttgcttcatcttgaattaaataattacattgaattctgtgacaaacaatagaatgctagtagtcattcttccaaccacattttttaagtgtcttctatgtgctgtctggtattgctgtgtgcacttgtaatgcagagaatgagataaggcagagttgcccaagaggtatgcagtgtagtgcagtggtagaaaaatactaggggctatgtttgaagaaggtgaaaggttcaattttctcattcaaacatttggaacttttataaggacctaaagacataattacaggacactgtaataagtgtagtaaccaagttggtgcaggcagagaaagagaggagaggaaagggcatttcacacagagggaaaaacattataaagggaacagtcaaaacagtatttttaagaataattccagaagtggaaaagcaaacatctaacagagaggagtcttggctcctaagggtgcagggtataggtaaaaacaggggaaattaaaattgagcatgatgcaagttacagaagcatatcaggggtgtgagagtggtggacactgggtcctcccctctgggtttataggtggcagaactgagatggaagagtctgatgtacggttctcatagagacgacattcagacccagctcttcacgtttgccatttcaaagaacttttgttatcttctaatgtagagagaaaggggactcagattgctgagtaatagggaatcggaatgcatttgagatgtgaattctattggcgatgacagagtctcatttggataaacaatgctcagattgtttagggaatcgcattgatttcctaaacaaaataagtaagtgctccaatgtgtacatatagaagacatccaaagaggaaggggcagaagcctgatacatttagagagacctgctggtaggaacacagcaagtcactggcagggttgggattcgagtctttgtttctggctctcaacctaggacttgttacccaggatcaaaagtcctgatcatctctttgcagcaaaagtgctccttggtctataaactatcccataagttattcttaaagaaagaatgatctaaaaacaaattacttcctctttaaaacttcctgcatgataaaaattagaaatagcaagagccagcattgcagctgcaaatgagaaaataatgggcagtggtatttgcttacaggctgtgtcatgcacatctctaagcctcacttatgccccgtctcctgcccagaattgctcccctttccttcatatctacctaaaatacaccaatccaccaagcactgggtcaaaccacacttcctcatggcaacactcctaatatctgcagcctgcaaagatcatttccactttctgccttcccgagcatgaatgggaaattgactgtaagaaagtcaggagccaagtctgtagtcacttgtgttttccctaattgttttctgtggaaatgtcttatcatcatgacagaagaacatgctcctaaggataaaacgacatgtcttctctttattgtgttccctaatgatagttaatatatggacagtgcttagaaaataaatgctcattatgctcattcagtaaacatcgcatagcttatgcagaatatacaggtgagagatgaacaggaaactatccctaccatcaaaaagctgccactccctgggaataccgatgtttaaagaaatgaagcagagtcctattcagaataaatttgtacccttatttcaccaaagaaggtaccggaacacaacatagacttgctgaggtctatgagttaagagtaaagactcagagttcaaacaaagccggggggaacatcagggcattctgaggttctgcaggtggtctctcttgtccgggacaaagagtctgtgggagctgtcctcagaagggttctgaccctttgtgttttgaggtcctaaaataagacccgcctgagcctgagaagaggacaagagaaaaggagaactaacattctagggccacagtaggactcaacatgctgtcctgactggagccagcccaaagacacattctttcttagcgtgtgattgcacaggtggattgagggcatgttttccaagctcatggcagtaccttgaatagatggcccatcttcagcaactgtgcccagccctaccttcaaggagtcttcaggcagcttccacttctgcataccagaaggtgatcatgccagcaccctctccactcctcagacacagctcacccaggctggcttctattcactccagcacccttccctgtggggcagaagagaacagaaaggaccaacctggacttactctaatgcttgctcatttaatatgggaccccttggtgccactagggatgagccagctgaaggagttaccactaggagcatagggaaggtctgaacctctgtaggttgaggacaccctaagagcattagttatgcccagctccatcctcacctgcacatgaatgttggaaagaatacttggtatacagtaggagagagcatttaaaaatcaaatttattgaggtagaatttaggtacaataatgagtgcatctattttaagtgaacagtgtgaagcattttgttatatgtatccacccattaactagtgagggcatagaatattcccgtcaccctagaaagttctctcttgccccctcttgtcaactctccttgcttcccagcccagatacccactgatctgaggcctatcactacagcaagttttgcctcttctagaatttcatatgcatggaattatacagtatgttctcttttggtccagcttcatagggtcagcataattgtttccaacattttattatgtaatttttcagaatacagaaaagttaaaaaaattttacagtagattcctaacctagactctatcattaagatttccttccctgctttattatatttctatgcatttatccatcttctattcatctaccttttttttgatacatttcaaagtaaattgcagacaccagtcaacttccttttaaatacgtcggatgttttactaactcactttcaattttaattaatttactaatgcaatatttgttatgattttcttttaaggtaaaattaacatacaataaaacacaaaaatgtttaacatattttttttgagttttgacaaatacacatacccatgttaccaaaacccctatcgaaacatacagtttacatcactctagaattcccccatgccttttcccaagaaacacccttccccccactgcaaagcaacttctgatctttttctaccatagattagtttatctgttctagaacttcatatagtggaaacaccacatgtacgttcttttgtaagcctcttacttagcataatgcctttcacttcaccatgtccttgtattatcaatatttcattctttttattgttgaatagtattccatatatcaatatactgcaatgtgtttatcctcttattgatggacatcttgactatttcaattctgatcgataaagctataagtgtttttatacaaatgtttctatgaacatatgttttgttctttttattagggaaatacctgggaggagaaattctagatcatagagtacgtgtgtgttagttttataagaaacggccagactttctctgaagttttggtatcatttcacacacccccagaaactgataagagctgtacttgctccctgtaggaactaagtgtatgtttctaggttcttttctttctttcttccttcttttccctcctttagttatttattgttttactttagtattcccattagtgtttagtgatttctcactaggattttgttgttgttgttgttgttgttttttctgagatggagtcttgctctgtctcgcaggctggagtgcagtgtcgtgatctcggttactgcaacctccacctcctgggttcaagcaattctcctgcctcgacctcctgaatagtgggactacaagcacgtgccaccacgccaggctaatttttgtacttttagtagagatgaatttcactatgttggccaggatggtctcaatctcctgaccttgtgatgcaccagcctcacctcccaaagtgctgggattacaggcatgagccaccgcacccagccctcactatggtttaatgtgcatttccctttatatatgcttattggtcactcgtatatctcctctggtgacattctgttcaaatcttttacctactttttaaatttctttttgtgtctttttgttactgagaaaattattcatataatttggatacaagtcttctgtctgatgatagatacataatatttagtggcttacattttaaattttctttttatctttttgaattttgctgtatatatctaaggatacaacatgatgtttcgacatacatagagatagtgacgtggctaccatagtcaagcaattaacacatccattatctgacatagttactcccctttttaaattcagtaccttttgaaagtagaattttaactttttattacttttcttttatggctagtgcagttttgatgcactttagggaaatctttgcctgcatcaggccatgaacatttttcttctgtgttttctttttttcaagaaattttacaatttcagcatttacatttaggtctataatctattttgtttgttttggaggtaggatttgagatgctatttgtttatatgggttctttagaaatgatgtaggagtgtattatttataccttaaatatgtattagaatttaccattgaagccctctaggcctggagtttctttgggggaaggttttaaattattcattcaatattctcggtagatataggcctttaggttttctattttctctttagttacttttattaatttacacatttccaaaagaatttcatctcatctaggctataaattggaagcaattgtttataatatttatattatttaatatctgttcttaaggtggttccagcagacccaatataccatgatatatgccataacgggagaatgcagagcaaatgtggaagagtatagggaatgatttcttgaagtggtatttaagcttagttttagagatgagaaagaatttttaaggtaaggaggcaatgcagagagggtagaaagaggaaccgcatgtgcaaagaacccgcggcaagtgagagcctgacactgtcaaggcatcgtcgttcagtgtggtggatttggtggaagatgatgtgagctatgagagaattaaacaggagcttgaagccttgatacccaagattttctcaaattcccatttatctggtgttttgtttatttaattgcctctagcacaagaatataagcgttgtgaatgcaagaagttttgccaattttgtaaccattatatatatatcctcaggacctagaacagctcccgcgatgcagcgggaattcgtacatttttgttgattgaatgaatcagttaatcaatacccaaatgtgtccacattaaaatgttttctataaagattaaaaaaataatgcagctgagttaaaagtcctaggaggttgcaggctctccagtgttcagccctctagccccagcctgtcaacctggacaattcacagcaggcatggatggctataaggttttctgttctgacagtggtaccaccaagctttcatatgagaactggaaaaggctgctggttgtaggctcaccatcatagttaaatgcactgatgaaatctctttgaatttcccagagtaatttaggggctccctcctctgagcttccatggtatcctgaaacagctccttcattacacaccttatatctccacacacattattacacgcattatatccctccttttggaggtgcaaggagagagcttgaaagctaagaaggtagaagataaattttactatttcaagccactgccctgtggaataagagaaagttcacagtggtaaattcttcccgctttacccaactgggacgtttagaaagttaccaagcctcaccaccatttagctagatgttgaggcaagtcttccattttacagatgggaaaactgaggcttggagaggcagagtgcctgcccaatgtgacacagccactcaaaatggggaagggatgacatttaggactcctaactggtgtccagtaatacacagcaccagcatcaccttcttcttcatctttcctttcctccctctacagttgctcattcctctctgtgtgtcaccttcccacacagatcccagtgagcctcttaattcttgtttacaagcctgtcttcccatggtcaaaaataggacatagtaggtgcttgtctggtcactcatatatcacagtggttaagaatacaggaatcagagagaaagtacatttaatcccaactccaatgtaatgaagcattgggaaaagtatgtgacctctccatgcctcaaatcatcattggtaaaatcatgcacattgaagtcctatacaaagtaagtgttcaataattttagctgttattactgttaataataaatatttgttgaacatcattttcaggctaacataaaattcccaaaagacatagccatttagcaatcctgactggctagcccagagtcccatctgacctatgttaaaataaagttggaagaaaaaataaattactggactctgtgtgctagcagtgggggcagagataattcatctttctgcaaatgaaaattaatcatcttggctttgctcgcaggcaggcagcaagaatgccagttgctcccttccctgccactggcgggattgttcagaaatgaagaaagaagatgggattgttacaggaggcagcctcacaaactacatcctccactcagatatgggcattatcagcttcctcttggtcctttctattaccacttacttagccaccatggtgacaggctcccagcatagcagcctcgtgcttatagcattattattctttaatcggtttcaatacatttcaacaatacacgcttttatctaggactgctaaaaaaaaaaaaacaaacacctatctgctcaacaattggaatagagtctaaggcattagatgcatatgctaaaatgtctgcttgtgagataaacacacattgtgtgtgtcttcttttgtacctcagagaacatttctgaataggtggtggtccatttcctgagtctccttctcaaaattattaacagaaaatacaatccttcttcatatataggcaaagctctttacttttggtcccaagcattttgtgagtgccttctacaaagatactagtgatagttacgtgacacgggtgaggttcgtgtctattttcacataagacaaaattgaaacccagagcctttatagggctgggctaaagtcgtgtctcaactagggacagatttttctatcttccagacccacaattcttctacagcaatatggtaatgcctgttcatctacccaacacccattttccctttcttgtcactaaaaaagaacaccatgtgcccagctaaaaatactcacctttccatatttttctgcagccaactgtagccatgtgctgtgtgttggtgatgtgaagtgtttgagaaacaatcttaaaggatacagactcagcagccctttagccttgtagcccttttttttttcttttttttatcatttgggcctctaatgtaacataggagtctggaagtgcagcagctatcttgggaccatgaggtgacattggggccaatgctaaggatggaagacagaaatgatggaaagagtctactatcctatggcatggtggaccactacaccaagatgaaatggcctattcctgcctgcttctgaccacattaatctgttgttcttgggtgagttgttgacaaacatgagtcctaattgatactgaacacagtgtttctctttaactgtaatgtcctttatttccttgtgatatactttggatctgtgtctccacccaatctcatgttgaattgaaggtggggcatagtgagaggtgactggatcttgggggtggatttttttcatgaatggtttagtgccatccccttgttgctgtcctcgctgtagtgacttctctgagatctggctctttacagctgtgtagcaccttggattctttattacttctgctcccagataggaaatgcctgctcccccttgaccttctgacatgactagaagcttcctgagggctcctggaagcagatgctgggtttatgtttccgtacagcctgtagaactgtaagccaattacctcttttcttgtaaattacccagtctcagatatttcttatagcagtgcaagaataacagttctgtcaatcaagtaaactcctgttcttctattaaacctctgctcaagtgctcccattctgtgaaatcttctttgaacttcccagagtaacttaggggctccctcctctgagcttcgtggcatcctgtaaacagctccttcattacacccattgtatcaggtagctgagcatttgatgtctgttctctccccacaaacaccttcaaggacaaggactacaacttatagtcccagcctgtcacttagtaggcactcaataacattttatgtaattaattgcttcacctacgtggctcacccacattaatccattttttgttatctttttggaaatctgttggcccaatttttaatattgatgtttttcagttacatactcagaacttttgtagttttcttccaagaatgacccattcagtctaataattcatcatgctatgaagatgctgatgcccagcccagattcctactaggaatttccagcccaggtcccctctggagcaccattatcatatagctcacattggtgggtctactggttaccagcactgtttgggggcccatctgtcagaatccaagtcttagctttccacttattaaatatgtgactttgaagtggttatttaaactctctgtgtctgttttttctctatcaatgaggaaaacaataatacttaggtagaatttttgtgagggttaaaggcctaccacacatgtaaactacttagaaccatccaggttcatggtaactgttggttatgattttctcattagaccagcatacctgggtgccctatatacacttcccctcagtatgttcattccagctcacctctttcttctaaactcaggaggctgctcaccttcctgtattctctctctcgttaatgccatcatctctctagtctccctggccagaaacctaaattagacattgccttctcttaacccttgcttcttaagttgaaaaagatttgtcaaatggtcaaacatatttgaattttttgagttcatcttcacatcatagaactggtcagacacaaagtatcttgaatgaattttgggatagtctccaacttgtacccctgctgtgtttttataccatgaattacttccacctattttggccacaatcagctttcccttgtgcaaataggatcatgcctcttccttattaaatccctcagtagctccccataatctccaggatcatgatttcagccactagtcaaggagctttcttctctgactgttccctgctcatctgtgcagcttcacactctgctggtctctccacatgaccgtaccatggctaccttgaattgtctcttcctcagatccaccttgttaattcagccttcatgcctttgattatgtttttcttcccttctgctatgcccttttccgaacctgctcccctgcccagtctagaggattgattttctgctcattcttcaagttttagtttacctgcaccatgcttctgtattcctccaagatttctcagacagatgaggggctccttgactccagttcagatggacctgtcaaatttaaacctcacaggatggtaactgcttttcggcatgaccttttctttagattataaacttctcatagaccaaaacaaggccatttttgttcatcttttggctgcagtgcatagcccagtgcctgaaatagttgacactttataaataattgtggaaaagtcaggggtcctcaagccccagggaaccaggctgcgcatcatgaggtgagcaataggaagcaagcacagcttcatctgtatttacagccactccccactgcttgcattaccacctggctctacttcctgtcagatcagctgcagcatcagattctcatatgagtgtgaaccttatgtgaactgcacgtgcaagagatctaggttgtgtgccccttatgagaatctaatgcctgagatctgaggaggagctgaggcagtgttgctaaccctggggagtagttgcaaatacagataacattagcagagagtcttgactgcacacagaccataataaatcaattgcttgtagactatatcaaaaccttatccatgactggcaagtgacaagttgcatctggtggcaggctttaatcagaatctgacacttactttagtctgcgtatggcctgcccgttattttaccatttccacggcacctctttcccacagtgcacacttgtctcagtcagttttcgtaagcacacaagctatcctagccaaaatgagtaaaaaacaaatgtcactggaaagcttcttggaaaagggggaagacccaatgatgaaacagctagaagactctcttaagactgccaacaaaaagacggctgatttgaaagaaaatgccaagagtcctacttaaattatagcatcattgcaacaggaggatatattcttcaagcctgctttgtataatatttggtgaccaactatccagcagagccatgaaccttcaaaactgcttcgccacatggagaccaagcaccctgcattaaaagacaagtcttggagtttttccaaaagcaaaacatgtgaacacaaagaatgaaagcaattattgaaggctccacttcatcaaatgtgtctgcactgagagggtcattcttagtagctaactgcattactaagccaagaagccctttactgttggtgaagacttgatcctgcctgctgctaaggatactgtcatgaatttgtttggagaagctgcagttcagaaggtggaatgtgtttctctttcagcagcaccataactagaagaattggtgaaatagcagaggatattgaggcacaattgttagaaggtttaatgagtcaccatggtatgcaatccgggttgatgagtctaccagtgttgacaaaaggcaacaatgcttgtttttgtgcaatatatttttcaggaggatgtacatgagaataattatgtgtacttttgttgccactgaacaccacagctgcagaactattcaagtcttagaagattacatatcaggaaaactgaactggtcattttgtgttggtatatgcatggacagagtgctgccatgactggatggctttctggtttcactactcaggtcaaagaggttgcttctgatgtgagtctatgcactgtgtcatccatagagaaatgctgcctagccgaaaaatgtcaccgaacttaacgttttgcaggatgtgattaaaattatcaatcacattaaagtatatgcactaactcatgtctgtgtagctctgtgatgagatgaacatagagcacacacgtcttctcttaacacagaaacgaggtggttttctttcttttctttttttttagacagagt

SEQ ID NO: 5074 - DNA, 38183 bp, Homo sapiens
ggctgctggcaatccctggtgatccttaacttgtgggatccctccagtcacatgactttttcttcctgtgtgtcttcagttgttttatctctagggctgtctgtctccgtgtccacacttccccattttataaggacatcggtcatattggattatggcccacccataagacctcatttagcttgattacttctgtaaagaccctatttccaaataaggtcatattctgacatactgggattagaacttctgcatatctttttgggagacacaagccaacctcataacagagggttcagtacagggcaggacccaacccagcatggaagtgggctatattcagtggggcaggagaggggagaagctatgtaaatacactgacaacaatagtgtagtttcacacagataagaaggaggtacagatatagacagagagaaagctagaaagaaccctgtggtgttggattggaacggcagtataagtgtgaactcatggttttcaaaatgataggtatagaaataaatacagctgtcggacgtggtggctcaagcctgtaatcccagcactttgggaggccgaggcaggtggacacttgaagtcaggagttcaagaccagcctgaccaacatggtgaaaccccgtctctacaaaaaaaaaaaaaaaaaaattagccgggcgtggtggtgcatgcctgtaatcccagctactgggaggctgaggcaggagaatggcttgaacctgggaggcagaagttgcaatgagccgagtcgtgccattgaactccagcctgggcaacaagagcaatactccgtctcaaaaaaagaaaaaaatatagctgtaagtacaatatacgcatttgttcattcattctctggctctgtccaggagagacctgaggacagtgacacttgggcagcagggagcaagatcaccttgtgtgtgtacttggctctaaataccattctctactatgaggaacccaagccccttggagaaaattcccagtccgagcccagggcaaggtaaataggagaggagatgagcatttcatgctgcctgaaatcagggaggtcttaaagaacgatggggatcattgaaaaggacacaggagcccatttgaagagctgtcactggccaaagttggcatgatttgagcattaaaataaatcatggtaggtacgactgtaagccatttaataaaatagaaatccgtgagtccacactgattatataagttaaaaagaacacaagaaggaaaacaaactcttccttaggtagaatgccaactattaaatacaaaggaatggtgacattttatttatttatttatttaacaatagcaacttttattttagaccagggggtgtacgtgcccctttgttatctcataatactttagcattttagaatagtttttctaattctgtgaaaaatgataattcatatcccaaaccacatggtaagtgtagtacccggtagttagttcttcaatccttgcctctctgcctcacccctctaagtagttccctgtgtcattgttgccatctttatgcccattagcacccaatgtttagctcccacttataagtgaaatatacagtatttggttttctgttcctgcattaatttgcttaggataatggcttccagctcatctatgctgctgcaaaggacatatttcattctttttatggctgtgtagtattccgtggtgtatatataccacatttcctttatccagtccactgttaacgggcaaccaggttgattcatgtctttgctattgtgaatagtgccgcaatgaacatatgagcacaggtgtctttttgatatatactcagtaatgggattgctgggtcaaatggttgttctgctttaagttttttaaaaatctccaaactgctttccacaatggctgaactaatttacattcctatcaatagcataaagcatttgcttttctctgctgcctcaccagcgtctattgttttatgactttttaataaagtcattccaactgatgtgagatagcatctcattgtggttttgatttgcatctctctgagattagtgatattgagcatttttcatatctgttggctgcttgtatgtcttctttggagagtgtctgttcatttcttttgcccactttttattggggttattttattttattttatttttgcttgctgaattgcctaagttctgtacagattctgaatattagacccttgctgcatgcgtgtgcgaatattttctcccattctgtaggttgtctgtttactctgttgatagtgtccttgctgtgcagaagctttttagtttacttaggacccacttgtcaatttttgtttatattgaattgcttttaagaacttagtcataaatttttccccaagaatgatgtctagagtggtgctcctaggttttcttctaggattcttataatttgaggtcctacatttaaacttttaatcctcttgagttaatttttgtatatggtgaaaggtaagggtccagtttcattcttttgtgtaggctggccagctatcgtatcaccatttattgaatagggagtgcttcccccattgcttattctgtcagctttgttgaagatcagatggctgcgggtattcagctttatttctgtgttccttggtctatgtgtctgtttttataccagtgctatgctgcttcgattattgtagccttagatagttttaatttgtgtaatgtgatgcctcaggctttgttcttttggctcaggattgtttggctattcgagcttttttttggttccatatgaattttagaatagttttttctaattcttgaaaaatgacagtggtagtttgacaggaatagcattgagtttgtggaatgctttgggttatggccattgtaatgatactgattcttccaatccatgagcatggaatgtttttccaatgtttgtgtcatctatgatgtcttttaccagtgctttgtggttctccttgtagagatctttatgaccttgcttagctgcattcctaagtattttatttgtgtgtgtgtgtgtgtgactatgcaaatgggattgcattcttgatttggctctcagcttgaactttattggtgcacagaatactactgatttgtgcacattgattttgtttccaactttatagaagttgttcatcagttccggggacttttggtggagtctttagggttttctaggtataaaatcatatcatcaaggagagagaaagtttgacttcttcttttcctatttggatgtcttttatttctttctcttgttgattgctctggctaggacttctgaatgacagaatttttaaaagtcaccatttggcaatgtcatcatgataatgtttaattaaattaaggaacatcattgcatactgaaattatacaaggtgggagtgggatgagaaagcttaaaagtatctccctaccaaatgcttataaattacgagtggaaggggaagtaactttacaatagagaaacttgattggtgtcaagttaatcaaatgtcagagcgaacgacattagtgatgggacagattgacaatgaaagctaataggactcaccagaataatccagcatcacttctgtgctattttggccaaaaaagcataacccagttctaacatcagacagagccaaatcgagggacattattcaaaacaaccaacctgcagtcttcgagtgtcgaggaaaaaacaaggcatctgtttcaaactggaggcccgaaagacatggcaactagagccatgcatttagagagaatgcaaagtcccggatggattttcttgttacaaaaccatattgagaagcttagcgaaactcaaagggggtttccacatgaagggtatgtgagagttcttgtatcattcctttaacgctctgtattttgaaatagtttcagaataaaaatggaaatggaaaaaatgcaatgttaacatatacgagttactactttcaacaagttatcttccttttcagcctcaatttcttcatctgtaaggtgaagacagtaacagctacataaaggttattgggagagatggagaagcccccagccgaaggtctgctcacagcgtaaatgctcaagccctggtcttatgagtactacgttcttgccaacattttcttgggtttcttagtctctaaaagatcgtaattgcaagacacggtattttacataccactgaaggaaaaaacaaacaaacaaacgaaacattcaatgaattcctgacggtgtgattcttctcgcttagaacttttaatacttattgaagaactctgttagactcattcaaatgtagatttttatcccctgctgctctatgatgactttaaaaggaaagggtcagtcaagtgaattggctgaggtgttcctaaagctccttcacatttgggtctggtgtccggagtgattttgactcagagtctcgggttcttcgtttctccaccgacagcatcctctgtgctcctgagggcatccaggcccgcagcctcccagtcccacagagacctcagcaaagacaggcagagtggggacacctgggagaaaagagagcccgggacgtcatttaattccatcctctccagccctggagaagcccctgcagggtttttccatgccaggcaggacctcacactgaccggagtgcctgagagaaccacacatgccttcctctaccctgggcttctctgctagggtgaggccctgccagctcttcctggccaaccctgcccttcctggtagaggaaagcaaagaacaacaatcaggccagaattccagtggcttcgaggcaggttcctgccctccatttcctccattcccctcattcttgccctccattcccctcattcctgcctgctgcctttctcctgggaggcagccccatgtaggagaaatatgactgcgttttgttgtgtcttgcactgtgattcatcttgtctttattcaaacttttcatatttggttcaccgtgaatagttctgcatcagttgggatttttttaaaccatattgcattaaaatattacttacaacaattctgaatttttaaatgcctgtttaaattttgagcacgagagactgcctcactcacctgacttaattctgctggccctgctgtgctcatggagccactcattcattcattcattcattcatcattcattcattcatctattcatttgcacacagtcaaaggtgcaatttctcctctgtacaggccatgtgctaggtatttgggagggaagtgcaagccggacacaagccagcactgaaatagtgtcagaagaaagacagccatgaacacacatgaccatatgacacatggtggggtgggcggcagggcaaagaggacatcggggaaatcaacatgccaccagctaccacttgtaggggttctcctgtggccagctctgagctaaggtcttcctgcacagaatctcactggattcctcaacagtccttccaggtttgtagatgcttctgcaaaagtaacagacagatggatgtccgaggcttggggaagtaacacgcagatgatttgcacaaggacacgctttaagaagcagtgacttggaagtccaacacagatctgtctggctctgggctcaaaccagctattgttattgcgccacttccacctgcatccccatcaagcagtcagggaaggctgcatggaggaggccctggtcagctgaggcttgaaggaggcctaggagtttataggaaggtaaattggagtaggaggtttctggaagtaagaaaagtcacgtgcactattagcaaagtaggcctgggccggcactgttcctctttctgcttctctgtttcctgatgacatcaacataaataggaaacgtgggaggtcactctgcctagaggctccagaagaagactggtctctcccaccacacagaggtatggccggcgtccaggagcagggctgaggggtggggtcagagcaggggggaatgtggggagtccggatgaaaaaggacagggggagcctggggggcgtcctgtgggtagctgtgccctggggattggaggagttagggcttggcctcttaggatgacctgagcccagactcctagggcggccgtggatggggaggcagccaggggtgccaagctgcttgggtgttgtaggagagctctgggaggactcagcctcgctagcgggatctggttggtcctggtgggaaggacgcctagtgggggaagagagctcaggcctgggagtcaggcacctatagtctgtcttcgctttgtcactaagtgctggtggtagtgagagcaccccctgtccaccctgggcttctgtctcctcatctgtggatggggagcatggatagtccctgacatcttggtttagaaagagagagaacgcatgctcggtgtttgcccgtgtgtgcatttgtgtgtgtgcctgtgtgtgtatgtgcatgtgcggatgctggggatgcaggagtgcagagagactaagaggcagagggtgaaacctggaagcttgctcgctgaggcccagagctgggtgcggtgtggcttgagaagctcactttgaacttgagaaaagcccagcactttgcccagagacataccaggcactatccagcaatctctctctctctcttctctctctcagtctctctctctgtctgtctgtctttttagttatgacactctgccctgtgatttgggttgctgatttgggttggggcccaggtgtgtgtgttctgtacccaagtatgtggctgggtgggtgggtatctggggtgcctgcttcagggtgtgtgcaggtgtgtgtactgccctgagaatgaaagggcaggtgtttcactgggaccttgtcagacaggtgctagcgacagctgcatatgtgcaatttttagtcttcaaaaaccctgctgttatatttttgtacagccaattctaatttttttctatcatctttcctgctttgtaatcattttataatgagtaaacattcctattagcttttggtcactctttttttcatccagcagttttatttatattgttccatatacagatataccaacaccacaggataattcatgagttgtataaggaatgtatttaatctaaacaagcaactacacagaaacctaccttcatgaaaattagaataatctagaattattagcacaagagacaaagtccccagcaatttcttttccctagttccatagcttattctttcaccacatgtattcttccagaacattttctaagcatgatacaagcatatagtttttctttcctgtttgttttttgttttgttttgttttgtttttgtgacagagttttactcttgtcgccaggctggaatgcagtggtgcaatcttggctcactgcaacctctgcctcccgggttcagtgattctcctgcctcagcctcctgagtagccgggattacaggcatgagccaccacacgggctaatttttgtatttttagtagagacagggtttcaccatattggccaggctggtctcaactcctgacctcagatgatccgcctgtctcagcctcccaaaatgctgggattacaggctgagccactgtgccaggctggtagtttttctttttacagaaatgggattattttatttaatatatatatatatatattcctaattttttcacttaatattgtattttggaatatttccaatttctacaataatacatacagatttaactcgttaagtaaccctaagaaatatgtggctttattaggatgggtacaccacaattcatctaatctcacgttgatcgacacctagattgttctaatttttccacatctgtgaaagtgtttctgtagcctaaattactaaatgcagaatgctgtgcagaggttgtgcgttagaaattataataggtattgtcaaatcagcctcaaagtgctgagctaagctgacgtccccaaggtagtgcataaagggtccaatttacctttagagaattatcaatcttctaattttgtccaatattatgtatggaaattctcaatgtcgcgtgattttttctttccctgattatgggtgaagttgtacattttctatatgtggattggccttttgatttcatttatgatgaatgtggagaaatttttgttcatctcctgttgaattctcttttcatcttaacttttggagtgactcatttattacgtgtattaataatccatttatatatgtgaaaatatattctcccaggttatgacttatctttttctttaccatgtttaagatgtctttgtcatataaaaatgttttcattgttaagtcaaacctgtcattacttcttactttatggttctgattttggtgtcttgtaaacctctaagatcacaggtgtcttgtaaacctctttttctttatggtttctggttttgtgtcttgaaacctctaagattacagaaagagttttaatattttactattttggttttgactttgagatttttagcccacctagaatttagagaagtgataatgtgtaaagtaacttttaaaaataattaccatctaattgtcttaacattgctaatttgagtgtgtgatttctcctctcttcaatgatttgaagtgcccctattacatcctaggctctatacatacttcgttattttctttattgttttctcttccatttggctgtcactacattcttattatttttctagcgaatggagcaagtctctcatctctggtttgttataatttagatcagtttgccaaggccaggcacagtggctcatgcctataatcccagcactttgggaggcgaggcaggcagatcccttgaagttggacgttcaagaccagcctggccaacacggtgaaacccatgtctactaaaaatacgaaaaattagccgggtttggtggtgtgcacctgtaatccagctacttgggatgctgaagtgggagaactgcttgaacccaggaggcaaagtttgcagtagccgagatcacgccactgcactccagcctgggcaacagagtgagactccaactcaaaataaaaataaaaatcagtttgccaagcccattaaattcctttttggaattttcatgttgatgcattgaatttagagatgatctgagggacattgaccactggaagtaaagacaatagtggagcctcctgtgtgaggctttgacaggaggacactaacgtgcccccttgactctgtcatgcctttggtttctggcagactttcagtgatgccaacgtttccgccactgcttcatttgcagggtttgtttgttcatttaaccagaaatgtcttgtttattattaaatatttaggagtgctgtcaagatcagcttatccttttttcccttttaatccgttcatctgtttgtttgaatctaaataggtttcttaagggttctccttccatgtatggagtaccctctacttggccatgagtcttcttcttttaaaagtctttgtcaggttgacctatgaaattgtttttgtctggagtaatttgtattttgcttttcccccctagtttttatccctgccattcaatttcttcataagttgggaatgtttatccctgccattcaatttcttcatgagcttgggaatgtaatatgtgctgtttattttgagtaagaaggtgtttggtttttctcttctcttttctctctcttccttttctgtccctcccatcccttctctgtcatcctcctgtccccatgcttactcttcattcttgtgatttttaatctttatgtttttagggatttaaaatgtattgaacttatattttctggtcgggcacagtggctcacgcctgtaatcccagcactttgggaggccaaggtgggcagatacttgaggccaggagttgagaccaacctggccaacatggtgaaacccagcctctactaagatacaaaaactagccaggcgtggtggtgcatgcctgtagtcccagctacttgggaggcaagtcacaagagtcgcttgaaccccggaggcagagattgcagtgagccgagatcatgccttgcactccagcctgggtgatggggtgagattctgtctcaaaaaaaaaaaatagtatttttttaaagaaaccatatttgctgccagcatttgggtttatttagcacatatatgatcttcaaaacaagaggagatctttagcaagttttcagttctcttccattctccaccccagcctacagcaaactcccacattaaaatcatctgagttttagttcaatattcttctttaacttactgtaagtgttacaggtttatttacctcagtatttcagctttcttggatttttttttccgaaatataacctagagtaatttctttcagaaaagatctgaaaaactttctttgtccttaatactcaaaattttttgtgtcctttaaatgtcaaagaaaacttggcattttgtgattctggtttaagcataattttcccttggtattttcaagacatctatttaaagttcagagtctctatgtgaaatctttagccaatctgacccttgttgcattcaaagtatcctatttgttttctctggaagcatttctgggatcatcctcatattcttgcaagacgaaaagtttaccagtgaaactaggcatggctttattaaaaggaatcttgggagttaaccctgatctctgtcccctatacaaaacctcatcgtagtagcctccccccttgaatacagattccttactgtctttgaaaatattttaaaaaggagtcttgttctttattgagtggcctcttgtctccttgaaagcccgtgaagctttccccatttgctgttgtatctgtttggctgcacatggaaaatccctaagcacagaggcttaacaacatagaagtttctttttcccagcatataaaagatgcccagaggtgcagtttcaggctagtatggttgctccagagtgagagtgggaatccagcttcctctcttctgttgcatcatcttcacatatggcttccatcctcaaggtaacctcatggtccaaaatactgctgaagctccagctatcacctccaagttgcaggctggaagaaggaagaaagacagaggacaaaaatgaacccctcccacctaagtcaactgccattgagcagccttttttggaagcatacacaatgtttctattctcatctccttggatcacgtttagtcacttgactgcacctgtggcaacggagtataggaaggaaatagacctttttattctgtgtagcaataaactcagtaaaaccttggcttctgttgccaggaggaaagggacacggtcttccattgtctttcagataggtagctgacattgtctgccatacctgctcttaattctctccaccccctgcttctgatgctggaatttttgaatttctttcccaaacctaaagttttctctaagacttttcatctcttgactatttgctctattttatatatctatctttttcatttgtggtatccattctgtggttggcccactattgattgttgttgtttttttgtttgtttgtttttttgagacagagtctaggctggagtgccatggcaacggtctcagctcactgcaacctccacctcccaggttcaacaattctcctgcctcagcctccagaatagttgggattacagacgtgcgccaccatggccgctatttttttttttttttgcgtttttagtaaagacggggttctaccacgttggccaggtggtctcaaactcctgacctcaagtgatctgcccaccttggcctcccaaagtgctgggatacaggcatgagccaccgcgcccaggctttgattgatttttttttaaattatggatctctatcttcaaattccaagaactctgttctttgcatagaagtgtcttcttttaaatggctagattctcaaatctccctgaggatgctgatttagatgtcttaatgtactcttttatttttctgtatctgtacatgtctgtagaagtgtctgctgggttagcatatgtcagaatagatgtcgctgttttgacatttgggaaactgaatcactattggcatagaggtcagggacagagtcagaggcagcccactgcgggctcgaatctcaacctgttccttaccaaccgtgtgactgtcaccaattacataacatcccacccctgttttctcatctacaaagtggagcttctagtggtacctatacatagatgtattcatatccgtaaaaccttttgaataatgcctggctcatggaaacactgcaatattgtcagccactatcatgaattctctctgtgtatgtgagtactgttttgctctttgatgatattgatttgttttaaccttttaaagtaaaagacactaacctgtccccataattctggttggtatggtctatatgttgaagtgcacccaagtttatgttgcaaccaagccccaatgtgagaatatctggaggtagtgcctgtggcaccctataaaataccccaggagctcccttgcttattccatgtgagattatagggagaagactgcaaggaacaggccctaccagatagtgaatctgcccgcaccttgatcttgaacttcccagcctccagaactatgaaaataaactttgttactagtaagccactccatctatggtatgttgttacagtagcctaaggatgagtacattggtgcaaagattttctgtttgcactccgtcctttccttttatggttagtcagtttgacaaattacagaagatttcacttttatgtacttctgccagcctttgtcttgtgatgtctcctatgcttttaagcttaaagagttcaaaggcattcactcctctggtttcagctttcataggatgtaacattttacatttaaatttataattaacttgttatttggggatggtgtaaaatggggttttagataggcatttttatgttgttaatcaatgattttagcattttttaaatttaatatttcatcgcttcacattgattcctgattccttctcagtctgggtcaagtagagtttgtttccagccagcatgtccattgatagattctgtgtgtgtgtatgttgtctgtgcatgtatctgtatgtgtgtgtgtatgtctgtgtgtaggtggtatatgcgaggtgtatgtgtgtgtgtgttgtgcatgtatgtgtatgtgtgtctgtgtatgtgtgcctcttgtgtgaatttctgtgtatgtgtgaatgtgtgtgcatgtttgtgtgtatatgtgtatattgtgtatatacatgtatgtatctgtgttgttcatgtgtgtatgtgtgtctgtgtctctggtgtgtgtttgtatgtgtgtgtgcatgtttgtgtgtgtatatgtgtgtatattgtatgttctgtgtgtgtctgtgtctgcctctgtgtgtgtgtctgtgtgtgcatttgtgtgtatactgtgggtatgtgtgtgcatgttttgtgtgtacgtgtatatatgtatgtatctgtgtgtgctgtgtgttgtgcgtgtgtgtgcctgcgtgtgtccgtgtgcttgtgtgtgtgtgtgtgttgcatgggcatcttgagtgaagcttccaacaatctaacagaagaaaaggagccacactttctgttctgctctcttgggtacttcccagaccagtgaaatgaaagggaggaaacccccgcctccgaggagaaaagggaactggcaagcagagggtggggggatgacggtaaaaggagcggggtggggagagcacaggccctgtggaagtgaggacatgtgtgtgtacatgtgttcattccaggggatgacactgtggcatccaacagccgtggaccagcagcccacggggagcttataggagtcaaatcctaggcccccgtctcagctgctctgctgtctagcgcattgtgcagtgtaggtgtcagtgatccaagtggggacccagtccctcaggccacacagcgcatgtccatgccttcatgccgcaggagactgaggggtcatgcatgagggccacttctctgggttgtcccacaacacgggcggtgtccctgggacacgtggaaggggaggggcagctcactgctgacactccttctgcaggcctggaggaggcagaggccaggagggagaggtcccaagagcctgtgaatgggtctggcctggctcccagctgggcaggaacacaggacttcaggacactaaggacctgtcatgcccatggccagcacccaccagtgctggtgcctgcctgtccagagctgaccaggagatggtgctggcccaggggctgctctccatggccctgctggccctgtgctgggagccagcctggcaggggcagaaggtgagtcccgtggctcccacccacttccctgtccctgtctcactgctgcaccctgggggagggccgcagcgtatcctcaggatcctgcccgccagccccctcctgctcccctccctctgtctctccccctggccttccctgggcctcccccgcttcctcctcctgcacattcctgctcatcctgtcttggaaagtccagctgagcgtgtctggcttcttgcccacatttctcagggcggcactcccggcccctaggctccaggatggctgctctgccgtttccctgcccctccttccccagcagacactctctgtgcctcagtggttcccacctcgggactttgctcctgcagggccttggctggggttctctccctgcttcagccgctagcacctccttgtgcctgaagcccgcactgggatgctcctgggctcttgaggtgaaatggccctcccaagggctcccagagacctggcttctgtgataatgctgggaccacagtccccttaaaaataccaggctcctgaggacggggactagagaggaggtgggaggttgcagggtagaacctgccacgctgcatcccagggctgagtgtgtgccccctcccaggctgcacagtcggtccggggccaggcctgtgcttgatgcatgtccctgtcctggggtggggggaggggaccgtgccaggaacagcacactgcggaggcccagaaaccatgctgagaaccaacagaatgtcttgctctgccaggagaggagggtccgcaaccaggagcccaccccggcagacatgaacacatgtcatgtgcctggccacctggtgcctctgcagggacctgggagacccctccccagagcgggcatcccaaagcagctgggggtgatggtgacaagggtccctgcaggaaagagaggtgaccccttctacccctcttgtcagaaaccatcccgctgcagaccctgcgctgctacaacgactcaccagccacatcacctgcaggtgggcagacacccaggatgcccagcggctcgtcaacggaccctcattcgccgggtgaatgagtgagtgatgctgggggcaggggccacgggcagggctacgacgtcccctgtgcctggcatggggcgacagtgtagagagggacctgtcaggtcacctcggggtgggagtggacagaggacagaggaggagggaggccctgcaagagctcctgcccgccaggcacctgcgaggccgggtgctgccgtctgacctggggtttctgcggagtgcccctacactgatgttggtgacaatggtggtggtggcaatggtgaaaatcttctcttgtttatcacaatttaacacaattgccccacatgacctatcttagttcctcctcactgtgaggtggcagggccaggccacgaagccccagctgtgccactgcctgcctgtccagagtagaccaggagagatggcgctagcctgggagttcacagatgggaaaactgaggccctggaggtgagtgccagccctggccacggggtagacagtggcagagcaagctgtgtggacgtgtctgggaggggctccgcgctctcccagggcccccctccgtatgtgggctgccacctctcccacccagctctcctgggcacgtgccacaagggaaggggaccagaatcgctctggggtgttggccaggtctaaatcagccataaattaagtaattaaatagctggaaccagagaggcagatgacacccattggaggtcaccccagcgttggggggcggggccggctctgccacccccacccctcaccgccttcagttctccagggcgtctctgtcggaccttctccattctcctcaaagaccacctgcccctccctgtgacctgcttcctgctgctctgacacaacaggggaccagggagaactccccacccaccccacactcacactccccaccccctttgcccaccgccggggcctgggctggaccagggctcctgtctgaggcctgagacacgatgctgtctggtcctgttgctcagaacatcacggcccccaagtccccactctgccctgtgccacccaccatgccctctcccagatctttcccaattgccttgcaaacctgccccaaccccctctcagatgcccacaggagtgagcgcctgggcatctcctgacctggcaaccctgcggcccctctttctctgcttcctttgcagcagcattccctaaagagttgtccacattcaccacgtccagtgtctttccagccattcctcctgggcccactcccctaggatgctgcccccaccaggccacccaaactgctctggtcaagtcagcaaatgtcccagggagcaggatctcatggttgggcctccgccttcttcctattgaccaggggcagcccctgacaaggaggaccaccgcggcctccctgcagtttctcttgacctgactctgcccacagctcacccagtgcccccggggccctgcccatcctcctctttcccttgtctgctgcctcctgatggcaagacacccaggcccagtccatggacctcctctctctgtatccactctgcagagaccccctcaggcccctggggcatctcccaaaggtgacctcagcccacaattcccctaagctccagccctccaggcgtactggcctctccacctgtcactagacaacaggtgtctccgactccaaacgtcctcaaccaaagtcccgctctcacccgagcgcgctgctgcctctgtcttccccatctccctttctaaatgggagctcctagtggctcaactaaacaacagggaggattttgttttgtttttaagtctcttttgtcaccattccttcctactgctacatccctccaccagcaaatgctgccaaccttatctcaagcagaacatgaatccacccacgccagcctgaccaccctgttgcacgccacttcctgtcacctgaatattccagagcctcgtaactgggctccctgcttccaacattgccacattcccacctcagtctattcgaaccgaggaccctcaggaatcctttcaaagcatttatcaaaatctacaacacctctgctatgactgtttcccactcactcgcagtgagatccaatcccatcatgtagatggatgggtccctagacctccctatcacacgctctactccctgcgcactggttttaggccaagccacgcgcacaccaaactctgcctgtcccagggcctttgcacgtgctgttcccatttcctgaaatctcacaatttgcacagtccctccctcaatgcctttaacattctgcccccaggtcacctcttagagaagcctgcttgtcccatatttcaaattgcctccctggcccagcccttcctccccctcacctgcttcttgctttatttttccacatgaagttctctccactgcacacgctacaactttgttccatgcgggtccccttctcccaggatggcagctccgtgggcaggatttttggtgttttatcactgctggcccctgattctgaacagagccaggcatgtggtgagcactcgggaacctttcgtgagtcagtgatacccatacaccctgggctaagccgtgtcctctcccacagggacctcctggagccagtgtcctgtgacctcagtgatgacatgccctggtcagcctcccccatccccgctgcgtgcccaggagatgtgtcattccctgccagagttttgtcgtcatgacgttgactacttctcattccaaccagacaggcctctgggcacccggctcaccgtcatctgacccagcatggtgaggggctgggggccctgcccggggcttggtttcctgtgtggaagcgggggcaccaggggtggtccagggagtcttcaaggcagaaggctgtggcttggggtgggtgagggtttcttgagggatgagggtatggtctggttacatggagacttcagagcagggggcccctgacaaaggcttctcctgtgcccctggctgctaccacctcccactaagccagggcttccagcactgcaggcttgtcttgaagaaaaccgttctcaccactcacttagaaactaccaagttagaaaactctgtccgcttagttgtttcatctcatctctgaagcaacccattcctggatgtggcccttgaggcccaggaggtcagatgcctcctctgaagtcccacagcgagcagtaatgacagagatggggtcagccttcccgggggcttcctgcatggtagacaggagcttgtctcctcgctgccctggaggaggggccccggtgtgggccgaaatcccacagtgtccatgaagccatctgtggtctagggtggggtagatgattattttatgtagttaggtttatttgcctctatattagaaagaaatataacctgcacttcgaagtcctggattcaaggaatggttgcttagaatgaagctaaacctgaaaagggacacgttttatgaaagttttcgttgcgtggcaaaaacccatgctggtggcaggctggtaggaggtactgcaggctgtcattggggtctcagaaccacggcaggcttggtgctgttattggtgcctttggctgctgctgaaacgagacagagggaggtgactagtccaaggcctctctactgctgctggcagagctgagatccgtgcaggatggtctgagtccccggtcctaaccaccgaaccacctggtgctctttgcaaggtcacacggaaggggctctgaccatggcttcctgcccttttttgccacaacatcataaaccactgccagaggaggggatcagttaggccaccaggagtccatcagaagcaacatttcccacatgggtttgatggacacgagagtcccttccttcccgaatggagctcagggggcccagctggagggaggggaaacactgtatgccgtccaccgtgagaacttactgacagtggcggtgggtgcctcatgcagggggtaaagggcagggcccctgggagatcagaacaggcttcccgagggaagagctttgcaactcagatctgaagggtagacaggaggggagggcagtaagagctctctggcagggtaacagctgtgcagaggctgggggatcagaagggcatgggcagctgggaacctgctcaccattgtgtccagggagcatcagcttcaagggctggacagcggtgggagaagcaggagacacaggtaaggacctgtccctggagaggcttctgtctcctgcagtctaggtagaggggaccctctaggcatggagagcactgaggggaaatgacatgatcagatgtgatgtgagaatgctggggacaggggacttacagggtagattggaggagcattagttgggaagaagttgaaattcaggctgtggcctaaagcactcattcctagaaatgatgaggacacactggctaggagatggggacatgagggcatgcaaatcatagttcagatatacacacaatcattcattcaaccttctttccttgagcgcctacataagccaacgaagcagtcaacaaacagccagcaaccctgcccttggagcttacagcctggaaacaaggaaggtttctaaggcgaggagacaacttagatatagggagagaagtgtggcccttggcctcctggagcctgtgttggtagcgaggtagggtccagcctaatgcagattagcaatgaatcaaggatgctgggaggtctgggcaggcgacaggcatgcatctgatctgctctgagtctccatgtttggagaccttgacattttacttcctctatgagtttctccgtctgtgaaatgagctggtggactcaagaggttctcttgagttggctgagcaggtttctgatggggctcccagtctgcgcagtttgtggcgcttccgagagggctctgccgggaagagctccccctccatgacagcctcgggggctggggtgcagtgacccatgagggacgcctgtcctggctgtgggtgaggaggggcggttcccctctgtgtgtctgccgttctgggttgatggttcctgacatgctctagcatgccataacccagtccagcagagagcacttacatcctatgtgtgaggatgttttcgtttgaaagccatccccagcaagcagacaccagaaaccagaaatcaggtgccgtgtcttcattctgcattttcttaacaacccagagttcccaggagatagatgcttgccttgtggctgcaaggatttcatgagagccccaaagttgcttacgcgtatttgttcattcattcactcattcaccttgccccatattcactgagaagccgcatctcagcctggaggtagggaagggggtcaggaccaatcccaccacccccatctcctcacaccttaggggaggcagacacagaagcataggaatccctcagcgtggtaaggccctggtggagggaattccactgagctatggtgaaatgagagaaggaatggggattccgcctggagatgcagatccgaggatgttcctagagccggaggcatttgcccgggcactgacaacaggaaggaccctgggcaggaggaagggagcttggacagcaggagggggaggccgctgaaccgcaggcccctctgctagcaggagccacccaggccgcagcgtgggcgtggggagcctcaggacagaggaggctccaatgagtttcctcgccagcgctttttatgggttcgggtcacgtgcgcattgcaatctgcacggctttccattgctttcatgttgaaacctacagttttgcagatgaagggctgaggctcacagaggagacgggtcttgctcaaggtcctcagctgctgggggcaggggtggcctggaaccccctgtgtccacacaaaaggccatgcagccctgactgccccccagcggtccagcccttaggtgcccttcacttcctcccctccagtcagcctcctgagcccagggacctgcagatcagcaccgaccaggaccacttcctgctgactggagtgtggcccttgggagtccccagagccactggttgtccccaggggatctggagttgaggtggtctacaagcggcttcaggactcttgggaggtaggaaccacggccagctctgcccagcccgaagggatgggcagcacccctcctccagcacccactgtctcctgacaggacgagccatcctcctctccaacacctcccaggccaccctggggccagagcacctcatgcccacagcacctacgtggcccgagtacggacccgcctggccccaggttctcggctctcaggactcccagcaagtggagcccagaggtttgctgggactcccagccaggtaatgttgccagagccaggaaatgccccgtggtgggagggcaggctcatcaggagctcctggcacagcagggtcctgggctccacctgggggcttcccagatctcctgctgccatctttccagtagcgtcccgggccgtcccacctctactgtgaccactgaccagtaggactctgcatctgttcactttggtttccagttttctgcacgttctctgccaatggcaattacaataataacaacaacagtgtattagcagctgtgtgttaatggaggctacaggatgctcagggcttacccacatttttcgttcaatccccaaacactgaaacttagatactatttccattctcccgggagggcgtgcagtgcacagaactctctctctctctctcggagctgttggacacacagctggcaggttcagctgaagtttcagccctggtcttttggccccagagctcatgacctctgtgtgatgaatcaacggtgggcacccactgagagctatgggagggatgaatgacggagtacatgaggacctgctccaacccaggggatgaggcccagccccagaacctggagtgcttctttgacggggccgcgtgctcagctgctcctgggaggtgaggaaggaggtggccagctcggtctcctttggccattctacaagcccagcccagatgcagggtgagcatcttttttctccatcccctcccctctcttggccttgctctctccaagcttcctcctgtccctggggccccagcagaagccacagccaccctaagctctcctccctcccgtgtgccctccctctccctgccctcagctctgctggctcctcagggaggaagagtgctccccagtgctgagggaggggctcggcagcctccacacaggcaccactgccagattcccgtgcccgaccccgcgacccacggccaatacatcgtcttgttcagccaaggagggcagagaaacacataaagagctcagtgaacagtgagtttgctctagcccgctgtggggatggtctgggaccagcacaccctcattgtgtaacccgaatcagtcagggttcctcctggccccgtcttcatgtttgtcactttcaaagagatgcagtccagtgccaaaagtgaacagagaagcaatgaaaccacgacggcagtggccaaaaacaggagcagactttaaaacctctgatctcttgtccttttcttctgcttccctctcccatcctgcagctcctaaatctccactgctagccacaccctcctggtcctgtcaccaaaaccttccctttcatcctcattggattttcctctttctgatatccgaaattccccaccgactgatattctatcttaatgtaattgatctatgatgtacttttcaactggagcctgtggtgtgtacaaatagtgtgatccttggaggttaacatccctcgtttctgtgatgtaacaaggaccccagtgcaatgaacctctcacgttgtttcatgatgaccaagttcttccatccagtctttagcatatgtgagggcagaggccaatttgtcttaattacctgggtttgaatttaccattaactctcttgggtcctcactggaaaaaggaattctgattgttcaaaagcacaggatatattaagggcctcaataatgcctggcacataagagacctcagcaaattacgggcattcatattatgtttatacgtgaaggcatcaaggttataagcattctcttttttcttttgggtagactgaagctcagaaggttgagtggcttacttaaagctgcacagctattagtaggcagatcaagattagagttagaacttctcactccctgcccagtttctgctttctttaccctttgcctctttcaagttggggtctgccggccaggtgggaggtgctgtctgcaaagggcttccctttctctttggccatatctggctggggagaggcctcacctagatgttgttgaaggcctgttacagccgctttatggggattttctggcgatgagaacgtgtgaatgtcctggcctttagtcaactccctacactctgagagtgtcagacaagagagcccatcacactggtgggattgcaatctttgcctctccactgcttagctgcctttccttagggcaagttacttaatggttctgtgactcagtttcctgtttgtgaaaagtgaaggttaatagtacccaccatatagggctgttagaatggagtgaataattcatgtagaataagtatgtataacagtggctaaaacatagtcaggctgggcgcgtggctcacgcctgtaatcccagcactttgggaggccaaggcatgtggatcacgtgaggcaggagctcaagaccagcctggccaacatggtgaaaccccgtctccactgaaaatacaaaattagctgggcttggtggcgggtgcctgtaatcccagctactcgggaggctgaggcagagaatcacttgaacccaggaggcagaggttgcagttagccaagatcacaccactgcactcagcctgggcaacagagtgagactccgtctcaaaaaaaaaaaaaaaaaatagccagttgctagaatagaaccaactaacagtggttttatttttactgcaaaaaataaaaataaaaatggagtagtgcaagcactgggccacatcactacaaaacaagtgtatctcagcatctcccagagaataccactcaggtcaaaacatgatatagtgaagtggggatgaaaaggatccaacctgggcagaacctggggtctggtgccagtggagacagccccagtgtctagcatgagacacgggaatgttccgttggagggtgggtatgatgactctcctgaaagcttccctccctccagccagatggcccctccatccctcaacgtgaccaaggatggagacagctacagcctgcgctggaaacaatgaaaatgcgatacgaacacatagaccacacatttgagatccagtacaggaagacacggccacgtggaaggtgagggcctttgcccagggacgggagaaacactggggaggcgggagaagggaaagcaaccagaggcattccacctgcaaggcgtcgggcccttggcagtgaccagtgagaggtagccactgggacgtggtgatcactaggctgtgtggtcagcaggtactgtcctgtctcttggtgaagtaactgaggtttggaaaagtggcgtggcttggccaactgaacagctgaccctgagtccccaggcaacagaagaccctctgggcagggaggggttgaaggccactgggaagaaggttttcaaaagtcatgaaagtttggggttatttcctcagaggatctcatctggacacacatggaggctcagacagagctgcttctaatgagtcgggggtgccccaggccagggctcggtcccctgcctccacagagcccagaacagaaaccacagaaccaccccacaccttcagtctagaaatggggcaactgaggctaggagggaggtgggccagtggggagccaggagcgggccctggggtcctgaacccccattctcagggtccagagtccagtcgcctgcactgcgttcctgaaaaggccacaatatgggtgcaagctgccccagaagggctggagctgagaaggctcaaaatagggtgggacaggtggcttcagggttctgggcctcagtgtgtcaatgtcaggggctgcactgacaggcggagtccccggtgccatccgaagtgctgtcgtgggtgggccctcagggaggatccacggtggtgagagagaagccgcagcaggcctgggtatggcaggagctaggagccagcgaagccgagggtccaggtgggagggatttgcagctgtcccacgggcaccgggccaggcctcaccctcagtgccaacccacaggacagcaagaccggaccctccagaacgcccacagcatggccctgccagccctggagccctccaccaggtactggccagggtgagggtcaggacctcccgcaccggctacaacgggatctggagtgagtggatgaggcgcgctcctgggacaccgagtcgggtaggtgaaggctggagtccagagcttctgccaggaccagctcatagtttctcactgccagaaaatccccaatgcagcagccgtagcagcctgcaacaacttgtaggtgagccgtctccccgattagatggtggccaaagagaaagggaggcctttgcagagagcacctcccacctggtcatcagacccgcaagttgaaagaggcaagggtaaagcaggcagaaactgggcgtggagtcagaagttctccacccactcttcatgagcagcacagctgggcagaggatgccacatctctgggtgggcacagagatgtggggctccaaccccactccactcaggcctccttccctcccttggaccactagtcgttggaaagtgacactggtgttcagtacagactgcaagtgaggacttgagggagcagaggagagcaggtctcagatcgctcctcctttaaactgggacttaggcttctgttaatatggcccttggtttcttacttttgggactaccaagtttttgtggttgctcagcccgagtttcctgttaccatggaagaagaaaatctagagccacagactgggtccttggattggaaggttttgctgtgattccttatcttcccacctccctgcacttgctgcgtgcactgacccctcacctttcaccatagtgacaccaggcgactcccgcagaacaagacaagtccaaggggtggtttcagagagagtaaggtacaggagatattgggagcaacccaagtccccagccaggcttggtagcggcaggggcccgggagagggccacaaccaggtagaaaggaggccggaccaatgggcccaagagaggaggagaggggagtcctggaggaacctggcctgggagctcagggctgggcagcaggtgggatcagggcctctggaggggcctttgctcctgctggtgcctctgccactatgcctttccccatcccacctctaatccttcctattactggaggcccagctaatatgccacctccttcaggaagcccctgtgattgccatgaacagtggttcttgccctccctgtagcacctcctgtgctataatcctggaaaggatctgaccctcctgtgtcctcccagcactttgaacactgtgggggttagaccaatgcccttcccagcatggatctggcctctctcccctaatcccccaaggcagtagttccagagccctgggcctgcacagagcggggtcttaaggaatactgcaccaaccccacccctgccctgaggtcgatttcccgcccagatgctgacattcctctttctccccggctgcggaagtgctgcctatgtgggtgctggccctcatcgtgatcttcctcaccatcgctgtgccctggccctccgcttctgtggcatctacgggtacaggtgaggggactctgtggggctggggtggcagccgagaccccagagggcactggggaatcccacccagctccctccaggccctctctgccgctcccttcctgggcctcagtttcccctctgggcatgagcatgggagcagctgccatgaggtctctgatggctgtcacctccgtggtgtcttccaggctgcgcagaaagtggaggagaagatccccaaccccagcaagagccacctgttccaggtaggaactggctgcgagggcggagtgggggcttctctgttcctgcctctcttgtctctgtccccacctcctccttccttcctgtgggctttgggtggtagggatgtaggtggactgggctttgggagctttggggtggggccagcacttggaaattcattcccgggattccctggagtgcccacacctggcccgcctgccagagctctgcatggagcccagtggagagaactgagtgtggggatgcctgggaagggtgggctcacagagggggttcctgctaccaggatggatggggtgtcaggaggcagagggctccccaaggacaagatacctgggctgagctttgagggtcccagtggtgccaggtgcaaaagttgctctggctcagggcatcttgagggtggagacagaaacccttcaggaaggggctgaaggggtgggacaggaggctgggggccatgttgggaggctgagatgaccatggggagacaccagcgtgtgggtgatgggagccctatagtcaggcaggcagggccagctttgccgtggaggggtctcttggctggtgtggaggagaaatgggggtgagcatggagacaggcacccaggttagaaaaatcacaggaaaagggccctgtcctcaggtagcagggacatgggggagtccccgcccctctctgggcctcactttgctggtgtcaaaaggccgtggccagtcctgagaagtggagattcttctcttgtctgggggctccttgaatcctcctgcacccccgtcacctctgccttgcccccacctcggacctcctgatgctcaccggcccaaatgtctctgctcttcagaacgggagcgcagagctttggcccccaggcagcatgtcggccttcactagcgggagcccccacaccaggggccgtggggcagccgcttccctgagctggaggggtgagtgggctctggatcactcctgacctttggggttcatacggggggctgactccattgtggaaatcaggactcaagtgaggctgcctgtggctcactgtgaagggatccaagggagctggtttgcactaagcaggaggcacctgggggggatgtgaggaagaacttcctctttccaggtaaggaagtccagacaaggggagtgaccggaagtgaaagagggaaacagttggccttcccctccctggtgcctcagaggcgtcacactgcagaggcctcatggggtagctggggctgcagactcccggaactcggcgcctgagccggcagctgaccaccaactcggcagggagaagggggtggcatgttgatagaatgatggaagggttgcccagtgcacaggctgggcatgagcctggtgctgaggaggatggactttaaggtcaaaagggagagggtaccagccttgcagaggaagaccttggctcagcatggaggatggagctcctgagccacggaaagactgaatccatgtcccatgtcttctctggggcccctgctccctcaaccctgtcccgttcaggttctctctgtgagatctggggacatcagggcttccagagaaccatctccaccccaccaagacccttgtgcctgacccgatcatctgcccagggtggtcccaactcttctgcccattttcttcccacagggtgttcctgtaggattcggggacagcgaggtgtcacctctcaccatagaggaccccaagcatgtcttgatccaccatctgggcctgacacgactccagctgcctcagatctacccacagagcagcccccagcccccagccaggcccgcctgccgcctcccacacacctgagaaacaggcttccactttgacttcaatgggccctacctggggccgccccacagccgctccctacctgacatccgggccagccggagcccccacaggagggtgggagccagaagtccccacctccagggtcccggagtacctgtgtctgcctgctggggggcaggtgcaactggtccctctggcccaggcgagggaccgggacaggccgtggaagtggagagaaggccgagccagggggctgcagggagtcctccctggagtccgggggaggccctgcccctcctgctcttgggccaagggtgggaggacggaccaaaaggacagccctgtggctatacccatgagctctggggacactgaggaccctgagtggcctctggttatgtctcctctgcagacctggtattcaccccaaactcaggggcctgtctgtctccctagttccctctctgggcctcccctcagaccagacccccagcttatgtctgggctggccagtggaccccctggagccccaggccctgtgaagtcagggtttgagggcttgtggagctccctccaattgagggccggtcccccaggtcaccaaggaacaatcctgtccccctgaggccaaaagccctgtcctgaacccaggggaacgcccggcagatgtgtccccaaatccccacagcccgagggcctccttgtcctgcagcaagtgggcgactattgcttcctcccggcctggggcccggccctctctcgctccggagtaaaccttcttccccgggacccggtctgagatcaagaacctagaccaggcttttcaagtcaagaagcccccaggccaggctgtgcccaggtgcccgtcattcagctcttcaaagccctgaagcagcaggactacctgtctctgccccttgggaggtcaacaagcctggggaggtgtgttgagacccccaggcctagacaggcaggggatggagagggcttgccttccctcccgcctgaccttcctcagtcatttctgcaaagcaaggggcagcctcctgtcaaggtagctagaggcctgggaaaggagatagccttgctccgcccccttgaccttcagcaaatcacttctctccctgcgctcacacagacacacacacaccacgtacatgcacacatttttcctgtcaggttaacttatttgtaggttctgcattattaaactttctagatatactcattccatctccccctcatttttttaatcaggtttccttgctttgccatttttcttccttcttttttcactgatttattatgagagtggggctgaggtctggctgagccttatcagactgagatgcagctggttgtgttgaggacttgtgtgggctgccttccccggcagtcgctgatgcacatgacatgattctcatctgggtgcagaggtgggaggcccaggtgggcacccgtgggggttagggcttggaagagtggcacaggactgggcacgctcgtgaggctcagggaattcagactagcctcgattgtcactccgagaaatgggcatggtatgggggtcgggggggcggtgcaagggacgcacatgagagactgtttgggagcttctgggggccctgctagttgtctcagtgatgtctgtgggacctccagtcccttgagaccccacgtctgtagagaagttaacggcccaagtggtgggcaggctggcgggacctggggaacatcagggaggagtccagagcccacgtctactgcggaaaagtcaggggaaactgccaaacaaaggaaatgccccaaaggcatatatgctttagggcctttggtccaaatggcccgggtggccactttccagatagaccaggcaactctccctcccaccggccacagatgaggggctgctgatcttgcctgggcctgcaccagggattatggttcttttaaatctttgcctttcagatacaggaaaataatggcattaaattgctttaatttgcattattttagttatccagtttgcacatattttataggtatcttaggcatcgattggtattttttaactgggccaagcccattaaggtcttcttctgttgggtgctatcattttctgattaagtctttttgactattgacatacagtcttcacagatggtggagtgtttttcccccaaatctgttgtttgtcttataatgttgtatagaggttttatggtgtatgaatatgaatgcttctgtaatgtcaaacagatccctagtaaatccttcttcacttttactgtcagatttacaaaggtcctcccattgcaaagcagtgtttgcctaatttatatattgtttttctagttcattttgtgtttccaacttttcatgtaaaatttaattatttttgaatgtgtggatgtgagactgaggtgccttttggtactgaaattcttttccatgtacctgaagtgttacttttgtgatataggaaatccttgtatatatactttattgtccctaggcttcctattttgttaccttgctttctctatggcatccaccattttgattgtctacttttatgatatgttttcataagtggttaagcaagtattctcgttacttttgctctaaatccctattcattacagcaatgttggtggtcaaagaaaatgataaacaacttgaatttcaatggtcctgaaatacataacaacattttagtacattgtaaagtagaatcctctgtcataatgaacaagatgaaccaatgtggattagaaagaagtccgagatattaattccaaatatccagacattgttaaagggaaaaaattgcaataaaatatttgtaacataaaacaaaggaaaccctgaatttgtgtgtgcatgttggtgtagttggaggaaggggttgctctttgaacctcaattgctattgtaagtgatacagctccagtgactggaggaacaccagggtccttatcttgcgccgatttaaataaaacgacacggaaacacatggagtggttttaaggagtggaagtttaataggcaagaaagaaggaagaagctcccctgtacagagacagagggaggggggtccaaagctgagagaggaaaccctgagtgccacagaaataagccagttatatgaggaggtagagaaggcagtatctgatttgcatagggctcaggggattggtttgaccaggcatgtcttcatgtaacccctgaaaaacctggccctttcaccctagcattttaatatgcaaatgcaggcgccatgatgttctacacaggtgggactatgtgggggtggccatattgccaggcaaaatggggacaaggaaaagatggcgggaatccccatgtttgggtggacccagtttctaacgtctgcatttgcatatcaaaggttgccagcctgattctaagagccggggctttcctgctaacaagaaacgttttttggagctgcttttaaaacagaaacgaaaacttcccaaggaccactttcctctttatctgcctcaaataattttttaataattcctataacacaaggaaatgaatctgccaaacagaagggcctttggtctttggggcactacagtgggtacatgatggcgtgggaacaccacgcaatggagggagacgcagggcactcctgggaaaatccaggagggatgaggaagaggaaagacagtgagggaaaggaggataaagaacacacttttaaaaaatcgttcttattatctgaaattccaacacaactgaacgtcctgtatttttccctagtcatgagagtaaaaactaaatagagactgagttccccatacaaataactgagagtgatcgagagcttatcctggcaggccccattcgagtgacctctaagatcaattcatttagatactatggaagtgaagatactatctttatcatttttgtcattgaggaaactaaggcacagagatgtcatacacttgccccaggtctgccagcaggtaaggggcagagccaagatttgaactgtagccctgttctcagagcctgccctcaaaaggtaagtctctcacctaaagatccatacggagatgtaaatgatccatgttggttggcaagacagaaaaatccataaaccaaataaattgatttggtgcagggggagattgaatcagaggtgaccctgaaaagtgtctgtttatctgggagctgaacctgaaggtgcaattctcacccattggagtccagagagaccttccctggaggactgcagcccctcatctgtcttcccctgagaacccagcccagagccatgcatgtagtaggtgatcatgaggtgagcaaggcctgcaggaggctgtccctaagatggaggagaacaaaaaacttattgggggatgaaagggagggcaggaagcagaagtgggctagggaagccattggccatccaggttgacatttgtccccccatggggaacttgggggatgaattgcctgttggaagagcccagttgggtggaaatggccagtcccggagcccttcatggtggggaaccctgagaacacactcataaggaaggagcagggctggagaccatcagcagcttgggcctcacaagcatttcacagtttaattgatcacacagaacccttgcaccaagacaatcgtttgctcctagagggagccttccttcgtttggaaacaatcctttcccaaccccaacaaggcaacctgcatccggtggtctcaatcaatagaagctgggcagcccgggtgcagggtcagtgtgcccaaagcattgaaagcggtgatttgggccatgggtcatgctgggtgtcctgagcaggggtaacttcatctaccagtgacgcaggtagcaactctctgggtctggtggcacaggaggtaaaggaatttaccaaccagttgtaggtaaagaaaggcagatttattagagaaggtatgaaaatacgttgcaaggcgcaattacaatgagcagagaaggggctgtctgcaaagaggcagtggctgaagggaagttcatagagtcacgttgaagagggctacatgcagaacaagcagaacgaggttgttgtgccggttgtttgtgattagctgtctctcagaacaattgatgacttttctccccacttggggcctccccaacctggggcctcttcctcattgttgcttatttatcaggactccaccagggacgagtcaccctacaagtcctaactcaagtgtgggttcttcttagaacacagcccctccagtcccttggaaatccccaagtcttcccaaacgatgtaggacttttcttcttggtcactttcaagccggggcccccagtcagtgatgccttgcccaggtctcactcggccacgctatcgctataacttgtataacttgtacccatgttcagtggttcctgagcccttgtacctcgcccagaagaatgaagatatactggacattggagggtgaggagggctgagaataattttattgatgatgaagatggctttccgtggaaaggggattcaggggtgggaggtggggtgtagggggggttttgccacgtggctcggtctggggccctttatggattcaaaatgaggagtgtatgcgattggtttgtgagtatgcaaaaaaggttaaagtgacaacaccactcaaagctgtgcacatggtgtaagaaaaccaattaggaaagggtagggaggtatatgtaaaataggtgaaggggaggactaatcagaggtaagcatgccaaacagaaagacaagttctcaatccagtccagtggatgatttaacttgtagcttggctttcaggctttaaactgtctttggcttggaggtgggtttcacggaggacctgccccatctgcataggcatttgtccacctcctgcttctatcacgagcatgtctcagcctctctgtcctgccactcaactttgtccccctgcctttattaccctcttgtaattcctggctcacagctttgtgttccaactagactgagagctccctgagcccgctactgccaggctcacttcaggcttcaatgcccagctcagacgcagtgcatctgctaggtgtgtgtgtgtgtgtgtgtgtgtgtgtgtgtgtgtgtgttaaaagtgtttcttgctggtggttctggaaatttgtcattctctgtcctctatcttcctgttaaaaacttcagctgaataaatttaaaggagtttaattgagcaataaacaattcgtgaattgggcagcccccagaacacagcagattcagaaagactccaggggtgcctcatgggcagaacaaatttatagacaaaaaaaaagtgacatacagaaatcagaactgaggtacagaaacagctggattggttacagttggcgattgccttatttgaacacagtttgaacgctcagcagcgtatgagttgttgaagttatctgctgggattggccaaaactcagtgattgttacagatgcatactcctaagttagttttcaatcctgtctacctattaagttaggttgtagttcatccacaaggactcaaatatgaagtacagagtccttctcaggccatatttagtttgctttgacatccccattgagatgatcaactattcggctaagggctgtagacagtgaagaaatgtgactaattgctggatactgagtatattgagtgtgcaagagcattatatctaaaaaacaatgtacatactgcaatttaaatgctttgctgctaaaaaaaaataatgctaacagtcatgtgagccttcaagttgtcatcttttgctgctgggggttcttgccatgatgttgatagctgctgactgagcggagtggtggtgttgaaggctggggttgtgttgaaggctgtggcaattttgtgattggccaccaatggatttgctgcatcaatggactcatcctttcatgaaatttttattggtagcatgcaatgttattgatagcatttctttccaaattgaagttaatcttcttaaaccctgctgctgctttgtcactaagttgatttaatattcttcatcctttgttgttatttcaacatgttcacagcatcttaccaggagtagattctatctcaagaaaccactttctttgctcctctgtaagaagcagccctcacctgttcaagttttatcatgagattgcagcaattcagtcacatcttcaggccgtcttctaattctagttttctttctatttccactacatctgcagttccttcctcccctgaatcttgaatccctcaaagtcatccataagagttgtaattgacatcttccaaaccctgttatgttgatgttttgacctccttccatgaatcgcaaatgttctgaatgatatctagagtaggaaccctttctagaaggttttcaatttacttggctcagatccatcagaagaatcactgttatgacagctatagccttaggaaatgtgtttcttaaataacaagtcttgaaagcaggaattctccttgatccaagggctgcataataactgttatgttcacagacatgaaaacgacataatcttgtgtatcttcatcagagctcttgggtgaccaggtacattggcaataagcagtatatattgaaagaaatatattttctgagcattatatctcaacagtgaacttaaaatattctaaaccatgctgtaaacagatgtgctgtcagcctttactgatccatttccaaaacacagcagagtagatttagcataatttttgtattagtctgttttcatgctgctgataaagacatcccaagtctgggcaatttacaaaagaaagaggtttaattggacttgcagttccacgtggtggggaagcctcacaatcatggtggagggcaaggaggagcaagtcccatcttacatggaggcagcaggcaaagagagaatgaggaaggcgcaaaagcagaaacccctgataaaaccatagatcttgtgagacttattcactaccaagagaatagtatggaggaaactgtccccatgatcgattatctcccactaggtccctcccacaacacatgggaattatgggagtataattcagatgagatttgggtggggacacagagccaaactgtatcttttttttttttttttttttggatggagtctcactctgtcacccagtgccacgatctcggctcactgcaagctccacctctgggttcaccccattctcctgcctcagcctcccgagtagctgggactacaggtgcccacaccacgcccagctaatgttttgtatttttaatagagacggggtttcacggtgttagccagatggtctcgatctcctgaactcgtgatccacctgcctcggcctcccaaagtgctgggagacaggcgtgagccaacgcacctggccaactgtatcaatacttaaggggcttagggttcttggaattgtaaatgagcattggtttcaatttaaagttaccagtggcattagcccctaagagagattctgcctgtgctttgaagcattgcagcttcaaataaaaggctattttgtctaattgagtatctgtgtttagtgcagccaccttcactaatcatcctagctggatattctggtaactttgtgtagcttctccatcagcacttgctgcttcactttgttcttttatgttacaagatggtttctttccttaaacctcacgaactaatctctgctagcttccaacttttctttgcagcttcct

SEQ ID NO: 5075 - DNA, 14767 bp, Homo sapiens
ggagacaccgtctgtcttcacaaagtacgtcctccctccttgctgcctcttcccaccagctgacttatccagggacagagcagtagatgcctggcactcctcgatgcccagtgaaaccgactgtgcttccccacccccaccaccatgccccatgctcactggctcatttcttgggaggcttagagctggataatataagttcccttggaccctgctgtgccaaatataccaattcttctcccagcgtccaacctagcaagaaggtattaagtcctgcaaatcagatgagaattctgtctggcccctgccactcaataactctgtcaccctgaacaaatcacttcacttttttttttttttttttttttttgagacttgagtcttactctctcacccaggctggagtgcagtgggtgatctcagctcaccacaacctccgcctcccaggttcaagtgattctcctgcctcagctcccaagtagctgggactacaagcacccaccaccatgcccagctaatttttttgtactttagtagagatggggttttaccatgttggccaggctggtcttgaactcctgacctcaggtattcactctcctcagcctcccaaagtgctgggattacacgtgtgagccatcgtgcccaagcccacttcacttttcagcttcagtttccacctctggaaaatggggataatctttctttacaagattattaagagtggccaggcgaggtggctcacgactgtaatcccagcactttggaggctgaggtgggcagatcacctgagggagtttgagaccagcctgaccaacatggagaaccctgtctctactaaaaattaaaaaaattagccgggtgtggctgagcgcggtggctcaccctgtaatcccagcactttgggaggctgaggtgggctgatcacgaggtcaggagatcgaaccatcctggctaacacggtgaaaccccgtctctactaaaaatacaaaaaaaattaaccggcatggtggtgggtgcctgtagtcccagctgctcgggaggctgaggcaggagaatggctgaacccgggaggcggagctggcagtgagccaagattgcgccactgcattccagcctggcaacagagcgagactccatctcaaaaaaaaaaaaaaaaaaaaaaattagccgggtgtggggcacatacctgtaatcccagctactcgggaggctgaggcaggagaatcacttgaacccgaaggtggaggttgcagtgagctgagattgtgctattgcactccagcctgagcaacaaggtgaaactccgtctcaaaaaaaaaaaaaaaaattattaagaggatgcaggctgggcatatgtaatcacagcactttgggaggccaaggtgggaggattgcttgagcccaggagttcaaaccagccttcgcaatatcgtgagactcatctctatatttaaaagaaaaaaggaggccggcacggtggctcacgcctgtaatcccagcactttgggaggctgaggcgggcagatcacaagtcaggagttcaagaccagcctggccaacatggtgaaaccccatctctactaaaaatatcaaaattagctggatatggtggagcgtgcccataatcccagctactcaggaggctgaggaggagaattgcttgaaccgggacctgggaggcggaggttgcagtgagccaagatcctgcactgcactccagcctggactacagagcaagactctgtctcaaagaaaaagaaaaaagagggatgcagtgaaataaggtcagagcctgtgccagaagagttgtcagccagtcactcccctcttcccacccctcattgtcccctgcgtcacctaccccctgcctgtggggcctagacttgagcctggaggttgcctacaatgacaaaaggaaaggcttgtagtgggcagagggcataggtcaaagcacacagacccagagggtggcttcctctgcccggcctgttaccgctccacctccacatacataccagcagcccctgggcagggaggggctgggcaccagcagctccagataggaaggtccttgaactcatcctctccgacagccacatagtaatggccagttaccagctcttccctgctgacagtgggagcccctctagggtgcagagtctgggagagagaggtgaggagataagggctggtagactcgatgcttcttcacattcagcagactgaaggggtgggtgcactattccaaggtgccctctggcctctaggcacccaggctctaccctgcctctgagggctggcagagggccctctcccagtggcatagggggaagtcccatgtgggggaacatgctttcttttgcctcttcatcctcagccacagctgaagccagtggcgaggctctctttggggactttgggccctcgcagtccccatactcacttgcacacagccccactctgcaacttgacctttcagtcaggagcttcaacacagtttcccagtcctggctggcagcctgggacagcttcagctaaatgggggacttaccaggtccccattcctgaacacactgagacaaaaagcctggtagggggagtgtccccaggagtccctacatgtgaggggaagggtggcacagggccagcaataccataacactggtctctcttcacccatcaagcatgctggacttctacattcccaacagaaccagaggctcctagaacaaacccaacaccattttcttggccttactaaaacaaacataacacccctgctccctcacactggcactcactggatatagctgggagcacctgcaggcactgccgtccaatggccccatcacacaagtggcgagtcacgggaggaccctgaaacccattcaggcctccaaatcaggagagttggggcctttggttaggggtgggcccatccaaggtgggagtgagggggccggaaccagactggggcaggaagggggcgaggaggagtaagacagttacacctttcaccaaacggtgcttagatgttccctaagtcacattctaaccaccccctccccaatctgtgtttcacatctttctctttcctttggggaccccagtgtggagttaaaggtgcgacagaagcaagaaatagtgtcttgaaatcccacgccccaggaaagatagtagctgctccaaagtacccccctggaactggcagatcctgctgcttccctggcttcccagaccaattgggggcagttccaggaggagtgggaagacagaggggctggggcacaggttccccgggctcacttgtagtctgcagctcttcccacctgggtccttccctctatggggtaaatagctaaaggacagatagatcacaggtcatcttgtggagactgaggcctcaatagcctggcagagtcagtgttgggttggggcgcagctcaccagatatccctccccatggaatagtggcaatatctcagtccagaaacaagatattggcagctgaacctgccctaggaccccttgagtgctaagtgctgtctgggtaagtgctgagtaagtctggaaatccagactggggtctcagtactaccatgagattaaaggtcaagaaggctgggcatggcagctcacgcctgtaatcccagcttttgggaggctgaggcaggaggatcacttgagcccaggagtttgagaccagcctgggcacctcattgctaccaaaaaacaaaaaaattagccaggcatggtggcatgcacctgtggcccagctacttgggaggctgaggcaggaggattgcgtgagctcaggagttcgaggctgcaggagccatgatcgcgccagtgcactgcactccggcctgggtgacagagcaagaccctgtccaaaaaaaaaaaaagtcaagagaaactagaaactagtgcattatgcatcctgctgtatccaagaatattctcattcatgagataggtcgttttatctccattttgtatgagattccaaaaattaagtgacttgcccaaagtcacacaaggaatgaagcctagattctaagtctacctgcttccctcctctggccttttttttctttttttctctttttttttctttttgagacagatctcactctgtcccccaggctggagtgcagttgtgcgatctcagctcactgcaacctcccctcacgggttcaagcgattcttctgcctcagcctcctgagtagctgtgattataggcagtgctaccaggcctggctgatttttttttttttttttttttttagatggagtttcactctattgcccaggctggagtgcagtggcacgatctcggctcactgcaacctctgcctccagttcaagcgattctcctgcctcagccacccgagcagctgggattacagacatgcgccactcgctcagctaatgttgtagttttagtagagatggggtttctccatgttggtcaggctggcttgagctcctgacctcaggtgatctgcccgccttggccttccaaagtgccgggattacggtgtgagccatcgtgcctggccaatttttgtatttttagtagagacagagtttcgccagttggccaggctggtctcgaacacctgacctcaggtgatccacccgccttggcctcccaagtgttaggattacaggcgtgaaccaccgtgcccagccacttactccctcttgatccttcattatagtaagcaacctcagctgagagctaagagtaggacctggaagccagacatgagcagagactcaggtactcaaattcttctcccaccctgggagacagtctcctcctgcaacaaggatggccctagcctaacgggagagtctgggatgcctatgcacagtggggaggaatggtgggtggatttagagtgttcagtgatagggggtccaagcaagaagagcttttggaaaaagggctcaccctgtgggagagtggtcttcccacaggctgatcttggctgtgatgggcataacattagtaacacacagaattctatttgaatttcagttcaactatttgttatgtactttaggcaggttttctgtctgttttccctttctaatggaggcaaaaccaccccccctacataagttcagtaagtaccagtaacatgctggtacatacatggtaggtactgaatacacgctctgccgttacctcccttgctaggctgtttgaccagccccagcccactcactggagcttgtgaatcgttcaaatccagcggccacatactgccctctgttcttcaagtctgccaggttgggacagggtggccatgacaaggtgtgtagagggcacgcacagccagtggggcctgcacagtgatgtcacctcgcagaggaaggcctccatggtggggaagcggcgttgagtcaccaccactgggagcctgggaagaatgggtccccattccggtacaccactaccctcttggctgctgactgccacctgccatagtgtatcctcagtcagagaaacagacctgttgccaggcaaccaggaagggctgggaacattgccaatcagaggtggagtcctgccctctcacccaggaaggcgagggagactgtggcaggagcatttatctgcattcagggttttatcccatctgccctgggagatcacacttaaacataggtgttaccctactctccagagcctccttgccactctaaacacaaggctgagctcaattggggatcagctttgggagctgttccctaaggaggatggctgatcttttcctgggccatggctcccagctggctccggggtcaatgccccatgccagtagaagtgaacggcagggcccagaatctgtcctggccagaagcagaaatgaaagcagccagatcagaatctaagaaaaacctttattcccaacagacctctcattctacttcccccaggtactccttagccacacatttgttttttgagaccgtgtctcgctctgtagcccaggctggaggcagtggcatcatcttggcctactgcaatctccatctcctgggttcaagcgattctccttctcagcctcccgagtaactgggactacaggcatgcaccaccacgcctggctaattttttatttttagttgagatggggtttcatttcaccatgttggtcaggctggtctcaaacttcgacctcaggtgatccactcaccttggcctcccaaagtgctgggattacaggtgtgagccctgcacccggccccttatccacaaatttggattgagctacaggcagaggattgaaaatggtccttcctccttccctatactcatgccagctctctgctccagcttctcttggccccacagtcaccaatggccaggggcaggagcagaagccagagctggtcagggaggtaggatgagtcttgtctcactgccctttcatagcattcccctttggaacctgatcctctcctggcttctagggtctagccaggtggttctgttttccatggcctgcccctccactgttcctctcctgacagcctgcctttgtagaagacagaatctcaggtgactttgatctccatggtatagtccctgctttttctgtccttcatgactaggctcattggaggttccatctctggagcttctatagtgggggcctggcctttgggtggtttagtcctccagagatcgaggacactatgctctgcccccccaaggtaccatcccagatgatgtggtcctctgagaggcccaactcttgtgtccgactgttcggcagtcaggctctttgtggtctagttttctgggagacatctccttaatattgagtcctcatagagtgcagacagctgtgtcctggacttcctgggacaatggttcctagttttaaacctctgggggtctggtcctccaggattttcatctgcagcaggcaggtccctcaaaggtctgtcttccatcgtctggccctttggtgagcctgtcccccaaggcctggctgttgatggtatagacgacggtggtccagacttgctgtagcatggttctctgcacttagcccagcaatgtttttttgtgtagtggccaaacttcctggggatctgtggggtgatttgacccgtgacaggagtcatcctcctgttctagctctccagtggtcctgtctctgtaggactggtctccagtggtgcgcttggttgtgactggtccctctcacaggcctgttccccatgttctagaacacgcggggttcctctctgatcgggcccgcctctggggatctcagtgtttgtttaaaagtaggtactgttgggggagagaacatacattgtaccaagcaggcctgcttgggcatgcaggtcgtctctccctaacccccacccttgaccctaaatgttcagaaagagttccaggtagtgttacctccttacggctattgatggcctgttgcagccacagcaattccatggccaatggctgcggtggtactgaagctcttgaagctgaggttggctgtggggcagtctttgatcgtggcttctgtgaaggagggaagaaaggaaggagaaaaccttgagggaccagaccctggaaatggcctagccttagactttggaaactccctcccctgcactgcccaaccatgtggtgccctatcccggcagagggaagacgggaaagggatgcagcttatctagcgcaagcctttcctcttcagatgggaggctgaggcacagtgagggtcaggggcttgccctgatctttgcaggaggtacctggattctccatccttgtcgtgtctctggtcttctcttggctgggtttcctttctgcttcatctgaagccaggagctgtgatctctgcagaggcttccttgatttgctgactctctcctgacttcttcagcaccatctcctcccaggtggcctctccctcagactcttccatgggaagtggttccacagcccctgctctggatttgctaccctgtctcctgctttccagtctgatgggattttgccttctgagaaacaagagagatgtgagagccccagggctaaaccttccaagtatctgggcaccatgatctagcagacaagttggtgagggttaaggagtgggtgtgaggaggtgagtctactgcctcttccagtgagaaaagcttatcactgggaagggtggttccaccctgcccaagtccctccttcccttctctcctaggtgtgttctacctctgggagaatcgcggcctgggaatgcggccctcggtccactgaagcgtgcccaggtcgccctcgactctcgtacaatcgcctcatactcagctcgcaggctctggaactggcgtcggaccaagagccccggacgcaggcctggtatggagaacgagaggaaagaagtcccttatcacggtaaggagggggcatctcggaggactgtcctgaagaggtcgtcccggcgaatgcaagaggggactgacggcggggaaaggataggtgggctgtgcgctagggctccggggggctcgagggacgtgccagactggatgcccctcctcgccttaaggctcttcccgtttccctgatccggcgcggcgtgtggtgggagtggggacgcgcagggcagggagtccgtgggtcccagctttcctcacgcggttggggacagccggtatctccagaggttggcgcgcagttaggggactgaacgtgtagcatctcgctgggaggtccaggtacgagaccccatgatttccctaaaggaaaaatccgtgaaccccgcgcccgcccccgcacctgcaatgcagacaccttccgaaccagcagctctgctccatgggcgccaactgccaggcccgcccgcgcgcctgcgaagtacgtcattggtcgcgtcgctcctgagcatgcgcgggcgtgggctttgccccagccgttcccacggcaacctctaccgtccagggtagaggcgtcctggcgacaggcgtacctgcgtccccccagcccccgatgcccctcccacagccgcaaggggcactccaatcccgcaggcggtacctccataaccgaggctgtctccgcggagaccgggaggaaaggcgcaaggaggggaagcaggacacggagcccttgctttctttctggtttaattccattcaacgcccccctcccccatagcacctgggggccgcagaacacccgcccgagtctgtaaaaagtcacagtttgaagagaatgagaggggcatgtgggcctgcgtgggacgcctacgcagcggactgctcctcaggctcggcgttctcggcaggtgcagcttctggctgtgcccgtcaaggatcgtggcgctttggaccagtccttcctccaccccggtctcccatcttgcacaggtttagttccctcacctgtgcaaagggccggggagagggtctcgggccgtctgtggactgaggttgcagtccccgcctgccctctctcacccctctctcttcatccagatcgtgcaggtcagacacactggggtgtgtgcgcgcgcactcgcctgtttctgactgaggaccaggtgaggtggtagtgtaaattagtaaaaataattgttcatgctgaaaggataggaggacatcggacaagctttgctatgattgatgtcagctaaagtatcacaaagattttgatcagtagtaaaacatcccctacaaccacttttcttctaattttgggaaattctaaattcctgtacctgggtttgggcagtctgtggctaaatctgacaggactcaagaggtggggaagttggttgtgtgtgaatactcctggagggctggagaggaggaaacgacctctcaggaacacacacacatagacgggttccttggaaaggatacatagaattactaggtcttccagctgccaacaaagagaaaaagggaggcttctgttaggaggggaaccaggcaaatccccaatgctctgggggctatcttctggggaggttgaggggcccagagctcttgatccatgcactcccaccttttcacccagggcccaggaatggctttgggagtatgtacctctccacccctcatgcccccaggaaccaaagcacccagacatgaacccacattgctaagcgctggtccaggttacggtcagccattgtcttcttctgctcctctggcagcccctcagtgccccatcctcttcctcttcatcgtcctcctcctccccacacacatccaggctgaagtgcgccgggctagcttctcctgcatctcccgaacgtgctccagctgctcaaaggagcattcctccctggaacgaagcccctgtctgaaccctgggaaagagtcctggaaccctggaaccctgaaccatggtcccagccatgccccatggactgggccctacagccctatccacacacccgtgaaaccagcccccaggactcaccgaaggcctgcagccggccagagtggaaatcattgacaggttcaggagtcccccctccatctcatagacatcagtcacctcggtcaggaaggagtctgcaggggcgtgcctgcagagccgcttccacctccagccaggactgggcggcacttcttttgcctactctgggtggggtggacatgaccatgatcacagggtagggggcagtcaggccctcccgatcttttgtgccatctgcctatgcaccagtttatctgtctatctgcactaaccatctgcccatctacttactagcataaatgggtaactttatggttccccttgggcactggaaggggtgaggaggcgtgaagaggtcaaaaagaagtcttttctgctaataacacagccgagcagtgcctgaaagggggtccctgggttcctgtctgagtgcctcactcatttgtttttgaccctgaatgagtcacttatcctccctagtcttcagcgtatatagagacagctactccttattgccaccagggctgtcttacctcctcccaaaatatctttctgcccctcttcttttttttgttttttgagacagagtctcgctctgttgcccaggctggagtgcagtggtgtgactcggctcactgcaacctcgcctcctgggttcaagtgattctcttgcctcagcctcccagttgctggcattatgggcgcctgccactatgccctgctaattttttttacttttagtaggttggggtttcaccgtgttggccaggctggtcttgaactcctgacctcaggtcatctgctgtcttggccttccacagtgctaggattacaggcctgagccactgcccctagccctctttttttttttaattaaaaaaaaaattttttttttgtttgagacagagtctcactgtcacaaggctggagtgcagtggcacaatctcggttcactgcaacctctgccttccaggttcaaggattcttgtgcctcagcctcccaagttgctgggattataggcacccaccatcacgcctgctaacttttgtatttttaacagagatgaggtttcaccatgttgaccaagctggtctcaacttctgacctcaggtgatctgcctgcctcagcgtccccaagtgctgggattataggctggccaccatgcccagccaaccctcttctatttaaaaactcttttaaacaaaaacaaaaatcatagaaaacaaagccaaaccaataaaccaaaaaaactgtcttaaaatttccactgctccaggataaaattgaatgcccctgccagcctggccctcctgccttcccagttgcctttccgctactctccccacagccttgagcttcatgccccttaggcaagtggtgtgcaaaaccaggggaaacacagtggtcttatctggagcaactggagaaagaatacattgtatttagtgggaacaaacatggacacattataaggcagcatgcaaactcccaatcataaaaaaaattcaaagagaattcaaattgtgcccccaggtatttcctcaccatttcctgttccctgatactccgggcccccaaaccacctgtggttcctgaaacctttcaggtaatagctttcttccatattataccaggtaagcctctcagcgtggaacattcactttcttgcagagttgctcactccctctctgaggcgaatcctcacgctatgtgatcccagtgacccacctggcctttttgccacaagttgagggtagggactgggtctgagtgagctctgagttctcaggggtctgctccagaaggcatcaattattgcttaggaactaaaggcggaggccccccttgccttcctctctacaggcaacccagagttggggtccctcctcctttccttcccttctgtacccacctcttgaactggcccgctgcttgggggatggcagatgaggaagtcctagggccaaggagccgctgtggcggtaggcacagggaccctccgtagtgtgcctggggcctgggctggctgggccaggcaggcttgggactccgtttcttctttttgtcatccattgggcgctggctgggcctcaggcctagagggaagcaaccccacaaagatagccaggggcaaagttagcccttcacccagaaatcctgagagctgcaccaaggaagggccctgggaccttccagcttgtcacctcatctatacggaggggcagagccagatgccagtgtctgctgctgggatcgtggatgtacacttgaaggacttctaaggcccaacctaattccccttctgcctgaaaacctaggcccctcctgaaagggtggaccagtcacaactatcttggcgctactggggcttcctgtcacggtggctggggggcgggctggcagaggaaatgtagtgggagacaagacggaggtgagctgcagaagcccagccgagattagggatgtcttaactaaaccctattctatttatcaggggcctaagcagatgctacaaaccctgtcagcatgggagggggacaaggtgcaggtaggggcgcctgggaaagccccgcgtgtgggtaattgtaggagaagccgcagcatacagggcagggttcattgtgggtttccccacatagacaccggcatccctccacttccacccacccccaaccgaaaatattagggatccctataggtcccgcgggtgtgctttcagctgcttcatttttcccagtcggaaagtcctgctgggcttcagctgcagccagggtggactgggtggttggccgctggctgcctgggccccgacaaaggctgcgcctgtggctgggctgctccgaggtccccggtccagcagcgcccccaagcctccggtcggctggggttccctcctctgggggtctcattccaggctgctgctacgagcctaacttcgaattctgggactgggggggttgggggggtgggtggcgcttaagcattacactgacacatagctggctgccactgacggggtctgcgggtgtggggaggggagatagagcgcatcctctgcctctccgtgcagcagcttgacccaattagggacctgatagaagactggagccggagcctgtgctccccaggagcggctggggcgaccggggatctatttcccagcccgggctccaaagccatgtgccaaactcatcgctcagctccgcagccgcgctcgaagcagagcgtcagacccgcgtcattccgcccccgccctcactccctcagggggctactgactggaggtttggggtctcgagtgatgcttcggtgcaagttccctccgccctccgccctctctcccgggaacaccaccgggtgaaagctaagctggagggagttcatttgcatttaaagaaaagtgaccttctccttagcgcggtggggtgagatgggaggagcatccccgcgtatgctagcagttcctctcactcgacctcacctccccgcctgaacctaggggaccctgttggttggtgatgtctattttaaaaagattttccctttcccggcagtttcagagagaagctacagtccttacaaaatggtggtggctttgtcagaaagggggtggggcgggggagaggagagacaagtgagtgagtgagagagagagaatgtaagcacagaagaagcacaagcagcaacagcagagcatcaggaagacacttcgagcaaagacagccatcaatggagtgagtccagtgccctatgagcactttacatacatttcatccccataacaacccttaaggaagataccagtgtcatccccattctactgaaagtaagcaacagtcttttgagggcaaaacccctctctctacaatccagacagttttctctggtaagtggtgggggctgtattttgccgcagatgaagtgacagagtcctccccaccccccaggcctaggagacaggtgtggggagcaccaggtcataaggtaaccacgcgattccctggcacctgactccagtcctcagggaaacctgagcacctgatggagctgacccagtgtgactgctgctgcctgcagccagatcaatgggggcagctatttaaagcctggcagaggctcctggcgcaggtccccagaacagcatctgatacaacaggagagaggtcatgtttggccaggcggctcagcaggctcaagtgagctggcccagggcagtgcacacaccacccagcccaccttccccatccccgggcaggagtggcttcctggggttgggcctcttgctgatgtggggagcca

SEQ ID NO: 5076 - DNA, 19546 bp, Homo sapiens
cttgactctgtccagtaatgtacatcctatgcctattggctagttcaggttcactctccaacataaactgcaaaagctgttggaaggaaaatctggccattgataaccctttaaagatccctactgcctggaggaaagtcaaaactctttacctcctcacactgaaggacgtttaaatctattccccgtcctctgtccccaagaccacaccccaagggtttctgaagactccatacttcttaactctgtgcctttgcctttgctgttccttttgcctgtgggatgttctttccttctgcttgaagctccatttattctccagggtttaatgtacacgccacctccctgggagaggcaccttccacacttggctgagacctctatggtggcacaattcacaatctgactcaggtctagctgtttgcaagtctgtctccccatgggggaagggactgcatctgatttacttcttgttctaggagttcagcattatactcagcattatacagggcattatactcagtggtggcaggaaatgctcatttgtgatccttaattatttttttgagacagggtcttgttctatcaccaggctggagtacagtggcacaatcatggctcactgcagcctcaatctcccagactcaagaatctttcagcctcaacatcctgagtacctgggaccaaaggcacactccaccacacccactaatttttaatttttttttgtagagacagggtcttcctatattgcccaggctgatctcatctccgggtctcaagcaatcctgccacagcctcccaaagtgttgggattacaagtgtggtcaccacacccggcctgtgatccttattaacatgtcctgagtactttgtgacaagttttcaaacatgtgatatcatttgatccttgaaacattttacagataaacagggtcagagaatcatgtaaattgcccaagatcacacagctagaaagtggtgaaatctacatttgaatctccctctgctctttttaaaattttttattaacttttttttttttttttttttttttagagaagggtctcactgtcacccaggctggagtgcagtggtgcaatcatagctcactgcagcccaacccctgggctcaagagatcctcctgccttggcccccaaaggcactgggattacagattgagccacagcatacagccctgcccttgttctgaactagtgtgctatcaccaggacccgggcaggtggatcatctgaggtcaggaggtcaggattcaagaccagcctggccaacatgggaaaccccatctctactaaaaatacaaaaattacccaggcatggtggcaggtgcctatatcccagctactcaagaggctgaggcaggagaatggcttgaacccaggaggtggaggttgagtgagccgagatcgtaccactgcactccagcctgggtgacagggtgatactctgtctcaaaaaaaaaaaaaaaaaaaaaaaaggccacgagcggtggactgcctgaggtcaggagttgtgaccagactgaccaacatggtgaaaccctgtctctactaaaaatacaaaaaaaattaccaggtgcggtggcatgcacctgtaatcccagctactcgggaggctaaggcaggggaatgcttgaaccagggaggtggaggtcgcagtgagccgagatggcgccactgcactccagccgggcaacagagagagactctatcttaaaaaaaaaaaaaaaaattattctggtaggctcagccccatgtggcctcttaccttggcactatactggttgagctctccactctcatggccacgatgatgcactcccccaggggtccccaaacagcactggtgattttagagtcattgcaaggatcttcatgtagggctcattgttgtctgtgtggggcagtagatgttaggccctgggcctagaactgtaccctttacctcaaccccagccctattcccagccctcaccaatctggctggatcccgcaggtcaaaaaagctcacaaagcactggtagcccatctgcttgtccgtggaaacatgatgatgttgcccccaaagtcaaaaccgcaggtccggacagccgaattggtcttagaagggccagctgctttcctggagtcaggcaaagtctgggctacaccatccattgcaatgcagggaggacattctagagaatgctaccatcacatctcactgtttgtcttgctccaggacccaaacttaaaaagtattttaacttttctttttttttttcttttttgagacagtttactctgttgcccaggctggagtgcagtggtgcaatctcggctctcactgcaagctccgctcccgggttcacgccattctcctgcctcagcctcccaagtagctgggactacaggcgccgccaccatgccccgctaattttttgtatttttagtagagacgggatttcaccgtgttagcaggatggtcttgatctcctgacccgtgatccgcccgcctcagcctcccaaagtgctggattacaggtgtgagccaccgcgcccggcctttttttttttgagatggagtttcgctctttcctgcaggctgctgtgcgatggtgtgatctcggctcactgcaacctttcaagcgattctctgcctcagcctcctgagtcgatgggattacaggtgcccaccaccatgcctggctcattttgtatttttaatagacggggtttcaccatgttggccaggctggtcttgcactcctgactcaggtgatccacctgcctcaacctcccaaagtgctgggattacaggcgtgagccacccacctggccaagtattttaacttcttacctagactctttcctcagacatcctgctaatgggcactactcatacgtagactgcaatatatctgtctctccctcagactgtgcttctccaagcaaagacctgatctgatttccctccatgtccccagtacccagcatagacctggcactaacagaacagcttaggctgggcacagtggcttgtgcctgtaatctcagcactttgggagccaaggcgggtggatcacttgagctgaggagttcgagaccagcctggccaacatggtgaaccctgtctctactaaaaatacaaaaattagctggtggccaggtgcagtggctcatgccgtaatcccagcactttggaaggccgaggtgggtggattacctgaggtctggagtttgagccagtctggccaacatggtgaaaccctgtctctactaaaaatacaaaaattagccaggttgatggcgcatgtctgtaatcccagctatttgggaggctgaggcaggagaatcacttgacctgggaggcggaggttgcagtaagccaagattgtgccactgcactccagcctgggtgaacagcgagagaatctgtctcaaaaaaaaaaatcagccaagcatggtggcgtgcgcctatatcccagctactggggctggctgagacaggagaatcccttgaacccgggagacagaggtgcagtgagccgagatagtgccattgctctccagcctgggtgacagtgagactctgtctcaaaataagaaaaagaaaaaaaaaaaaaaaaagaaaacttaatctatgcttcctctaccaggcgtgtattttctcatctatctttcttgtctcttattccctagactggaaactatctaggatttcatctctattttcctaggacctgtttactcaaacaggtacactgtaggtcctcatatttgctaaaaaggtgaatgaacccagcttacctgtttcacagtcccagagacgacactgttgtcagctgagccagtgaggacatgcttggtgtcccctgaagagttgttaagaaaatgacgaagttcacccgagcccttgtcctcttgggatgccaagtgaatcatctccctgtcagccccaaagagcctttctacccctcttacctccttatccagaactggaatttgtcctaatgtttcctcagtcagtgaagagaccagggagtaggaggtatcgttctctaggccctcacagcacccccaactcccaactcccaactcagcctctccatcgctgacagaccctagcacacggactcagacccaaaataaggatacagtcagcgtccacacaccacacagctccggttggcccatgtaggtgcccagcctctcaccattcacagagtaccatacattgacgatctgaaaagtcaaaccacaggatagtacacatcccagtaagagcaatggcttcctattttgcccaggaaccctcagcagcctgtagcaaggctgattctgccctcttctgtttatttcttggaaacagcagggagctggtaaaaagaccaactcctggattctcctcccttcctgaagggagcaacagaggagtcaggcggcttgtaaaggcatcctcatttgttagctccagctctcctggactcccaacggctccaaagaataaaaggccaagttgagctccagtccagaaaaacagatctctgatgtcttatccaagtgggagcagctggtagtaaggaagtctgggttctggtgctgctctgccactgtctcactatatgatctcaaatacagtgcttctctcctctgaacttagttttctcatcttgaaaatggccaggccgggtgtggtgactcatgcctgtaatcctagactttgggaggccgaggcaggcggatcacctgaggtcaggagttcaagacaagcctgtcaacatggtgaaaccccatctctactaaagatacaaaaaattagctgggcatggtggcacagcctgtagtcccagctactagggaggttgaggcaggagaatcgcttgaacctgggaggagaggttgcagtgagtcgagatcgcgccactgcactccagcctaggcgacagagcgagatccgtctcaagaaaaaataaaataaaatggccaggtgcctcaaaaggcagtatcatgaggattgtttggcattgagtagcaggatgggattgacttaaaatgagactagagacaccctattaagttccctgtgtctgaataacacagcctgcacctatcctggtagaaagattagatatccctaaaggtcgcatcccgttctctgggcaagctgaccctcatctttatcccctttcacagtggtctcttgcttttcttggagtgcagtggcacgatctcagctcaccgcgctcaacgatcctctcgtttcagactccgaagtagctgagaccacaggcgcgaggccaccatgtcggctaatttttttgtgtgtagagatgggtcttactacgttgctcaggctggtctccaaccctgggctcaagcgaccctcccacctcggcctctcaaagtgctgggattacaggcgtgaccaccgcactcggccaatagagttcttccccacctttcccggtagaatactttcgccaactacccccggcatggcctctccctacttctcacaatgggctgctctttggttccccgctacggcaaaactggcgtgtccacccatcgtcctggcagaaggatcccgcccctcccggacccctccagccaacactcacagggtccttggccacagtaaagaggaggtctccttcgcggtatacttaatctgcgtaatggaccgctcatggccctgcagtaggatcggcttctgtgggacaagacagtaacgtcagtgctcggaattgggccccagcctcagcccaggacccccactcaatacccctaactctgaaactcaccatcccggctgtgacgcgaggaaggccgcaacgtagtaagaccggaaaaggtttcgaggtcacttccggattatgggtctccgccccttcgttccggaagtagaagacagcggcgttgccatggcggcgtctctgggtaggtagccggcccccccttccatggatttcccgaccctcgcctcgaattcatttcctgctccacatccacccttaaccccgacccctgctacaaccccagaggccggactcctggattcatctccctagcttcctgggcctgccttagccgccagtcgcagccgaggcgaagagagcgaaggagggaagtggggcggctagctggggctagaaggccaggagagggcggggtgggcggccgtttggggtggggtcagggtgactcactcgtctgcattcagggcaggtgttggctctggtgctggtggcgctctgtggggtggcacgcagccgctgctgaagcgggcctccgccggcctgcagcgggtcatgagccgacctgggcccagcagttgctacaggagatgaagaccctcttcttgaatacgaggtgcgtctctgtgaaaggcccctctctcggtggagttgccgccaagaatttggtcttggagtcaaacaggtctgggtcagccccaccacttactcactagaaattctcggaaaagcagttgtccttgagcctcagtttcatcatctgtaaatggcgattataataataaccatcgataggtcagttgcaggaattaggtgagatacgtagagcacttagcattaggcctagaaatagtaagtgctcaatctatggctgccattattcacattttattgtgattccttcagttcataaggcaacatttgtgagcctttccagagggagggcttggggctcaaattggccctgaggggaggagttcagaggaggaaggctggagctggaggacttggggaaggcttcctggagggctgacattggcttcaaggccttgcaggatgggaactagcagaggtgagggagagggagtttgagcaaaggcacagacttcagtctgtttccctctttgccctggaaggatcctcctagagggattagtgttctctgggtccttataaccctgcctccctccaaggaaagacattgctaggagctcaaagaaggcagtgctgctcagtcaggccatcacactgactgcaggttttcctctttccagtacctgatgccctttctcctcaaccagtgtggatcccttctctattactcaccttggcatcgacaggtgggtcctggcttggaactgttctgcttagtgtttgaggcacctggaagagtgattggggggggcggggtggagcttgaaacacctcattcccatcaggagagagggctgactagctctagttccctcttactatcctcttctctgaacaagaggggacagtgtgctggttatgagtatgttgctaggcactggagttggtttgaagcctggcagtatgtgtgaccagcggaggaagaaggaaggttcattttgctgtgccaagtgctggctttccattcttgcttccactgtgtgctacctacctgaccatgagcaagtcacccatttgagcctggttttatatagttggcttcatagcattgtgaggattaaatttaatgaatgggaaacactaggagagtgcctggcacacagtcagagctccatatacataaatttcctttctcttgaatttgtgactgccctctactacgtcagatactgcactagtcttacacattatttaattcaatcatgactctgtaaagcagatatgattatcttagaaaatgaagttgcaaaactttgtcaatttcacctctcaagtcccacaggatgtcagtgcagaaggatttgaagccatatattaaagtttatgctcgactgggcatggtgactcacgcctgtaatcccagcactttgggaggcaaggagggcagatcatttgaggtcaggagttcgagaccagtctggccaacatgctgaaccccgtctctactaaaaataacaaaattagttgggtgtggtggtgtgtgcctgtagtccagctacttgggaggctgaggcgcgagaatggcttgaacctgggaggcggaggttgcagtagctgagatcatgccactgcactccagtccctgggcaacagagcgagactctgtctcaaaacagaaagaaagaaataatatgcacttatttaaagagtttgaaaacctctggcctcatcattcactgctgtggaagaatgctgaacccttgaccagctgactacaggtagccattcacaagttttaatcaaattgcagttttaggttctttttatctcattaccctttctgcctgttcctttaatatccatcctttctaataaccagaacagtaataactatttatgaagcatcccttcagccagggactatccatgcattatcacagttcatcttacgacaacccaacaaaagaatggtatactgtgacccctattttacatgcggggaaacaggttgagtgtttgaatatctaaccaagattgcaagggaaactcagatctgcctcactccaatgccctcactttccactcaccgtgctgcatccttcttccatctactgttgcaaaccagaccttagcagccatgacatccttgtaaggtatgtaaacttaagaaggcagctctgggcagggcacagtggctcaggctataattccagcacttttggaggctgaggtgggcagataacctgagcctagagatcacctaggcaacaacaacaacaaaaatacgaaaattaactgggcttggtggtgtgtgcctgtatcctagctgctcaggaggctgaggtgggaggatcgcttgagctcaggaggttgaggctgagtgagccttgacctcaccactgcactccagcctgagcaacagagagagaccctgtctcaaacaacaacaacaaaaacgaaaaacaaccaaaaaagaaagcagctctttgtaagtgggttgtatcaatttcttagatgggtaatgcctccatgctggggcctcccaggggatgaggacaggacagtttgctcctttgcctcacacaggcgagccctgggagtgctgggaaagaattgctgaggagccagtgtgaacatctggtctgcagttgagtcttgttaccatggataactcgctgattcgtccattggtcttttttatgtgtatgtggtgctttttttttttttttttgaacggcatttcgctcttgttgcccaagctggagtgcaatggtgcgatcttggctcactgcacctccgcctcccaggttcaagtgactctccttccttagcctccccactagctgggatttgggcatgtgccaccacgcctggctaattttgttcttttgtttttgttttttgagatgggccttgctgtgtcacccaggctggagtgcagtggtgcaatctctggtcactgcaacctcgcctaccaggttcaagcaattctcctgcctcggcctcccaagtagctgggactacaggctgcaccaccatgcctggctaatttttgtatttttagtagagacggggtttcacaatgttgccaggctggtcttgaactcctgacctcaaatgatccacccgcctcggcctcccaaagtctgggattacaggcgtgagccaccacacccagcctaattttgtattttcagtagagacgggtttctccatgttggtcacgctggtctctaactcccaacctcaggtgatccgcccgtccagccttccaaaatgttgggattacaggcatgagccactgcgcctggctgtggctcttttttgatgtgataagaacacttaacaggagatctaccctcaacaaattttaagttaactcattagtctttttcttttttttttgagacagagtttcactcttgtttctcaggctggagtcagtggtgtgatcttggctcagtgcaacctctgcctcctgggttcaagcgattctcctgctcagcctcctgagtagctgggattacaggcgtccgccactatgcctggctaatttttgtatttttagtagagacggggtttcaccatgttggccaagctggtcttgaactcctgacccaggtgatccgcccgcctcagcctcccaaagtgctgggattacaggcgtgagccaccctcacccagccaactccattactctttttcaagtttgcttattggcagtcagccccttggacttcaaaattaaggaacagatcctgggctatgatgccctctacccacaccacaggtccacccaatgtcctgaacaggtcctgctccttccttctgacactttttatttttaactccataggcctgagcttgggctgaaacagaaacaaaatgtgcttcatctgatgttctgctctgttatatccacagtttaataacggcgcaggctttggagtcaggcaagccttggtttaaatctcaacttgccttagtttatgtgacttctttgagcctttgtttcttttacgcaaaatggtataatccccttcttgcagtgttgtgaaaactgagatatgtacacaaagcacctaggccaggtatgtgcttaataaatggtggctgtgcttggtgttacctgactctctactcatccttgggatttgggtgcctgcctgtccgtccagatgtccttgagatctcacgagttctctttggtgcaaagacctcattctcattatcaaaccaggctggtcccagacctcagagttcaggtttcatgctggaatcctgggaagcactgaacgtggagtcaggagatgtgggtttgagtccgagatttgctgtgacttcatctggaagatggggttttgataccttttttaaaggtatgaatgatgatgatggaagtgttttgtgcctagaaaggcatttgttgcatctcaggcattctttcattctgaccacccagatctgaccctggctgtgcccatctgtaactctctggctatctcttcacactgattgttgggaaggcccttggagaagatattggtggaaaacgtaagttaactactgcgagtgcgggacgcagctctgtggatctcgacatacctgtgttagttccttccagaacccatctccccagagtgggtgaggacacggccttttcccatcctgccctttccttgcagctgttttgcttccttgtggccatcagagttcccttcccctggacagtctggagaagacagaggctggggtttgggattgaagaccagaccccatctgagcccttcctccagcctgtaccagctcctactggcatggctgagctcagaccctcctgatttctgcctattatccaggagcagttgctggcatggtgctcaccgtgataggaatttcactctgcatcacaagctagtgagtaagacccaggggcaacagtctaccctttgagtgggccgaacccacttccagcctgctgcctccaggaagcccctgggccatgaagtgctggcagtgagcggatggacctagacttcccctctctggccttagcttcctcctctcttatggggataacagctacctcatggtcacaataagagaacaagagtgaaagagttttgtaaccttcaagtgctgttcagctgcgggatttagcacaggagactctacgctcaccctcagcaacctttctgccccagcagctctttcctgctaacatctcaggctcccagcccagccaccattactgtggcctgatctggacttcatggtggcaggttccatggactgcagaactccagctgcatggaaagggccagctgcaactttgagccagaaatgcaaacgggaggcctctgggactcagtcagagcgctttggctgatgaggggtggaaccgagggaagaaggtgcgtcggagtggcagatgcaggaaatgagcttctattagccttgcctgccccacccatgaggtaggcagaaatcctcactgccagcccctttaaacaggtagagagctgtgagccccagccccacctgactccagcacacctggcgagtgtagctgtcaataaatctatggtaaacagacaagaggttagtaagtattcttttattgtacaaaccctctcccaggcttagtcagctactcctttctctggccagagaatcccataagaaatagcccccacagccagggctgctctgctcagaggaagggaaggctgggctgtgggttaggagcaggagaacggggagggctgaggaggccgcagtgtaccctgtgagcccagcggggtgctggctcctgaggaacaagctgctggaggctaaggacaaaaggtggccagagtagggtccccagttgccctctggagctgctggctctcaagatggcagagctggggctgaggcgagatagcagccccagccccaggctggttttccagggacaaggcctcttccactatctggctgccctctgcaggaggtggaaggccatacagaatggagccgtgagtatggccagcctcagctctcagccaggaggtccccaaccccaaggaaggaagaaactggaaattaggaactcttcctcatttaacaaggtaggaagttaggagatcatttactttcaatcacaagggagggaactgttcctggggcccaaggctgccagtttccagctcagagctcctcccaccccaactactgtttcctgatccaacagcttacctgatccaagggctcctctgtctgagtgtcttctcatctgctacttccagggcccccgctgtctccttccttcggtggggagctccatataccctataactcctaaagaggggaggcagcactgggtgatgcccaggctgaagagccctcacattcctgccctggaccttcatgctagcccctttccctcccctgaacctggttctgcatccccaccacctcccaggatggcaaggaagtgagaggtgggcctttggtcccacccccatccctctatatcccacccctgaagtcttatcgctttaagcactgccctttccaggtgcttttttcatgtgatgaggccctgtgaagaagggacaggatatacagacgggggcagctggaacagttatgatgaggtcagtaccagctttttttttttttacgggcagtctcctgagccaagtaggttcagactcctttatcttttttttttttttccagtgccggctttgtgtctgagattctgctcccatggacatccccaacaacagcagggaccaacctatgtcactgtcaaaggcagctgagaagggcctgagccccagggacccctcacctgatgggaatgagagtgtgggagcttgcttcttggctgaatggtctgctggggtctggcatagaaagcagatggcttaatcggtctggttcctttggagagggctgggttacctgggccctgtggccttgggcctagagagggacactgggcttggaccctgattgctggccattcttacctttcctactccccagttaggcttcagagagcccctgacgcctgcaggaacatggcagaggagacaccgtctgtcttacaaagtacgtcctccctccttgctgcctcttcccaccagcctgacttatccagggacaagcagtagatgcctggcactcctcgatgcccagtgaaaccagactgtgcttccccaccccaccaccatgccccatgctcactggctcatttcttgggagggcttagagctggataataaagttcccttggaccctgctgtgccaaatataccaattctctctcccagcgtccaacctgcaagaaggtattaagtcctgcaaatcagatgagaattctggtctggcccctgccactcataactctgtcaccctgaacaaatcacttcactttttttttttttttttttttttttgaacttgagtcttactctctcacccaggctggagtgcagtggtgtgatctcagctcaccacacctccgcctcccaggttcaagtgattctcctgcctcagcctcccaagtagctgggactcaagcacccaccaccatgcccagctaatttttttgtacttttagtagagatggggttttccatgttggccaggctggtcttgaactcctgacctcaggtaattcactctcctcagcctccaaagtgctgggattacacgtgtgagccatcgtgcccaaggcccacttcacttttcagttcagtttccacctctggaaaatggggataatctttctttcacaagattattaagagtgccaggcgaggtggctcacgactgtaatcccagcactttgggaggctgaggtgggcagatacctgagggagtttgagaccagcctgaccaacatggagaaaccctgtctctactaaaaataaaaaaattagccgggtgtggctgagcgcggtggctcacgcctgtaatcccagcacttgggaggctgaggtgggctgatcacgaggtcaggagatcgagaccatcctggctaacacgtgaaaccccgtctctactaaaaatacaaaaaaaattaaccgggcatggtggtgggtgccgtagtcccagctgctcgggaggctgaggcaggagaatggcatgaacccgggaggcggagtggcagtgagccaagattgcgccactgcattccagcctgggcaacagagcgagactccactcaaaaaaaaaaaaaaaaaaaaaaattagccgggtgtggtggcacatacctgtaatccagctactcgggaggctgaggcaggagaatcacttgaacccagaaggtggaggttgcagtagctgagattgtgctattgcactccagcctgagcaacaagagtgaaactccgtctcaaaaaaaaaaaaaaaattattaagaggatgcaggctgggcatagtgtaatcacagcactttggaggccaaggtgggaggattgcttgagcccaggagttcaagaccagccttcgcaatatctgagactcatctctatatttaaaagaaaaaaggaggccgggcacggtggctcacgcctgaatcccagcactttgggaggctgaggcgggcagatcacaaggtcaggagttcaagaccacctggccaacatggtgaaaccccatctctactaaaaatatacaaaattagctggatatgtggagcgtgcccataatcccagctactcaggaggctgaggcaggagaattgcttgaaccggacctgggaggcggaggttgcagtgagccaagatcctgccactgcactccagcctggatacagagcaagactctgtctcaaagaaaaagaaaaaagagaggatgcagtgaaataaggcagagcctgtgccagaagagttgtcagccagtcactccccttcttcccacccctcattgcccctgcgtcacctaccccctgcctgtggggcctagacttcgagcctggaggttgcctaaatgacaaaaggaaaggcttgtagtgggcagagggcatagagtcaaagcacacagacccgagggtggcttcctctgcccggcctgttaccgctccacctcccacatacataccagcagccctgggcagggaggggctgggcaccagcagctccagatagggaaggtccttgaactcacctctccgacagccacatagtaatggccagttaccagctccttccctgctgacagtggggcccctctagggtgcagagtctgggagagagaggtgaggaggataagggctggtagactgatgcttcttcacattcagcagactgaaggggtgggtgcagctattccaaggtgccctcggcctctaggcacccaggctctaccctgcctctgagggctgggcagagggccctctcccgtggcatagggggaagtcccatgtgggggaacatgctttccttttgcctcttcatcctcgccacagctgaagccagtggcgaggctctctttggggacttttgggccctcgcagtcccatactcacttgcacacagccccactctgcaacttgaccttctcagtcaggagcttcaaccagtttcccagtcctggctggcagcctgggacagcttcagactaaatgggggacttaccggtccccattcctgaacacactgagacaaaaagcctggtaagggggagtgtccccaggatccctacatgtgaggggaagggtggcacagggccagcaataaccataacactggtctctttcacccatcaagcatgctggacttctacattcccaacagtaaccagaggctcctagaaaaacccaacaccattttcttggccttactaaaacaaacatcaacacccctgctccctcaactggcactcactggatatagctgggagcacctgcaggcagctgccgtccaatggcccctcacacaagtggcgagtcacgggaggaccctgaaacccatgtcaggcctccaaatcagggagttggggcctttggttaggggtgggcccatccaaggtgtggagtgagggggccggaacagactggggcaggaagggggcgaggaggagtaagacagtttacacctttcaccaaacgtgcttagatgttccctaagtcacattctaaccaccccctcccccaatctgtgtttcacactttctctttcctttggggaccccagtgtggagttaaaggctgcgacagaagcaagaaaagtgtcttgaaatcccacgccccaggaaagatagtagctggctccaaagtacccccctgaactggcagatcctgctgcttccctggcttcccagaccaaattgggggcagttccaggagagtgggaagacagaggggctggggcacaggttccccgggactcacttgtagtctgcagtcttcccacctgggtccttccctctatggggtaaatagctgaaaggacagatagatcacggtcatcttgtggagactgaggcctcaatagcctggcagatgtcagtgttgggttgggggcagctcaccagatatccctccccatggaatagtggcaatcatctcagtccagaaacaaatattggcagctgaacctgccctaggaccccttgagtgctcaagtgctgtctgggtaaggctgagtaagtctggaaatccagactggggtctcagtactaaccatgagattaaaggtcagaaggctgggcatggcagctcacgcctgtaatcccagctctttgggaggctgaggcagaggatcacttgagcccaggagtttgagaccagcctgggcaacctcattgctaccaaaaacaaaaaaattagccaggcatggtggcatgcacctgtggccccagctacttgggaggctgggcaggaggattgcgtgagctcaggagttcgaggctgcagtgagccatgatcgcgccaggcactgcactccggcctgggtgacagagcaagaccctgtctcaaaaaaaaaaaaagtcagagaaactagaaactagtgcattatgcatcctgctgtatcccaagaatattctcattcagagataggtcgttttatctccattttgtatgagattccaagaaattaagtgacttgcccaagtcacacaaggaatgaagcctagattctaagtctacctagcttccctcctctggcctttttttctttttttctctttttttttctttttgagacagagtctcactctgtcccccagctggagtgcagttgtgcgatctcagctcactgcaacctccgcctcacgggttcaagcgatcttctgcctcagcctcctgagtagctgtgattataggcacgtgctaccaggcctggctatttttttttttttttttttttttagatggagtttcactcttattgcccaggctggagtcagtggcacgatctcggctcactgcaacctctgcctccaggttcaagcgattctcctgctcagccacccgagcagctgggattacagacatgcgccactacgctcagctaatgttgtattttagtagagatggggtttctccatgttggtcaggctggtcttgagctcctgacctcagtgatctgcccgccttggccttccaaagtgccgggattacaggtgtgagccatcgtgccggccaatttttgtatttttagtagagacagagtttcgccatgttggccaggctggtctcaacacctgacctcaggtgatccacccgccttggcctcccaaagtgttaggattacaggctgaaccaccgtgcccagccacttactccctcttgatccttacattatagtaagcaacctagctgagagctaagagtaggacctggaagccagacatgagtcagagactcaggtactcaattcttctcccaccctgggagacagtctcctcctgcaacagaggatggccctagcctaagggagagtctgggatgcctatgcacagtggggaggaatggatgggtggatttagagtgtcagtgatagggggtccaagcaagaagagcttttggaaaaaggggctcaccctgtgggaggtggtcttcccacaggctgatcttggctgtgatgggcataaacattagtaacacacagattctatttgaatttcagttcaactatttgttatgtacttttaggcaggttttctgtctgtttccctttctaatggaggcaaaaccaccccccctacatagagttcagtaagtaccagtacatgctggtacatacatggtaggtactgaatacacgctcttgccgttacctcccttgcaggctgtttgaccagccccagcccactcactggagcttgtggaatcgttcaaatccagcgccacatactgccctctgttcttcaagtctgccaggttggtgacagggtggccatgacaggtgtgtagagggcacgcacagccagtggggcctgcacagctgatgtcacctcgcagagaaggcctccatggtggggaagcggcgttgagtcaccaccagctgggagcctgggaagaagggtccccattccggtacaccactaccctcttggctgctggactgccacctgccatagttatcctcagtcagagaaacagacctgttgccaggcaaccaaggaagggctgggaacattccaatcagaggtggagtcctgccctctcacccaggaaggcagagggagactgtggcagggcatttatctgcattcagggttttatcccatctgccctggggagatcacacttaaacatggtgttaccctactctccagagcctccttgccactctaaagcacaaggctgagctcaatggggatcagctttgggagctgttccctaaggaggatggctagatcttttcctgggccatgctcccagctggctccggggtcaatgccccatgccagtaggaagtgaacggcagggcccgaatctgtcctggccagaagcagaaatgaaagcagccagactcagaatctaagaaaaactttattcccaacagacctctcattctacttcccccaggtaactccttagccacacatttttttttgagaccgtgtctcgctctgtagcccaggctggagtgcagtggcatcatcttggctactgcaatctccatctcctgggttcaagcgattctcctgtctcagcctcccgagtaatgggactacaggcatgc

SEQ ID NO: 5077 - DNA, 17032 bp, Homo sapiens
agaccgcatctctacaaaaaatttaaaaataagctgggtgcaatggcctgctcctgtggcccagccatgattgcaccactgtactacagttggtaacacagcaagactgtctctaaaaagaaaaaaatagaagaaaaggaagaaagaaagccagatgtggtggctcacgcttgtaatccagcactttgggaggccaaggcgtgtggatcacttgaggccagaagtttgagaccagctggccaaatggtaaaaccctgtctctactaaaaatacaaaaaattagtcaggtgtggtgtgcatgtctgtaatcccagctactcaggaagctgaggcaggagaatcgcttgaacccagagctggaggttgcagtgaactgaaatcgcgccactacacttcagcctgggcaacagaacagatgctgtctcaaaaaaaaaaaaaaaaaggcctgacatggtggctcacgcctgtaatccagcactttgggagaccgaggtgggcagatcacaaggtcagaagattgagaccatcctgctaacacagtgaaaccccgtctctactaaaaatacaaaaaattagctgggcgtggtggtggcatctgtaatcccagctacttgggaggctgagccaggagaatctcttaaacccgggaacagaggttgcagtgagcccagatcacgccactgcattccagcctgggcgacacagtgaactctctctcaaaaaaaaaaaaaagaagaagaagaaaaagaagaatagataagaaaataagtttattcactgacgagatcaagctccaactcctcagcaggacacacaaggccacatacccaaggagcccccacctgccctcactccatctcagcctctccatggttcatccatgtccacgccctcccagatctttgatacccagcaggctcagactagtatgtcaggaactatgtagaactaatatgtcaggaactgtgtgagattaataagaacaacatttcttatatatattagaaatatatatatatctcatatattgagcactttctgtatgccaaacactatgctagaattaaaatgtctacatgatttcatcaaatcttcacagtaaccttctaagatagagaaactcccattttgtagatggggaaacagtaatagaggtttagtcatttgttcaacttcgcactctaacaactcgtttcttttgtttttttatttttttgttttcttgttccgaagtcttgcctgttgcccaggctggagtgcaatggtgcagtctcagctcactgcaccctccgcctcccggttcaagcgattctcctgcctcagcctccccagtagctgggattatgggagcccgccacacgcccagctaattttttgtatttttagtagagatggggtttcaccatgctggccacgcggtcttaaactcctgatttcaggtgatccattcaccttagcctcccaaagtgctgggatacaggcatgagccaccgcgtccagccataactcatttctttgatggtccttagtagaatagcaactaggtttcttggcatctcagatacctctgctaaagcattttacatgtctatcctctctcaagaccctggttctggctgggcccggtggctcacgcccttaaactcagcacttgggaggctgaggtgggcagatcacctgaggtcaggagtttgagaccagcctggccaactggtgaaactttgtctctactaaaaatataaaaattagccaggtgtggtggtgcatgccgtaatcccagttacttgagaggctgaggcaggagaatcacttgaacccgggaagtggaattgcagtgagccaaggtcacgccattgcactccagcctgggcaatagagggagactctgctcaaaagaaaaaaaaaaaaaaggctgggcgcggtggctcacgcctataatcccagcacctgggaggccgagacaggcagattacctgaggtcaggagttcgagactagcctggccaaatggtgaatccccatctctactaaaagtacaaaaattagccaggtgtggtggcacatgctgtagtcccagctacttgggaagctgagacaggagaattgcttgagcctgggagacagagtttcagtgagctgagatcatgtcactgcactccagcctggctgaaagagcgagactcttctcaaaagaaaaaaaaaggccaggcacagtggctcacgcctgtaatcccagcactttggaggccgaagcgggtggatcacgaggtcaggagatggagaccatcctggctaacacggtaaaccccgtctctactaaaaaaacaaaaaattatctgggcgtggtggcgtacgcctgtatcccagctactcagaaggctgaggcaggagaatggcgtgaacccaggaggtagagcttgagtgagccaagatcacgccactgcattccagcctgggagaaaaagcgagactccgtctcaaaaaaaaaaaagaccctggttctccagcccagtaccaagttttatattcatctttagatccctgtggtgggctacacagtatttgaccaatgtatcagcagccaatacatgttaattaatgaaagttggggggggcgcagcaagaagggagggagagagagagagagaggcagtggtaggatggggtgagtgggtagatcaggcccagaggctttagtgtgtgctgccaagctctaaaagtttttgggggtgtggggaaggcaggggacactgggcaggcatcgtaggtgccctggttgggggcctggcaaagtcgatgtcaaagcgaagtcagtcttaatgaaagagtgtagcagctctggatggtaatcaggaatcctggaatctagggcaggctggggaaagagaggttgtggcacagtgtcctggagaaggtggggtggagggaggagagaaaagccagctccgagggattccagggacaaaaggtcaggatattggcactcggaacaacccccttggtgggtgccaggtacatccgggctctttaacccccctccctgctggctcacactccacaggcctccacggatgacttcttttcattattcaggtctctgctcaaatgacttccctgaccacccagctatgttgaccctcccctccccctcctattatattacagggttttgttccctttattgctcaaccgctatctgaaataatcctgcttatttatttgtgttcttgtttgtgtctgcttccctctactatgctataagttccatcagagcggggatagtgtttgtccttttcttttttcttctttcttttttttttgagacggagtctcgctctgtcgcccaggctggagtgcagtggtggatctccgctcactgcaagctccacctcccgggttcacgccattctcctgcctcagcctccaagtagctgagactacaggcgccgccaccacgcccggctaggatggtcttgatctccgacctcatgatccgcccgtctcagcctcccaaagtgctgagattacaggcgtgagccacgcgcccagcctgtttttgtccttttcaccaacgaatcctcagtatctacaacagtgcctgtacatagcgggtgctcaggtggcctaggttagccctgaacgtcaacaaggggccagagtaaatgtggatgccctctccattgctgaagactccactaccaacactgctggctgggtgaggcagttgtagatcctgagagggtctatagggtcaagattaggagaggtagaaggtgggcttgggatttgtgtcttctaccctacagactccccagggcctccttaccctggagtcattaggtcccggctgatctctgcagaaggggacagcagctccagtgagtgactcagcctgtgcctgggttactggtgaaaagattcttgtaagaaattaggagtcttggacactgggatctcatggggtctggagatggaggatgctttaacctaatggttctttttaagttttttttgttttgttttgtttttttgagacagagtctcactctgtcacccaggttggagtgcagtgcgcaatctcggctcactgcaacctccacctcccaggttcaagcaattctcctgcctcagctcccgagtagctgggattacaggcgcccaccatcatgcccagctaatttttgtattttagtagagacgggattgcactatgttggccagattggtctcaaactcctgacttcaggtgtccgcccaccccggcctcccaaagtgctgggattaaaggtgtgagctaccacacctggcgacctaatagttcttgagaggaaagaggatggggggctttagccccagggctccttagtggctgggagctttgggctaggacacaagggttcctaagagggcagaagactgggagctgggggtaggggctatgggcttggatacgagggttccccagggagggatgctgggcaccagattctctagaggtctgtggttgagagctgggtcaccgtattctttgaggggagagatatcccaaatctgtctgtttttcccagctgggaccagcacaagccagttcttgcttaatggatagagacaaatttgtctgggaaggcagcaagtggaccaagactaggagagagagagagaacgcgactttctccctctgctctcctccctttttctttctccctgcctccaccccttttccagaacccctacccacatctctctgtgaccctctcacgccccctgctgcttcttccctggcagcaatggccagtccaaggaccagatgactgagatgtcaaaatcccatctcttccctcctcctgatctctctggaccagccacagaggcaggaaactggtctcaaagggagtagctctgcggaaccaggtgggtcctggcttccagaaagtgacctgtatccagagtatgtctgctgtcggggtttttgctgggatctcagcctaagaagtcctcatttccagccggacgcaaggctcacgcctgtaatcccagcactttgggaggccgaggcaggaggatcacccgaggtcggagttctagaccagcctggccaacatggtgaaaccccacctctactaaaaatacaaaaattagctgggggtggtggtgcacgcctgtaatcccagctactcgggaggctgaggcaaagaatcgcttgaacccgcgaggcggaggttgcagtgagccgagatcacgccattgcactcagcctgggcaacaagagcgggaaactccatctcaaaaaaaaaaaaaaaaagaagtcctctttccttagagaaactctccttgacgctcagactaagttaaggcctcctagtctccatgtttctattttttcttttttctttttttttgagatggactcttgctctgttgcccaggctgagtgtagtggcgcgatctcggctcactgcaagctccgcctcccgggttcacaccattccctgcctcagcctctcgagcagccgggactacaggcgcccgccaccatgcccagctaattttttgtattttcagtagagacggggtttcaccgtgttagccaggatggtctcgatctctgaccttgtggtccgcccgcctctgcctcccaaagtgctgggattacaggcgtgagccacacgcccggccagtctccatgttttcacaactctccaattcttctttatcagtgcttccactatccacttattagttagcctttgatggatgtctgcttccctatgggactgtgggcacaagagggtaggaaccagagtgtttttgctcattaagacaactcaatacttggcacagtcctggtacattgctagtgcacagtgaatatttgttgaataaatgaataatcagtaacttcaaagggggttcttaggtggagctttaatgggaagcgtcagtgccattgcctgggctctggggcagctgtgagtccagatctcatggcttctgttcagggcctggtccacatccagccctgaccttgtgcccaaaggccattcaggcaaaaagaggtggaagagtcttctcctagaggaggtagtgcaaaggtggcattagagcattaaggtggctcggatccagaatcttctcccacttttccactcctccaacctgagtttgcaaaagcactaccttccactgcccccatatctcttcttgtggcctattcttcttccctcccagaggtttccttcccctcaaaatgtgccgctcccttgagctgtttccaatgttgtgctcatgaacttgaacatcattctctcttacctgtaaagcccccaggaagagacgcccttgaggcttggcccagaggttaaggaggggagccggcctaagggaggcagggcaagggccttcatcttcgacccttggctcaagaccaccctgacatactcagcttcagctgaagagggagtcccaagaccaggggcagatccagccctggcccgacccagaagacaacaccaccttctgcagagtgtgtgggaaagggacggtagagagaagggaagaatgagccgggcctactgcctgtggcctcacccctagctgccttaattctgctcttcgctatgcctccacctactggccattctcaccacttaaatcctgccccaatttttttggcttgaccctttttgaaaccacacctgccccaagtaaatatgcagtctaagtcaaactgtttgcttgctgtggggagcttcaagatatgtccctcgcccctaccacccacctgaggccatccataagccttatttttatttttatttttttgagacagggtctcactgtggcccggtcagagtgcagtggcacatcatagctcactgcagcttcaaactcctgggctcaagtgacctcctgcctcaggctcctaaatagctagggcagcagacatgtgctaccatgcctggcaatttttttttttttttagacagaggtctctgctatgttgcccaggctggtgtcaaactctggcctcaagtgatcctctggtcttggcctccagcacctgggattacaggcaagcaccccatgcctggctaattattaatgaaaaacaattctgtggagccagtcttgttatgttcctgggctggaaaccttcctaatattgacatgttggactcccctcttccctcattgctccagctccactgaatacaggcaatgccccactgtccccctttacttgatcttggaggtggagctgagccaagatgggttctctggtgtcccaagagcaaggaggtggcctgagcctgctgctgcttgagtcccaggtccaaagagaaggcccagggctctgcatgaggctggggaatgtcgtggggagaaatgattatcctgaggcctcaaagctggggtctcaaggaggaaaggggccgtggtagagggggacagaggcaggctgagctggccagggtgggaaaaatagactccgagaaatctacctcggagattgaattctgcctgagtccctggagggagaaatatcccgggattgattctacatcacagcttctgaggctagtgggggcagatgctgagatctcggcctgttgtccagccaggaatcccggcgcaggcagccatccagggcaggaaccagctggagtgtgaagagataagatacggggatgtagaaatcagggcatcggagccgcagtcccgacctccctccctcagttgactcccctctgagcatttggcctcccccttgcagctctcaacccttccctctccctaaaagtgtggacttagattcccacggccagccacccagcagtgctttaccaatcttggctagggttccacccctggggtgtagttaccggcaaccgaaggttggaagcgggaagagcagccccccaagcgcaatcctcatgatgggatggcgtttgctggtcaggggcccgagacctgtctcaggcgcagcacctcctccccatccacctccagcagcacagagtcccctccatcttgacttccacctgcaggaaggtgggaagcaaaatcagaggcccctgggatcttttctgccaccttcctgtgaggcagcctagtactatagtggaaagaacatgccttaaagagcagctagcatccttggccttgggtcactcagctcttgtcacttatatactgactgagcttagaattcccatcagaaaagatggggccaagaatagctactttgtgggggttcgtgtgattaaacgagatgacagtggtaaagggatgcccaataacttggttttgttccctttcccagaccagctccagacatccctcccctgaggaccagagctagcttacctggtgccatctccatcatccagccgtggtccagcacccaccgtaagctgggcccagtgattgtgcagttgatctcaggcctgccgtctcgaagtcccagcataaaccagtcatccttagggttggtatcccataaaaaatcactccctctgggtcccaggttcgaacctcaaaggaggaggaggttctgaaggacacagaaggaaagattgtgtatgtcatgtgtcctttgagaaccagtgtgggttgggggagatggtgttcacagataaggaaaggaagacagggaaaagagaagagctgatgggagagggcagaaccaggggactgggtcaagggctaggccaaccccatactttgtgatctggtgaggtcaaaggtcatgacagcgataggctcttgtcctgggccattgctgaggtggaagccggagggtcgtgggcactctatcagaaagagaaaacaaacaaagctgagtagggactgtcagagacagacagagggagaggccctgctacagggccagaggagagaagggaagacgcatgagctgagtgccctgtcccgctcctgcacctgggtggggagaacaggtctcagggccatccctggcgggtgtgacgcagtagtagcaacagcagcaacagcagcaggcgcgaggagccagtgggcctctgctctccataatcagccactgtccactcggcggctcagacaactttgggagaatgtgtagaggcaggcagccttgcgtgtgggcggtggagggttaaaggttgccggggaggagggggtaaaggaaacaggggcactgacccttgacccctgcccaggggccagtcacaagactcagctatcacccctctggggatcaatggggtgaaggacagagtccccccactatcatcctccactgccgagaaagtttctgaactgggagaggatattccatctccctctcctcctctagggcctgatctaggtcctccaagatttctgtccactcggggagcctcattcacaggcctgaggtctagaaacagtcctcccctgcgtcccaagtagcatcctgtacaggactagaaatgagataatggaatcctaaatttctagctgagtgaccttgggcaagtacttcacctttgtgcttcagtgtccttgtctgtaaaatgaggaaaataatactttacgggtgactgtgaaagagggttcattgagaaaatgcaggcacagtgcctggcatctggtctgactcctcccccagtcttttcccaggcctctgaggcctgtctcccaagaaggtattgtcttgtgtatgattcagtgaatattaagaagggacctgccccccgcctctcagttatcttccttatccatttattacagggcctaaacagtctagcagtagaaatcacccactccctgaccattttattttattttattttattttattttattttattttagacagagtcttgctctatacccaggctggagtgcagtggcgtgatctcggctcactgctgcctctgcctctcgagttaagcgatcctcctgtctcagcctccttagtagttgggactacaggtgcacgcaccaccagcccagcaaatttttttgtgtttttagtagagacggggatttcaccacgttgcccaggcgatctcgaacctctgacctgaaatgatccgcccacctcagcctcccaaagtacctggatacaggcattagccacaaggcccgaccctccctgacgcattttattttatttatttatttgagatggagtttcgcttttgttgcccaggctggagtgcaatggcacgatctcggctcacgtaacctccacctcccaggttcaagcgattctcctgtctcagcctcccgagtagctggggtaaaggcatgcgccaccacacctgtctaatttttgtatttttagtagagacggggtttaccatgttggtcaggctggtctcaaattcctgatctcaggtgatccgcctgcctctgcccccaaaatgctgggattacaggtgtgagccactgtgcccaccccatgacccattttaaatgcaaatgacagaccgggcttggtgggtcacatctgtaatcccagcactttagaaggctaggcgggcagatcacttgaggtcaggagttccagaccagcctggccaacatagtgaaacccgtctctactaaaaatacaaaaattagccaggtatggttgcccatgcctgtaatcccactactccgagggtgaggcaggagaatcgcttgaacccaggagggagaggttgcagtgagcgagatcgcgccactgcactccagcctgagtgacagagtgagaatccgttaaaacaaaaaaaagagaagaaaaaagaaaaaaaaattagccgggcgtgccggtgcgcgactgtagttcagctactccggaggctgagacaggaggatcgcttgaactcgggaggtggaggctgcagtagcagagatcgcgccactacaccccagcctgggcgacaaagcaatacaccatctccaaaataaataaataaataaatataaaaataaaacatttaaaaaatgcaaatgcccccaagagtaacacttcatgctactcaagagctgcaggaaacagctttcagagctgagggtcttaagcttacccagggtctgggcgggtgagtgagcctgaggctaaagcaggttatcactgcatagtcaatttaaaaagcactgcgggggagcctttgaaccgcggggtatctcgacccaggttggacacccacacaaccgcaaggaagccgcttcactccaaccttgaactctacccaggagccagtcacaagatccagctgtcgggggtggggcttggggggggacgcggccgtgcctgtctccaagctgattggctgacagttgtgccccctgctgcgacagaattcgagggggtgggctatgcccggacagaggatcgcctcgctggcctactctctcctcccgtacggcgccggatcccagctccacttaccaggccgcggctaccccgccgtcccccccgactcccgccacccgctctctcaggctcttcaggatccaagtccgtaggccctttaaggggtctagttgccgttgcgaggccctgggactttggtcccagacagcggggatccggatggcttccgtgcggatcgagaggccaaggagggagactgtggagatatcctgaggctgattcgggtgaagactgcggccggtaacccgggggtcagagtggcgcggccagagcggggtcgtaggaggcgggggcgggggaggggctcgccttgggaacctgctcggggagcagcggggcccttctgctctaattagcttccgtacccacgccttaggagctagccgaattcgaaaaactctcggatcaggtgagatcagtgaagaaggtgggggctcagcgcccaggttctggcggaggctggggaggaaagagggatgggttccccaggcgacagctccaggctgggcatacacccacgtcctctttcttatctctttgtcacaactccaatctcggcagccctgagagcagatggctttggagacaacctttctatcactgtttggtagcagagattcttccagcgcccgggaagctactgggtaaagcacctggcccttagaagtccacctctccagccggcctcagaggtctccccacaggctccagaagccttactccccttttctctctctcagggccctgcgtggtgggctatgggataactatttcatctacagtacatggaagggacgcaccatttatctggaggatatctatgtgtgccggaatatcggggtactgggcagaagctgaggctggggtgggagcaaagcaccccaagaccccactgttatcccctgtccccagagcccagccggtgtcattttctgatccccttagctcaaacaatagctattttttgcctctttctctccacaacaggtcaagggattggttcaaaataatcaaaaaggtggctgaggtgaggagatgggtggggcgacaagtgaggacctaagaagcaagggtatatggaggggggacccgggttgaaagagggagtgagaaaaccttttcttttttgaccccagaaaagttagtgttgtcttctcccacaggtggccttggataaggctgctcccaattccgcctggccgtcctggactggaaccagagggccatggacttgtacaggccctaggagcccaagatctgacggaagctgagggctggcacttcttctgctttcaagagaggcaacgagaaagttggcaggaaagtgacgccatccctaggaggatctctgtcttggtttctccttccccatcagctgaagcactcttcagagactacgtccacagacactgatgtgaggcctccctggaggaaggagggttaggggtgcctatcctcaagtattggaagagcaaattgagggagagacctttcttccttgttgagggtgaaaaataaataagaattacatgtctgatgtggtgttgggtctttcttttatttctttttttttttttttttgagacagagtcctgtcgcgcacgctggagtgcagtggtgcgaactccgctcactgcaacctctgcctcacggttcaagcaattatcctgcctcagcctcccgagtagctgggactacgggtgcgcaccacatgcccggctaatttttagtagagacggtgtttcaccatactggccaggctggtctccactcctgatctcgtgatccgtccgcctcggcctcgaaaagtgctgggattactggtgtggccactgcacccagtccaaagtctttttttttttttttgagatcaagtcttgctgttgtctcaggccagagtgcaaggagtgcaaaggtttgatcttggctcactgcaacatccgcctccgggttcaagtgattctcctgcctcagactcccgagtagctgggattacaggcgcctgtaccacatgcggctaattttcgtatttttagtagagacggggtttcaccttgttggccagctggtctcaaattcctgacctcaggtagtccgactgcctcggccccccaaagtgctggattacaggtgtgagccaccgcgcccagcccacagtcttttctttttctttttatttttttgagacagagtctcgctctgtcacccaggctggagggcagtggtgagatcttggctcacgcaagctttgcctcttgggttctcaccattctcctgcctcagcctcctgaacagctgggctacaggcccccgccaccacgcccggctaagtttttgtatttttagtagagacggggttcaccgtgttagccaggatggtctcgatctcctgacctcgtgatccacccaccttgcctccaaagtgctgagattacaggcgtgagccaccgcgcctggcctgacagtcttcattttcatctggtatgccctacaaaagctcatgcctggccgggctcagtggcttatgcctgtgatccagcagtttgggaggccgaggcgggtcgatcatctgaggtcaggagttcaagagcagccgaccaacacagcaaaaccccatctctactaaaaatacaaaattagccaggcgtggtggcggcgcctgtaatcccagctactcaggaggctgaggcaggagaatcgcttgaacctgggaatggaggttgcagtgagtcaagatcatgccactgcactccagcctgggcaacaagagcaaactccatctccaaaaaaaaaaaaaaaaaaaaaagctcacgcctgtaatcccagcatttggattttgggaggccggcaaattgcttgagcccaggagttcaagagcagcctggccaactaggaaagcaaagtctcgtctctacaaacaatacaaaaaaagccagcacgcaatggcatctcctctaggcccagctactggggaggctgaggcatgagaatcgcttgatcccaggaagggaggttgcagtgagccgagatcatgccactggactccagcctgagtgacagagccataccagtctcaaaaacaaaaacaaaacagcaacaacaaaaatctcaacactttgagaggttagggtggaggatcacttgagcccaggagttcaagaccagcctaggcaacatgggcaagacacatctctacaaaattaggccgggtgcagtggttcatccttataatcccagcactttggaggcaggcagatcacttgaggtcaggagttcgagaccagcctggccaacatggtgaaacccatctcaactaaaaatacaaaaattagctgggtgtggtggcacccatgtaattccagtacctgggaggttgaggcatgagaatcgcttgaacccaggtggcagaggttgcagtgagtgagattgtgccaccgcactccagcctgggtgacagatggagactctgtctcaaaaaaaagaaaatggccaggcgtggtggctcacgtctgtatcctaacactttgggaggccaaggcggtggatcactggaggtcaggagtttgagaccagcctggcgaacagggtgaaaccctgttctactaaaaatacaaaaattagctggtcttggtggtgcaagcctgtaatcccagctactaggaggctgaggcaggagaatcacttgaacctaggaggtggagtttgcagtgagccgaattgcactactgcactctgggcgacagagcaagactctgtctaaaacaaacaaacaaaccaaagaaaacaaaaactaaataaataaaatttgcccaggtcagtaacaaatgcctgtagcccaactactcaggaggctgaggtgggaggatcacctgaaccctagaggtcgaggctgagtgagtcacgtttgtgccaccacactccagcctgagtgacagagtgagaccttgtctcaaacaaaaaaaaaataataggttgggtacagtggctcacgcctataatcccagcattttgaaaaccaaggtgggtagatcaatagagtccaagagttcaagactaacctgggcaacaggcaaaacccggtcactgcaaaaaatacaaaaacattagccgagcttggtggcaaatgccttagtcccagctactggggggctgagatgtgaggacggcttgagcctgggaggttgaggcacagtgaactgagaacctgtcaatgcactctagcctgggtgacagagcaaagccctgtccaaaaaacaaactttaatcactaatgcagaagataaaagagtataaactaggaaacttatacttccaaaattttgtttgtttgtttgagatggagtttcactcttgttgcccaggttgagtgaaatggcacgatctcactcactgcaacctccacctcctgggtccaagcagttctctgcctcagcctcctgagtagctgggattacaggcatgcgccactacgcctggctaatttgtgtttctagtagagatgaggtttctccatgttggtcaggctggtctccaattctgacccaggtgatctgcccacctcggcctccaaaagtgctgggattgcaggcgtgagccactgtcccggccaatacttccaaaatttatcttgcccccatcttgttttgtctttggttttcaggtttactttttttttttttttgagacggagtctcgctctttcgcctaggctggagtgcatggcgcgatctcggctcactgcaagctctgcctctcaggttcgtgccattctcctccctagcctcccaagtagctgggaccacaggcgcctgccaccacgcccagctaatttttttttttttgtatttttagttgagacggggtttcactgtgttagtcaggatggtctcgatctccgacctaatgatctgaccacctcggcctcccaaagtactgggattacaggcgtgagccacgtgcccagcccagggtttacatttttaatgttattaccctcaccttggtcccagatcttctaatattcatagaatatctttgcactccagtatcactccattttcacaaccacccccagtctacatccttgggctccagcccattcatcacttcattagccatctataaaatgatccggccaggccaggcgcagtggctcacgcctgtaatcccagcactttgggaggccaaggtggcagatcacctgatgtcaggagttccagaccagcctggtcaacatggtgaaaccctgtcctactaaaaatacaaaaattagctgggcgtggtggtgggcacctgtaatcccagctactgggaggctgaggcagcagaattgcttgaacccgggaggtggaggttgcagtgagacaagttgagccactgcactccagcctgggtgacagagtgagactccctcttacaaaagaaaaaaaaagtgatcctattaggtgttggggctgattggagtggggtgaaaagggcctgggttcgtccattctaagggaaacagagtggagggtatttaggctaatggctttttaaagggagataaagaaaacttgggctgggcgtagtggctcacacctgtaatcccagcactttgggaggcgaggcgggtagatcatttgaggtcaggagtttgagacca

SEQ ID NO: 5078 - DNA, 13395 bp, Homo sapiens
gtgtagtggcgcgatctcggctcactgcaagctccgcctcccgggttcacaccattctctgcctcagcctctcgagcagccgggactacaggcgcccgccaccatgcccagctaattttttgtattttcagtagagacggggtttcaccgtgttagccaggatggtctcgatctcctaccttgtggtccgcccgcctctgcctcccaaagtgctgggattacaggcgtgagccacccgcccggccagtctccatgttttcacaactctccaattcttctttatcagtgcttccaatatccacttattagttagcctttgatggatgtctgcttccctatgggactgtgggcaccagagggtaggaaccagagtgtttttgctcattaagacaactcaatacttggcacagtgctggtacattgctagtgcacagtgaatatttgttgaataaatgaataatcagtaactttcaagggggttcttaggtggagctttaatgggaagcgtcagtgccattgcctgggctctggggcagctgtgagtccagatctcatggcttctgttcagggcctggtccacatccagcctcgaccttgtgcccaaaggccattcaggcaaaaagaggtggaagagtcttctcctagagggggtagtgcaaaggtggcattagagcattaaggtggctcggatccagaatcttctccccattttccactcctccaacctgagtttgcaaaagcactaccttccactgcccccatatcttttcttgtggcctattcttcttccctcccagaggtttccttcccctcaaaatgtgccgcccccttgagctgtttccaatgttgtgctcatgaacttgaacatcattctctcttacctggaaagcccccaggaagagacgcccttgaggcttggcccagaggttaaggaggggagccagcctaagggaggcagggcaagggccttcatcttcgacccttggctcaagaccaccctggaatactcagcttcagctgaagagggagtcccaagaccaggggcagatccagccctggcccgacccagaagacaacaccaccttctgcagagtgtgtgggaaagggacggtagagagagaggaagaatgagccgggcctactgcctgtggcctcacccctagctgccttaattctgcctttcgctatgcctccacctactggccattctcaccacttaaatcctgccccaatttttttggcttgaccctttttgaaaccacacctgccccaagtaaatatgcagtctaagtcaaaacgtttgcttgctgtggggagcttcaagatatgtccctcgcccctaccacccacctgagtgcatccataagccttatttttatttttatttttttgagacagggtctcactgtggcccagtcagagtgcagtggcacatcatagctcactgcagcttcaaactcctgggctcaagtgaactcctgcctcaggctcctaaatagctagggcagcagacatgtgctaccatgcctggctatttttttttttttttagacagaggtctctgctatgttgcccaggctggtgtcaaactccggcctcaagtgatcctctggtcttggcctccagcacctgggattacaggcaagcaccacatgcctggctaattattaatgaaaaacaattctgtggagccagtcttgttatgttccctggctggaaaccttcctaatattgacatgttggactcccctcttccctcattgctccaggtccactgaatacaggcaatgccccactgtccccctttacttgatcttggaggtggagacgagccaagatgggttctctggtgtcccaagagcaaggaggtggcctgagcctgctgcctcttgagtcccaggtccaaagagaaggcccagggctctgcatgaggctggggaatgtctgggggagaaatgattatcctgaggcctcaaagctggggtctcaaggaggaaaggggccagggtagagggggacagaggcaggctgagctggccagggtgggaaaaatagactccgaggaatctacctcggagattgaattctgcctgagtccctggagggagaaatatcccgggatttattctacatcacagcttctgaggctagtgggggcagatgctgagatctcggcctgtttgccagccaggaatcccggcgcaggcagccatccagggcaggaaccagctggagtgtgacaagataagatacggggatgtagaaatcagggcatcggagccgcagtcccgacctccctgcctcagttgactcccctctgagcatttggcctcccccttgcagctctcaacccttccctttccctaaaagtgtggacttagattcccacggccagccacccagcagtgctttaccaagtttggctagggttccacccctggggtgtagttaccggcaaccgaaggttggaagcggggagagcagccccccaagcgcaatcctcatgatgggatggcgtttgctggtcaggggcccaggacctgtctcaggcgcagcacctcctccccatccacctccagcagcacagagtccccctcatcttgacttccacctgcaggaaggtgggaagcaaaatcagaggcccctgggatctgttctgccaccttcctgtgaggcagcctagtactatagtggaaagaacatgccttaaagaacagctagcatccttggccttgggtcactcagctcttgtcacttatatactgactgagcctagaattcccatcagaaaagatggggccaagaatagctactttgtgggggttcgtgtggttaaacgagatgacagtggtaaagggatgcccaataacttggttttgttccctttcctcgaccagctccagacatccctcccctgaggaccagagctagcttacctggtgccatctccatcatccagccgtggtccagcacccaccgtaagctgggcccagtgattgtgcagttggactcaggcctgccgtctcgaagtcccagcataaaccagtcatccttagggttggtatcccataaaaaatcactccctctgggtcccaggttcgaacctcaaaggaggaggaggttctggaggacacagaaggaaagattgtgtatgtcatgtgtcctttgagaaccagtgtgggtttggggagatggtgttcacagataaggaaaggaagacagggaaaagagaagagctgatggaggagggcagaaccaggggactgggtcaagggctaggccaaccccatactttgtgatcttgtgaggtcaaaggtcatgacagcgataggctcttgtcctgggccattgctgaggtggacaccggagggtcgtgggcactctatcagaaagagaaaacaaacaaagctgagtagggacattcagagacagacagagggagaggccctgctacagggccagaggagagaagggaagactgatgagctgagtgccctgtcccgctcctgcacctgggtggggagaacaggtctcagggccatccctggcgggtgtgacgcagtagtagcaacagcagcaacagcagcaggcgcgaggtaccagtgggcctctgctctccataatcagccactgtccactcggcggctcagacaactctgggagaatgtgtagaggcaggcagccttgcgtgtgggcggtggagggttaaaggttgccggggaggagggggtaaaggaaacaggggcactgacccttgacccctgcccaggggcccatcacaagactcagctatcacccctctggggatcaatggggtgaaggacagagtcccctcactatcatcctccactgccgagaaagtttctgaactgggagaggatattccatctccccctcctcctctagggcctgatctaggtcctccaagatttctgtccactcggggagcctgcttcacaggcctgaggtctagaaacagtcctcccctgcgtcccaagtagcatcctgtatcggactagaaatgagataatggaatcctaaatttctagctgagtgaccttgggcaagtcattcacctttgtgcttcagtgtccttgtctgtaaaatgaggaaaataatactttacgggggactgtgaaagagggttcattgagaaaatgcaggcacagtgcctggcatctggtctgaatcctcccccagtcttttcccaggcctctgaggcctgtctcccaagaaggtattgtctgttgtatgattcagtgaatattaagaagggacctgccccccgcctctcagttatcttccctatccatttattacagggcctaaacagtctagcagtagaaatcacccactccctgacccatttattttattttattttattttattttattttattttagacagagtcttgctctatcaccaggctggagtgcagtggcgtgatctcggctcactgctgcctctgcctctcgagttcagcgatcctcctgtctcagcctccttagtagttgggactacaggtgcacgcaccaccacgccagcaaatttttttgtgtttttagtagagacggggatttcaccacgttgcccaggctgtctcgaacctctgacctgaaatgatccgcccacctcagcctcccaaagtacctggattaaggcattagccacaaggcccgaccctccctgacgcattttattttatttatttattttggatggagtttcgcttttgttgcccaggctggagtgcaatggcacgatctcggctcactgaacctccacctcccaggttcaagcgattctcctgtctcagcctcccgagtagctgggagaaaggcatgcgccaccacacctgtctaatttttgtatttttagtagagacggggtttcacatgttggtcaggctggtctcaaattcctgatctcaggtgatccgcctgcctctgcctccaaaatgctgggattacaggtgtgagccactgtgcccaccccatgacccattttaaaatcaaatgacagaccgggcttggtgggtcacatctgtaatcccagcactttagaaggctgagcgggcagatcacttgaggtcaggagttccagaccagcctggccaacatagtgaaacccgtctctactaaaaatacaaaaattagccaggtatggttgcccatgcctgtaatcccagcactccgagggtgaggcaggagaatcgcttgaacccaggagggagaggttgcagtgagccagatcgcgccactgcactccagcctgagtgacagagtgagaatccgttaaaacaaaaaaaagagaagaaaaaagaaaaaaaaattagccgggcgtgccggtgcgcgactgtagttccactactccggaggctgagacaggaggatcgcttgaactcgggaggtggaggctgcagtgacagagatcgcgccactacaccccagcctgggcgacaaagcaatacaccatctccaaaaaaaataaataaataaatataaaaataaaacatttaaaaaatgcaaatgcccccaagaggtacacttcatgctactcaagagctgcaggaaacagctttcagagctgagggtcttaaggctacccagggtctgggcgggtgagtgagcctgaggctaaagcaggttatcactgcatatgcaatttaaaaagcactgcgggggagcctttgaaccgcggggtatctcgacccaggttggacacccacacaaccgcaaggaagccgcttcactccaaccttgaactctacccaggagccagtcacaagatccagctgtcgggggtggggcttggggggggacgcggccgtgcctgttcccaagctgattggctgacagttgtgccccctgctgcgacagaattcgagggggtggggcatgcccggacagaggatcgcctcgctggcctactctctcctcccgtacggcgccggaatccagctccacttaccaggccgcggctaccccgccgtcccccccgactcccgccaccccgtctctcaggctcttcaggatccaagtccgtaggccctttaaggggtctagttgccgtttcgaggccctgggactttggtcccagacagcggggatccggatggcttccgtgcggatccagaggccaaggagggagactgtggagatatcctgaggctgattcgggtgaagactgcagccggtaacccgggggtcagagtggcgcggccagagcggggtcgtaggaggcgggggcaggggaggggctcgccttgggaacctgctcggggagcagcggggcccttctgctctaatctgcttccgtacccacgccttaggagctagccgaattcgaaaaactctcggatcaggtgaaatcagtgaagaaggtgggggctcagcgcccaggttctggcggaggctggggaggaaatggggatgggttccccaggcgacagctccaggctgggcatacacccacgtcctctttctcttctctttgtcacaactccaatctcggcagccctgagagcagatggctttggagacaatctttctatcactgtttggtagcagagattcttccagcgcccgggaagctactgggtaagacacctggcccttagaagtccacctctccagccggcctcagaggtctccccacaggcttcagaagccttactccccttttctctctctcagggccctgcgtggtgggctatgggatatatatttcatctacagtacatggaagggacgcaccatttatctggaggatatctatgtgatccggaatatcggggtactgggcagaagctgaggctggggtgggagcaaagcaccccacaaccccactgttatcccctgtccccagagcccagccggtgtcattttctgatccccttcactcaaacaatagctattttttgcctctttctctccacaacaggtcaagggattggttccaaataatcaaaaaggtggctgaggtgaggagatgggtggggcgacaagtgaggacctgagaagcaagggtatatggaggggggacccgggttgaaagagggagtgagaaaacctttttttttttgaccccagaaaagttagtgttgtcttctcccacaggtggccttggataagggcgctcccaattccgcctggccgtcctggactggaaccagagggccatggacttgtacaagccctaggagcccaagatctgacggaagctgagggctggcacttcttctgctttcaaggaaggcaacgagaaagttggcaggaaagtgacgccatccctaggaggatctctgtcttgagttctccttccccatcagctgaagcactcttcagagactacgtccacagacactgatgctaggcctccctggaggaaggagggttaggggtgcctatcctcaagtattggaagagcagattgagggagagacctttcttccttgttgagggtgaaaaataaataagaattacatgtccgatgtggtgttgggtctttcttttatttctttttttttttttttttgagacagagtctcgtcgcgcacgctggagtgcagtggtgcgaactccgctcactgcaacctctgcctcacggttcaagcaattatcctgcctcagcctcccgagtagctgggactacgggtgcgcaccacctgcccggctaatttttagtagagacggtgtttcaccatactggccaggctggtctccaatcctgatctcgtgatccgtccgcctcggcctcgaaaagtgctgggattactggtgtgagcactgcacccagtccaaagtctttttttttttttttgagatcaagtcttgctgttgtcccaggccagagtgcaaggagtgcaaaggtttgatcttggctcactgcaacatccgcctccgggttcaagtgattctcctgcctcagactcccgagtagctgggattacaggcgcctgctccacatgcggctaattttcgtatttttagtagagacggggtttcaccttgttggccaggtggtctcaaattcctgacctcaggtagtccgactgcctcggccccccaaagtgctgggatacaggtgtgagccaccgcgcccagcccacagtcttttctttttctttttattttttttagacagagtctcgctctgtcacccaggctggagggcagtggtgagatcttggctcactgaagctttgcctcttgggttctcaccattctcctgcctcagcctcctgaacagctgggacacaggcccccgccaccacgcccggctaagtttttgtatttttagtagagacggggtttcccgtgttagccaggatggtctcgatctcctgacctcgtgatccacccaccttgcctcccaagtgctgagattacaggcgtgagccaccgcgcctggcctgacagtcttcattttcaattggtatgccctacaaaagctcatgcctggccgggctcagtggcttatgcctgtgatcccgcagtttgggaggccgaggcgggtcgatcatctgaggtcaggagttcaagagcagcctgccaacacagcaaaaccccatctctactaaaaatacaaaattagccaggcgtggtggcagcgcctgtaatcccagctactcaggaggctgaggcaggagaatcgcttgaacctgggagaggaggttgcagtgagtcaagatcatgccactgcactccagcctgggcaacaagagcaaactccatctccaaaaaaaaaaaaaaaaaaaaaagctcacgcctgtaatcccagcattttgattttgggaggccggcaaattgcttgagcccaggagttcaagagcagcctggccaacatggaaagcaaagtctcgtctctacaaacaatacaaaaaaagccagcacgcaatggcatgccctctaggcccagctactggggaggctgaggcatgagaatcgcttgatcccaggaagtgaggttgcagtgagccgagatcatgccactggactccagcctgagtgacagagccataccagtctcaaaaacaaaaacaaaacagcaacaacaaaaatctcaacactttgagaggttgaggtggaggatcacttgagcccaggagttcaagaccagcctaggcaacatgggcaagacccatctctacaaaattaggccgggtgcagtggttcatccttataatcccagcactttgggggcaggcagatcacttgaggtcaggagttcgagaccagcctggccaacatggtgaaatccatctcaactaaaaatacaaaaattagctgggtgtggtggcacccatgtaattccagctcctgggaggttgaggcatgagaatcgcttgaacccaggtggcagaggttgcagtgagctagattgtgccaccgcactccagcctgggtgacagatggagactctgtctcaaaaaaaaaaaaatggccaggcgtggtggctcacgtctgtatcctaacactttgggaggccaaggcggtggatcactggaggtcaggagtttgagaccagcctggcgaacagggtgaaaccctgttttactaaaaatacaaaaattagctggtcttggtggtgcaagcctgtaatcccagctacttggaggctgaggcaggagaatcacttgaacctaggaggtggagtttgcagtgagccgagatgcactactgcactctgggcgacagagcaagactctgtctaaaacaaacaaacaaacccaagaaaacaaaaactaaataaataaaatttgcccaggtcagtaacaaatgcctgtagtccaactactcaggaggctgaggtgggaggatcacctgaaccctagaggtcgaggctgaaggagtcacgtttgtgccaccacactccagcctgagtgacagagtgagaccttgtctcaaacaaaaaaaaaataataggttgggtacagtggctcacgcctataatcccagcattttggaaaccaaggtgggtagatcaatagagtccaagagttcaagactaacctgggcaacagggcaaacccggtcactgcaaaaaatacaaaaacattagccgagcttggtggcaaatgcctgtgtcccagctactggggggctgagatgtgaggacggcttgagcctgggaggttgaggctaagtgaactgagaacctgtcaatgcactctagcctgggtgacagagcaaagccctgtctcaaaaacaaactttaatcactaatgcagaagataaaagagtataaactaggaaacttaatcttccaaaattttgtttgtttgtttgagatggagtttcactcttgttgcccaggttggatgaaatggcacgatctcactcactgcaacctccacctcctgggtccaagcagttctcctcctcagcctcctgagtagctgggattacaggcatgcgccactacgcctggctaattttggtttctagtagagatgaggtttctccatgttggtcaggctggtctccaattctgacctcggtgatctgcccacctcggcctccaaaagtgctgggattgcaggcgtgagccactgtgccggccaatacttccaaaatttatcttgcccccatcttgttttgtctttggttttcagagttactttttttttttttttgagacggagtctcgctctttcgcctaggctggagtgcagtgcgcgatctcggctcactgcaagctctgcctctcaggttcgtgccattctcctccctcacctcccaagtagctgggaccacaggcgcctgccaccacgcccagctaatttttttttttttgtatttttagttgagacggggtttcactgtgttagtcaggatggtctcgatctcctgcctaatgatctgaccacctcggcctcccaaagtactgggattacaggcgtgagccaccggcccagcccagggtttacatttttaatgttattaccctcaccttggtcccagatcttacaatattcatagaatatctttgcactccagtatcactccattttcacaaccacccccatgctacatccttgggctccagcccattcatcacttcattagccatctataaaatgatcctgccaggccaggcgcagtggctcacgcctgtaatcccagcactttgggaggccaaggtgggagatcacctgatgtcaggagttccagaccagcctggtcaacatggtgaaaccctgtctcactaaaaatacaaaaattagctgggcgtggtggtgggcacctgtaatcccagctacttggaggctgaggcagcagaattgcttgaacccgggaggtggaggttgcagtgagacaagatgagccactgcactccagcctgggtgacagagtgagactccctcttacaaaagaaaaaaaaagtgatcctattaggtgttggggctgattggagtggggtgaaaagggcctgggttctgccattctaagggaaacagagtggagggtatttaggctaatggctttttaaagggagaataagaaaacttgggctgggcgtagtggctcacacctgtaatcccagcactttgggaggccaggcgggtagatcatttgaggtcaggagtttgagaccagcctgaccaacatggtgaaacctgtctctactaaatacaaaaaaaaaaaaaaattagccgggcatggtggcgcatgcctgaattccagctacttgggaggctgaggcaggagaatcgcttgaacccaggaggcggaggtgcagtgagccaagattgcgccactgcactccagcctgggcaacagagcaaaactccatcaaaaaaaaaaaattaaaatgtctctcaaatctgtccatagctctatccttacttgcaaattctcactctttgaaaattgccacaacctccttactggtctcccagcctccttctgtaattctcccccaattccatgggattttttttttcacagatatacattatgtactttattttttatttaaatttaatttatttctttattttgagaccagtttatgcagctggtttttttttttttttttttttagacggagactcgctctgttgcccccaggctggagtgtagtggcatatcttggctcactgcaacctctgcctcccaggttcaagtgattctcctgcctcaacctctgagtagctgggattacaggcgtgcaccaccacgcccagctaatttttgtattttttttagtagagatgggttttcaccatgttggccaggctggtctcaaactcctgacctcagatgtctgcccgcctcagcctcccaaagtgctgggattacaggtgcgagccactgtgtcaagccataatttttgtatttttagtagacatggggtttctccgtgttggccaggctggtctcgaatcctggcctcaagcaatcctccatccacataaatgataatacatttgcccacgtggcatcaaatccacaaccttggtgttagcacctggctctaaccaactgagctaactggctatgcaaatcttgatttttttttttttttttttttttttttgtgacagggtcttgctctgttcccaggccaagtgcagtggtgcgatcatggctcactgcaaccttgacctcctgggctcagtgattctcccacctcagcctctcaagtatctgggatcacagtcaggtgctatcaagccggctaatgaaagcaaaatttttgtctgggcacggtggcacatgcccgtaattctagcacctgggaggccgaggcaggtggctcacctgaggtcaggagttcgcgaccagcctgactacatggtgaaaccctgtctctactaaatacaaaaaaattagctgggtgtggtggcacatgttgtaatccaagctatttgggaaactgagacaggagaatcacttgtacctgggaggcagagttgtagagagccgagattgcaccattgcactccagcctgggtaacaagagcaaaactcgtcccccaaaaaaacaaaaaaaaaaattattaatctgggcactgtagctcacgcctgtatcccagcactttggaaggctgaggcgggtggatcacttgaggtcaggagttcgagaccacctggctaacatggtgaaaccccacccgtctctactaaaaatacaaaaattagccagattgggggcaaacggctgtaatccaagctacttgggaggctcaggcaggaggatctcttgacccgggaggcaggggttgcagtgagccaacatcgtgccactgcactctagcctaggcaaagagtaagactctgtctcaaaaaacaaacaaacaaacaacaaattttttattggagactggtctcactatgttgtccaggctagtattggactccagagctcaagcaatcctcccacttg

SEQ ID NO: 5079 - DNA, 15763 bp, Homo sapiens
cctctgccacacgcttctgattggggaggaaggagcctagagaggttacacacaacacacccagctctgccacctactaggatatcacttttcaggttgcagcttaaatgtcactccatcccccagaatctcaagcaggattagtgtttactgatttgggcttccattgttccctggctcacccaggcatagcaccaaccacactttagtgctattgcttgtttaattactgatcactttactaaactgtctcatcctaaggcaaccgtccatcagttctgcgacctaacaaccgttggcctcccgatttctcctgtccgttgctgataaactgcttgaaagaaaagtctacatttgcctccacttggtcctctctctcctccctctcagtccacacccgggctccaggctcctcgctctactgaaagtgctctttttgtcctcagcctccctgatccttttgtgcacctggcctgtgggccccccttccttgaacctcattcttcttggctttcatgacgtcctctctccggtctcttcctgggaacttagagatctaggccttctcctctttctcctcttctccctcttctcttcctcttcttcttgcctcaagtccctctgtgctgactctgctccttcttttcccgatcctttcccttaggccacctcacccacaactgggtttcacccaaatccttgagggggtgctccaggtgggcccgttgcacgtggccgtgcagggtgttcagtgtacaggcacacccgccaggaaacaaggaagaggctccctctctgcaatttgtgtaaaggccccgcaggttagtgtgaccctggcatccatacctcctgccccatgcctctcccaagctccagccctgctctctagctgctcacaggatagttccctaaacactgctggcagaacctgcccagcctaggccggaaagaggctgacagagacagagccggctgactggatgatctggagataggttcttggcactctgttcttccatttcaccccccttttcaaagactcagtcttagccaccctgccctagcccatgttagatggaaaaaaatagtggtgagcagggagcagaaggctggagagtagtagtgcaaaagaacaagggggctgggaagaaaaggagcaaatggggcaaagcagacaggagggaggtcagctggcttctcagctgccaaagctcttccaggcacgtcatctcatttggtctcatgaaaactctctaagtggatattactatttttctcattctacagctgaggagagacaagctagtaaaggctgctcaagatcactaagccagcagtggggaatattgtgaaatatgaaatattttattatttcatagagacagggtcttgttatactgcccaggctggtctcaattcctggccataagcgattctcccacctcaacctctcaaagtgctgggattacaggcatagccacctggccgaatccaggtcttttgacaccaagtgccctattcatccctttgccctccctaatctctgggcagatttgagtgaggcgataggctgggggatatggcattgggatatggggttgcacctgaggagaagccaacagcaccagggtcagaatgggcaaaggacataacacaggcaaggccattcctggtggggctgggccagggagctgaggggctcctagaagggcaggttccccgacttctctgagcttcagcgcctggaggtttctgggcagccacacgctttcagcgctgacccttcctcttcctttatccttggaaaataacccctagggcacaaacccaccgaagcaatgatactaagtgtcagggcattcctcgactctcccacccctggggaagaggcctggcccaagccctgagaacccgttcccacctccacaggcagtgccagggactccaatagggtgctgaaattccagaagtcttgatatcagactgggtcctgcacccagctgccaccgcatcctccccctgctccgcagctgcctctgaagcttgtacccttgcccccacctctgtctctctgcagtctacctgactgcactttctgatgacccccactgacctctcctagcacccatgtttattaattacttaaacctaaagtatttacggagctccacctatgtgccagagcagggctgggcaggaggattcccattccaccccagattccttttcctttgggttctacccagatctccctctgtctcaacagctctacccttaactcagcagccctgggatttctccgtgggagggccccctgcatgggtataccctccactgagagtagctgaaaggagcccagggagcctcccaggcgatcccttcctccctccagcccaccccaccacagggccttctcacttctccaacacactggagtcaccctcagtctttaaagaagaggatgggaatcagtctctcctgttttgtgtatagaccccatccttacacctcagttgctgttccgaacacctccctccccaggctgagcaaggaatttccagcctaaatgttaaagcaaaggcggaaggactgcaggcttccaatcctccctaatcctctcatctctccaccacctagtttccccagagccatcagtcaagccctttgtgggagaatgtggagtgggcagtaagagctgacccacccctatcgggcatctctgagtctactctgaagttaaacctgcctcacaggttcccactccccttctgctgacgctggaatgcaggactgatggtgggtggagaaccatttcccctctttccggattccccctgccgaggctcattactctttgtgtctgttctgggagcttctcaccagggcccctctgctccaccctttcccgggactgtcctcacaatcacgccatccccctttccaccttgctcccacccccaccccagaaccctagtgctgggaatctggaggccgagaccttcaccccagtctccaagaggctctctgacaaagtgaaaaagccctgagccacagaggaatctggaagtgtggaaaggggcaggctggtgctggaagcccgaggtcggtatttgccccatgctgcaagagtcaggaatgtggccatcgacatcagtaggagagataaagtctagctggcagctctcctctccagcccccacgctgcacctccacaggtcccagaagtttcctagcagttggggtgggcaggaatcagacaaggacctgggaattagcttggagaaaaattctagaatctgttttgttgctggtagatttcaaagtgccccagggtttttaaatgactcagagagacagacttcaaccccttgagcccgtctttcgaattaaattgaccccctttatctgccctcctgtatatatgaagccttccttactttgaaggaaggctccagtacaaataattagtatttgtttgatgatgagtgagtgacaatttacactcacattcactgccacctgaggaaatagactggacagtcttactgttttccctgtacaagtgaagaaattgaagttcagagttaggtgacttccccaggttacacagctagcaaagtatccaggctggctgacttaaagcttagcaataacagtaaaggcagtacatagcttgttgactccacatactttattataaaatactgcccaacttgaagttctggaatccagtgggggaatataaaggtgaaagcaggagagacccctctgactggacctcttacctcccagaagccttgtatgcaaaaccagtgggcattcatttgtatgttatttgcatcccgtttgcctcccagccttcagcaggccccgaccctcccctggccagcttccccctgactgccccctggctggctcccattgagcactgtggggctctccccaccattagggacagatcaggaacaatccaggctcaggctctttatctgtgctctgcctcccacctggcggtccactggccaggcttttccagggtcccttctctcccaggtctgccctactatttgtctccccttccccctcagctggtagctcgataagaatcaataggtccactccagagcaaaaacacagccaaatgtgtcataccaggccctgccagaaaaacgagctgctggagctgacaacttgaaggccaaacacctaagggttccccccaacacttcattcagcagggatggtcatcagcttcagggggcaggcagcatgaaagcctccctacctccatccttctcacacagaggtggggagagcatcttggaggatgcagtcccctggggccaggcttctaatccagacagccttacaaggggggacaggggaaggactggcttggagaaaagtcctagaaaagaggggagggcactggccaccagggctgggtcgctgctatgatggtcctaggagtgcctgcctgtccttcaggccccatgcgatgtaggacacattacttttatttatttatttatttattttgagtagagtttcgctctggttgcccaggctggagcgcgacggcacgatcttggctcactgcaactctgcctcctgggttcaagcgattctcctgcctcagcctcctgagtagctgggattacggcacacactgtgcctggttaatttttgtatttttagtagagaaggggtgtcaccatgtggtcaggctggtctcaaattttttttttttttttttttttttttgagacagagtcttgcctgttgtctaggctggagtgcagtggcatcgaactcttgacctcaagtgatccacccgctcggcctcccaaagtgcttggattacaggcatgagccactgtgcccggcgatgtgggaccattatcatctctgtgagagatttttggtctcttttgtcaccgcccttctctcccagctctagaactgggcctggctcacagtaggtgctgaatgcatactggttgaattgtaaatgccaggatttgtttaattaaggatgcaggaaaggtgatataccggtgtgcagaagtcaggagcattccctgtccaaatcacagtgttccactgaggcaaggcccttgggagtgaggtcggagaggggagggtggtggagggggctcagagactgggtttgttttggggagtctgcaccttttgctgagtgaatgtatgtgtgtgtgcatttgagagcacacctctgtatgattcgggttgagtgtgtgtgaggaaacgtgggcaggcgaggagtgtttgggagccaggtgcagctgggtgtgagtgtgtaagcaagcagctatgaggctgggcattgcttctcctcctcttctccactcccagcctttcttccccgggactcctggggctccaggatgcccccaagatcccctcccaagtggataatttgggctgcaggttaaggacagctagagggactcacaggccattccaccgcacaccaccagacccccaaatttcttttttctttttttttttttttttttttgagaagagtctcactctgtcgccaggctgcagtggcgcgatctcggctcactgcaacctccgctcccaggttcaagcgattccccttcctcagcctcccaagtagctgagactacaggcgtgaccatcacgtccggctaattttttgtattttagtagagagggggtttcaccatgttggcaggatggtctcgatctcctgacctcgtgatccgcccacctaggcctcccaaagtgctgaattacaggcgtgagccactgcgcccggtcaagactcccaaatttcaaactcgccagcactcctccacctgggggagaagagcataataacgtcatttcctgccctgaaagcagcctcggggccaacaacacctgctgtccgtgtccatgcccggttggccaccccgtttctgggggggagcggggcttggcagggctgcgcggagggcgcgggggtggggcccggggcggagcggccggggcggagggcgcgggctccgagccgtccacctgtggctccggcttccgaagcggctcggggcgggggcggggcctcactctgcgatataactcgggtcgcgcggctcgcgcaggcgccaccgtcgtccgcaaagcctgagtcctgtcctttctctctccccggacagcatgagctcaccactcgctccaccttctccaccaactaccggtccctgggctctgtccaggcgcccgctacggcgcccggccggtcagcagcgcggccagcgtctatgcaggcgctgggggctctgttcccggatctccgtgtcccgctccaccagcttcaggggcggcatggggtccgggggctggccaccgggatagccgggggtctggcaggaatgggaggcatccagaacgagaaggagccatgcaaagcctgaacgaccgcctggcctcttacctggacagagtgaggagcctggagccgagaaccggaggctggagagcaaaatccgggagcacttggagaagaagggaccccagtcagagactggagccattacttcaagatcatcgaggacctgagggctcaggtaaggggtggagggacctcaactcccagccttgtctgaccctccaattatacactcctttgcctcttccgtcattccataaccaccccaacccctactccaccgggagggggttgggcatacctggtttccatccgcgcacctagccacagggtccctaagagcagcagctaggcatgggagggcctttcccaggagagagggggaaggggacagggttgagagctttacagaggaagtggacacatggagggaggtaaggaaaggcctgtaaagaggaggagacactggctctggcggaatgggactattggagggttaagcggatgtggctaaggctgagtcatctaggagtaaacaagagccttcctttgggaggagccaatccagggtgtagggggcccagagtgaccaggtgcactgggaaaaaatgccaggagagggccaggaagaggacttgttagtagcgactcacttctggcaggcaggccagccagctagccagcctgctgaggcttcccaagaggggcagagtgctggatctgggaatccaggaaaggagggaatggggtggggctagatgaaaagggataggtgtcagggagagcctctggctattcctgggaccaggaagttttcactaggatacataacacttttacacactcaccccacccatccctggctttctattcatggaacaacctctctctacaaccctccagatcttcgcaaatactgtggacaatgcccgcatcgttctgcagattgacaatcccgtcttgctgctgatgactttagagtcaagtaagtttgggggctagagagctgggggccaggggtggagctaagaaggatctgctccccaggctgggtcagttaggggctcacagtggatcctgttaggtgtgggtggatgagagtcagggtccatcagtgtattcatttaactgtcatttgtataaccccgtttaagaatactgtcctccaagtgccaagaatggtgctcagggattaccacctaattgctgactcaagttgctggtttgcaatgggcacagaacttctcttgtaggtggcatgagttgagaaggttctggatcagagataggggcccctctgatcacctcactcctataggtatgagacagagctggccatgcgccagtctgtggagaacgacatccatggctccgcaaggtcattgatgacaccaatatcacacgactgcagctggagacagagatcaggctctcaaggaggagctgctcttcatgaagaagaaccacgaagaggcaagcaggggcactggccaggccagggattgaggggccaagagaagtctgggtcggagaatagacaagacaaccaactgcaagtagccttgctaagacgtttagaaatagcagcctgggctcttcttaataagaccgttctgatgaagagcattctcagggggtcgagtacaccctggctcacctgaatacaggtcaaaatgatatgggttagaaaatgagatgagaacagaagtagaagcagctaaactaggagctgggggtgataaaggaatgacagcagatggagttggcagcgcttcctaaagatggtagaaggagcaggtttgtgaaggggagggtggataaaggaacagggtgaagttaagagaaaccatcagtgagtgggtggcatttctacccactggagtagaaaggccagaactgcattgccctgagtgcaagccaaggggttcctcctgtctcttctccaactgtaggcctctagaagaggcaatcacagaagaaaggccttgttggagctctgaccctgaaccctcctcattttgcccctgtcacctttaggaagtaaaaggcctacaagcccagattgccagctctggttgaccgtggaggtagatgcccccaaatctcaggacctcgccaagatcatggcagacatcgggcccaatatgacgagctggctcggaagaaccgagaggagctagacaagtactggtccagcaggtgcgtgaggggaggggatggctgccaaggtgtgggagggaggcagacggaataggggcctgatggactgtccccatcctgcagattgaggagagcaccacagtggtcaccaacagtctgctgaggttggagctgctgagacgacgctcacagagctgagacgtacagtccgtccttggagatcgacctggactccatgagaaatctggtgagtgccttcacatcacctgccagctcctccttcacttggcctcagacccaaccctgtctcaacccaaatcctatccctatatcatgagttcctttagctcagaaagagtcagtttcctctttgcatttccctccactctatcccttatcccagtacttggcacatagcaggtgcccaaaaaagtttccaaaagtgagggatgagcagtcctgggactctgggctcaccctgcccctcctctctgtgcccctgcagaggccagcttggagaacagcctgagggaggtggaggcccgctacgccctacagatggagagctcaacgggatcctgctgcaccttgagtcagagctggcacagacccgggcagagggaagcgccaggcccaggagtatgaggccctgctgaacatcaaggtcaagctggaggctgagtcgccacctaccgccgcctgctggaagatggcgaggactttaagtgagtggggctctccacccacacgtgctgggatcaggagatcacttctccccaaagtctgagcttttggaagcacccatgtgtctgttcactggtatccactgagcactgggccgttgctccgtgggtgctccgtgtcttcaagggagtaacagttacagaggtctcccccttgaagaaagcaaactaagtatgtccctagctgtacttagtatgcaaatgaagtttggccttgagtttcccttttctggagaagaggctgagggtgatttggagataaaggtagaggtcaggaggctttttccctctactttcttgtctcccttctactccacggggctgtttataacttgggcttggtcttctgttaagtcttggtgatgccttggacagcagcaactccatgcaaaccatccaaaagaccaccaccgccggatagtggatggcaaagtggtgtctgagaccaatgacaccaaagttctgaggcataagccagcagaagcagggtaccctttggggagcaggaggccaataaaaagttcagagtcattggatgtcactttgtcttcttttggctgttttcattgtgcacaaatgccctaacccacagtcccatccctgatccagcagaaaccacctctgacccctgagggtttcatatagatggggtgtagaaggaagagggatctgtattcttggaaacacttctgagagacagaggaggagcagtagatgtgatgggtcacaggctgtggggatccctacaagggaattgtggaatcttgccttgaagcgatctggtgttcaaaaggtccctgactgatcattagcagaaatctgaacagaggaggaaattaggccaaagacagaggacagaggagacagggagacacatctggcctcccctaccctgctgctttatgcccttggcccactgcccagggcttcccacccacagtttttcctccaaccccaggccatactcatcctccaaacctatggtgccctcaactctgttcttcactcaacggagatatgatttttagggtgctagaggtctggctagaagttgagtaaagatcatggaagttcccatctaggaaagaggtgcccctgagtaagcacccgtataggtaagatgggcatcttaaaactaaccgaggctgggcacagtggctcacatccgtaatcccagcgtgccaccacacccggctaatttttgaatttttcatagagttgggatttcactatattgccaggctggtctggaactcctggcctcaagtgatcctcccgcttgtaccctttggagtgttggatgccactttgtgtcttccttggctgttttcatacttgtgtgaaaatgccctaaccaacatgattacatgtagatattcgttgcagcagttttgccaaaacaaaactactaaagtcaaggcacccatcactcaaagacctaggttaggttaattttttttttttttttttttttttttttgaggcagagtcttgctctgtcacccaggctggagtgcagtggcgcgatccggctcactgcaactgcctcctgggttcgagggattcttctgcctcagcctcctgagtagctggatttcaggggcccgccaccatgcctggctaatttttgtatttttagtagagacgggggtcaccttgttggccaggctggtctcgaactcctgacctcgtgatccgcccgcctcggctcccaaaatgctggattacaggcgtgagtcaccacgcccggcctaggttaatttttaaatgttgggttaaggcaaaaaaaaattttttaatttaaaaattagccaggcatggtgacattacctgtagtcccacttaatcaggaggctgaggtggaaggattgcttgagtccaggaagaaaggttgcagtaagctgtgatcatgccactgcatttcagcctaggtaacagagtgtgatctgtttcacaaaaaaaagctggccgggcacagtggctcacgcctgtaatcccagcaattgggaggccgaggcgggcagatcacaatgtcaggagattgaggccatcctggctaacatgtgaaactctgtctctattaaaagtacaaaaaattagccaggcagctgggtgtggtggccatgcctgttatcccagcactttgggaggccaaggcgggcggataacttgaggtcaggattcgagaccagcctggccaacatggtgaaaccctgtctctactaaaaatacaaaattagtgggtgtggtggcacatgcctataatcccagctacttgggaagttgaggcaggagaatccttgaacccaggaggtggaggttgcaataagccgagatcatgccattgcactccagcctggcaacaagagcgaaactctgtctcaaaaaaaaatatatatataatatatatatgtgtggtatgtatatatgtgtgtatatatgtatatatgagtatatgtgtatatatgtgtatatggtatatacatatgtgcatatatatgtgtgtatatgtgtgtatgtatatatatacatataacatacatatatatatatatacatacacacatacacacacacacacatatatatgaaataaatttaaaatcttgctgggcatggtggctcatgcctgtaatcccagcactttgggaggcaaggtgggtggatcatctgaggttgggagtggagaaactctgtctctactaaaaatacaaattagccaggcgtgatggcgcatgattgtaatcctatctacttgggagactgaggcagagaatcgcttgaaccaaggagttggaggttgcagtgagacgagatcgagccactgcacccagcctggcaacagagcaagactctgtctcaaaaaaaaaaaaaaaaaaaatagccatggtagtggcatacacctgtagtcccagctacttgggaggctgaggcaggagatttgcttgacccagcaggcagaggttgcagtgagtgaagatcgcgccactgtacttcagcctgggtgcagaacaagactccatctcaaataaataaataaataaaactaaataaaataaaatctccctctccactccctagaagtaaccactgttaaataccttttaaaattagacatatacaagacatttcattatgttttatatatgtaaaattatccagctctgcatcttgatttcttttttatttttttttaattgagacagagtctcactctgtcgcccaggctggagtgcagtggcacatcacggctcactgccacctctgcttcccgggttcaagcgattctcctgcctcagcctctgagtagctgggattacaggcacccaccaccacgcctggctaattgttgtatttttagagagacagggtttcaccatgttgatcaggctggtctcgaactcctgaccttgtgatccactgcctcggcctcccaaagtgctgggattacaggcgtgagcaccatgcttggctttgattcttaaattctactttcttcatttaacaatacgtctcggggctgggcatggtggctcatcctgtaatcccagcactttgggaggctgaggcggacagatcacgagatcaggagatcgaactatcctggctaacacagtggaaccccatctctactaaaaatgcaaaaaaaattagctggcatggtggcgggcacctgtagtcccagctactctggaggctgaagcaggagaatggatgaacctggaaggcggagcttgcagtgagccgagattccaccactgcattccagcctggcaacagagcaagactctgtctcaaaaaataaaaataaatgaaaatacatcttggacaccttctgaatcagtatacatagacctgccccattcatttgagtagctgcttagtactctacgcgtggagtacaaattaattaacctaacctaggtctttaagtaatggatgtcttgatctttttttttttttttttttttttttgagacagaatctcactctgtcgcccaggctggagtcagtgctatgatctcagctcactgcaacctctccctcctgggttcaagtaattctcctgctcagcctcccgagtagctgggactacaggtgcatgccaccatgcccagctaatttttatattttagtagagacagggtttcaccgtgttgccaaggctggcctcgaactgagctcagcaatccaccagccttggcctcccaaagtactgggattacaggcatgagcaaccacgcccgcctaaaagctttttcttttcttttttttttttttttgacagagtctcaccctgtcgctaggctggagtgcaatggcacgatcttggctcactccaacctctgcctcccaggttcaaggattctcctgcctcagcctactgagtatctgggattacaggcaccctccaccatgcccactaattttttgtatcttttagtagagacggggttttcaccatgttgatcaggctggcctgaactcctgacctcgtgatccacctgcctcggcctcccaaagtactcggattataggtggagccaccgtgcctggccatcttgatctttagtagctttgtttttgcaaaaaacagacacagccaacgttataggatgcgcagctgactgaaggtaaaacaggaagtccctggggagctgagcagtacttgcagctgagtcaagctgatcagagtaatccaagacgatgcacctgatcgattagccctcccattagacaatgtctcacagttcccagggtgcttatgcatttgatctcattacaatcctgtgaggtatgcaaggctgtgggtattattggctctggctctgagagtggatactgaggtccacaggcatcatgcaacttgtctgaggtcacagagctggaagcttaagcaggaaccacatctccaggttcccagtccgcaggtctttcctctgtgtgctataactaactgtgcgggctgcacaatagaatccccgggaagctttacaaacaatactgaggcctggtcccagcaccagagattctgattcaggtgtttggagggcaggactcagggcaaatgttgaaaagctccctaggtgactccaataggcaggcaaggttgggggccagacccaagctgacctggggtttgcagcatgacattccttcctgattcaggttatggttgtgtcagatttattatttatttatttatttatgagactctgtcacccaggctggaatgcagtggtgcgatctggctcactgcaacctccgcctcctgggttcaagtgattctcctgcctcagcctcccaatagctgggattacaggtgcacgccaccacgcctggctaatttttgtatttttagtagggcagggtttcaccatgttggtcatgctggtcttgaactcctgacctcatgatccgctcgctcggcctcccaaagtgctgagattacaggtgtgagccactgtgccaggctggctgtgccattttaaacagcgcactgctggaaaatcccgaggcctctggaacaatcctactcattcccagcatgggaagatgactgaggggcagcctattttgtcccccaagcaccaaaggttaaattatcaatcccaaggttataacatggagtcatctgttccatattatatcagtcctatttatccattctctatcaaagtgcaacccaacccagatgataaaattaataaatggtactggagatacagaatggcatatagtgccatttgagggaaaaaagcaactcatatgtatataccttgtacatgcaaacatctctacaaggagacaggaaattggaattcgtgattgcctccgggagagaaattggtaggggggaaacaagggggaaggaagactactttacattgtgtgtcctttataccttctgaattacttattactaattacaaagaaagcagggaaggattgttaacttcctttttttttttttttttttttttttttttttgagacggagtctcgctctcgcccagctggagtgcagtggcgcgatctcggctcactgcaagctccgcctcccaagttcacgccgtctcctgcctcagcctcccaagtagctgtgactacaggcgcccgctaccatgcccggcaatttttttgtatttttagtagagatggggcttcactgtgttagccaggatggtctcgactcctgacaccgtgatccgcccgcctcggcctcccaaagtgctgggattacaggcgtgaccaccacgcccggccgattgttaacttttcaatggtacaggaatctacagacttccaggaaggaaatgttgctgctgtctttgttccactcttttttatttcttttttctttctttttttttttttttttttttttttgagacaagtcttgctctgtcacccaggctggagtacaatgcacgatctc

SEQ ID NO: 5080 - DNA, 11889 bp, Homo sapiens
acagcaaggtgggaaagtcctgctggaaatttttggagagcacattttttaaaagttgaaagttcatcagcccaagaagaaaaggacacagagagtttgggccgacatatcgcaactccattagcgcgaaatgaattcacgttactctgcctctgaacatggagggccctgtacagaacaaagacatatgcaccatcatgcaaaaaagccacttgaaacatgagggagcatagaggaagtccttgaagaggtcttttccaatttttctcaacccacatattttataggaaagcttaaactctcactaaaacaatggattaaaaaatgagaaaccctccttccagtttcacaatcatttgtctcatcctctcgagagttgctagaaaaaagaaaaaaggacaaaatacgtggcagagctccagcatgaacaaacttgaaaaatcctgcctttgctaggaaaatattcttaaatttcaaacacattccaacctacccgatacaaggtacaaaaagatcattgtcaaaacaaagaaaaccactcacatgccaaagatcatggaacctaaagcaatcaataaagccaggactgattaataagcacagcctacttataaactgactcgtcttttggtttgtgatgcagggagacttaaatttcaaagacctcccgtgtgcttctgaaaattacaaatgagaaatattggagtctatactgctatcaaagtggcaagttagttctccttaaaagctgtacttaaataaccatgcgctgtgtcctttaagaaagccctaggatcatttccccagccagcctcctctgatcccttctgatccgtgtgggtaagtgcactgtacctcctgaccatgctcttggtgggacttttttagcatgaccttgaaatactttgttttactgagtccttgcagtcaaaaggagtctcttggcatcctgaaactcccaagtcaagcataatgtgtattatcaaaaagatgcccaaaaatcctgtggaattaatctttgaaagctaacaacatcaaaataatagtactttaaaatctctttgaagctatcaagaaatggcaaagatgtttcaacatgtgcatcaaccctggtcaattggaacagcctcccagaacactctattaaagagaattcaagagtcagatccattcttgggagaaaacagagtactgatgaatgagtgatgtccgccagtgacctggaattaaggaatgatgcaagtagcctatcggtttgtcattcttgttcttatttatcctcactctctgcacaggttcttacatgaaatcctaaaaagaaaatccactaaaatccaaagagtggtacaatcagcacgccccaacctacttagaatactgtgggcctggagtctaaaaatggaaaccagttcatgtcaaaccaattgttcttcgtggagcacagggaggatattaggaatatgccttcataaagcctgagtcagactggtatcctctaggtgactttcaaaactataggtctggaagcacctctcctatggcatctttgtaaaactgattaactattttcaataagtttttctatcttccccatggaaaattgcaagcgcgctgcatatgtaaaaatataaatgtgtgactcatctcgcctaggaaatgctgacagaaccaggaatgtatgtgtgctcctgactccataaatgtctcccgggccccggttcatcttgacattcccacacgctcccatgccatcgtggacaagcttgcattcataaaattctgaccctgggatgcccctcctcaaggaaaattggaggtcagcacagtgcttgttggctctgagccatgaacttttgacacagcatctgcatttctcggccagtcaagggtttgtatgagagggatcctggctgacgggactgcagaaggcagccatttggaatgcagcatgagctgcaacttctacactccttccggagtggtcagcattgcaatgtgaggatccagtaaattgtctgtgcctatttttttttctttttcagatggagtctcactcttttgcccagctggagtgcagtggcacgaccttggctcactgcaacctccatctcttggattcaagcattctcctgcctcagcctcctgagtagctgggactacaggcatgcaccactatgcacagcaatttttgtatttttagtagagactgggtttcaccatgtttgtcaggctggtctgaaaccctgacttcaagtgatcctcccaccttggcctcccaacgttctgggattacagcgtgagcaccacgcctggcccctattctgaatgtagtgcaggcgacttccactagtgacagggaggatctgtactagccagagatgtgaagtgattcatggcacggggaccctgacactgctatagccctgtggtgttgacaaggcacattggagacaacacaacaccctgcgtgccggtggccagatttacgggctgaactgcttcctctattctgacataatgcactgtgacagagtgacgaagacagcgtttgtgcctgtaaaaccctcatgatcaacaggaaatggagctctctccaagttaagtcctggaagaaatcgcatgccgatgtcatggcagcctctgctgctggggctaagccatctgcaattcagatggaatctgatccgttcggaaacagttacaaagtccaaaaatgggcggccagagcttggctcctgacagagcggggtggagggggcaagggactcagcaaacttggagctgggcaaggatccaatattttttttttccttttgcccagtatctgtccattcctcttaacatggcaaatgaaatcagacttcaacaccagaaccttgatgagccgattactgaaaaaagaatcagttcttcccctgcacgctccatgcacccttcttcctcgtctttccctttctgttacatcccctgcacacgttccttacctgagctgccggtatcgatccacagcaccacagaggaaatcacgaaaagaggacgaagaaagtctgaccacttctaactaaacgtattacaaaagtatgaagattcacaggatatttttggtagaaggttcctaagggtcagttgtatgttgttccaatcaaccagttgagacagaaacattgacttacttgagtagaagtagtcagtatctctccgaacaaagttgatgccagaactctctgctcatgtgagtcatcccaagggctaattctggcctgctgcctgtttttgtaaataaagttttattggcacacggccaacccatccattcacttactgtctacagctgcttttgcactacaacagcagagttgggtattgaaacagagactatatgacccacaaagtataaaatattaattttacgggcctctataaaaacatttgctgattcttgacctagagagtgctttcttggaggtgggggacttgcaatacctgataaagctcctaagaattccaagctctaccatatagcagtcttggcaaacatgtcaggggtatgtgccacatggttataccagactcaaagcaaataaaagacaaagaatagcctctggccgggcgcgatggctcatgcctgtaatgccagcactttgggaggccaaggcggcagatcacgaggtcaggagatcgagaccatcctggctaagacagtgaaaccctgtctctctaaaaatacaaaaaaaatagccgggcatggtggcaggcgcctgtagtcccagctactcggaggctgaggcaggagaatagcgtgaacctgggatgcggagcttgcagtcagctgagatgcaccactgcactccagcctgggtaacagagcaagactccatctcacaaaaaaaaaaaaaaaaaaaaaaaagaatagctctcataacagatggactgcttcaccagtcctatcgttcgcattagttaagctaactccacctgctgtaggagatatgtctcaaagtcacaggggtttacacaatagaagtttatctctcactcctgaaatgccttattgaccagaaggagatgtgcccacgcagtcattcagggatcaagactagtttcatcctgcagccgattccattggctggagtcacaaggccaaatctaacaccaggagagtctagaaaatataatctagtggtgtggcaggagaaaagggagacaggctgaacatttagccccacaactcattctgagatcttaacgaccccatttcttctccccttcctctcttttcatagcatgatggtctttcctattagaaaggcacacataacacctgttcagttttatggataaatacatcatgtatcatccttcccagaaaatatccatcctatccaaggagaatgcaatgctcaacttaagaaagaacaccacggagaagcgtgagaccagatacgaggaggccctggttcctgattctactctcccgccagcttttggccagacacttcctttcttcagcttaggttttcccattcatttcaggataaacaattgagtgtccgtggtctatgtttcagctctttctgattctttgattctatgaaggaattctaatgatggagtttgatgccttggtgggaaaaagatgtttggatgctattctcagtgtcgtctacaaaagcaaaacacaagcccacttccacaagaaactcagactacaggagacccaaataaatacttcacaaaagaaacaaaggaatatattacactgcagccaaaggaaaccacgccccaaagactgcttctcccattgcaaacagttttatatgcaatctgctcagggtaatttattatttcaggcactgttcacaacatcaccacacagaaatcaaaatttgatgaaattgtttagccatcacaggaaggataaagaggggctcagaagggtattcatttgataaataaatatattttagaagagaatattctggtaatcactatttattaatgcaaacttctcgaggtttgcaggattcaaatgcacattttctcctcactaaataagcatacatgtttgaggagccggtctaaaatattaacagtcctcctgcaccagaaatattagtccttccctccttctctcctgctcctgtcaagaagccatagagcatacaatagcagcgcctagctaaccatgtaatgataactccctactctactcactgtgggaatctgtcagttaaagtctaaagatacataccaccactatgaaaatgaactaacacaagtctgtctgcagaccaggaagggcctgaatgcgtcgacatttcactatttaattggttggggccagcttaccagcacacacgtgtattctgcaatggcacgctgtactatgactctttttgacagacttatttagtgaagaggaggtattttttccccagataattgctcaaaatcacgctttcaaagtcaaagtgattcaaacttgccgtctgtattttggaaacacaccagttggaaggaatgcaaattcatgttcctatttcttagcgtgtgtgcacgaaagaggctgtttggggtcgtttctttttattttttttcttcttttctctgagcaatgaaggagaaggaatacaaaccccacggagtttagcccatccccagtgagctcagatgggccaaatcctacagacaacacgtttcacccagcataggtccagagccctagagacagatgttgaaactgagattctgccagtcaaaacactggagccttcaatgttctggagggtctctccagcaggacatacagttgtagcatccaaatcttcaggatgcttgaagagtcttcttgcttttcggggggcacctggcaaagtggacacaggaaggactttgaaattgaccatcttcagtgtaactcagggaaatgacctcactctgttgctcctcgtccttggaacggagctggttgtatctaccgtgcagggatgtagagggcttaaattaagatgctccaagtgggcacaatgtctcacacctgtaatcccagcactttgtgaggccaaggccggtggatcctcgaagtcagcagttcaagaccagcctggccaccccatctctaacaaaaatacaaaaatagctgggcatggtggcatgtgcctttactcccagctacttgggaggctgaggcaggagatcacctgaacccggaaagtggaggttgcagtgagcccagattgtgccactgcatgccacctggatgacagagcaagactccacctaaaaaaaaaaaaaaatgatgcttcatataaactcatcctggatgtgatacgtgctgcatggacagctgcccacattgtccgtgtccctcccactctgccctaaagagatctgctggcgttttccccccccacccagcatttttggttattccgtaaagatcattagatggctcaggcatcagccagcgcagagaaatcctaataagaggcagagttgggagatgtgggcaaagccatttctgatgctaacacagccaggacatcatgggaccacatgcagagtttaggaaagtgctgcagtacaacggtcctcccagctaggacactgttcaacaccaaggcatgggactccacaggaagaactcgaatgaggctcccaggggtctcaaagtatgactgcatgacatacaaaaatgccccatgatgacgcaacacagcgcttcttgcacagatttctacataagccaagaactaaactgtggggccaaccctgtgactttatatactcgatctcaacatttctgaagacaataaaaacggagataccatcacctctacatttaccactgagtccagtcctacaggattacagaaccataatcccttccaagagaggactttcagataaccctatctattcctcctttccagatgatgaaaataagccctgcaaaatacttatcaaaaagtaagaaaggtagtagctaaagtctccttgggagaatggagctgatccgggtccctttcaaggtcaaagttctgattgtgatttgaaatgccatgtggggttcctgcaacttggaataatcagtcatggtattatcattcttaccatcaggatacctacataggatcctggagatggtaaaagaaaacgcttcgtaaaagacaaaataaataaataaactattagtatttaattgagactggattgccaggcagtcaatttaattaactgcggcacaattaattgtgaaattgaggtttgactgtgatgttgtcaattcaagtggtatcgtgtagacttggttacagcaagagaactaaaaccattccaaggacattgttggaataaaattagcagtgcaagtgttactcaaaataaagacatggaaatcctgaaggcaaagagccatctttggcaaactaccttgtttttccatctgtcaaatggagctcacacagccaacttcacagcaaagatttaaaaacagatgcttataaaggtgaaggataggtatgattcagcaaggatttggggtgggagttggggaaaagggggcacacattgactggttgattgatttgagatggagtctcgctctgttgcaaggctgcagtgcagtggtgcaatctcagcttactacaaccttggccttctgagttcaatgattctcctgcctcagcttcccaagcacctggaagtacaggtgcccaccaacacacccgctaattttttgtatttttagtagagatggggtttcaccatgttagccaggatggtctcatctcctgaccttgtgatccacccaccttggcctcccaaagtaatgggattatagacgtagccactgcacccagccacgttgatttattctatatcactacccacacttaccaatcacccctttggataaatgcagtgcagttttcctgctgctttccaagctgagaaggaaaaaccggaccactggggacctttatcttcagcatctcatgcctcaagcatggacggctgcacagctctgagagatgggtactgatcattgtcttagagacatctgagtaacaagatcctttcagagcatcggtagaaactcccatttgactctcctctctgggtggaacctctgtagaaacctcacaggagccttagccatcgctagctgattccagggagtgagggcctttcacctgccttaattcagtcctgagcaaaatcatgcagtggccaccatatctgagcacctcgatggggggcctgtcacgtacgtattccgagacagacataaacttctctcttcttgttgctgctgctatgttaataacagaagcagttttcacttggagccaaaccaatgcctaactaatatgataaaaaaaaactataaaggttagaaggagatgaactaaaacacaggcgttatctctgggagtgggaatggggatggcttgttttacttctgtatgttttccaaatgttctctaataatgtaattctttttgtaacgggggaagccacatgcatgtagcataaaacaagataagacccaatgatattcgagaggaaaatatatacttcctgtgtctgtatagggaaaaaaaaaaaaaaaactgaaattctgagcagggaggacgaaggagacctggccgtaaaggagagcagatgctgtgaaggtcgatgctggtcctcatagcctaaaatgattgcacctgcttcaaggtgtagggagagtaaagtggggagggacatcaaaatgtacctgaggaaataacaagcgctggtgataggtttggatctgtgtccccgccgaaatctcatgttgaattgtaatccccagtgttggagtggggcctggtgggaggtgactgagtcatgaggatgaacccttcataaatgatttagcatatctccttggtgttgtcccagtgagagagttctcatgcgattcggtggttgaaaagtggtagcgcctccccagtcgctctctgttgctcctgctctggcgatgtaagatgtgcctgctcccctttaccttctgccatgattataagtttcctgaggcgcccccagtagcagaagctctatgcttcctgtgcagcctgcagaatcatgagccaattaaacctcttttcttcagccatacccagtctcaggcatttctttatagcagtgccagaatagactgacagagttggtgacgtgtgagaaactggaacccctgcacttcgctggtgggaatgcaacatggtgcagccacttggaaaacggtttgatatttccccaaaaagttaaaaagaattactgcgtgacccagcactccactcctaggtatatacccaacataattaaaaacaggaacccaaatactcatatgcattattcacagcagcatggattcacaagagcaaaaaggtggaaataacccaaatgcccatgatggatgaatgggtcaaccaactgtggtatcaatatacagtggaatactattcagtgaaaaagggaatgaagtactgatacatgccacaatgtgggtcaaccttgaacacatgatgcattgtatgatcccacttaaataaaatatcccaaataggcaaacctactgagacagaaggagaatggtagggaagaggaatgggtagtagctgcttaattggtacagacttttattgtgggagatacaaatattttggaaatagatagatgcggtatttacacaccattgtgaatgtatgctattgaactgtctactttgaaatggttaatcttatattatgtgaatttcacctcaatttttaaaagtaggggaaaacaaaaagcgtccttgaagtttccttgcttttatgtgtgttgctgcttcccagatgggagcttggtgtgaggctgggatgggagtgcatgtttgggatctaggaagggggtccttcaggacggtcacagacttgcaggcaccccctgcaccccctgccctgctgatgatccgagccctctgtcagaacctcctttcctttaagcacttctttcgaggtgagctttcactgttttccttcttctatctcctctcccctttcatttttgtaacaacaaaattttatagcccctcaaagaaaaaggaaattaagcgactcccccagacaaggacacatcagagagggcgtctatggtgggattctaatagggaaaataaagtaaaggacaggcctacgagctcatctccttatagcttgtggtgtgtgctttgcttgcggggcgaggacagaataagagtgccaccccacaaacttctatggtcataacgaataaggcaaatgaacagcatctggggatctcagtcctctggaggatccaaaaggacttctgcttccctgtgggaggccatttaatttaagagctcgaacctctctgacaaacaccatcaggcccagcctttgaagagctctcgggctctcctgtctgaagaagtcttgccaaaataagtggttcaaaacaaacagttgagtaatgatatatagggtaccagagataccacatatgggagtaaagaggaagatattagagctgtaggaaattgcctggaggcatcaaaaaggttcctgtgttgacgtgtgcgtgagcctcgttgaaacctgattgtcccaggccaggggaaagctctctgatgagcttatacatgctagttcaaaaacataaaacgaacaaaaaaagaggtgtcaaatctaagccagttacttccttttgatggccctgagaaaaagaaaagggcatgggaggtggagtgcggcgtgcatactttggtgctatcaaacctctgccctccatgtttgcaactgaaccaggcattaaagacactgacatgtcagcactaagatctgcctcatggaaaaagtattttaaacggtagttgcagtaaaaaacctagagtggggaagatagaagtagtatctggtgagctcctggtgggtctcaggcatttctctttggattattttatttcagcgtcacattaatccaagagatggtcttatcttcgcggtgtggatgttcaggcttggaaacgcaacgccatgcttttcgcagctgcaagatcccagctgagacctagatcaagctatgatggcaaagtgcatgcaactacatcacccctcacgtcttgcttaagcagaaattacttgctcagtcagcctcccaggctgccaccattgcgtgcctgtggctgttagtcacaggcccacgcacatcacatgctccgaatctgagactctgaccaacagccctgagtgctgggagtgagcgaggacctgaggtaccatgagcaaaagcagcttctcggttctcatttcaaaactacgtaagaaataaagatcagaaagaagtaggagtgtttccaagatgctggtaagattaaagtgtgcagggagatttgcaaggaaaaaaactttcattcttcattcatttgttcattctttcatccaagaaataattatccagtgcctactctgtgccggaacggtgcaggatatacgaggatggacaacaaagacgtgagcttgaaattgtcattcgatggaataacaatgccctaatgttgctggagcccagagcggggcgctggctaaacgcacattgaaaggacatggcatctccataaaaagactttgcaaaggtttccaagcaccggcactaaaaggcaggagggtatcaggggatggagggtggcagggcaaagggtggaagaggggtgacatgtggctgctgagaaagctggaagaggtttggtcctaatggcaagggtccttacgttctaggagccagaggtcttgcctgtttcctcccaccctccaagggcctggcagaatttctgaaaggctgaattccatcttgacctcc

SEQ ID NO: 5081 - DNA, 12048 bp, Homo sapiens
ggagacctatgagaaccaacacaacagctaggtgtaagcaggcaagctcatgaatgagctaacagaaatctccaatgcctaggaggccaggccatttctacaatgagtgaagcaggccgatgggtactatggcaaaccacagggcacatgccccagctaaagaggggcagccgctgccaagtccagccaactgtagccaaatgtaaaatgcaggcaaaggatgccagatctgcttttcgagataagcaggaaatcccaattttgatgggatgtctcccaagttttaaatgttcacgctaatttatttcattaaaaaatccaaaacaaacttcagcaggccaaaccaaagacatcacaagccagcaatttgcagcttctaggatatgactgggaaacgaggatggagactccagcactagaaattttcttacttcttacccagggatcggaagggcaaaaacactgaaaataagctgacctccgggaaggcggtggtggcagcagccagggcagctgctgcccaggagtgaagcaaacctctctgaaagccaagaatgagccggggccttcagaatcacagccccacatcttgacctaagttagtcaacaaatgctcactgagggccgactatgtgcttggcactgttccggctctgaaaaagcagcagtgtagaaatccaatgaaattcctgctctgcactttgggagccaaggtgggcagatcacctgaggtcaggagttcgagagcagcctggccaacctggtgaacactgtttctactaaaaaatacaaaaattagctgggtatggtggtaggtgactataatccagctactcaggaggctgacgtaggagaattgtttgaacccaggaggcggaggttgcatgagctgacatcgcgccactgcactccagcttggacaacagagtgagactcctgtctcaaaaaaaaaaaaaaaaaaaaaatccttccctagaggaatgcacttatgtgtcgcatttccggcaaaatgaaaaataagacagttttcagtggttttagcaaaggctgtgatagagggtctcctcttcagctatagtgccactcccttcttggaaactcaaagacgacaaaaacgtgtagtgaaacgggctccatgggcccagtgctccggcattccagaaatgaagagaatggggtttcctgcttgtttttggatgtatccccaacacctagaatggtgcctgcacgtgctaacattgctgaatgaatgtgacaattgagggctaagagatattcccaagagcccggtgcgggggcggagaaataatatcactgaagttggtattggtttttcccacatgaaaagcatttctcttgcttccaaatgtctatgtgatcatagataggtagaatcaggtcttaaggtaaataatataatcatgataattggtctttccctgtgttagcaagcttgggtattcagaaacaagcagggcaaaatctaatagcccactacaaaaaggaagtccaaatggagcaatgtggacttctccaatcatccttccacattttcatctctgcttctcacttaggacaatcccttttctttttttttattgcaatgtgttttaaagtaagtttgccggctgggctcggtggctcacgccttatccctgcactttgggaggctgaggtgggtgaatcacctgaggtcaagagttcaagaccacctgaccaatatggcaaaacctcatctctattgaaaatagaaaaattagccgggcttggggtgggcacctgtaatcccagttacttgggaggctgaggtgcgacaattgcttgaacccggggcgggggtagtttgcagtgagccgagatcatgccacttcactccaggctgggcaaaaagcgaaagtccatctcgaaaaataaaaataaaataaataaaaaatgtgtttgccggtccagggaaaacaaatacaaagcagtgttgtgcaaaatcacacaccggtacgtttggttgactctgtcctaaacacagacagcagtcgtggtgggcacggcaactcaccgcacgccggtcagctgcgattgatttcaagacccatttccattgtagatactttataattgtactctaatgtagttaagatggcactcaagataaatgaatcatctcagatatgggaacagggtgctcctcatacaaattccctgaccgttccccgtgctctgagaccagaagaactctgctcctctcagtcccagttggtgataaaattccctttgccttccttgaaccagatcctgacagccagcagccaagcgttcccaatcgccgactgtctccatgtctctgtgttggattttttcttttttttttttttagaggaggagggaaagtaccctgtttatttccaaactcccttgcatctgagcacgataggctggcatttgctgttaaagcagaaaattataaggagggcctaattgacctcttgcgtctttgaaaaagcctgtctgtggtctctaattgaccctctaggtacctatggacaatgaatgaatcttcaggaaataatggagggcgatgattaatagcccgggcctggctgacctccatctctcacagttcttctccctgttacttcccttcctcccctccatgacactgattccttgcatttcataagcagcgatttattattatcacagaataataaataccctgcgtagacacttttaagaatcggagacatcacgattctgcagagattgtgataacatttattaagctggcattctcatttttcttattggcatggctcagaagagtcctcctctggcattgtgggcaaagtcaaacaagaggcttcttttgcactccttgtgaaatcattccaaatgtgagtcatttggaactgcaggggcttcttacttccagtccaaagggtgaacattgtccctttgccttgctcataagaggactaaagcccttcagacgtacagcaacaacaacaacaataagcaagtagtaaaaaaaaaaaaaaaaagtggcactcctttagtggggaatgtggtactggctgcatatattaccttgatgaatactcacagaagccccgagacatcgatgttgctactgccccattagtcagaagaatacactgaggtgcaaagagaataagtaatttacctaaagcccaaagtccaaagctgcagctctgtatgctatacacatcgccttccaagtattcaacaatactgtgccaaatgtacaatattaaggatatgttttgggaaatgtgagtattagaataaaaagagtacctttccctttcagtttggttgaaaaatgcttcctttccccggacagtatagagaatacatttaaatttagaaatatacacatgcctccaatgaggattctgagaaactagatttttttttttttttttttttttacaaaatcatagcattaactatgagagaaagagaaaagacagagagaaagagagatagagacaaagaggaaaaaatccgtccttccaaacccacctggcccccaccaatgtctccacattcctcgggaccttaaatggcaagggagccagaagtgtctgccaggccctgctggtttatccgggccccttttcttcttactcagtgctttgtggagaacaggccgcctatgcagcaaaattaatgcttgggtaaggcttacagtctttgtgaaggaatggattgtctccagcaccaggtcccacctctgtcttcagaaagcactgggccacattcagagtcaggggctctgggtgggcagtgggcttctgacagataggtgcagcccacggactcagaaatagagaagaagggagctgaggaaccaaatctgcgtgccctgaatggaagctgccttaggccacctctacggtcctattcaactgcagcattttaaaagccaaatgagatgtcctggggatttttttttgtccaaaggcacatatatatttgtgtgtacctgtgtgtgacacccacgtatatgcatggatatgtatcatacaatatatgtacatatatcaaggtcttacctatatctattactgtgcatatatgtgtatatatgtatctatatctatcacttctacaacccatcagccagaactgttttcatatgctaggttttactgtatggagcttaaaaccctttatgcctcaggttgcaattttttgaattttcacgatcagaccttggtgatggctttggcggtaggatataaataattcccacatacttagtgttccaataatggaacactaggcatttactacggggcttataccactgatagtgaaaatcttgacagttcttctcttccctttcatcatgtccacatgcatctggccaccaagtcctccccatccctgctctagtgctactgcttagggcaggccaccttcagcacttttctgcatggtagcaagaagctgataagagggaagggtgccacatggtttagcctgttacccattaccaacttgtactgcactcaaagtatcttggaacaactcagatttgttgcctccctgcttgacggcgtgtttgatgccctcagaaaacacttccactcctcagtagagcatcacagccctctgctgtatgacacccgacctttctaacttttctctctgcaccaagctgtgggagtttgctctcttaaactcccacgttccaacccagccaagctctccgggcagccacacttccctttgccagctgtgaccaccaatactgccccaggggggtctgcaggacctgcagggccacactcattggcacctcggtgacttcacttctctggtcaccctgctgtctctcccaggcctcctccctcacagaccttctagggaaagctctctatcatggtcaactttgagccgtgtatattggccacaggcatccctccttctattgggcgccatactgctcacttattattgcctaaaacctgctcccttgtaggctttctttaagggctctagcggattcttagagatagtagacagctcactggtaaccacagttcaaatgaaaccaaccaattcacagccacaccctcaccactggctttattgggctcgaactccaggcacacccacctaccctaatcaccccatagccatgggtcagacacctaaagacaaccccttgtcccagagcccatggaaatgacccaagccagccaatcctaagcctgcttaccctgccggccccttctttcctgtgaaaatcacaataaaaacattttttaaaaaaatttaagttccgggtacatgtgcaggatgtgcaggtttgttacataggtaaacctgtgccatggtggtttctgcacctatcaacccatcgcctaggtattaagcccaacatccattagctattcttcctatgctctccctcccccaaccccactcctcacaagccccagtgtgtgttgtttccctcccgtgtccatgtgttctcattgttcagctcccacttacaagtgacaccatgcggtatttggtttctgttcctgtgttagtttgctgaggataatagcttccagctcaaaactcttgacagtctccccctctccctctgcctcctgcccaaccctggggctttcccaggtaactccctgtgcatgtggagtccccatggatctgtgagtaacaaaccatctttgcaatagcagtcatttctcatcttggccttaccataccacaataagaataaaacctgttaaaacagagagaacaggggagaaaggaaggagaaaaggaaaatgaatgaagaaggaataaagaatgagtaattaatgaacaaatgataagttacttaaaatctgctttttcttaggaggagaaagaactaacaggatgcagaagtcctcttctactcgggctggggatatgcgtgagaaagacacgcgtggatccgtatgagctctcgttctgaatgcggaaatctgacctcccaccggatactcagttcaggggctcctggaccctccagctgctcctctactcatcgctccctcactcagaaaaccagcgagaagtgaacttcctcaaatgactgacggtaaatatccagcatggagctggattacaaactgtataaactgtaaatagcatcacgctattcccttttaaagaagtgtcagtgcttttttcattaagattcagatgctatggagggggcagatgcgccttctcccctcctggatcccaataaaacaccccgtatggaagcagatggctttgtgtaaatcagatgacagtttacggatgagacggcctcatcggaacggcattacaagtatcatcttttgaggggaaatggggttatcaagtccagctttaattggaggtcacatttgcatgtgaaattctgggtccctgtaaggctgcctgggtccctgggtcatcaggccagtaacctctccaccattttctttccagaggggccccaggtaatgcatgagaaaggaagtgttataagaagccaagaatgggtgccccccacccccaaccaagagccagttctgttaacacagcagagagccctccccaggtctcaaagttccctgcctttgctgccacaggtaagagggggtggttttgctcactgcaaaccacataaagaaacaacacctgcttgggcacttaaccctggaacgggaaagctgaaagtggtttctgttattttgatctcgagcgtaaaatgaagagcaatcatgtccctggagtctcggcagaggcaaacaaagctgatggaggaagacaaagtctgctttttcaggatgcttcatgggaggctgggtgttaagcgctcctcagcctgcctgtgtgatctgagaaacggggcgggggcaggtgggcgggggcagtggcatcaggtgcctgcctcccgccgagggtattcaccattcaaagcaaggcgcgaagagcaaacagctaccagacagaatcctttaggtctaggctattcctttccttgaaccagagacaggaacagaacaccttagcccagcctccctgcaacattccaacactgaattgtaggatgggagtcccaatttcccagacatcagggcaatattctcccatttcctacaacactgggtcaatgtaaaggttaaaaatttaaataaatataaataaataggagatcacatcctcctttcttgggaaaattcagacaatgctacacaaaagtttggaagacgagattctaaagatcacccagaaaaaagatataggagcatgctgttttcattaggtttcttcaaaatcagtggtatgatttcacagtattttgtttcatggaatatattcacgatatttgtttatggaataaattcatgatatttgtttcatggaatatactggatatctgtttcatggaattattcacgatatttgtttcacacaatatattcatgatatttgtttcatggaatatattccgatacttgtttcatggaatatattaggtatttgtttcactgaatatattgactgttaccagaatcctaacatgcaatgtctttcttcaaaagacagtgtcatgcattccttacagtgatttatcaattaatgctgagtccccagccaagtgataagtcataccatctctcttactcttttttcttaatccttaaaaaaaaaattaggtccgccctcagcctttatattccaattctcattccacactcctgactttttcccaagttattcaaggatggaaaagcgtatcatctcaagctagctctttcccgccttcccatccaaccaccccactctgctgccatccccagcacgcccaggagtaagatatttgacaagaattgtcagggttaacaagaactcccaaagcaagactttgagttatgtcagacaaaaatgaaaattcaaaagaggagcattcatccatagtagaaatatcatgttctaaaaccatgaaaatcaaaaaagaaaatgatttttgaaattatgtccccagacaaacaagtgctcttgaccagaggccagcaaactacaacccacaagctaaatcagtctaccacctgtttttctaaataaagttttattgtcacacaaccatgcccattggttatagattatctatgtgctttcactaatgcatgatagcttagtagttgtgataggtacctgtaggccacaaagcagaaaatatttatcatgtgaacctttgcaaagtttgcagatgctgtctagactcaaaattcatttcagtgtctctcaaataattgggtttgctttgttactctggtataaatggaatgatccagtgagaacttttaatgacaatagtaaggaattattaatttggtttagtgaagaagagaatgttaaagaaccaaagaaatttttaaagattcacagccacctttttgaaataaagattaaatccctaccaggtaacttcattcaaccatgaacatttatgaatgtgtattgcgtgttttcaacctaggcatttcccttcattgttgcgggggtgggatggaattttcagtcctcctctcctgacttttcttttttttctttcttttttctcagtcaatctgtccttgtttattttatctggctaaataaaaaatcctttaaagattccccaattctatggggttcctgccctacatacaccatacaaatgtttgttacaggtatttggatatctcgatcatctaagacgttcatcttacccttaggcttcatatctaaactgtaggattaagccttcagaatgtacttgattcctataatatgtagtgattttgctaatgttgttcagttttgttccttgcccagaatgatttccattagctcgcttgcagattagcagcctaatctcctaaaagagctcttcgatcaaatggtctggagtggccacatgtcttgctgctgccaagtgactatttaagagatggacaaaaaggagacacacagaagtcgagatagcatgattaatggtcgtccaactttctctgaaccgcatatcatgactgaatgggaaaccctgaagagattaaagggggaattacattaccatgaataatataaaaaagtgatattctgtctaaaaaccttttgatgcaagtgactcgaacaaatatattaacagagcttacagcagattcaatcaggttgaacctccccagaatttattttgaaataagctttatatatctgagacgtgaagaatgaatctatcgtggctggcaggaaagctattaacatgcagattttaattctgcctttgattctacagggttctattgtccctcctttacgaccggcaatctctcccaattacggatgtagtacaccccacaaatctcaataccacagtgacactctagagagctgagatttattttcctcactttttctaacttctaaaaataagttcaaatatttattatcaaggcaccgataaaagtatgattttaaaagcatgaattatattacaccaacccatccatctgttggaaatgccagtttgggctatatttggggggcaaaacttggcagttaagatagaaaccttctttacaaaaactagggcacattaacttacaattaagccttgatgttaatgaggttacagcatgtgaccagttaagggctgcagccaaaaggcaaatattgaaatgaaggcgtttattttcaaaccaacaaaccgaactaaaccattacactaagtcccattagcattctagttattgggcaaaataatttcactccaaaattaattaaataaattggaatgacctggaatcacttctgtggcaggcggatgaacaatactgcatgaaaggcaaaatcatttagagtcaaccggcccatcagttccttgaggatgatgtttaaattgatgggaagtgaaagttaaaaatatgattcatccaatgaggcaggatgtactgttaaaatgtttgcaaaacaattttaaaaataaaccttacttaaaaaaatgctccccctaaattcagggataggatgtctttagattaaaataatatgttaacatgttcacacttagaaaattcggattctgctctgcgtgagtcacatttattttctaagcaatctggtttttttttttctttaggaacaaaaattaataaaatacatgactgttgaatgcaattaagggatccaagggctactgccaagtttttgaagagaatcaacagcagagtcttagctcaatcatatccacatcagtactacggattaaatgtttgcgtcctcgcaaaattcgtatgttgatttttttttttttttttttttttttgagacagtcttgctctgtcacccaggctggagtcagtggtgtgatctcagctcactgcaacctccacctcctgggttcaagtgattctcctgctcagcctctggagtacctgagattacaggcattcaccaccacacccggctaatttttaaatgtttttagaaaagacggggtttcaccacattggccaggctggtctcgaactcctgactcaagtgatctgcccatctcagcctcccaaagtgctgggattacaggtgtgagccacccgcccagccatatgttgaaatttaatcaccaatataatatattaggaggtagggcctttggaggtgattaggtcattgaggcaaagccttcatgaatgggttaagggcttaaaagaggcagatagagagaccctttgcccctcccccgatatgaggacatagcaaggaggtgaacattaggaaccagaaagtgggccgttgccaaacactcaatctgccagcagcttgatcttggattcccagcctcaagaactatgagaaatagatttcaggtgtttataagccacctagtttagatattttgttatagtagccaggacagactaaagcacaaggctttctggatggcctaataatgagaagtagaatcacttgtaactaatacagtgtctagagcacagtcaacactaggcaatgccagcaatcacacttcaccacagggtcattgaaacctggcatttgggtgcatgcttgtcgtttgtgagctatgtgaccttagatacacatctaacctctctgtccctcattttttcatctgtaaattggggatactaatagtgtcccctctagtagaattgtattaatttgaagagctgatgtacacaaagcatttgttatagtgtctccgatgtaaaggctcaatcaatgtcatctcaccctatccccgtgggttgaaactggcagacattccaacaggcctggtagttgttttttttttttttttctgagacaaggtctcacactctcccaggctggagtgcagtggctgatcttggctcactgcagctttgacctcccaggctcaagcaaccctcgaacctcagcccccaagtagctgggaccacaggcatgcactaccatgcccagctaattttttctatttttgtagaggtagggtttcaccatgttgcccagactgatctgaaacccctgggctcaagtgaccacccgcctcagcctcccaaagtgctaagattacgggcatgagccaccgggcctggccaggtctggtagttcttaacaactactgttgtgcccaggttttctaggctctctctggtacacacgtcagtaacttatctctttagatggagctttctcaaagtgtggttcatggacaacagtaccagaagaacctgatgcacttcttaaacacactgattcctagaccccatcctgatgtactaactcagaatctttagggagtgggactaggaatttatattttaaaaataagttctagctgagtctcaggtatccagaagttttgagaattaattatttcaacaaacaatataacaatggaatcgtaaataatcttttcttgggcaaggtaattgcaatcccacaatatgagtgtaattaacaaagtgatgaaactctgggtccagtattcttttgaacaatctcttgccccactttctagtt

SEQ ID NO: 5082 - DNA, 12212 bp, Homo sapiens
tgtcctccacttaatgaagtggactgtcaaactgatttgctatttttttgttttaatcatctagccaggcagatcagacactcgagaattagagaaatactaatttggactagacactgaaatgtcttatatactgggagcatcataaagctagagaaggcttacaaagcaagatggtgccactgagatcagcacactggggtttttaacagaaacctattacttgatttactggggtggtagaaccctaaagaagcggtgaacatccaacactgaaatttgagctggctcttcccagaaaggtttcagcggcttaatctcatgcaatcttgcaacattcctgaattcaaaccctgaagtagagagtcagcccgagaccctcttcagaatccaccgagtctgctgggcaggaaagctagcttgttgagttgtcctgctgcaaatgaaatagtaactttctcagaagcataggtattgaaagattcctttaagaggccaagtcctcaaaggcatgtatgcaacgtgaagtcagggggcaggccttcctggttccaatgcatgttttcacagggttgtgtctctatgcttgaggggagctcttgggcctatctgagggatcatttaccacttgctgtaggaaagtccagtgaaatcacttctagtggtgagtcttggccaaatatactcctatgtagaaggcctgtgtagaggttatgcttggaacagttgagtagatgttctggcaacctgtgatggccttactaagtatgacagtcagccaaaaaaaaaaaaaaaaaaaaaaagaaaaaaatcttctggtcacagaacagttgaaggtgtttcaatttttgtccactacccattgccaacatgtctttaagtcactgccatcagaatctgtagtggagaccatccagacatcttttgccatgaataacatcaagtcttcctgtataccaggcgctgcagtgagccctggccaggcaccacatcaggctcagacagtccataattttttgaaatcgacccagttggaggtagcagaaccaggactgcattccagggagcgggacttgacagctttagcaactgcgtctgctttccctccgctcctagcctctactcacccaagatcatgtctgttcaggatgcagctctctattcaactccccaactcaggcctcctttcctggcggctcaaatggaagcttttttttttttttttgagacagagtctcgtctgtcgcccatgctagagtgcagcggcgccatctcagctcactgcaaccttcacctccgggttcaagcgattctcctgcctcagccactcgagtagctgggattacagacgtgtgccccatgcccagctattttttttttaaataattttagtagagacagggttggtcaggctggttcaaactcctgaccttgtgatccgcccaccccggcctcccaaagtgctgggattacagcatgagccaccgtgctcagccagaacctttctttaacttgattactgtgggtagttacaattttcaatggccactagaatgaagtcttcagagacactaggacctgacctgtgattgccctcgctatactcccagggactaagcacatggcctggcaaaaaaacatagccttccaaaatctcgttttattttactattttatttactttttgaggcagggtctctctgttgcccagctggagtacagtggtacaataacagctctctgcagccttgaacttccggcctcaagcaacgtcctcctcagtctcccaagtagctgggatgacaggcatgcaacatcatgcccagctggttttaaaaaatattttatagagatgaggtgtcagtatgttccccaggctagcctccaatcctagccccaattaatcctcccacctcagcctccaaaagtgctgggattacaaggtatagccactgtgcctggccctccaagtatttaaaatgaatggatatctcccaaagactaagtgtaaatggctgaacaacttacattcttaccacatctgctagatggtaaatatttgtgcgctatttaaaagaaaaaaaaaatcagcataaggagatagtcaacttgaagggtgatgacagatctctgataataggagctagtcccttcttaattccaattaggagctacacgttggtattagtgacattcaaacctctatctaaaacaaatttttaaactttttttatcaagcatattacatgcagaaaagcacatacataataagtgcacgactcaaatttttcacaaactgaaacgcatggaaccaagacccagatggaggaagagaaaaaggactagcatttaaagaaggctctgggctgggtgtggtgacttacacccgtaatctcagtacttcaggaggccaaagcagaggactgcttgaggccaggagctccagaccagcctgggcagcatagcaagacctcatcttacagaaacacaaagattagccaggcatggtgaaatatacctgtggtcccagatacaaagaggtcaacatgggaggactgcttgagccctggaggccaagcctgcactgagctgagatacaccactacactccagcctgagcaagagagcgagaccctgtctcaaaaaaattaaaaaaaataaataaaaggggcctctgcatgtgaagtaagtgttgatgcttcaaaaaccaccaaatggcagcttcggaaggcaaagaaagagaaacgcagggagtggttggggacactgcctgctatggttttgagcactggctgcaagcaaatgtgaggtaagcaaaaggatgagaaagacgtgagcatttactgaattcctaccatgtgccctaaggtattttagttaattatttttaaacaaagaaattgaggcttagagtgattaatgcacttgttcaaggccacagatgccaggctgtgtgacaccacagcccctttatcccccactgtaattcactgtctcatctctcagcctgcatttctttcctttaactcccttctttaaaaaaagatggctattttcataataatgacttagtaatagctttaattataactttgttgagtcctcagtctgcaacaagtgttttcccacattatttccttatgcccatctttcttatgagaaaactgagacttggagaaattaagtaacttttctgagctctcatagagatctcagtaatagcagagctgggatttgaatccaggagcctggttctatgggttgcactgttagacatcgtctctaaaagtacatgcaattataacagaattcctttataattccgttcctctaattcctcattagaagtggaaatgaacgtctacgtacttcaaacactggttagaagggttgacagaaattttgtgccctagactagagattctctccagttggcccttgttgagtggcatctgagagggtctgcaaggccacagccaagtctccctagggcatggctggaagaaaataggttgaggggccagaaaggaggggcccaggtagggcctgggggctcacacctgtaatcccagcgctttgggaggccaaggtgggcggatacttgaggccaggagtttgagaccagcctggccaatatggtgaaacccctctctactaaaaagatacaaaaaattaggtgggtatggtggtgcctgcctgtagtcccagctgcttggaggctgaggcaggagaattgcttgaacccagaaggcagaggttgcagtgagctgagattgactactgcactccagcctgagcaacctggtaatagccatttctctagagcctgtcacctgtgcatttcctagtaagcctcaatttaggatttagattgtcaccacagctccagagtcaccaagcgtgaactggctccttggagatcttgtcacctgtgtctcacaggactcatttctaccacccaggtgcagaagcactggaaactgtggtggacacaagcttcatcgaagcctgtccaaccattcagttatcaccctggtgctttgcaaacatcattacaaggctttaatccagcatcgagactcaagttcacccagtccctctcctgccactgtgacatggttattcagcagttcagcagtgcatacaggttataagaataaggacgaagccatggggggaaaaatccccctctttctgtcttaggacagcagcgggggtttttacccctgattgcctcattaaaaaaaaaaaaaaacaaccttcacgaaagttgggaattactatattcaatgtagaatgccatttgtcattcatttgatattcaacaagtatttactgaattgcttctatgagctataggggataattaaaaacttgttttacctcgagaaattaatttccccagaagaattaaccataagcagatctatgagaccctggctattgggacacttaagactctggtggttgtggtaaaccagaataggcggacagtttcagatttaaaggaattgattagattaggccgggcatggtggctcatcctataatcctagcactttgggaagctgaggtgggcagactgcctaagctcaggagttcagacaaccctgggcaacacggtgaaaacccgtctctactaaaatacaaaaatttagctggcatggtggcatgcacctgtaatcccagctacttgggagactgaggcaggagaattgctgaacccaggaggcagaggttgccgtgaggcaagatcgcaccaccgcactccagcctgggaacagagtgagattccgtctccaaaaaagaaaaaaagaactgattacattggtaggggtagaagagagacaaggggagaagaggaggaagaattacatatttaaaagatcagtgagggtttttgttttttttttaatctgacacagaaaaaatgagctctgaatcttgaatcaagacttgtatcaattccggttatccccatgatggcaggtcattcaagcttggaccttagtcttccatctacaaaatgggaaggtcaggggagatgtcctttaatggaccttgtgattctaaatttgaaaaacttatgattcctagaatgaaaagaagtaatgtgtgtctatacatttatttgtcaaagaaactgggtcattgtcatcaagcaaaacagaaaccagagtcctgaatgtgtacaacagaatcttgaggaagcagattacctgccatccaggatcttagggttaggagatggaagcaatttcccccttcctgtttgaggattgagtcatgccctgtcagagcacttaggccggccttacacatggacaggtgacagaccaatactttgatcaatgatttgtagttgatggagaagtcccctggaggactggaagacagatcagtggagagactttgatctgtgtcattcgcttccaaaacctttaagctcacataaacatagactcccaaggcactgacgtcaatgataatcccatgttctccaaatgtgctggcccctcagttatttgggaaaaaagagcccatgataaaagggagataaacatacacacacaaacttactccaaagcaaatgctgagtcttctcctgctggcttttggctctgctaagaggctatctgggggcaagacttattgttgtttagaactagaaatctacaactcagcagctcttgctcatctaaatcagagtgggcgatgcactgaagtaggccaccactccccacgtccacaaaaataccgcagaatcagtaacccatcatgaaccctttcccaacgagcccatgcgcagtgtcaaaatccttttcaacacagcacttcaatggctgtttcaattgaccagacttgggtcatgaaatgaatcctattttacatccttcatcaaattgttaccggatgagctgggagggagggctgtgtgcacttcttgcgtataaacttggttggtgactgtagtccaggcaattgccaaataagaatagaatccataaaaaccattttagtaggaaagacaggttgcagtctggatgcttggaaaagtaggcactttctgactgaagtaatcacaaccaactctcggactttccttgatccccttctaacccctaagtgtttcattccagcagggtgacaggatagagatctgcttcagggaggcttggaccccacccaccataggtccacagaacatgaataagtcagctgatggttgactaaaacgtatatacaattttaatacatatactagtgtatttaaaatttcattctaaactaatgtaatcaaaactaatgtaaaaaacatacagtggttatctctgaatgataggactacaggtgatttttattttcttccttaaaactttggcctttgtgactttttacagatcgcatgcatgtgtgtgtgtgtctgtgtgacatgggtgtgtatggacgtttgcacgcaggtgtgttttaatggaaaaaggggggaaaatgcaaatttctaagggatgcaaagacatattaaaaatccatgagacaatgagatagcataggactagaagagctgcaggtctttcctctcctgccagattattaatggtcattatttggggttaggggcatgtgaattttagacatatatagtgagccagagcctatgaatggctcacagcattggttccaacgttcccttcctctcttcaatctcagagtgactcttgctaaactttggacagatagtaacagaatttgtctaattatacagaatgggtgaaaatctttctatgtcctgtaactattggctcagtcacctgatttaatggtcctggaattcattttttatgacttattaatgtgaaattcacataccatatgatttaaccattgtaaatatacagtttgatgtagttagtatatttatccagttgtgcagccatcaccacagtcttgtcctagaacattttttgaccccccaaaattgccccaccctttccaggtaatcccctccactcactcccagcccaggcaaccatcattctgtttgctgtctatagagtttcatcttttctagaaatttcatataatgtcatcatatactatgtggtcttttatgaccggcttccttcacttagcgtaatgttttgaagttcatctatgttattaaaggtatccagagttagttccttttcattgctgagtatattccattgtgtcgatagactacatttgtttctccattccccagctaatggacatttggtatttccggcgtttggctatcatggatgatgctgctatgaacattcatgaacaagacttgtataagcatttattttctttccagtaggttcttaggaagggaactgctgagccacattgtgtgtgtttaactttttaaggcactggacaactgtttccaaattcattgtaccatttacattcccaccagcagtgaatgacagttctagttcttccacattttcacaactcttgggtaataaatctttttggttagagctaagctagtaggcatgtcatggtctggggctagaatcattttacagtggcagcgatgaggtcagaaaaggcctcagattggcagtataaaaattattccgcaatttacagctcacagctcaccagttgtaggactttaagaaactcacttaattgccaggcatggtggcaggcacctgaaatcccagctactcgtgaggctgaggtgggagacctcttgaacctgggatgttgtagttgcagtgaactgagattgcaccaaggcactccagctgggtgaaagagcaaagctccgtcttaaaaaaaaacaaaaacacacacacaaaaaaacaaacacacacacatacacacacacacacacacacacacaaaatcatttaacttctctgagctcagattccccatctgtcaattggaaactataatagctctagattatgaagagtcaccgttgaggtaagatgtgtaaaagattgtgcctaagttcccatttatttctggaacaaaaatatattgataaatatgtacataaaatagaaagggatatgaaaatagacggcgttggtatcttttcttctgttaaccaagccaagatgttcactccattttcctttgcacctaaacttctgcactcccccactcaccagtgtgccatgaagatgagttgcagttttgtctgtctcatctctccacttttcttgtcattgacccaccccttctcatcattaaccacttttagtgagctagaacataacagaaggcgcccttctccaattgtgaatacttcctcaagccttctccttcacaaagtcaagaaggactagacccagcctgcaataggagcgtttatgacaaatcacaaattgaaaccctttggctatcatatttatgcagctggtggcaagggttcatatttgaagctcagaccaaagaaagagtttgctcctcagccctgatgctgcaggcttggcttctgagtgtgtcacctactgaccctactatttaaagaaaaactggaaaggccagtaatttggatatggcctagctcaagatacattacagactgtccccaattccctggatagcccgtggctggaaaagtgcattcctggtttattgccaatgtccttgatttgcgtgctctgccatttacttagacaatcaggctacgttgcaagccagggcaacaaaaacaccgccaggagccaaacaggctccaggggatgcaccagtgccttggtggccctgaacacttaagtgattttgttccccttccatttcgtgtggtacattagcttttatcgatagctcatagcttcagcaactgttcttcgtttactaacctgaaggacagaggaacaagaggtacccacacagctgatatgcaagaaaaaaaaatagcacgggatgtcttgatcagtctcaatgatttcttcccttgctacagctctccttaatgagggagtcacaattattgcaagttaatcatgtctcagtcccccagagggagaagagtgaaatgaccacttgaaatctgaccgtggctccctccaagaaaatcctggtggcacgcgaggcattcatgaaactgcgggctctgatttatatcactgctatggagactggcagaggattcttcggtgttttcataatacaactactaaacaaaagttagcccaggagctagatggaaatctatgttatggaagagaaagagatcaattttttcattgctctaaaaaacttaaatttccaactagaatctgcaccttggagcaatgcagtgagtctatgactcacggatgcttgaatgctgtaactgcttccctttctgcgtagtatgtgatcacctacggtttttaaaaacattattgttaaaaccaaaacaatcacagatatgatttgttgagtaactatcacaaaggcagacacaattcttgtttattctttgagacggagtttcactcatcgcccaggctggagtcggtggtgcaatctggctcactgcaaactctgccttccgagttcaagtgattctcctgctccgtctcctgagtagctgggattacaggcacttgccaccaagcatggctaatttttgttttttagtagagatggggtttcaccatgttggccaggctggtgtcgaactcctgacctcggtgatccacccacctcagcctcccaaagtgctgggattacaggcttgagccacactgccctggccggccacacacaattccttgcactttacctaccttgcctcaattcattctcacgcaatctaaggaattataaatttgtattgctattttgtggcaaaggaaactgaggttcaggagcatttgaaattgtcaaaagcctcagcaaggaagagaaagagccatgatgtgaatcaagtccactggagtgtaaagatttatctatggtgttgacctctatctgcccttcacctgcgtacttcttttaaggaaatcagtcatttaataagtcttgcaagttgtcttacattattatgagattggcaaggaataacagagaaagtgaagaagggaaaaaaataaaggaagagagaagtcaaggaaaaaaaactgatcgcatcctaaatcattctcttaaacatatccatcgcaaaacatacaacctttagcactttaaaatgtacggagtttattttacatattaacatatgaatatgttaataagggtgtttaacatattaaagcattaactttaaaaaatggaatttgaagccaggcgcggtggctcacgcctgtaatcccagcactttgggaggccaagatgggtggtcacttgaggtcaggagttcaagaccagcctggccaacatggtaaaaccccaactctacaaaaatacaaaaattagccaggtgtggtggtgcacgcctgtggtcccagctactcgggggctgaagcaggagaatcgcttgaacccgggaggtggatgttgcagtgagccgagttcacccactgcactccagcctgggcaatagagtgagactgtctcaaaaaaaaaaaaaaaaaaaaaaggagttggagaaaaatagccacacagcctgtttttaattaccaaagatccattgttatctgtgatgtgtcagaccctgtgctaacagggaatctcagagctgggcccaatgggactcaacagacacagccagaatcacatcatggaggttatgtgcagccctgtttcaaaaagcaaatccagggctgggtgcagtggctcatgcctataatcccagcattttgggaggccaagcaggcggatctcctgatcccaggagtgtaagatcagccttggcaacatggagaaaccttcctctacaaaaaaatacaaaacttagctgggtgtggtggcatgcgcctgtggtcccatcactcaggaggctgaggtgggaggatggcttgagccccaggagatcgaggctgcagtgaacatgactgcaccactgcactccagcctgggcaacagagcaagattctgtctcaaaaaaaaaaaaatctgtaaagtaaaaaagggctccattctgtattatcttcagatatccaacatcaaaatttataaaataattcctgatgaattaaccatagatttactgtatgaccccgtaatccactcccaggtaggtggttaggtaggtagtttggcttgatataaatacatatccctaaaactggaaataggtgttccaacaaaaacttacacagaaatgttcagagcagctttatttcaatagtcaaagggtaaaaacaacacaaatgcccatcaacagatgaaaggagaaaaatattggtatatccatacaatgcaatgatattcagccacacaaagagagatggacatgctacactgtggctgaacctcaaaaacacgacgctaagtggaggaggccaatcacaaaagaccaatattgtacaatagcatttataggatgtggacatagttttttgagagccatcattccaatcactatgcctgtgatagtttgtttatgaagcaatagaaaactagtacagtgaccacccttaatttattcatttgtttgttttgccggttcaacagatacccactgagcacttgctgttgcgaggcactatgctgggctccagaaacactgagtaaataagagacttcgtgcctgccgaatacagcttatggttgggagattcactcttaggcccttctcacaaagggagccacaagccgaaagatcacgaggactactgatggttttgagctgtgacactaaatcagcagggacagtggtccattggtgactctctgatgaaagacaagtaccctcttcccaggtacaaatggatataatgctgcatattatttcagaagattctaagatactcagggtccattcatcaaggccatagttaagaacacttggcctagagatttttgagatgactctgaaaaagaaatatacaagtagagaatgtactgcgagtgtctgctcattgtttccaagttaaaacttacttggctgctgggagtggtggctcacgcctgtaatcctagcactttgggaggccaaggcgggtggacacctgaggtcaggagtttgagaccagtctggccaacatggtgaaaccccatctctattaaaatacaaaaattagccaggcttggtggtggcgcctgtaatcccacctacttgggag

SEQ ID NO: 5083 - DNA, 12544 bp, Homo sapiens
aaaggaaagtatctaaactaacccaaacaatcttgaaataaagaacaaagtttgaatcctattattacctagcttccaggcaatcgagcagtaagtataagaaaaaaaattagatcaaggagtacaacagtctagaaatacacccacacatatatagtcaactgatttttgacaaagtgccaaggaaattgaatagcgcgaggattagtctttgaacaaatagtgctagaacaattgagagtcttatggagagaaaaataaacctctaccattacctcacaccatatacaaaaataatttgagatggaacatagatctgaatgtaaagattgaagttatggagtgtctagaagaaacataggaaaatatttttgtgacctggtgattggtaaaggttcttagaacaagaaagcctaaacaaatgaaaaagataaattggacactatcagtatttataacttctgcttttcaaagataccattaaggaataaatagacaagacaaaggagaaaattcacagtacatatgaaaaaaaagaatgtatccaaaatatatatagaattcctataattcaatattaaaaagactattaatttttagaaaatggccaatacataaacaagcagttcacagaaagaaaatatatgaaggccaatgagttcataaaaagaggcattagtcactaggaaaatgcaaaataaaactagcagagatagcgtttctcacccacaaaaaggctataattaaaaagactgaaattacaaagtctgatgaggatgtgaagcaacataaactcttacacacttctagcgaggggttaaaatgaacaattactttagacaactgtttggcagcattcttacaagttaaacactaagagtcaatatttcacacctaggtatttatcaaaaatacataaaaacataagggcataaaaacatgtaacaggatttatgaatattcgtggtagctttattcataatagccaacaaatataaacaaccaatgctcatcaacaggtgcacagataagcgaattgtggtgtattttcaccacaggatatatccagcattgaaaaagagaacccctaatacacccatcaacatggatgaatcacaaaacattatgtgaatcattaagcagaagacgacacatacaaagcagtaggtatgatttctataaatgaagttctagaacaggtaaaacaaagttacaatgattgaaacaagaatgcttgttctgggaataaaaggatttattggaaaggagaatgagatacttaccgacgtgatgggaatttcttgtttttgtttttttggtttttttttttttttttttttttttttttaaagacagttcactgtcacccaggctagagtgcagcagtgccatcttggctcactgcaacctctgcctccaggcgatactcaagcctcagccaccagagtagctacggttacaggcatatgtcacaaggccagctatttttttctttttttttttcttttttttgtatttttagtggaggcggggttcaccctgttgcccagactgatctcaaactcctggcctcaagtggtccaccctcctcagctcccaacatgctgcgattacaagcatgatccactgaacctggccctggaatgttctattcttaactggggtggtggatccatgattatgtacacgtatacatttttcaaaatccagaaactgtatatttaaaatatgctaattttatagaacataaattatgtaaattatgtctcataatatatgtatatgtatgcatatacattttctctctctctcacacacacacacacttcgtgaagagaattattccacaggcccaattttatattagtaaaacagaccttacttttgatgctacaatccaatcgacaaaaatgcttgaaaaggttaagattatttatgaaaatgtttctaattactatctgagtacatcaagctttgtggaaagagagtaggcttcagtgtcatattcccaggtcattatgatgcgtttgcttctcattagctatgtgaccttatgcaagttaatatcagcctcagacggtttttgacggaaggggtaggggaagcaacgctggcctcacaagttgcggtgtggcttcagtgtgctaacggatgtagaatacacgattcagggccccaggtttgttattaccatcagtggtcccagcccgtttttgataactttgtaaacaccaagtggtttgggaagccagtcattctacaatccttttcccaaatttttgtctctgaaaatgactaagcaatttacaaaaacaattggaaacaacttggtgactttttttttttttcaaatgggtaaggcattccggatataattatgtttaaaacatgattcagcacactttatttcttctgaagttttctatttccttcttttataaaacctactatttctatcttatttttaaagatcaattgctgcatgttttcagagccctttcagaaatatctttggttattactcatctgtgaaaaggaatttaaacaaagtttgagaactgttcatttctcaaaaaagacagtggaattgagtatcgtttcctgggatgttaagtcagcgtcaagaccaaattcatgagattgttttccaaagagagacaggagtaatacgaaagaatgactgaggtttcatgaactgtatcagcttcctggcagagagcactcgactttatatagtcggatactgtgagtcagttgacattgttcttaagaaacttgtttttgttagcatctcagaatttgccagagccatattacatttaagtcttgcgtcctcaatcaatttgaccaatgaactttttgaagatcaatgggcaagataatagtagtagaggaaaacaccaatgatagttatttctcatttggggtcagcattgccaagctgctcaggtttccatggcatcatttccaaaccctcctattaaattctaaaggagaatagatctttgctgtggacagtgtaaatttgacaacaaatacagggttgatagactggtggaatagaaaaaacaagaagctacgggatggaagctaggccatcgtcaccactgccatggggcagaacagaagaagcatgatgttttgaccccacagaggagacaacactcaaatcctcttcagtgaacgctgtgtttctagggtactgggaatgagaaaggaagatgttgtatgcacagaaacttaagtattttcttaatgcataattaagaaaagaaaagaaacccacagaaaagtgaggcaaaccactgataaacaggcaggttctatttctgttaactgggtaagcccagattctttaaaagtattttaaagccgttgatgctatcaactttgaaatgtggtttgaaaaagcggatattacatttagcatatgcctaataactgccctcaccatggaaacattgaaggcagaaaccattgttttgttttcctaatcgtactaccaagataagacatagagttctcgtaaaccggtgcccgcggcatgatgggatctccagcttctgtacacctagttgtggaggtggatcctgggtggaccattggaactatcgtaataagaattagtcccgtcatcagataatttctgattgaaaatccgagaactgagttatgcacagtgctcagttagtcactgtttttctcataatagccgcatgtggaaaactgaagccggtcttggggtctcaaggtcaacttcatatgataaacatcttaaggcatgattttagtcccgtcttctttcccaatcttgtttaattgcaacgtggccttcatgctattctctctattgtttccacagcctctctccaccttgagacacacacaagcaggtgggtaggtataagtaccaccttgctccctcgacacattaatcaatttgtttcatggaaaaaaaagaagacaaccatctccagttgaaaattagaatcaggctggattacagctgcagaatgaactaggtagagcagaaagccaaactcaagcctgtgtttccaaccagtagagaggtgactacaaacaataatttagacaaaaaatagtctaggactttatgatctacatgcttagcatcactgaacattactaactttgaagttcaatattatacttggaggtgtatcctttgtgtgctggagagaagcaaagaaccaggcttgagtctaaaatattcccattaacccaatacacaacaattagatgtgtgtgtatgtgttgtataactctttaaaactaaacgatcaaggtaactatggaaataaaagtgaacattaacaattgccacagtacacttgcctgtagctccgctattcaggaggctgaggtgggaggattgcttgagcccaggaggtcaaggctgcagtggccatgactacactattgcactccttcctgggcaagaaagcaagaccctgtctcaaaattaataataataataataataataataataaaagcctcaataaaagacattactctatggaatcagggatacctggtactcaaatacatcacagacacaatatctgctcagctggtaacaatctgtcaaggaaaatattgcatatcaactcaaaagatgcatctagaaaatcttgtgtctagcttgctagaaaacaaaagatactgtgtgagtgtgatttcctcttacctctgtgaacaaaagtgtgatcgatgaaggtgagaggggcagggaaagacagagaaaggcacgtaatgatgacagacattttctggaacaaggggaagctaatgagttcacagaagtgctagaagggccctggaaaataccagggaacctcagacaaaagagtctcccaggcaaggaagaaaacaaaatacatgaaatattggctgcaacatttaagcaaaaattaaaatggcagccatgtgggcgaagtggaaggagctgagtctgagagaggagtgggtggaggaggaagtgtcttaggcaggacctcacccttctctatttcaggcacttgttctagcctggagatggtttcctaagtagaacagaaaaataaaagaaaagagaagtcaatccaaactatttaaacataaagaaaatatctgaatgggggagcctggtatgacagcctcttggattcaaaccatgtgagaggggacagcgaaaggactggtatttttcgaggcctgactctgtgcttactgtggcactgggaggttgcagataaaaaagaagaatgtcttcccttatttcaggcataagatggtcaagaggggcatcccacttttttttttttctagctatagtcattccatctcatagtcgtgtgtctttgtgacctgtcagcctggagagcctccttttctgtgtgggtaactacagtttactcagcagggtgagatggaaactcctgactccagtgctcctctgacctcacggtctgctttgaggaccccgctctgctaccagagaagctgggcttcctgctgtcgctcttgaaggaaggaatccaaggattactgttaagctacctgtgagtgcttaaggacagaaaagacccttcattgccctttgaaccaagcctaggacttggcgtaggagataccaatgaatgaagccaacatgctcaaacacagagttccttaatccaattggatcagcagcccttggcctaactgcaggttggtccaaacgtggctaacaaaactctacaacagaggttagaaagttgtgggatgccatcaacaggacccggctcctatagtatcacaatcacctgcccaaaagacaatggatcctcacctagcccatgctggcctaattgttttgcttttggcaggtgaccttgtgtttcacacacgcagaatctagtagataacacaggtaaaagtggagctgctttggataaaatgtggaggaagaacgctcgaacaagaatgttgtcgtccagctcccacttcttgacatgtgttctggacagcgggggtacctgtccatgaccaccgttccaactagaggtagaaccaggcctagaacgtctcttgcacaacatgaaaggatgtttccctcattagagtattaatttctcgaaggcatctcatcagcatcctgtgaccccagagtccaggaacgcacacaggtgcagaagccatttgattttagcagtggttcatttttttttattttagcatgtggttcatcgagtacctcttgcctcttgagataaagaggagctagggttgctaatggttgacttcctcttcttctttccaatccttgaattcgtatgcaatttcttagattccgctggtctcactgccagtagaaaattagtatgaaacgaaaacatggtttggcaagtgacaatgtttagcgagaaacagaagacattcactaagcaggaaaaaaacccattttatcagacacactttttactttattataggcctggagttttaaacactattactgacagcttaaatatcctaggttatgatttctcaagctagggaagacctcccgacctacactgaccatatcaaagaactgaagcaaactccggaaaaccaactctgctcttcatttgttagagttgatgaagtataactggtcattatttaaagtttaattttttttcctttgccttcatatatgaaatttctcactgggacatttcagtgctcttagaagaataccagcagtggattcgaaatcatttgtcatctttcaagatctgagactctttcttgaccaattagaaaagaaggatgttagagcaaacagacagcttagctgctaatgacgggcaatagtcaatattttatgccaccttgaaaaagttgcagtaactgaaggtgttctcacattaattcttgcatcaattatcgacagagaatttaatttaaaggcaactagtcagtaacctaggggtgtgttttaaataatttataattgctgcatgggtgtaatcatattgctattgattaccatcagtcacttctacaggtccagcaggtcttatgctaattacttttagtgagatcaccttttaactctgtattccctggtaacaggaactcattataaaaataacttaatgaagcgcaatgtttagagtccttacagaaaggagggaagggaggagggtgaacttaggagaaagccagggttgaaagcactaggctgagatttacagatcaacaatcctaaacctgaaattacatattttattcaaatatcagatgggactgagacaaaagaggtgaaaaacagggtatatgaaagaggggcaggcagaaaaaagagaactaaaggaagatgtaaacaatttcagttttgagaaaattatctgaatttcactttattcattcatccaggatcactttttattcactatgaaacagctagccatcatattgagggatttaggaaaggcaacctgtgatttactaaaaatttgtcaaatgaggcccactgtatgcttccttttatatcctcaaacagtgtgagccaaagacaggttgttccccctgatgaaaggagattgattcagttattaagtggtgcaggaatgtacctaagtctttataataatagctatgaacgcattttactaaatattgacaaaacatgctcgaaaccatgatttcctgtatactgttaccttgaacaaggctaaggctggcatttagataaaaacagaaagtgaatgaggaagtcatcagtaaataatagtataggtggcccatagacaaggccgctcagatgctggtctagggaaagactggctgtggaaaatactggctgagtgagcagacacatgtagacactatcactcttctctctcttaatttgttcccctggcaaaaagagagcactacaaaggttgccaaggtggcaggaagtgaagacatcagcaccatttcagggaagccggaggcttgcccagttcagacagcaacttgtggacaagccctcctgactggggctggggaacagtctcagaaggcccagatagggtgggagggatgtccattaagaacatgaggattagaatgatggaggtcaaatttaagaatgatggaggtcaaatttaagaatgatggaggtcaatttaagaatgatggagaggcaagaggtcaaataagaatatgaaaatggggcttttattattgatgtttctttttatttattttcagaacttccatttttaagcaattgcatttcaagatagatgtgcctcatttacaaaatctatgtgtcagtgtgtatatgtgcttcaaaactgtatgacattgatgttgtttaggaaaaaatgtgtgtatgtgtatgtgtgtacatgtgtgtgatgtgtatttccctaggagcaattatgtaataaatgcaatgtttttgtgccacttggttcaaacttcagaaaattcctaacatttaggagaaagagaaaaaaaaacagagattcatttctgaaagaagagacataagatggtacacatctaatttaataccaacaatttgggtgactataaacagtgggagtttacattaatagaaaattcatcataaactatggactttctccagtacagcaaacgtaacccttgttctgaagatgaggacaacagtatctttaaacctcgggtgcagctgttgtgatcgaggcggaacaaaacaaaatagggaactatatcgcacaagttaaatggggggaaaatacctgcagaaattgtcacctgcccacactgagagtttgctcacaaaattctcacttaaacctagtgaaaaggaaacaacaaatttctagcttattccatttccccgggcacgcttagtactttcaagcttggctcggttttctcctagtggagaccagtggacaaggccaatacttatggctgtcgtatagcactaaaatacattatatttgaagctgcaacatctagcatcaaccgccaagggcaagaatgatcactctgagacacatcaagtcggctcgctttcactgcagactcttagatgggggacccagtttgcagggtttaggctgctgatccatgtataaatcggggcggggggtgggggagggacaaagatcttcttaaaaagccagatagaagcatttgactatgcaccattgcagtgtgaaaataattagatatgaacaatatataaataatgagtggagctgtattttaataaaattttacttaaggaaacagaaaatgactgtcattgccaatccctggtacgaatccttatcatcttattattaagccgtattcctgaagggtggacacagagtcgactccacagggcaggcagtgaagctgacctctgagttgaattcaaaggagacatcttcttgtaaaagggaagaagtcagccgggatgggataaatggtcagtttctgggggagctggaggtggtgaggaggactgaccagggaagctttctaagggcatcaggggagattatggggcttggggaaaaaggagaagcttgaaattgccactgtgaggaatggaaggaaattagatcgagtaaacagaaatactgctgggcagtcttgagacatagttgagactagaattaaaaagaaaaaaaaaatcaatatcctcttagaactgtaccaacagtgacaaaggcatagaactaaccctgggctattttaggggaatgtatttcgttgtctagtctgtgtctaagatgagcaaagcgattctacatccagccacaagagcatctcagaagactcctagtggcacataaaaataagttctggctcggtcagcagggacacatttaagtcctcattagaatgaagctgtctccatcctcaaaactaacaaacaaaagccgtctttgagttctggaagacaggaagctgggatcctgagaaaggctttctgcctagagctgtcagttagcaccagctaatagacctagtggacctcaggatgtgagaaactaaatccctagacaactacaaaaagaatagggtaacacctggaacaacagggacccaagggccaagggagctgcctctgggcaggtacctggatttcagttctgagaaggaaacaacaaatcaaggaaagctttctcctcactgtaatccactagcccaaagtgggttctcaagtcactttcagaagggagaagcaaagcacaaagccccagttgcccaacaccttgggtagggttaaacattttatgcaggaatcagcatctttaagagctcaccttttaaaaggagccagctttttgttgtaaatggcactgacactacaacaaaaagttgatttcacaaagatgattcattaagaaataaaatattcatggctgacagcttgaggatcgccatacagttatattctaatgcacctgtcctctctgacaagtccaatgtgggtgtcatgtcgccaaagttttatttagaaattgtttgtcagagtgagctttctaatgtgatgaaaaattcatcccctcattaagaagattttacatgaaatgtctaggattttcaatgacaccaggacatgaaccaattactgttaaacacttaaagagacagagtcctaagctcactagcaaaactcttaattgcacaaatgtggagaaaattcaacatcccgaaaggcaaatgggattttgatttggaaatcttcttttgttttgtcacatctggaaaaccactatctttaaaaacctgggggaattcaaatgcactattttatggaatccacatatatcttatctgaccctttgtacttacacattggctgatggattttggcattttcagccacttgttcaactcccgaaaaaatgattcaagtgttttggaagggtgttgaggtgtctgtagtcatttcttgtgtgtggtgtgtgtgtgtgtgtgtgtgtgtgtgtgtgtgtgtgtgtgttttatatactttgttgcttcattgccttcccaccttactttcataatttgtgtaaatatcaaacaggtgccttggagcgaatgcactgaataattccaaaacgtggggagttgggagagaggggaaagaaaagctcaacagattaaaatagagttgggctgcatagagagtcaggagaaatccacaggggaattctggtataatgaaatagcattttacagtcatgacaatggattaagttgacattgagactttttttgacatacagtctagttcagtttaacttacgggagaaaatagttcccaaacctaccctagactaggtatacacacacacacacacacacacacacacacacacacacacacaccacacacacacaccacacacacacacatatagccagactgtcacttcatcacttccaattcagaaaaggtttgagactgacaatatgaaaactcaaatttctcctccttaaacccagcgaccctataaactttaagaattttatattcactttcataggatagaagctttggtgaacagttcgaggaaaaagtagccttgcccctgtatctgtgcatcacaatcccataagactctacaaagctttccaagaaggaaggactctgaataagctttttaccatacagctgttgcagtggaaccagaatttcatagcctttccttgtgctttaattatagctgcctctgcagtttctttagacatattctttctctatatgtttttcttttcatttacatttatttctcccttcaatatatattttacatatatatatatatatatgtttttctttgtaatattttatatagttctggaaagcaattggacaatacatatcaatgtgtaccaagtgtcttaaaacagtttagagtgagatgaaattctagacatctatcttaaaacttctctgaagatcagatacggaatttgtacagagatgttcaatgatgtgttatttaaaattgggagcaaatgtccaaaagaagagaaatgttcttttgtgaagccaccattcaaaattacatttaggatttatttctcatataataatattgagtaaataaagtagaatacagaatgcacaaaatgtactcagagattcatgagcaaaaagtaaatgctttttttttttaaagaaaaaataccaaatgtgtacaatgggtatggtatactttaaaaaaaaaaaagtacagtcaggcgcagtggttcatgcctgtaatccgacactttgggaggccgaggagggtggatcacttaaggtcaggacttcaagacctgcctggcaacatggtgacaccccgtctctactaaatatacaaaaattagcctggtgtggtggcgacacctgtaatcccagctactcaggatgctgaggtgggagaattgcttgaacttgggaggagaggttgcagcaagccaagatggtgctactgcactccagcctgggcaacagagcaaaatctgtctcaaaaaaaaaaaaaaaaaattccatccccatccctgtacgtggatgtgattaaactcaactctaaactgagtcaaattctacacactg

SEQ ID NO: 5084 - DNA, 100000 bp, Homo sapiens
gtggtggggagggcactggcagccgccgcctccctatgggggagcagggtgtgaggtcatgggcaccaccatgagtgttgctgcctccgagggacagtgcccagaccgcccatacgtctgggagccatcctggcctctgcccagcaccagccccacccctgctacccctcagctcttgactggtttcctgcccttgctgggcctcagtttccccacttccccaatggaaggctgcaacacggtttccgtgggccccgtctcaccccgtggggttctgcccatacccggccagagggaccgacaggcaggccacgacccacacatcgtcccgactcagagctccaagaaagtcagagcggcccgccacgcccgggcccgcccgtcctggtggggcccacactgcccgctcgccccctgtactggaaggtcatgttggtgatcttgatcttgatctcctcgcccagcctgcgctgccggtcatctcgaagagcttgctggccatcttctcgtacaccttggcgttgcgcttggctgcttgagctcgtcgaagaactcctcccagaccagcatgaggccgcgcatctcggcgtcgtccagttgcgggcccgccggtgcttctccgcctggggagacacgaggtagccgggccctcggccgccgccatgccggaggcgcctgtggggtgagagagcgcgctcagcgagggcccggcccggccccacgcaccatgggcgggaggcgccgctcacgctcgctcgaaggcagctcacgctcaaaatggggcctacatctgacaggcaggaatttagttaaaagcttttaaacggaaacgtcattttgatgtcacgtttccatagcaacagagcaactgcataagctacaacacagaaaccttttaactgaaagcacaggaatcagggccgcactgacgggccatcaatattcggcgagcgggccaggcccaaacccagcggcccggctcccggccctgcctctcaccgcccccaggcggatcggcccccagttcagtgccgccccggctcacgcaggccaagagggggctcgggtgggaacaggcaaggagaaagggggcaaaaggtgggagaaacagagaggacgaggacgaggaggctgagtcccccaacgctggccactggccctggtgggggtcctgggctgtggacccttaagctccctcagaaggcccctgccttctgaactggggctgggccctggggccctgggtgtcctggtcctggggtcctggggctgggccctcacaagaaccccaaaccccccccttggctccttttgcttctcttgctccagcccccaggcgccctgggccttaggtctgggacactggaagcccgggttggtcagagccaggccctgcccagaggtgcagacacagggacacagacacgggcctctggcaccggccggtgaggacagcagtgatggcaaaggtgagcctgtttgagacacaggagggaatcagcccagcaagccagggggaggccacagggcactctgggaagagccacgggcatggcagggcacagtctgggtacgcagggagctgatgggcagcagattcggcacagcgtgcggagacggggctcgaggcccaggctgcggggcaggccccttggggctgagggactgagatgcccccaggctggccggaggaccacagcctgccgagagcccagatgcagcggaaccggaaccggagcggtggcctgggggttctgcccggagaagtgcgcccaagggcatcggcacccgaaacgtaacacatgcatgtcaggcagggctctgtggagccacggcacctgtgcagcatggactgtgctgggcgcggtgcccaggctaaatgccactgggtcagcagagggacagcaggcacccccctgccctcctcaggcctgaccaactgcaggaactctcaggtgtgggctgccccaagaagggcagctgagcctggaatgaggaggcatctcgcctctgcccgctgcccctgctgtcctctgaggcaccttggaggtgggaccgaggctctaggggaaggacagggcaggggcatggcgggggtgcccagccccactgtgggtgcccagctagggaaggcgaactggggctccctcttgcccgcagtcaggataggaagtgtatggggaggccccagggatgtgtgaggaactcagaggggtctctgcaccccctacactgggtccctgtcaaggcctggccccaccatcagccccatgagactagtccagtcccttccatctgggctcaggagacatcatccctactgcctggcactggggcatctccactcgactaaggtcagcctccgtgctgggggctggcacagagagctctgtggagtgcctgcagatgaaggagtgacagaaggcctacctcctctaggaagccctggctcctcaggaacagggttcggccctccccgtgaggtcagggaccggtccgaatgccctttccgtagccatgactccaagggcagaggtgggctggctcccagcatctcttggcatctcccggcacaaggggtaagcagaaaggcatgggtcccagcagtggttctgggtgcagctctagcgactcagcatggaccttagtcatgtctccccactaacctgtttcctcacctccacaacaggggtaacaggatctgactatatcaccagcatggtgctggctaagggggcacagccctcccagaaccctggggaggtcatggggccctacgtgccctctacccccttccacaaatccaccttggagctgctggggacagcgtcagcctactgtcctggctgaaggggcagctgctggccagtggacaccaccaccactgccggggcccccaccggacggctctagaggaggcacctacacccctgcctgcccgagttccagtggcgcagggaggcagggccctgcctggcagggtgccaccccacacccgcaccatcctccggcagcattcccagggtaaaaggctcaactccaaccctctcttcccaggctcagtgcactgggaggccctggacagggcaagctccatggcctttcccgaggcagagccctcacactgcctccaatgtgaggacaagaaccaggcaggcagcagatggcagcaccaggcacccagctctcctgcctgggagggtccccacatctgtcccctgctggggaggggctcgtaccttggcaagctgcatggcctgctgggaccctcagtcgctacggggtctcctagggccagaggctgtcaaccagcagcacctgagggagaaggggcaggtcaggcctcggcaggagctgtccctgtgcagacctgggacatgggcggggccctgctgggctcaggctagaagcatgctccctagcctccatcccttctaaataatgaggctgggcccaactagactctcatcctgctcagcattctgggtggattttctgccctgcctgacaggccagcaggacatggggactgaccaaggggggggcagcagggctcccaaacacagaagcccagagaggaggtgggcgtcccactgagggcaccttccaggagcagcagtggtgagcacagcctgtgcagatgggtggggatttggcactgaggagttcagggcttgggtgaaggcagagaaccacgtggagtcctgggcccaaatccggggggcccctgggcaggctccggagcctggacttccccagagcaattggggccaggagggaaggatgtggccaacactgccgccgctggggcagggtagaaggttgggcgggtgggtgtccagagggtacaggggccaggatccacctcaggaccagcctgtcctagcagttttggggtagctgcctgaccaagcatggagggcaggggcctgtgcacacaaggggaacccagaccacaacttcagccctctgcctccagtgatgccctgaccctgacctcacaggtccacaggcccacccagggcccagacacccccgaccaggacacctggaggcctggtgtagggtggaaaagccggccacactggcgggcccccccagaggatgtggctgcaacaggactgggtccttgtggctcaagccacttgcccaaaaggcagccaggctgctggggctgcagagcctggggacccgcaagcgatgtccacatggtttcccaaaagaggtcctggtgatgacacaaggccggtccacctctacccacagacactgtcacggtgctcatggaccagactcgtgggctcgcgaggatgcctttcctcaggccccactgcaggcttccctgaggggtgcaccccacacccccggaacggggcttcctctgtcctcggttggctgtgtcacatcatgtagaggcaaggccccctacccagtcccttcagtggcggctccacccggtactcacctcaccctggctacttccccatctgacttacagtgctccacgcaccacgcaggggaagcgacttccagatcccaacaagccagtagcagccaaaatcaaataccaccgaaggcacagggcacagctcggcaaggggaagggtgtgctctccgatgaggaagaggaaggctgtgttgagggcagctctgccgtggcaggggagggactgcaaagcccactcacgaggggttcaccgctgcttcccactggaccccgcccctcttctttctgaaattaccagccatgccaggtgtgctcagtgtgccaggctgtcccacctggaccagggagaagggggtgctccatttctctgaagtgaccagaatttaggtagtctgaaaggagaggccactggggggccctggagcggtgtcacctatgaggagacagattagggagctcaagtggcatgccccgccccaaatgctttaggcctgtccaccacatccctcggcagactgatccctatccctgctcagagaaagggggcccccgcacgtgcccaagaggacaggcagcaggagctggccccttggccgactggcccccgtctctcctggcacagacagcgagcagggaaagaatgggtggacgacccctgccaattagccagaaccagacgggacctcgcaaacattgactaaataccctgcaccagaggaagccacagggtttttgttcttgcaggtggtaagacatctgcatcccaagatgactacaccaccaatcaccaaggcttccgagaggtcgtccggagcttagaagcatccccgctgggctgagcagaggcttcttggagtaggcgcggttcagacaggacaaacaagctagaatagacggggcaggccctgcggacacacagcagcccggccacaccagaggtgggatgtgccagctgctttgggggttacctgggagcagctggccagggacgcaggtgtcaatggccaaggaggtggaagggtggtgggccctgtgagaaccagctctagtctctgtgctgggcctgatgacctgcttcagtgccatgggccaagtcctgggcttgtgtatgtcatataagcttatgatgtcacttgaccatgaaggctccagcagctcagcagctcccacagctcccatctgcagggcaggaagaccacctgtactgtggtttgggaggcccttgcagaagcacccagccaggcccatgccctggggccacttcctcatccctggcacagaaaacacggggcctgtccctgctggcagctgcctgggggaccctccataatgccaatgttagctggtgggacagtttctgcccctgctggagaagcacttaggagactgcttccaagactccagctcagcaaggtctaggttctcatgaagcaaagcaagcctcacacagcaaaactgatggtttccatttttttcctttaatttggatgtacaatgtttgcagcagttaaaaattaaatatacatctctcgtcagtccttccctttgctctcagaagcattcaggtctggtggggctccgggactcgcccatcacagccctgctggctccaggggagctcaagctcagcgacagtccctctgaccacggtgcaaagcagtgagacctggacaaggaggccccacttggtcagagcccaccctccgtaggcaggtccacgttggccacgatcctccaaggctggcagtaccacccagattgcagcgggagactctgctcttagaaacaactgaggggaaggcgttccttgactgcaccagagcgtgacaggcacatgggggaagagcggcccctgaaccttccaggtgccttcagttgtcatgcggcattctgagcagctccctccttcccaggaggcccaggccggcaagcgagtgtcctcgtctgagccatcctgagctctccaaggtccctcagcagctctaagatcttccttcttctcactcctacacgtgacccctctggaggacagctccaagtctacctggccagcagctgtggtcccgggtcctccccgcagagggaggaagcgggggagggacaagcccgatgaggatgtctgctgggaaggatgctcacaggtagcaagagaagcctgactcacccaccagacacacagaactaacctcactccaccccgcaacgggaggaagttccaccgccaggcggccacacaccgagttattgctgtctactatccgtcccgagctccacgtgggctcatctcagctccaagaggaggagctgttcattggctccgagggctctgaaatgacccctccatgaagatgggggcgaggggtgtcctttagggcacagggccttctcagatgctacttctgggtgtctggagggggttcagcttcacattttccccttgaaaggacacatgcgctgcagaaatgagggtggacagtaacaaagagcacttggcagctggaaacatcacctacatgactcagctgggcccgcagcggaagggaggcacattttgggaaagaaacacgcttcagtcattgccaaacaattctaccctggtttcattaaaatctttcccgatattaccagcaggaaacaaaagcaatctccccacagcccacccccaaaacttgacaaccaaattaatcacattgcaacaaaatttggataatacgatgggtgcttgccacagatttttaggaacatgataaatcttcctcccttctgcagagagctgatatggagaccatcttcgccagtgggatcctagtggcaatgaatgagccctgccctgaccacgtcccacgcctggatgtccgtcacgcggctacttgacctggcgggtctaaggaaagtcaacttccaggaagaaccgacacgggcactcttgaggccatgcatctccgtcttgagaggtgtgtgtgtaaaattatagatgtgtctatatgacatgcatggatactttatgtatatgcgtgggtgaagtcatttttactaatgagctcatttcatctccggagcacacaggcaggtctttgggggtgggggacacctactgccagagcgggtgttctgagccccttgctaaggactggtttagatcacgtcgtaaacaagaggaagacaactctatgttgagcccagcgatatgcattccaagggaatggctctgttttacattcacgtgttatttcttacaaatgtaaacatctagccaggaacaacatctggcctgtgatactgtgtctcagagctgctgacataacctgcgggggaggcgggaggcgggtggggagcagccacagttctgagaactttcccctcgttcccaaaccttctagcgggctttccaggaaaaagcaggatgagaaacaggagcccccaaccaatacggaagaatggtgattttcttacgtgttaaattcagtagcttcccttaagggcctcctcaaacatcggacccctttctaccgctcctgtgccccgccacgaggacgaggtggtcctggctgggggaggcctctgttgggagctggtggaaaagcctcatacaggcctggcagaggctgctcagaggaggggctccctttcagctcccctcacgtatgtgggcagcatacaagtccacatctcagctgctccccagctgccacatagagagggacaggtggaagcttgggggtctcaaggcagcacctgcacagagttccaacattcctccacttaccacattcaatacccaaaacatcgacgggcatgaccaaaccaagccactgacagtcgccaaccttgcctggctcgcctctagggctgaggaagcagagcccctgcctgtctcacagccagtcggcaagcagagctcccaaatccagctcctacatcagcagcagccggccatccagaatccacttccattttaatgacttggctcctctgggcctgcaaacaggagctggtccagggacctggcctggggataggagtggcggctctgacagggccgtggggcatctccgatgagcacagatctgcactctcctgactaaaaggggtcaccgtgcaagatgtcgctggaacgggggcagaagggatgctgggctctgtcactaacagtgccaagacaccaagtttgctgttgaccgagagaggctcagacaaaacacagctcagtgacactcttagggcatcatccatggagcagcaggtcccaacacctgccagccagctcctaggcagacgccaccccgggctagcaaggaacaggagtgggaggcccatgtctctggacacagtggaggctgctcaagccagggagggctggccttctcagctgagtgacagggaggctgctgtccctgactggtggtggagaacgacagtcgtctgtgcccgaggaggaggggctgcaggtgagcgcacccctggataatgggggcctgtcctcagtcctgctgtggccacctgcccactaacgcctctctaatcccagtcaccttgtgaatgcataaacaggaacatgtacaacggaaatgtcagcgggtctcaggagggctatgccagtggctacaggagagggagcgtggccgggggccctgtccacaccccggacgctgtcgcatgcagcacaggccttgcgattcacatactttacacgggcatgaaagagttacgttaaaattaatctctttactgatataattaaattttaaatcctgagagaaaagagagaagggagaatggtgccgggtgtctagcacccccagccactggcccagcaaggccatggcatctgtgcatccagacacggggcgtggcatgcacaccccaccagggagaccaggccagtgttcccaaagcctgctcacggcaccttctactgcaggacagcagaggggcaacagccagcctgcaggagggaggacttctggcccagatgcaagagcagctgcaacctgcaacaaccagcaggtgactatcaggagaaaggacctggtcacccacatggggtgcagccagctgctcctgctttctggaaggcctcaggctcagccccaccaggactgcagacactcctgcctggccactgccacaaagagcacttctgccacatggcagagacacgcacgttgccggccgcccgcggcatgtgcggaagcccatagggaccaagctggctcggtggaggcagggacaagggcgcagacttccaaaggctccggccccagctgccgcctcacagtctctcccacatggcgctcagcaggtggtgaccttgtggacatttcgtaaacaagtcagcagccggtgaatgggcttcctggggctgcaaccacctcaagcacagactggaaggccctgcggtcgagccctcctctatctggtgtctgtagaagtctgtggcgaccaggcagaaaaggttcacgtcccctgctccagcttgcccatcctgctgatgacatgtgggaggctggtgcaggagttaaggaaaaggccggcaaatgaggggaatgctgcctccctgtcctcacctgggagttcctctccgaaacagtctacaaaggggtccagggagcctggagagcgagcagagccccggaagggcccctggatgcctccagctgcatcagcgcctccacctccattcctgcaacccttggctggcggatgccctgcaggcagggcacccactcggcagcactcacctggcctggctcctgtgcacgctggtggccggtgcttccgctggcctccactagccctgctccaatgcagtgagggcaagccgtgccaggcacgccgggcaaggctgtgctgtcagcaccaggacaactgtgctgctggaggctcttgtggtctgtcttggggaagggctgtggaaagggaaactcctggcagccacatctgggggtgggaactggatctttacttaagcctttccccgagagggcgatcgaggccaatgaccaaagctaatgagaagcagtgtcaggagaagcccagccacacagagcccgcggtgggcgggacgtctgcagagaccaccgcccaccctcgctcccctcacccaggccctcccagaaaggcccctcagctgcgaccctcctgccatacaccggcccctctgagaggccctgtcagcaaatgtctggacgtgctcctttctgtacccctgtcagcattttacttccctgggctgagggcctgtcaccctggcatctgtggggtttttgcaaaggttaggtttcaaaacctatcatgaaacatgagcctcggtgttgacaagggaaacggggccagcaccagggacccaggaggatacatcgccgcgacccacgggctggtggacgcgctgacaaagaagcaggagaggtccacgtggccatggcgaccggggccctctgcgtgaagttggagagggacagcatgaccagtcccggaccatggacgactgcccggtgctgtgcagagtctgaaacacctgcaaggagaagcaggcgcctgagtgtcagggctggggggacgggaagcacctgctgcgcctgggtgggggggtggggtgggggccagaggcattgctgctttaaagcggaggagctgggctctgctgcgaatctgctgggaagtcggaggcaactccacctccaggctttcccactccatccccacccacatgcaacctcaccttatacaccacggtggccatgaactgggggtatggctgctgttggacagaaactctccgatgactttgttcatgatgtcctggggtgggaagaagtcgtcagaaactggggcaggatcctggccaccactctggcttcacaaggaaagcctttcctgatctgggaggagggacgcaggtcagagactggcaccagctcccacagctgccccacctgccgcggagggccttggctctaatactggggaaaatgccgatgtgaaatcagggctgggaggaccctcggccgtgagggactttccaagtggggaaagtcagagcctaagcaactggagtagaattttgagactaaaaaggcaaaaccccagcccttcctctgtctagctcgtggaggcagctgctcggcacaggccctgggctcccacaccctgtagggaccagaactcctaagaggatttgaaagctacgtaaagcctgggctcccacgccctgtagggaccagaactcctaagagagtttgaaagctacataaaggaatatgcagaaacggcgcagcgggaaggatgttacaaagagatttttaaaaatcataacaaaagaacccgttcccattatgtttttgctgctttccaatgcaaatgctccacaaacatccctatgtgttctaacgcttcgtggcactgttgtcaacaggacttttttcttgttaccacacagggccccatctgtgctctcgctgcttcttccctaccagatcctgaaacacgccccctgagcagtatccctttcagtgctgaaaagcaaccatccgttcccgtctcatcagtgcacacatgccagccgtgtgtaactgagacacacgggaagcgctacgaaaatggcagtgcacttcctcacaggtgctcctggctctacccgcccgcagacctcgcccagcagtggcatggcagccgctctgaagacactgctccacagagagaaatctgggtcagctgcgaggtgcctccctgtggcgtctggagagcggtcaagcggaaggcgtgcacacactctttggagcactcgccacctagcattgggcccactagaccacaagccccttgaggccaggactggtcgtggcgcctccctgtgcccgtctgccagtcgcagtggtgctcagtagcatatggggactgaagaacgatgcagaggtgcatttaaaaatcgacatgggggccggcgcagtggctcacgcctgcaatcccagcactttgggaggccaaggagggtggatcacttagttcaggagttcgagaccagcccagccaacacggtgaaaccccgtctctactaaaaaccaaaaattagctgggcatggtggtgtgtgcctgtaatcccagctactagggaggctgagcaggagaatcacttgaacccgggaggcggaggttgcagtgagccgagatcacaccattgactccagcctgggtgacaagggaaaaactccatctcaaaaagaaaagaaaaaaaaaaataacatgaaaacagaccagcacaggcttggctgttcagaatgcctcatctggtcaaacagggagcaaggtccacctgagtatgctcttgagaaaagccaaatggctccccactggccacctgattggagagcacaggcaaggcagtgcaacaaggctccagatccaccatgtcgccagactgaggcctgagagcaaatcaggggcccttgtccttgagaaaaagccctaccaagctctaacccacttccagagcaggtgagggaagccaattctatgcacgcacagcagtggggggggtggggggcagaagccactgaccacacgggtctcaaagatgcatgtgtgggttccacctcatcctcctgccgctgctcctcaccctgctcacaggcaccacggcccccctcccacagcccgtgggctcccctctcacgataggcagccaggctgagccagctcctcctcactgtacggcttctgccccaccctcccagaggctggtcattcctgccccctgccacacccccaactccaggtactgtccctgagccctcaggagagatgggcaggcactgggacaaccttggaacggtcaacgctacacctgagtgctggggtccaaggaccaccagctcgccagtggaaccctagccaaggcagcccatggtcaggctgtggtggggaatcactggcaggactccagcaacacgccaggggatcagcagacacacacaaaagcacagcttcaggccaaagttctagggaagtaacggctgagggatggggcttcgcttcttacctatcaaaaagaacagatacccgctcctagcaacaatcactgactcgctgtcgggggctgcaggattagggtctgaagttctacccgactgactttctcctttcctgtaacaaaagtgttcagtacgaaggttacctctatacaaccaataggctctgtagacagtgctttgtacacaggggtccagtgagtccctggagatctaaagcaggtgatatcagccccttgcttgcccaggacccagcccagctcagccacatgggtgagtgaccacagggacggtcaaccctgaccaggtactccagccctgggggctccagagctttcttgcaaggtgatggggccggcttggggcaacaccagaagtgtgaaatcagagggacctagtcgaggtcccttgagtgagcatgctcctgcctcccttgaacaggacttgggctgccttatgggcaccgtgtacatgctcacctgtgtacatgcaggtgagcatcaggcccaggccgccatggcccggtgcgggctgtgcacgttcactctgtccacactcagcttgaccaggattctgcatccaggcgggagagctgctcagagagcaggaggcgctccaggcctctgaggcacagtggtaaatgatggagggggtggactcctcacttccagacagcatcaccccacaatctgcacagggagaaaggcctctgtgtcaaagaatcgctgcacagtctcaggtgttcagcctcctcccgaccaagtcaaaactggcccactggtatgatcctgcaaggaaaagagaaggaagcccactccccgtgtgcagaggaagacagccagggcccactcacctgtattattgtgctgaaaattccggccctacgtccagaggatagttctcaatgaggtaaaacgcagtggacacatgaccagtacgtgctgctggctgtgaatgttcacgcagctgaaaacgggagacacatccaggctcagccacccccatccaacgtggagagggcttcacagcatgtccggcccccgcgggagtgtagagctatgggccaggcgggctcccgggagcgcctaccccgcgtggctccccaggcccctgcaacctggcctgacccttcagcctctgcttgaccactccctgagtgctgagcccgtctacctccccaacgccctgccctctcggcctaactcagcctcccctgtgccacctccatgctggccaccacacacttcctctctctgtccctcaacgaggccctagatcccacaccccaggccagtcccctctacttcctgagtgccctgtgcttttccttcatggccatgccatcatgacgtgctgccttctgtgatcccccgacagcgccggccttccccatggacagtgaggacctggtagccagggactgaatgagtggccactgtgaacagaggagccaaacgatgccccccaacacccacaaaaacgtgcccagtgatgcgtatatctgtcaccacgtgtcccacctccacctcggaggcacgtgacacggcccctctgcccatggtgctgaggtcaccccacgcaccatttctacctggatgccacaagctctctgcatcccaaacgcaactcctgaccacctcaactctccttccctgagtcctccatgcccacagcaagagccatagaacagccaacacaccagcacaggcagggctttggcctgtgtctggggcctgttctggggctgcccccaaaatcacgtcactgcaccaacatatgtgcctgatttgcaggcctgtgccccgtgtacttggccctatgccaggctccagggatgcagagacagttgccagccgtccgcctgtccgctagcacagcacccactgcccagcaaggatgacaggcgagaagggcctccccacgggctgtgacactctggcctggatgagggcaatggcccctgatgagccgctgtccctgctccacatgtcccaaatcctgccagacggccaccggcatgtgccctggctcacacctccctccttctgaactgtgcctacagagaccttcccgtctccctccaggtcttccactcaactttgactagcccccgtttcctgcccacttgtcaaaggggatcactggccattcctcccagacccttcccatctttgctcctaattcttgccctcaactcccccatgtgggtggctgatgaaatccaccctccctctaaagacagctcccgtgtgcagaagcctatgactcagagaggctgggccatctctgctaaagcctctgcgactttggaagagtggcggtgagaccagggtgtcacaagccctctgcgcttgtaagacatcgctgtgaagagcttgacttgctcgctgaggggttgggcaccagccgtgctttgtcaaggacacgtgtgtacagaacctgccgtccagcagctttagataaggtgaggtcggaatcacagtggaaacaagagggaggtactgggccagggcgggaaggtgcagagaggaggctagcctgggtaataacagggttctgggagcagagaatgagaccgatggcctcgagagcagagtcaggaatgggcacgtgggagagtgtgctaagcgccactgagacagcagcagaggcgagagctccagctcgctggaggtgcccgaggaagcctctagacgcacctgtgctcttgcgtctcactgacctcagccatggcacccacctgggttcccacgatacctggcctgccatctggccaggagcctgggcacttggagagggtgatgctgcttcttcacagctcattctgagacccccgccccagccccagccaggctcccactcactgggcgtccctttcaggttggagaggagatagtcgctgatgaccgggatgagctgcttggcagtgcgtccagcaggtcgcactccagcacatagaggacgccgtgcagggctccaaccctgctggcaggtggctgctcctgagcgtgctctccagcaggcggctgacaggctccgccacggcctgtcctaggcacacacagacaaaagctgctgcatgccaccagagctcacgtcccagtggtcctccccacagccgaggcgggggcgctgccctcacgcttgtgtgcagaagagactacaagcaggccggagaccatcctgagaggcctgtgtgcaaggctggcccctggctggtgttggacggtgcccaccatcctcactgaggaggggctccctgtgctcagctgcttgtgtgggcccagggttggtgctgagaacttgccttccctccgggagtccagagtctgggcacgaggcggcagagggtgcccatgtgcccagcccccagtaaaaaccctggcaccgagtctctagtggctttcctggcgacgacactgcacacgcgctgtcacggctcactgtgcggggagttaaggcgtcctgcacgaccccgctgggagaggattctggaagctcaagcctggtgtcctcgggcatcgccccatgggcctctgcccttgctaattttctttgctgattttgttttgtgtgctttaccataacacatcttagctgagagtctttctagaaaagcctggggtagtcttggggaccctgatagtggtttctgtcaacttcaaccaaaatggcctcaatttcacttagtatccaaacctagcagggttaaatatcgacctaaacacttagcccacgttcttcactttcaatctctctttaacagtgaggagacccctgcagaagtcagcaaggaatgtcaccctccttcagccaagactatggggacacagaattcccatggagcgctggatggccaggcggcctcttgttttgtggaatgatgaggttctcggcagtggtaggagcctctccgcaggggaaatggccggcgacacagaagccactcccagccatcccaggaacaaggaccaaaagaggaggctgttcttgtgggtcacttccttcttgggcccccacctcaccctgtgctatcccctcacacgcacacgccacacggcccctccctaaggactgcgcacggccccaggtcccacttctgaaagcccacatcaggacctgctctcgggtggcacggatttcacaacggtgggcaaatacctcaaaagacatgctctggatacgtgggtaccaagcatgacgcgctgaaaaccttcacagaggatgccatcttccagaaagcatgagtgcacaaagagctgggagtgagtgtccatgaccatcctccttaggatctgcttttcaaaatgattatttctcatttgattactgatggcacaacactgcctagggggatctgggcctgagcacaaaaccacagttacaattcaagttagcccagcactgaaacttcccacaaaggagaaggaccccttccaagagccgctttgacatcgtgtgggaacacccagagggtgttcgccgtgaagagagatgcccacacagggaacccacacactcattgtttccactccctggacggctgctgagtcaccagcatggcaccaggctgaaggacaccacaagggaagatgactggcgtttgggctcggggaggacagagtctaggcaagagcagtaagactcgcagagagggagtcaggctccaggtcacggacatgtgctcacctcaacctctctgcattttgtgtgacccagacaagccagctaacctctgaccttggccgcctagggtgggccaaggtcacccttggccttgtcaggtgggggtgcgggaggaagagctccgcaaatgtagcggctggagtgatggcaaaaaaaaaaatcattcaccgtcatgacagcattgtcgttctgacacacaggagcccgtccagagcacgggctaggcaggccctgatgggcaccaccatgcattctcaccaagggccccagacggctggcacacggcagccactcaggtgtttgttgaaaaatgagtttccattgctatcataaaatggattactaggtaatgccacatgacaaggaacagaggtgccagctctgacagttctgccatccttgaatatgcttcgccagatgtcgggaccacgggcaatgatttcacgtgtgcaggtgatggatacttggcaaataccatgtggtgagtgccacagaatacaggtaccatgctgcactggctgaatcctgataaaccagaagcagataaggaggaactcaagaggatgaacacttgaccgctgggatggtctgaatgtttctatcctcctgaaactcctacactgacacctaatttgcagtgccacagtacaagaaggtggggcttgggaggtgatgaggtcatgatgggagagcccttgtggattggggcccttctaaaaggctgagggagcttgttcactccttccaccgtgaggacccagccagaagatgccatctatgagcagagagcagccctcatcacacaccaaatctgctggcaccttgaccatgaaaacttcagcccccagaacggtgagaagtaaatttccactgtttataaattacccagtctaaggtacttgtggtagcagccaaaaaagactaagacaaccaccacgctaaaaagagactatagcaccagatttgggactagaaacacagggtcactgtgacaaaacggcccccaggagagaagcgtccagccaggaagctcggggggcctggaacataactgagaaggggagtgaggcagtcagcctcagggcagagcatggggaagccagtagcatttccaccatctacgatgcctcagcgcaccacacaccgtggttctgtggggatgggctactacaatgatgtcataagcccagggaacgggaccccaaaccatggcttggccgccacaacccacatcacagtgacctgtgaatggactgaccgtcgctgaaccccctccatctgagaagcactgcagctcacgtgggccgtggatccggttcgggtcaactcttggaaggaggcagccgcacccggcacctctggccaacaccggtcccaaggcagatgggcccccgtggcttcagcacagaaacctctgtgccacctgtcattaccatcccaaggacggcagctgccttgcaggtggcaggcaccaggtactgagcgaggtctcgtcttctgaagggtgcacccttcgcagttctgtcagcgtcacatacatcagctcaactggttgcgctcggtgaacaagtctgagaccactagaagctggagatgtggaaaaccagagggcaaggggagaatcgcgctgttagaatccaggcaacgcatccagaacgctactacggcaagtcgtgttcttacacccaagagacattactgtgcgggacgcatgtgtgcgtgtggtgtggtgtatgcgtgtgctgtgtctgtgtgggtgcgtggtacacgtggtgcatgtatgtgtgtgtatggtgtgtacatgtggcgtatgtggtgtgtgtgtgcgcatgtggtgtgtgtcgtggtgtgcaagtggtgtgtgtgtggtgtggggtgtgtatatacatgtgtgtacatgtgcatgtgtgtggtgcatgtgtgtgtggcatgtgtgtggtgcgtacatgtgtgtggggtggtgcacgtggcgtgtgtgtagtgtgtgccatgtgtctggtgcatgcacatgtggcatgttgtggtgcatgtgtgtggttgtgtgctgtgtgtggcacatacatgtggtgtgtggggtggtgcacgtggcatgtgtgtgttgtgtgcatgtaacctgtgtggtgtggtgcatgtggtggtgtggtgtgtgtgtgtgtgtgtggtgcatgcatgtggagtgtgtgtgcatgtggcatggtgtggtgcatgtggtgtggcgtgtgtgtgtggcatgtgtgctgtgtgtgttgtgtgtaggtgcatgccgtgtatgtgtgtgcatgtggcatgtgtgtgtggtgtctatggtgcgtgtgcctgtgtgtgtgttgcatgcatgaggggtgtgtgtgcaagtggcatgtgtgtgggcgggtgtgtgtggggggtgtgtggcgtgtgtggtgcgtgtggcacgtgcaggtgtgaggggatgggaaggctcacttacggatctgaccacctcactgatcaggatggccggggtcctcctgctgagctggacggcaggatccagcggctgtacaactcaagcaaaaactgcgaacaggatggatgtcaactccagcccggtgtttcctgtggaatatgcgagatgggtattttccaagacatgagatgagaggctcatttcaagaagcacctcaaacaaatcaaatgactgataagaatttcaaatttctgttaaaaagaaaaaggccattggaaaacctggagttgactggagactgggtggtgacgaaggtgcaggggcgtcggcctcctcctcctcttcctcgtcccattcccctccctcaggggtgtgatgctgttccccagccacacggagtgtatggacacctgccacgaaacggggcactgctcagtgctgcggccacagtgccaggctcctggtgggtgggtgtgccactgggactcagcacatgcctaccgtctaacagtctgccccttagcaagggtcgttcgacaccccaggttacgggcaagggagcccacagagagggtggggcaggggctggacagcgctgggaagctccagcacatgctaaaggcatgaatcaggggccagtcaaccccaggagcgctgaggagggtgacacagaaagaggctctacgaagggatgctttcactcctaagtgactctgaatggagtccccaaaacacggaaccaatacgtgagattccttttccagtctcccgactggcagtcattgcggtaaacccaaggccagagctccctcgcgcctttgtgacccgcgtctagatcacgcagccaccacgcagtcagcacacctcgactgtcctcctttctgcctggtctcgggaagcctcgagcacttggcacagtgctgtgggctgtgtgcccataaaaagctgtctccatcatcactggcactagccccaactcacgttcttggcaccaagggccatttccccctgggacccagcaccctgcagggagtgggcgaggagtctgtatgaacagctctcaggcaaggaggagcccctgcactcccctcgcccagacccctaacccccacccctctttcccaaagcaagtagcggctcagtccagtggcatctaggggctaaacatcccagacagggcagggtggcactgtccttcagccccagacagggcaggggtggcactgtccttcagccccagacaggcaggggtggcactgtccttcagccccagacagggcaggggtggcactgtccttcagcccagacagggcaggggtggcactgtccttcagccccagacagggcaggggtggcactgtcttcagccccagacagggcaggggtggcactgtccttcagccccagacagggcaggggtgcactgtccttcagccccagacagggcaggggtggcactgtccttcagccccagacaggcaggggtggcactgtccttcagccccagacagggcaggggtggcactgtccttcagcccagacagggcaggggtggcactgtccttcagccccagacagggcaggggtggcactgtcctcagccccagacagggaaggggtggcactgtccttcagccccagacagggcaggggtggactgtacttcagccccagacagggcaggggtggcactgtccttcagccccagacagggcggggtggcactgtacttcagccccagacagggcaggggtgggaccgtacttcagccccatatgatcccatgacagttggtttgcggacgctggacacaacgcaaacattgaaggatgtgccaaatgcagcggggttggggggatagggaatacctcgggcacagaccagtgtccctggcccaggacaaggccagaggcacccagtgagccccaggcctctcactctcagcctgccctcagaaacactttcatgaaaaatacagtgcatcctattggtcattttcacttatcttgggtggaaacatctgtcaaaggtgaaaggacagaagagtgggacttctttttccaactatgctagaaaaatacaggctggtccagtagctccctgcttcctgtcactgaaaccggcaggccaaaacaggacagtacaggcagagagcagggaacagaaacaggcttgtgacatcacaggtttctgctgtgaaggctgcaggccaggaactcagaagaggaaactctcagagctcataatgtttctaaacaccatattctgacccatttccacagaaacaaaagctacaaagagaacttcctgcacaactgctttcactaaatcaggaacccggtgagcgaaagacacagcaccgggtggagggaaaggtgcaagtcggccagcacagccgggccccgcccagcatacacctgtaggctccacgccatgtgccatcatatgcaaatggccctacgtttctgtttacattttttttaagggacagagtactggtctgttgcccaggctggagtgcagtggtgcaatcatggctcatgcagcctcaacctcctgagctcaggtaagcctcctgcctcagcctcctaaaatgttatgattacaggtgttagccaccacacccagacccttgaatcccttcacttatctgaggaggaacagaagcacagaccaatgtgacctgctaggaagtggccgagctgtctgcctgcacacgggctcccacccagaactggccacagggacagggacactcagggagccccccaagagctgccccagggacactcacggccacgcctgcggccccccataccatggcccttcatggcgttacttcctcctgagcatttcagctgactccactctgtcctcacccccctttttgtgtctacggtccttgcttaagtccaagtcacgccctctcactgtctcttacacacatctctatcctacatgtgaggtctcttaactactttctggaatacagaacataaataaaaacaaaactatgcttcctctgcttgcgggacctaggaataaaacagataaaaacaatgaacattaaattttttttaaaaaaaaggaaaacttcctttcatttaaaaagtgcactgagcttttctcctggtgtgtcaagcgccaaagtctgaggacagaaacggacagaggccaggcggcgggggcggagactgacctggccgagtttgtagctcatgctccccagctcccgctcggggttgatcttagcagcagcttctcgtggctgatgagggcacctgtgaacaccagcaccctgagtcttgtctgcacaggggggcagggccgcaggcccaccccataccagcccagctcctgcccagacggcacccagccgtgagccacctgccctcgccgccactggcaggagggcccaggttgtgcgagccctgtgggtcttggggatttgtcactttataaccagttaagctggcagggccagtggcaagctggactctgtcactttttctctatgacaaataagactgcagcagtcacttgtacccctcagctcccacctctgtgaataggaactggttgtgggctgagctgcaaaagcttggagtcagcagttgcaggcgagccgacagtccaggcaggcaagctctctgggggacccaataagcattttggtgaacagtgccttccagaaccccacctcggtgcccaggctgaccagtacagccggcaggagcgggagcaggataatgcccccacttaacctttcacacccccccagccccaggccagcctcctcatgtctttctgctgggcatccccccaattcccgggcaccacctcccgctaaatgtccccagctaaccctctgccagaccccagatcaacttgcctcctcaaaggggcctccacgcccccttccctggaagcacttgctccccttggagctccaggagcgcctgtgtatgcctcccacccacctctgtgcccctcttttctgccttctatgacaggtcttgctcctgggtcctcctgacttatgagctccttgaaggctggatccatggccctccaatgctcagtttacttcaacgccctaataaacatttgagtctcatagacactgcgtataaccattgcacgtccacatagaactttctgcaattaaagccttcaaggtgcttaaactcctaatagctacggaatcacagagctctacgctaaaatacttttgagtgaaaaacgtgcatccaaatccccacacaactctcttcttttaaaccaggtgacaagctccgatgcctgtgataggcaggcacacaaccggaaggcttggtgggagagtgggcagtgacaggcagggcccagggggggagaggtgcagggagcggggtgctcaggcccagctgtgccctgccctgcagccactccacacatggtttcttaggaaaagctggagattcagcttgtgtagatgaacttggttgattcttaacataagcaactaattcaacttttaaatcctgctggtcttacagcccgtgagattctttcgcttctcatttcttgactggcaggagagaatgcttctcattcatttccagatttacttcctccctgggcctgactaagactcctgcttatgaaaggggcagcgtatttagcccacagcctccaactcagaccacactcaggtcttcccgcatcactggtgtggtgagcatccagtcttctctcattctagcccaagtacaaccgctcccccgcaccctttccctcaggtcctgtagtagccggagacagagaagggacaggatcccatgcctgatataaatgatgggtgcaatattctctctctttgaaaccattgcttgaatctcttgctccacaatccctctgatatgctcagcttcctcccaaacctacattttagaaaaaaggtaaagagtgttttgtttcctcaaaatcttacaagtgaaaaacaccagaactttccctccgctttgcctaaaggaacctgtgtaataccaaatgaaactcacttcctaagtgagcacctgtccgtgagcccttaagtggtgttctactagttgcctgctcattcctgctctgctaacgtcttcccctaaatgctcaaaaccccacgtcagttcctgtcacgtttccagcttctcactgaccaggaggccacctttggtctgcatctcctgcacaggccacacggacggtgttttcaattctagcaatgaaggaaacggcctggttgaagctgctggacgcttcagcggggaacccactgtccccagcacctgcttgtcccagagacacgtgggaactcaagcaaacctggtgtcgagagctttcagaggcttgtccggggctgctgctccaagcagcttacagctgggttgccggccacaggcacagtcattcactgagcaccagtgaggtgatggcctgcacggccaggacgttgatctgggtcctctcttgtcttcctggaaggagagcccacatgtcaacaagagcagcaagacacccacaaccaccctgcctgcagaacccagagtcttccctgcctcaatgggaggaagaggagccttaagtgcaccaaaggatttctgtcaggctgagctcacggggcacaaggcagggcctccgcacacacggccctgaaacaatctgatgggcaaaagcccatttttcaaatcaaggactcctttgggccaaaactccaaacatgaattactttttaataaattatctttgaattccctcatacatttacaggccttgcttatgacaccctgttagcttctatgcatgaatttaaagacaatcttgagacttgtgacatatgtctaccctccaaactgtcatttctgtgagttcaaaccacacctttatcagaatcaagggcctgcattccacaacttcccattctgctggctccgctgtaccaggcacagttattattaatatcgtgttagcgtaatgtacgtgaacacttcaagaagcctgaaaaatctctgcaagacattagaaaaatgaaaccaggtactactcatggcctttataaaggccttttcattttaattcaacctacactcctctgaatattgataaactaaaagatatttccagaaagggcacaatcgtattgatccttaacatggaatgcaccgtaataaaatgcattcagccattggtaatcgcagcccccagacctcagcaggctttgtccctgctctggaatatagtcaagacaccattcagctactctttcaaaaataaggtaagagaaaaaaagaacaccacttgctgccttattttattccccaccaaaggcctgcaagcggccataactgcccatgtgcaaccagcacagggtgtggccttacttctggtgggctctcctcctgctccatcacgagggctgcgtcaccaggacaccaaggagggtggcccaagtttcttcaaactgagtacgactgtccagcctagaaatataaatgttacatgagagagtgtcaacccttctcaagcctgtaacgagagctgacagctacgccgacacagcacggcccctggagaaggctccacgccaagggcgtgagtcccttaaacctcacacagttctatgatgcggggaacactatcccctccatttctcattgaggaaaccgaagtatagacatcggctgcactgtccgagacacatgagaggcagtggcacaggcccaagtcggccctggcagcctggtcaacccccagtggagcagacacaggacagggcagggacgcccatgcaggcaacctcgtgcagggccagggccacttctgccccatcactaaatgggctaaaatcttccctggagtccagccctgagactgtgcagctggctgccaactctgtggataaaactaatggccaccaagctgtccgcttagagtgggtgaaatctgagtatgtgaattctacctcaataaagctgctaaaaatttaaaagtcaaagtaatggttctctgacctgtctagaagaatagattaaaaagagtgtatcaaggtaggaacggggattcatgaaaatacatccgacagaccctccatccctattgatgagctgcattcgagtgtatctacgaacagttgtttctgacagctgtgcttcatgtccccatcatgatgtctgaggcagccagccacttgtggtaaggccagagagacgggatggggtgcttaggacaggagaactagagcatggacatcggggtccccgtgataaacggggtaaagaaagaacaagagacagagagaagagagcgtgcaggactgattcagacacagatacagacaaatataacaatttacgttacaggaaaaaaatgaacaaagaaaatgagcacagacaaggcaaggactgcggcacagtcttggtcacgcacgtccgatgggcagttcaagagcaagggcacccaagtaagcaaaggtgctcggttaggcaagggggagagagcaggaggccactgataccgatcctcacagccaggaagagaggagctccgtgaggcagctggcgtgaggtacctgctcagggctctctttggacattgattataaaggggaaagtagaggcaaggtgtctcctgccacaaccttctgggatccaaacagcctcaaatctgcagaagcccgagggactggggagaggactggacagtggagtcagggtcccctgccagactttctaggacaagacaggaacattccaggaaacaccacagcagggcaagtcactgagaactgactgattacagtcccaccacaagatcacacctcttgccatcaaaaggggcaaaagtggtgacttattcatttagacacttatttagaaataaggggtaacattgtttagaaatgtaatttctaaatctgcaacaattctatgaaatagacacgacccccatttacatatgacaaaactgagggtctctagaggttagacggacttgccctgcgctgctcagtaggagggctggaagcagaccaggactgtctgagccccaagcctgctttctccccatgcgcctctaggctctggggaaggcgagtgccaagaaacctgactccatctgctcccgtctgttgttcccatatgagaaaatggaccactgagacacaacaggatcagactggtgaacacagaaaacattctgagacaagtgctgccactgtttagcctaaatgcaaaatctaaggcagatttggtctcacgttgtccactacacatgaacctttcctgacttcaaacaagcccggaatcacaaagctgggattcaagccacaaaacacaggaactgggatctattttctcagtataaaggagttttgccaacactgcaaaatgtattcacataggtttgtattattatcatgcttaatcttttctggagtcaaatgagaagatcccagtactgggggctctggatttcctcccggagatgtccgacaatggtgacctgaaggagaggccccaagagtacctagtgtgttgatgcgtagatgaactccttaaagacttccttttcctggaggaactccacggggatctcagggatgctgtgccaaaatcccctcccggtttgggtgaccatccaagcttccacacctgagaagtgaaaaggaagtgacatcatccgagttgagtcaggacagacatactgtgaggaagcaggagcccgacttctctccactgggctccctcctcactaccccaacactgtcccagagctggaccttctcccccagaaaacagctccaactgcttcctgggacttccttccccatcaagtgccctcccaaatctgctctgccctcccacttcctgtcctcatcctgaggctgctggcacacccactcagggagtgctgggagaagcaggcaggagttagagacagcacccctcgcccacaacagcaggtgctgtgctagaataaaggcaggcgttcaatgaggttcagctcagatatgttattggcaagcaggcatgaaaatgaaccatacagcttatttctgtaaactctgaagtcagttctctgtgcgtgaggtgctcagacaagtgccatgcacagaagaatccagaggcaggttgatgctgttcaagtggcaggatcagctcacggtctggccagctcagcttacatgcctcagtgaggtgacaaaggacccaacggaaccccaggattcccacagcccatctgcacaaagcagagggggctctatgataatgaccagctaatctcttacctcaccacaggaaagcccttctttaaatcggttatgctcccctatgctcctctctggtacccacccagggagagactgagtgcctgttacagctgccttccagatgaccgcactcagggaactcctcaatgccagtgagagcttgctggaggaattttacctacagcgtgcagcccgtcctggcctatcctcaggttgctctggacggcatgacctcaagaccgtgccctcctgcatggtctccacgagcccctcaaaggagcagttactgtctcataaccagatgctaatgaacccacagtgactcgctgtgcccaagagtggggccgagagcaaccccatgcagcaagtgtggcctgcttctccagcaccctgctgctctcttcccaggaaagcctacaactccctgttctgcaactgcttccagcaccgcaggcactggcctcttcttcggaataagcccgccatctggaataccttcattccctgcgcagaatccttatctctcaggatcaaacaatactgcgtccttggagcaagcctccctagatctccagcatacatacacacacgtgcacacacacacacaggcaggcacgcacccttctcggcagccacaagcctcttccctgggacctggctccattctccctgacctacacctgctgctcacaccctgccaggtcggcctttctttcctgcctgaggatgctgcaggccctaaggacaggccccatcatcttatttcagcgggctggtgggagatgatgccatttcactgggcagagtcagtccccctccatcaaccctcactctcctcaagctaagctcctcatgttatctgaacaagggttctgatcaataacacctaccttttttttttttgagacggagtcttgctctgtgcccaggctagagtgcagtggcgcgatctcggcttactgcaaccttcgcctcctgggtcaagcgattctcctgtctcagtctcctgagtagctgggattacaggcgtacaccaccaccctggctaatttttatatttttagtagagatggggtttcaccatgttggccaggctggttcgaaatcctgacctcaagtgatccgcccaccttggcttcccaaagtgctgggattacagcatgagctactgcgcctggcaataacacctactttaaaccaattctgaagacaactgcaaactgtgtagaaaaacatgaattatctccaaaggaaaatctcactcactcgagggggttggtttctggtctgctattaagcaaagtggtctagttgctctagaatcaggtctaacacaatctcttagggatgtagggcctcagttcattttagaaaacccagtatttctactagcgcctccacacgtggtgcctgaggaaagcagcctggcaccagaaccacagtgggcaccagaccacagcaggcagcctctgggctgcggggattctgtcccgccctctcacgtgtgcccagccagggcctaccggtgcctttcaccgtacttggtcttctgcaaggaacgagcagactcacagtgggggcacacgtgtgtagctgttgacaaggggcaggcgggccaggctgatgatgagttcctgagcaatggcgtgagaaacgccggcacgccgctattccttttatgacccaaggcaacaccgactgcagagactccaccatttctgccaccatctcacaggctgcagtgatatcttaggatctaaacaagcaacggttaagagaggactttttaaaaaacacatcctatatgccagtgtagaaagcatgacctacaaccagctgctcaagctgtaactgtggaatccacttgactctgagttggccactgaaggcctgcagattctaccttcatatccgcctataccataaattctccccattttctgctgggattgctggaatggtcctgaacctgagctctggccttgttcccagccctctggcccactctctgtgataaggccagcagcagcctgtgacagctggagccatcctgtggctcctcagcctcagacttcctttaggacacctcctctgcccctcgttttctctggtctcccaggacctgtgtctgtccctcagctagtatcaaagggccatgttgcatccttgcttcactggctttcctaggtcagagtgcttgaggggcttggggcatggttcggtgggcatggaaactcccaaggcagacgctgtggacacttcacacccttgggaagatcacagaatggtgtcttgagtctagaatatcatacctactaaaatatgatttgttgaggcatgagtgtgtattacgtggctattacccacaggccacgagattctacagtttgggcaactcctaggatagagaaggacttctcattggacttaagcaattaagccccacgctaacgagtggctttattaatatttttttttttttttgagacggagtcttgctctgtcgcccaggctgagtgcagtggcgggatctcggctcactgcaagctccgcctcccgggttcacgccattctctgcctcagcctcccaagtagctgggactacaggcgcccgccactacgcccggctaatttttgtatttttagtagagacggggtttcaccgttttagctgggatggtctcgatctcctacctcgtgatccgcccgcctcggcctcccaaagtgctgggattacaggcgtgagccacccgcccggcctattaatatttattggatgacctttaagaagtaacgtcctatcgaggtgataaaaaaacaaagaaagcttcccactcttgcctaaagagggccatggggaataagcatatcatcttcacccaaacagaacccacttcagggcccgttgctctaactcaaaccgccaagtgtctcaactgttttaaagcaatggaaatctaactaaaaatcatgatagcatttgttgatattcataacaagactgtcatccgttccaggtgctttacatggagggattaactgattgtttcaatccacacggttggcactattcttatcctcaccacagaagcacaggatccacagctgaggtgccactcggctggaagatgcagagtagggaggtgggtgttttcatattccttggtagcaacaagaaatcatgaaatcacaaactgaagcctgaaggacccacagaggtttggatacaaattcagagaagtccttggctgtgcattaaaatgccattgcttctgggtcatttctaattacaaaaccttgaaccgggaaccagaagagaaaagtactatgcagaagactaagacaggaaaactccatccacaaccaggattgcacaaaagcggggagaaaaagcccaaaacactggtgcactcatgattgaaaaggcgtgtttcctgagccacagagcatggaaaagatcctgatgctccaggtaagcgtgctgtgtaaaatgtgtggacaggctccaggtgaggcaccccacctctgtgggacaggcaacaggggccattccccaccagacactgggctaaagaagtgaagcaccccagcagcctaggggccctggcaagaacaaaagacacttggccaaagaatttcctcccaacaggcactgccaccattttcctagtaaaatacctactctagaattgggagaaagtgcatgaaaagccgtagtatatgtctaagtctataactggcttaaatcactgggtttggatttttttttttttctgtaggaaaagcggaattttcttttaaatatccaccaaacagatggctgaacctgacactgaggttactgaatactcatgtgggaaacatttatttatcattatcactcaacaaaaggttgttgcttgctgaccagaggccgagcattaatttctgaaacacaaagaagacaaacctgttccctgccctcaaggatctcagaataactgcagagtggggaagtgcggggggaagggagcgctcccccagtggcatcccagctggtctgtagggtcgagacagccgcatgtgtacggataaggtgttcactcggaaacaaaagagctggcaaagcatggactacagcctccctgacagctagggaggagcagcaggacacagcggagctacggtcgcttccaggagtccacactcaccgcggtgcacgtctctgtgaatgatttttaagtcctgaggaacaacatgtaagaaaaaaatgggtcctgagacttactctgtgtgtttggatctattcctcctcctcctcgctgatggcttttggggtatttgtccttctttctggactaagaactgctctccaggctgcactgcaactaaaattacaacagaacaaagagaagaatttctaccacttccatcagtgctttttattcaacattttacatttgtgcagcctcacaaaagttgaagggatagacagactagcctagattccttagaaccaattttagacaaacagacaatactgactgaggtaccaatctcttggttagtggtatatgtctgaagatttgaacttcagatttattcagatttctaagtccctcgactgtctcctgttggccatctctcaccctgaggttatatgagacggctcaagatactatcaaaatcatcactataacctccaagaagtctggctttaagtagtaatccctggatctttgttttcaagttggctacaaatgcacagatgaaaacaatatgaaacatgaaaacatcactctataacatttaatttaaaaatacaaagcttcaaaacccctctaacatgtaaactatgacgtccaattttttaaaaattgtggctaatgacccttgtgaggatactgttccttgaaaagaacaagccacttttattttacagtacgttaatattaaatgcagtataaaaacaaacattttaactctgacagaaaacaaataatcttctgaatgtatgttattaatcttatgatcatataagactaaatacataaaacagctaagaccaaagatacagagacataaagtttagaggtatttttgatgaaagctgaaacttcaaaatctaaataaatgactaaaaaagcaaattccagttaaattccagtgtagactccaatatattggagagaagagatggggcccagcccttcctgatgcatattttatctacctctccatccccaattctagcttagtacctggcaaacaggcagcacaaaataaaaacatggtgaagcagacaggaatatgataggaacccaccgttcatggacggggactcaccggcctccaggatgaagtgcaccagtagatgagggagcaggcgtgggtcacaaactctgtggaggagaccacgctccagagccaggcagctgcagggccaggcagcagcagtccagccctgcctggagatccagactcaggggatctgctcatggatcaaatgccaggacagggcctaaagggaagtaccgagtcacagatgcccactcgtgtaccttcgtttggggaagccgtgtgaatcacagttgtggaaccgtcaaagcactgaggggcagcgcgtccaggtgcccttgcccttccagaaggacagctctgactggctccattacattcagtcctgacccacctattccccaaagtgccagtcccctctctgcacaaagcccccttactctgctgcctctctctccttcagcgctgtgggctcctgtagaatctctcctgggctacgtggccaccaggccagaggctcttccttggggctcccacagcacagggcttgcctctgtcataggttgaatttgagagcgtgggttctagggatagcaggcctgggttcaaatgccagaatggctacttcctagctcagaggacctgggcaagtcactgaaatctctaagccttgctttcctcacctgtcaaatgggagtaacagagcctatctcacaggggttgtgagagtcaaataagatgacgcatataaagtatttcatcctgcatacagcaggcaataatataatcagcagcaatcaccctgtgctgtgatcacacgctgactttcccacttcccactaagctgaaacctgaaggacagggatcacaaaccatatgactccacgtggttcagataagggtgtatttatcattttgtgagtaatggcactgatgccctttggactcctcccttctttggtgtgaggtggaggcggagcctctgtgggtctgcaaagtgtgtccttgctgaggcaggcagcacagcgatggccctttaaggatacaggccagactttaatgcatccagaacggtacacattctgggggcgaattacaagcactaacacaaaccaagtaagtattccttggcgacatgtccaggccaacttaagacataaagtacttccagatgattatttttcatgtctcaaaattaggatccacctaacatggtaggtgcagatgagaaggggacctggctgacctcaaggccaccatgaggagtggcgaggtgagggtgaaggatggctacaataacttgacggtgcaagacttactgccaggctgagatggaaaagtgactggactggtcagagatcttgctttcaaataaaactgctttaccctcttcagtgtcagccccatgccccctccccacagcaacatgagctcccgagctgcctcttacctcaagggttgccaccacgaatttcacaatgtcctttctttctcaggaggaaggtgcaaatgactgggcagtttggagaccaccaccaggtactggccagggcccgggccagagtgggcagggactgatacagtgcagcatcccctgaaacagaggacctcgtgggtgggtgcaaacgtgagcacagatgcatcaacttcgaaaggcagtcaacaattctctgagaatctgatgaaagctcaagacattgttcctcagtggcacatctacactccgtccacaggactgcacgtggtttggggctgcatctcccctgaggtctggcccagcctcctcaagggcttagagccctatgtccatgaccatgtcaatgaatggcaaagtggcaaaacacaggaagaaattctgagccgaggacacccgtgctgctctttagctacctctgtaaagctttcaatgtattagatccactgcctttattgtacatttacttggtgcaaagtactatctggccctggaatgctttttaaaaataagataaattttaattttaattaccaaacagatattcaacttgctccagtaggccgccggctctgcaggcagctcgggctggaagacatgatgacagcagggagctgctgcacggtgccgctcacacgggccagagtcacctcacgggctgttcaaaaagggcactcttctggccaccagaaatttcactcatccctaggcttaagcatgagctagcaggcttaggttgaactcctgaaatcagagcattaaaggttaacaaacaataaaacagattatgagctttcaatcaggtaagaaaaacacaacagaaaaaagaataaggcaatgtttctgagaaaatacaaattggtataccatcaaaaatatttttaagaaaattctacttatgcctgttataaatatttgaacaatttcattcaacatatgcttagtaaaatatatattgttctctcttagtattttaagtaatattttaattttttatgctcttggatttgcttgaataaaaattttggtatgacaattttaattcataaaaacaaaatcaaagctaaagtgtcaccaagacctcagtgatacaccaaccaccctaaagtttgaaaaagatgttcaaatgcagcgaaatacgtaaaagtagccatatgaatgccaaaattttggttggaaaaatggtatttctatgtcaatttggattatgttttagcaacccttttgtttagccatttaaagattggtggcgatccttcaggtaaaacatctatcttagtttaatactcagaaaagcatcatgaatgccaaagttgaagctttcttttacagtcagaacttttacagctgttcaaagcccaattagcaatttggaaaacctaataaacagatcactaagcaaatttatcactcagtaagttagctttcctgcatgaatcttaagataaacaattttaggccgggcgtggtggctcaggcctataatccagcactttgggaggccgaggtgggcggatcacctgaggtcaggagtttgagaccagccggccaacatggtgaaatcccgtctctactaaaaatacaaaaattagccgggcgtggtgggcatgcctgttaataccagctatttgggaggctgaggcaggagaatcgtatgaacccagaggcggaggttgcagtgagccaagatagcgccattgcactccagcctgggggacaacaggagactttgtctcaaaaaaaaaaaaaaagataaacaattttagtaaatggattttgggcaattctcctgttgttttcagttgagctcttcagtacgtcagaacacactgttgtgttgcctccccacaaggtctcttttcatgaacacctgccgtcactcccggcctctacaggcattgtcctcccaggtgcccacttccctcccatttgctgcatatcaacgcagggctaaagcacaggaggtttctcccgtcctagtaggtctgagaagaagccctgcttgggccatggctgcacatacccaagaggtggcccccccactgctcacaggacctgcccacgggtgagggacaggacaccaaggctttgcatggcctcctagctctgcgcagggtgccctctgacatctggggtggggggtgaagaacctcactacatctaacagaggtgtgagtagaggaaatctcgctgcaccaagggtctcttttacgactaaagatcaacttccaagacactagaaacaagttattgagtcacgcattacgacactgtgttgaagtctacggcaaatacgcaaccttgacttccatttgtcttggccatggagcttagatgataacatcctgtgtttgttcctccagtggaggccaatagttctcatcccaaaccatacacccagccttggggccagctggatttcaaaacaacactccgtggattctaatgtggctgaaacaatgtgcttttctgtctcgatcagcataaccccatgtcccgaccccatctgaaatggagtcctccccacttcccggccccattcagagtgggtctctccgacatcccgtccctgcccagactggagtccccaacatgtgttgtcaacaaggggtcacatgatgatgagacaaatcccacttggaagtcacaagaaaagctgaggattcctgcctccactgctccccccgtaccgagttcatcatgaaggcattcatatcttcagcaggatccgattcaccagctctgcaccttccagcagtgcagaatctgacctggtccaacactggatttgacaagatgaacgtaccagtcctgggaagaaaaaaatggataaggggaacatgagggcggcgttcaaggggacttcacatccctggagctacaggcctaggccagtgcttgggacaccgcactaggctgagagggctgccggccggcaggctgtggctatacggctcaccacccacaggttttcccctttggacttctgttacctgcctgggcaccctcacagcctccccctcacctggtgaacttccaataggccttccaaatatagctaaaccactaagggttagcggccctttgccatcctctcctgggttgtctgctttactcatctctccccagcaaccagggcgggcaggtgcttagcgaatagagcctaagaaggcaggactgaaccttcgctttcttatattgggctgctggtttttgaaatctaaattcatattcataagctgaactttgtccaggaagtagagtaccaaggctctaccaaggctctaccaaggctccaggtggtccctaaccatgagtatgagcagtggaggtgctgacaacataccagaatggctggcagtggcagtgcaactccaggtggccagaaggtatgaggagatggagggaggctaacggcattgacatgtgcttgaggcctgtgcagtcaggggcctgcaggccacggccgactattccttgattcacccactaatactcaccccacactcctaccaaaagggtcccacatcagcactgcttggctccctcagacttgatggccccccacgtctctaaccacagcttcactgagccgagccgagcgccagaacccttgggtccacggcacctcctctgcactctctgtatctgccacaggtgacagaggcaccagcgccctgtgcctcccatgcagacacgctggacacttactttgtccggactcactgttccagtgacacgtgcccatccccgtccagcgggtgggaagagactggaggagagggactagtgagtcttgcatggtggagagacgaaacctgtccagcagggaatagagcctttggtgctaaaatacaaataaaaatgaaattacagtataatttgtttttttttttttttagtcttgtctaaactctgcacactaggattctagaaatatacactctaaggagatgcactattagggcttcttaaaggaaaatacacttgtttaaacctttttcttcacagctatcttctcatcatactcaaacaggtcatgatacaaatgcaggccctagtttacttttaagtatcacagttgtactccattaatattttccagaaatttcatttatactcaaacactgcaacaggcaataacagtataaaagctaataaaggctttcttaataaatgtaaaacagatcatctaagactcaatgcacaaattccactatcaaatatcccagtaagacaactgataggaattcatggtcattcaaaataaaatcacctcatctggcacaagatatttataatcttttaatctccctcattggactgaagactaagtctagggtcaaaaagtaataatagtttatctcccgccatctgcatgagagtgacaacttcataatgcaaattacaaaagagcttggccctacagactgaaaatcatcccaaactgtccacctaattgtgcccaatcccatttaaaaacaccatcaacaaggactctaaagactgaaaagcataatagacaaggtactctaaagactgaaaagcataataattttgtgtgtttttccttttttgcagtttcagctcaaagtacacagcatgataattatatctccttctctgctgtctctctctccctctcacacacacaatccctgccccccaccccgcccgcaagggaaggaaaaaggtaaaagtttaacttattctgcagtcatggaaatacactacataggagatgtagggatttctgacaaaggcttctcaaagactttgcaaacacaactaatgattaaatgctttgaagacataaaatggcaacaggatgcagatgtaagtcctgcatgcaaggattgagtaatgtctctcagatttgccaactcttgtttagcaattagatgacatgtttgattttgctaagataaacctgataacctattttcccactcatcacaggacagtgaaacaggcattctaaatgctacctctcaaacagccaccaggagtgcaaactgcctccactccgtcacagacgtgatcctgccggtcatcctttactctttagaaagtgagatctggttgtttaaaagtaggaaggttctattatggcacttctgcagtaaacccacctataaggcacatgatttcttgtcctgtgaatttattcccgtacaaatctatatcctttatatcctgggttgcctaacacaaggacgacctgtgtttccagcattacctctgagcgagcccgctgctctgaggtattcctggattctgttgagttcttccattggcaactgggccatgctgctctaatagcaaaaacacattagtgtgtttgtaacacctaacaacccaaaataacctcatgctcatttaaaaggatgaactgatgtgtacagttcatcctagtaagggcagactagaaaaaaatacagaaacagtcagatcggacacacgagtaacggcaagtttgcagatgtttccatgtttctacggtgaccatgtcaagaccatacttacggaggaaaaagccagccacctgttttgcttggctgctaaattttcaatataaatcaatatcagggtttctcttcccaatacctgtaaatttcagccagaagcatttctacccggcgacaagcaaggatgtcgaccatgcgagccagcacaggaaaggggtgcacagaagcctgtccacatacagcgtgagcacagctcccgactggctggatggatcccctccaagcactgaagagttttcttcagcatggttggctaacagcaagaagaaaagaacaaaagatgactattttgcaaatcagaaattaaagttaaaaatttcaatacccatttttaaggcagggaaaactgcaactggcaatagtcggcaggatgaagacgtacagtgaaaggttttcacaacgagactgaattgcctggatgaacaggccgctggcagcagagtccgatgaacggcactgatgaagtcctgtactggaggctcgtgggaaaggctgatcagatttgaatgtgatttacaatgagccacgttaagtgctcggagtcatggaggttctgacactaggaaaaatatgatgagagattcattttcaagtacacaagaagagaccaggtattaatgcatagaaaggccagaaagggtaagaaggagaaaacacatcccaaatataaacctcactaaaatatacagtgtatgagcacaaataattgaggaggtaggaaactcgatttaccaaggcgtcacctccaaccacgcactgcggcagaggctgtgtgaagttaggccccctggggaagtgggtacagcagtccagctctcagagacactaacaaatggccaagggtcaaaggacaaagcaggcctcagcgagatccgcaggtagcaggggcagcgttgcgctgggatgaccccatcccagcactgcctgccctctcccgggcttcgggccggctaagccagtggggttctccaattctctttttccaattttgtgatagttcagtgggaaaaaaagaatcccctatcactgccacgttttgacagaactgttgaatccaaaatatgaatggatcccacatatcaaataaatcttagtgtagatatttaagatttataagaaaataaaaatatatatttttaaacatgcagagcttttcatcttgattcataatcctaggcagaaactgtaaaatgtgatcaattccttgatattggttaacgattaatatttttcatttgggatcatctgacagtacaggttgaataaccctatctgaaatgtttgggatcagaagtattctgaatttaggatttttttcaggttttgaatatgtgcattatacttatttgttgagctccctaaatccgaaaatctgaaaccttccaataacatttcctttgaacataatgtcagcactcaaaaagcttcagaatttggagcattttgatttcagatttttggatttgggatgatcaaactttattaacttataaaattagtatctttttcttatatttctgtgaaaaacagcattataaattatattatccttaaaagtagaacaaatagaaaaactacttcaatagagaaagtaaagcaaaaagtgactattaataaattgtctcaccagaaaaagtctctaggataacacctctttcagttggagagtcggcttccttttcgattcagaatatttaacactgttttgctatgtgacagtagtatctataagataccatgttgtgacaaagaaatgcatatgttttaaatatttttaatataaatatagaaaaagtattaatctagaccaaaatctaacagcaagttatctctgagtagtatgattacaggaggttttatttcctccgtttatttgtttttttgtaaattctccatggtaaatatgtgatgctagtttatggttaaaaactcccacaagttatttttttttctttaaagagaacggcatttaaacagaatccatcataaaatgtgacaaagaacatctaacaccttttctacaaattaacttaaaaaattattttagagcaggggtctcgccttgtcacccaggccggagtgcagtgacacagtccagctcactgcagcctcaaacttctgggctcaagcaatcctcccttctcagtctctcagtggctgggaccacaggcatgcaccaccacgccaggctaatttttctttcttcctctcttctttttttggtagaggcagggtttctctgtgttgccaggctggtctcgaactcccaggccaagccatcctccgccctcagcttctcaaagagctgtgattacaggcacgagccaccaccttggataattttttattttttatttttttagagatgggtgtctcacaccatagcccagcttgtctcaaactcctgggctcaagtgatcttcctacctcagcctctcgagttgctggatttaggcataagccactgctcctggtattaatttttaaaaaaatttaaaatcagaacccactacagtcaatgcacttactttgttttttaaatcattagttattattattccattgctccctcaaattaacaaacatacccagcatcatgtaggcgtgagccaatagccgggcatttataaatgagtcagctgcaaaaactctcacagtccaacttagaatccagtgactggaaggcaggcctggtctccaattatatgtcacagcagaagtaaacattcattctagatttagttcgatggagcttggcaggacaccgggcggtctgggttccagagggtccatgcaagtgtcactacacaggatgttctcctggtccccacctccctcaaccccgtttacaggcatttcaaattacgacataatcacagaagagaatgagagcccctcttcgtactatttctctattgcacttccaagtttggctgccaagtcagaatcctcctcttctccagacatctggggactaagtactttgtgctggacagactgtgtcttctagaaggagcaacagatgcattgacaatgttttggatggcagtgagcttatttgcaaaatactgaagatgattatgtttaattctagttctaaacagacaagttgttttaaatattgccatatcagaatgttgtatgtgtaatatatacttcagttatctattcctaagctacaataaaccacatatgaaaaactaaagaaaacagaattaacaggcagaaaattaaaatgcttgcctgaatagcaaaatccaccataaagctgcacatcaatcagcacctttatttcagaactcacactggctatgtttgataattgagcaattgctttgaaattctccatctgccgtgaaagttgccaactgccagaatgaaaacctccctgcttcatgttttactgttcgtttcccaatgaaacatcaccactctaaacatgttgatgttatcgttatggaaatcctgtttaaaaacacttcttccccactaacacaggttatttcactctcactgacttctcactttattgtttttttctttttgaatacgtgggaattataaaccttggactcttggctctagtccatacagttaaaatgttgacacactcccaaactgcccctctgccttcagggtctgaccgagcgacgtccttcccattgcggcaaagggccttaacggggacgaggtcacatcaagctaagaatattctgaaatacaacaacttttcctgtaatccctcagatttagaagagaactggtaaaaaccaaaattctacagatttaaactttttaaaaagtgcttttctctgtttcccaactggtgaagtgaaaacaaactacagcctagccatacaatgctagcagttgcaaggagcgagccaccgacgcgtgggcaacacgcgacagaactttagacacgctcaccgaaaggggccagactcagaaggctgcacaccgcgtggttccgtttctttctttttccccagagacaacgtcttgctgtgtcacctaggctggagcacagtggcacgatcatgctcactgtaacctctaactcctgagctcaagtgatcctcctgcctcagcctcccaagcgctgaactacagggacgtgattgtaatttttaaattttttttttctggagatggggtctgctaggcagcccaggctagtcttgaactcccagcctcaagtcatcctcccacttcagccctcaaaatactgggattacaggcatgagccaccacacctagcctatagattctatttcttggccttctgcaatgggctgaacagagggacagagcacggattggtggttagacctgggaggggcaggatgtggcagaggaagagggaactgtttgaagtgacagcactcctctatatttgatgtggttgggggaggggggctgttactgactacagttgatagaaaagtacattttctgtattgtaaattatgtgtcaatgtgaaaactaacgaacaggaaacgtgccctttctcgtgggccgtcctgccagcgcagtgtgacttacactcaagctgtaattgtgcactttgcataatacagctatagggtaatgagcctctgaaagagaagaggcagtatttgcaattcaaaatgagcagtagacataaagaaggtccactgtcaactcaaattcagccccaatttgtagcgcacaagcccccccaaatctcaggccatacaccgcccggtactggtggcgaatgaatgtccaaatctagggtgactcagaacaagatgagctgggaagtgaccaacacatcatgtgtacacaacacacccacaagcgccaaagtataggcaggactctaacagttcaccaagaggtagacagattgagagtgaatcataaacccacagtgacagagtccataagagaggggctaggtagggcaggacccacataaggacctcctggagcagagcacccagtgtcgcctggagccactcccatctgggagccagcctgagaggagatgcacacaaaccgagagagggtcaagagtagcagcaggaatttctgcaactggatacagcaattttatggctgctgagtctatggctaaaaaagagcagctgtgttttgtatttcacacttctagtaattcatttttctcatctcatgaaataaaaagatactcatcccccaccacccacagctggaaaaacacagtgctaagagcggggtttaaaccagaacagctctgctctctatgggcatcttggacacttatggggatttttttttccttccaccacggggacaccttagacactcacatgcttgttacatattatcttattttacctttacattaccattaaagaacgatattttttgaaatttaattattaggttaaaatccattgatccattaattttttttttttttttttttttttgagatggagtctcacttgtcacccaggctagagtgcagtggcgcgatctcagctcactgcaaccttttcctcctagttcaagcgattctcccgcctcagccttctgagtagcagggactacaggcacctgtcacatgctcggctaatttttgttattttcagtagagacagcatttcatcatgttggccaggcggtctcgaagtcctggcctcaggtgatctgcccgccttggcttcccaaggtgctgggatataggcatgagccaccacgcccagcctaatctattaatgttatttcaggataatagaagaacaatacagaaggttataaaggaaaactggatcagagggggtcacgaaacagtcacagatttacctacatttacaaaaagctgtagtttgccctcagagggctgaatgaagacgcttctgaattccaaactaaatttacctttggtttatttcttttaaacactcatcatctaagctttctgttactccaattcaggggacacaattcccagattcagagctttctgatataacacagagtaagcaggcccatctgtcagaaaaggagtgatctgctgaatccgcagctgattttatgcacgttaaagcagcacagaactaggagacactgactttctgtctcctgcccccacgtgctcagtcatcgtaacaggcctaagacatccaccaagcatttcaaatgtcgtcactgtctgtctcctccaacagaatgaccagaccccactacatacggcacagagtggatggttagaatgcctcccaacagtggactttccagctgagtgccatgaactggccctactgggagcctggcagcacaaggtccagtatccatactgagcagagaggcacggcagcacctgccctctttgtctccagaacttcttttccccagcgtgggatcttgagccttccagaaatactgtgtgaggattcagctgggcgggggccagggttgggggtggtcacagcttttatttccatactatacaaataatggagtgttggagcacctagaaatggagcttaagcctgaaaaccttttcaaaaagagggccacccataacgagaaccttagtaagcctttttgaatggtaaaataactttccaagaggttttgaaatttgctacactgttacttcattatctaaggataaccagaacacatttactttataatgaggttaagacattgcaacatgtctggctatggaaccaatttaggactagaacttagtaggagccacagagcatgacaagcatatcccacaagatgcaatgtgtcaaagaacctgccaaagaaaatcgcatttagaaagcaactgctattttgaatgccttagctggaccgcatgtttgtcccaataatatgctgtccatgaaaggaatattaatatgcgcagaaatttcacaagccctcacaaaaaatggaaaatgaaaatgctttaacggtggccaagctcaggttactgggagtctcaggacagggtgctgggctggcgccctgggctgtggggattatgaacctacttcggggtctgctgcacttctgcccaccagcggtagtcggtgtggtgacaagcagcagtatctgacaccagagcagcaccagggccgggtgggtggtgatcatggacgagcccgcaagttcaagctgtccagggtgtagaaactgccgccacagccatcactgcgaacagcctagtggcagctgctgtgattctccggaacattcctagaaacaaagttaagggaaatgtctttgctttcatctcggtccagtgccacatggctacgcgaagattttacataaaatgaaacaggctgagtcgtctcccatacttacgtattcagaacacctggcatttagaaattctgatttttctaagcagaaacagatatcctacttttttttttttttttgagataggttttgctcttgttgcccaggttggagtgcagtggcgcaatcttggctcactgcaaactcaccttccggtttcaagctgttctcctgcctcagcctcccaagtagctaggattacagggcctgccaccacgcccagctaatatttgtatttttagtatagagggggtttcaccatgtggccaggctggtcttgaactcctgagctcgtgatccacccgcctcagcctcccaaagtgtgggattaaggcgtgagccgccgtgcctggccaatatcccacttatttaatggactggtaagaaagctagcattcctcctctctcactgtcgacctccacattggtcggcaatgccaaccctccaggagctccaagccaagagctgcgaaagtctgaacacagctcctggagaaggatcagggaacactcagcgcctcgaatcactgcactcgggccacagcggggcccccacaggctgagccacagctacacaggcaggaacagcactcggcacctgccaaactcaacagctccgggcttgctaaggactgagggacagaaatgctgaaggaggccaggtgagaaagcaggaccccctgcggtccaggctctgtgtgccctctgcaggctcctgacacctgacagccaagtgcctctgtgcccggccatggagcatcctgggcctaggcaggccaagcggtcagcctcccccacacaatgctggcacctcagcaacacactcagctagattctaccggcaaatttctccaagcatccttctcagggctccaggaatcatgacttcattctatcctctcctttggataaaaaggtcaaaggcacagagacatgcacaggctgcaaagcccagcagggagaggcagcaagcttgggaaacagagaaaggcccagctggccaaggccaccctctcccccagatctgggctcctggcatcactgttgggatcaaaattttatttctgatttaaatttcaggccgggtgtgtggctcacgcctataatcacagcactttgggaggccaaggtgggcagatcacttgaggtaggagttcgagaccagcctgaccaacatggtaaaaccctgtctccactaaaaatacaaaattggccgagtgtggtggcgggtgcctgtaatcccaggtatttgggaggcgggagcacagaattgcttgaacccaggaggcaggggcagcagtggccaagatcgtgccactgcactctgcctgggcaatggagcgagactctatctcaaaaaaaaaaaaaaaaaaaaaaaaaaaatcacacatccccaaagtgaaagggtcctaaaacaggtaaaaacagagtacaggctttttaggctccacaatgccttaaactataacctgagaccaaggaagcgagctaacagaagcagcaactcagagaatgcagaccaggtcacgacgaggagttctaatgccttgtctctggctcctcaggtttcctgggatttctctacacttgcttcctggtcagcattgtcccctccagcccatctgcactggcctcatccttctgtggggccctctgttcctgcatgggccccctgagtgagaggcatgcactgccttcaaggaagatgcagccaggccacagagcacgtgcagggacagcccgggatgtaggggttttgaacaggtaatagaaacccacaatccaagctgtgttctagtggctgagtgtcaacacaggctctgaatcagactgcctggttcagatcgtggctctacttctactacctgggtgaccttggatgcaccttacctggggcctcagcttccttaggtgtagatggaattaagagcagtatctgttcgcagggctgtaataaggagcaaacaggagaaccaggtaaagggctcagcactgcacaaggcatggaggaagtactcagcccccggggtggcactgctggagcctattagggaagttcaggtggaagatgagacggactctgagggccacctctagtagatagagaggaggaggtaaggttagggttcctggggtagcgggaggaggaacaactatgatgctgggattctgaacatccctaatgatctaattaacaagaagaggccctgggagtgacagtggtgctagttcaattttaagtgcaagtctgaggtactggcaggacaagtccgtgtcgagaagctggatgccaggactacaaggaccagcaagagaaagttgtccatgaagcaacagccaaggtcacaaaggggatggacctaccaaggccaaggagagaggcagaaaacagagaaaacagtaacgagagaccatggacagcaactcgaggaacacaatcaattaagggctagacagagaagaccccacaagctactgagtgacaagagggcagctccacagaatcagctggagggcctaggatgagagagacctagaaagaaagaacacaggcagcctctgcaaggcctttttagtaaagagggcaagaggcaggctgccatggcttgagaaacaagagggaacaaaccaccatgggcaatgagaatggagtgtacacagagggagggacccctcatgaaggagcaggagggcacaggaagtgctggtttgtttttcatttaaggctggcttagtgtggctttaagtgtaaaagagcagctacaggcaggaaaggaaaggtaagacatacatgtttcgctcggtgaagtatgcaatggatttttttttttttttcagacagggtctcactctgtttgacagactggagtacagtggcacgatcacagcccactgtagctttggcctccggggctcaatgatcctcctgtctcaggttcctgagtagctgggagtataggtgtgcgccaccatgcccactaatttttgtattttctatagaaacaggatttcaacatgttgctcaggctaatctcaactcctgggctcaagcaatctgcccaccttggcttcccaaagtgcacaggattacaggtggagccaccacacctggcctgcaatggatatttttaaataagcatcaaaggcaaaattcattccagagaatccagaaggatgtggcgtcaggaagcagacataagaggggccaggaagcggcaggaggatgaggatgaacttggggacaggatagaaggtcccctgttccgctgggatttatgaggaacccagggtcccttccaggtggagggaggaacaactggacagaggctcatagaaggattcatcactctctctgcggagagcaaggcagacacctgctgggcatggtgtggcatatcagaatagcaaaagctttagaaggcatggcactcgctgcagctcattctgaagcaccactaatcccatggtgacacccgcctggtcccctccttccaagggtttccctgacttcctcatcctggaatcacctgtttttatcctcacagaaaacacatcagagaccacagtgtgctgctgggaagcagcaggacgacgtctctcagtccccttttacagggtggggctgtgcctgtcaccacgagagaacaccagcaaaggcatgcctgtcacttatccaaggccacaaaccttctttaccttccctctccttgtccccaaccagacacagaggatgtgaaggcctggaaacagaaccaaaagaaggaaaggagcctgggtccccgaattcccacatggaggaaaacctccgtgaaccaagaacaccctcaatacattgtcataaaaccaagaaacaaccttctctgtgtgaagccatggaaatgttggtttatttgttacagtagctaccattacctaacaaagaaacagtggcactgagaacgtggctgagatgagaagatgcttctcggtggaacctcccttctagggtcccgagtagtgatgagcagcagtctgagacagaaagaaggcagagcctgtggtcacaagggtggcacaggggagccaaagggactcgggggaagagaaagggaccaagtgccggagaccacgatggcagtgcaggaaaggaggcgggcaggaaggcggatgcaggctgcaccagagaaacagctacagctgcacgcagcagctccgcaagccgtgtttttgtgagctaacaaagaaatattaaaaggaacaatggaagcaggaattggaaataaagaatgctgttttcaaacaggcaggatgtgggatcgcatcccaattccaccatcgagagctcctagggcagaacctctctgggctgggcttgttcagctatgacacagagagaaccatctcttctccacgcccacagtgactggggcccatggtgggtattctgaaagtggcagcggctacactcaccacttcaacccaagaagtggcctgatgagagaaagatcgatgggcaagaaagaatgcttgggtttcattcttggttttggcacaggatcttttagaacttaagcacaaagcgggaaatacttacagagcagttctaagaattaactgggataattaaaattaaacctaccacatacccatggaaaattccattgctcccagcattataattgttagtagccctgtcctttccccaagcataacttgaatcaatgtcaactttattactatagaaaggaccactttctctctcttccagtttcctgctttgccccaaaaagtggaaccacagacgctttggaaaggacagggaagagcttcgtgcagccatcccctctgccacagaggaaggggtgagcatgcctccgtgagcgtcatgcacatctccaccacccacgaccaggactcagggaggaaggggcagcagctcctgccacctgactgggtatagtctggatggcaggcagggaagagcacaagatgtgtccttgaaaatacggtgagcaaagctggaaggccgtgttgaggctacaaggccagacagctctaattcagcacatggacaacaaacaaagctgatgtttccacctcctgggcctctggtgccatcatcttttctaaaccagtctatcttggaccaaaagagagggatgctggttaccccaaatgttgtaacaggaggacagctatctttcttggctattctgcttatcctagatggaatgtgaaatagcaaaccactgtgggatgaataccctcctctcccaacaagaggaaaagcaggaaacaaaagtcaagggtgccattctgactagttcctgaaccaggtattatttaagaagtacccacgctgaaatggacaaatttaaaggtcttcattttcggtttatgggtggaattcatagccttgtttaagcagtacgtgaatacatattaccaattttacatgctaaacacaccttacttattaaaaacacgagatgaattatttcaactcttatcttgaaaccaatcaaatacagtaatttgccacctagtgtctttcaaataaatgcagtcaaaggaaacaagaagacagaaacacactttatatatacacacacacacaacttacttgcaaatgttgggcagattaaataaggtcaaagataccagcaggaaacccacgtgccctctccaagccctccactcccaccagtaaagcgcttctcaacagacctgcactgtctcatacaggagccactatccacacagagctgtttaatttaagttaattaaaattaaataaaattataaattaagctatccaatcagaccagccaatttcaggtacagaacaccacatgtggctaaaggcaactaaattagacagtgcagacatctgtctctgctggaagtcctattggacaacacttcaacagtaacaatattttgcctcaatgtgagatggaaggagaggaaatcagcgcaataagacagtgaccacatttgagctgcacgagatcgctcggacatgtagaaggacacagaacacaccacccttatcccacaaaggcaaactagtccttagaaatgaggctgtctcctcctggcatcaaatccaaaccaactggtggcaaatattaaaatgaccaacatactaaaattgacctatcattcattaacaagccatatttctcaactttaaacttattacagtggtcagtgaagcataatccgaagatctttaaaaagaacaagaaaattatttcaataatagcaagtaaggctcaaaaactagagtccactatgaaattaaattttggccatggcctgtgcggagggtgacagcagctgaatgcagaggccatgaaaggcccctttctccaggattctgtggcgccgtgcggccgggccctaccggcatcctgccgcctgcctgtactctcagctgctctcttgggtgccggaactcttctctgcaaaaagctactacttctctccctcagaaatcctgcctctgcctgcccacccatttcgtctgtcactgcctactgttcttcttcataggaaatatcaagacttgtgatactgacgcactgactggaagtccgtgcaggcaagagccaggatgctcaactgaacttggcacaaccagagcctgctagctggaggcgggccacgccaagagtatcctcaaatggaccaaggctgaaaatgctatctttactctaagatatgtatgcaaaatgtgtacaaaaatccagtaagagaaaggagctttgatacaaaagcaccctgctcccatccctttttaaggcaactacttgttatcatttctgttttagttctggtagttacctccaaaattctaactgctgtgctgctatcccttgcagcagacctcagttactgcatgtgctcctctcccttactcccggagaccagccccacctcctcatcatggaatgctgtccagtctcccatttggcccatgtggaccagagcattcaggggtttatgtcacccatattactcatgcaaggccaatcacataggcctacttgaggggctgagaacacgcctgctagaggtcatcttcggtcatgtgaaaacagcccaccagagaacaaaactaacaaggaagcagagatgagactgggcgtggtgggtgacacctataacctcagcattttgggagcagaggcaggaggatcgcctgaagctaagagttaaagacccgcctgggcaacacagcagacttccatttctacaaaaaaattttaaaacctatccaggcatgttggtacatgcctatgtctcagctacttagaaggctgaggcaggaagaactctagagcccaggagttcgaggctgagtgagcctcgcactgcacttcatgccactgcacttcagcctaggcgacaaagtgagacctatctttaaaataaaatttaaaaattatataaatgaaaagaagaaagcagagctgagtgcataaatatacaatgcagaccacagaattacaacactagatgcagtcctaccaactaccttgcctgcactttccaggagcttaaaccaacacattctttctcttactctagtttaactggggttttatccctgcaactgaaagactgttgaatacaatcaccacatcataatttgcatgatttatagacttcagacaactttagacatcacccattaactctaccgtaataaagtgagatttagctcatttatactacctcctaacaatctgaattacatgtttagttctattggagacctctgaagcctctatattttggtctgtcaacttcagatgatgtaaccatataacccaacaatgctaggtgaagattttagttccccttccactccccacctctatctctacctctacttgccaaattaacttggttagttttccttttatattcatcagaaccgaagacatttcattctgttctgaaaccataattaagtcagtaagtcttcagtgtttcagtcatacatgatttcaaaaatgaaagctcgggccgggtgcggtggctcacacctgtaatcccagcacttgggaggccgaggcgggtggatcacctgaggtcaggagttcgagaccagcctcaacatgagaaaccctgtctctactaaaaatacaaaaaattagccaggcgtggtggtgcatgcccgaatcccagctactcgggaggctgaggcaggagaattgcttgaacctgggaggcagaggtgcggtgagccgagatggcaccattgcactccaggatgggcaacaagagtgaaactctgttcaaaaaaaaaaagaaagaaagaaagaaagaaagaaagctcaagcagtatttacattatactatctgaatctagttcccaagagagccaaggatcctagaaggatggcatctctttcttaggtctttgatcgtgactcctaagccgcttaaaggagaacctttttaatatcaagggctccaacagatcaactgctgaacaatcaagccacattttggtttgcctcatatttggacctgacttaatgctgtttgctgttactagaaattagaattgcctttctattttcttgagagagaaagacgtgcctatcccctagaactaggcttctagctatttagtcatttatttaaagaaagcattctcattacaaacgatcgttcttcttggaaaacacactgtcctaatttggacggctgctttccatgcttgctgcacagctggcatcttatgactttcttgggttcactgtcttgtcattttctttctctagagacatggtctcgatctcgcccaggctggagtgcagtggatgatcatggctcactacagcttgacctcctgggctcaggctcatgccactactcctggtatttttttttatttttttatttttgtggagatggggtctcttgctatgttgtccaggcggtctcaagctcaagcgatcaccccgcctcagcctcccaaagtgctgggatttcaggtggagctaccatgcccaaccttcaccgtccttgatcatttgtaaaagtaacaaaaacatctggcctccaaatttaacacaggaggaggaagctctcaggtttacttttttttttttttggtttttttttaataagaggcagggtatcattctgtagcccaggctggagtgcaataatagtccctgcagcctcgaactcctgagctcaagagatcctcccacctcagcctcccaagtagtgggactacaggcatgtgcccaccatatctagctagtttttgattttctttgtagagatggggtctcgatatgttgctcaggctggtcccaagctcctggcttcaagtgatccttttacttgacctcccaaagtgttgggattacaggcataagccactgtgattggcccatcttaacatttttggctcttgtcttgttttgttttgtttttttgaggcagggtcttactctatagcgaggctggagtgcagtggcatgaacacatctcactagagacttaacctcctgggctcagcgatcctccagcctcagtctcctgagtagctgggaccacatgcacaccactatccccgctagtttgtttgtacagatggggtcctaccatgttgctgaggctggtctcaaactccttgctcaagcaatcctcctgccttggcctctcaaagtgcttggatttcaggcatgagccatacacctggtcctcttaactatttttaactgtacagttcagtagcattaagtacattcatatgttatacaaccatcaccaccattcatttctagaataactctcttcatcttgtaaaaaaactcccctcccctgcagcccctggcaaccaccattctactttctatatctatgaattactactccaggtccctcatgtaagtggaatcacatagtatttgtccttttgtgactggctatttcatttagcataatgtccttaagggtcacccatgttgtagcatgtgtcagaatgtctttttttaaggctgaataatattccactgtaaatatacaccagattttgcttatccattatccatcgagggacacttcagttggttccacattttagctatcgtgaataatgctgctagaatgctggcatgcaaatatcttttcaccaccctgctttccattcttttgggtatataccaagagtggaactgctgggtcacatggtatcaggtgtactcttacagcaacaaatatttcaactggcacactgggcaaggcagagtttctaccgggcagcacagctcctacactctgaagtgtatagtgcagaatggggaacgagacactccaggaagactaatgtgattcacctacagacttgaagatgtggatcagacacattagcagtgtgcctagttcctggcaatagaaagatgttgctgctcactcatttccaccttcagctgttttgtaacaatgtcttctaaaagaaaccaaccagttgtaatagaaaccttccaagaaacaaaaaagatgacagtgaattaggtgctactataaagcacttacgccaagtatacatgaaaagatatatggtaaatataaagtaaaatataggtagagtacattaaccgctaaagtgaaatgcagagcgccgtcgccgtggacaagtcacttggtctctctgtgtatcaccttcctcactgaggatgaaatggcaggtagcattttttaagctttgtgaactgtacaccattacacaaatacaagctgatcatctgtcacagaatttaatgtatcatcaattttagccagctgcttcaatgcgacacagggaaagccatggctgcctgctgaacctgcaaaccaaaaggtgcccagcaggcttactgggcttatctccttgacaacacagggcatctccactgatgacaaaccaagtgaaggctgcatgaagtcacagcacttagcagaagcagcacatttgcagaagcagctctaactcagtgaatgctcagaatctgcaaaggtggagagggacccatctaggcagcaagcacttacgagtgcctcatcactgtcttggggagcttccaaacaatttatgagggaagacaggatttgatactacacgtatttatggaggcaggctgccctgcagggagaagacttttattactgacagcgtgtaaaactgccacacatggtgacaatctgagactcacttttactggcttctcttgggtttcaacttccctgcgtcagcgtgcccctactgcctgcccccaggacagccaccccactgccctgccctgcctaggcgagccactgctgtagcatctctactgaggacaagagacagaacatgacagaacttaagacaggtatgaaccaagagccatagataatgcaggacggattagaaaattacactgaacagacttctttacccaactcagaagtgaagcaagaccaggtattattccagacttactactgtgaaacatcacgtgacttcccaaaaggcatgggttagttataggctcagatagaagcataccttgaaaatgtttcttctggcaaattctttatttgtttcccttcactgtgttctctagcgttgaagtactgtccccatctcttaacctattaattactgtacaggagattaatacggagagaaggagagctcctgaatacgagaaagaacaatatcttcagttgactgggaatcagaaccctcaaaatggccagaattcccgatatccacagttgaacagtgctcacggagcctaaaataaacataatacataagtcacagctgaagaaaaaaggaagattaaatttccccaattgccaattttgtgaaagaaaataactcctattttactatcctaccaataaaccttctatcactgagtcccaaagtgtgctcccagaaaagcaggcattagtttcacctgggaattgctaaaaatgcaaactcttggcttggtgcgagagccacctgtaatcccaacactttggaggccgaggcgggcggatcacaaggtcaggagatcgcgaccatcctggctaacacagtaaaccccgtctctactaaaaatacaaaaaattagccgggcacagtggcacgcacctgtatcccagctactcgggaggctgaggcaggaaaattgcttgaacccgggaggcggaggttgagtgagtcgaggtagcgccactgtactccagcctgggtgacagagcaaggctccatctcaaaaaaaataaaaaggccgggtgcggtggctcacgcctgtaatcccagcactttgggagctgagatgggcgggtcacgaggtcaggagatcaagaccatcctggctaacacggtgaaacccatctctactaaaaatacaaaaaaattagccgggcgtggtggtgggcgcttgtagtccagcaactcgggaggctgaggcaggagaatggtgtgaagctggaaggcagagcttgcaggagccgagatcatgacactgtactccagcctgggcgacagagtgagactctgttccgcacacccccacaccaaaaaaaaaaaaaaaaaaaaaagcaaactctcaagaagccctacccaactgactgactcagacattctgggggtggtcccagtaatcagagcctgaacaagccgtcagattcatctgctgagccaggcgagagactcaccattgtgtttggagtgacgaacatacccgtaaaagcatgtctaccggacggagggaggaaggggccaaaatctcaaataatgtattaacactccaagggcttcatgagagtcaatgtgcatctgtggaattagacaccacaaactttctacgtaagccaaaagaaacgacagcttcctgtacaccagctatgtaactcaagggaaatcatcataatcatctcatcgtcaccttccctcatttaaaagcattttaagttcagtgtgaaccaagcaaacatttttacaacaacactgtatagctacatttttcccataacagaatcttgtcatttagatttttattacataaataataaatgctttctgtaaaagactcaaaatacaaaagtgtgaaaaaaaatcaactagcactgcagcaccctgacacaatcattaccacattttggggaccagtcttccaagcgtccctttgtatacacatacatgggatggtgtgccttttttttttctttttctgcactccatccctcccacaacagttgtaacaaatgctaagggtgtgtgtatatccctttcttaatctgccccatgttcctatagccatatccttgcccctcacccacagaggttttgttttagttgttttgaaaaatcataaacgtctctgctcttctacttaacccagtgcaatggagaactcccaaggcaactggctgaacttcctttcttccttctccctccccttcctcccttccatttcttccatttatttccttccttccttcctccctcctctctcttctttctctctctctctttctaacagagtctcactctgtgccccaggagtgagtggcgcacgaatgggctcaagtgatcctcccacctcagcctcctgagttagccaggatacaggcgcacaccaccacacccagctactttttgtatttctagtagagacagggtttcccatgttgcccaggctggtctcaaactcctgagctcaagcaatctgcctgccttggcctccaaagtgctgggattacaggcatgagccaccacacctggccagaacatttttaatcatcaaaatagcccaagctaaaatagtctaagcttataccacagtgtgttcaaccattacttttgatggtgggcactgactgtttccaatttttgtttctactgagtgtgtatacatagtaacaactctgcaaacagatgtggtgtttttcaaggcacagatgtgaagctcacaacactgccacatcttacaacaagggaacaactgacttgagctccaggattcctgcatcctggacctcgcctgtgctcaccaactctgcctcctccccagcaactctgggagaacccacagtgcttgtcatccatgcagccaatcctaacccatgtctgtgaacaccacaacggcgatttgtgttcctgtgtcatgaactgatcctccctgttgcttctgccctcagtgcgtaaacaggccttatttctgccaacttaacccattgccgactcctctcctcctctggctactgccctatttcccgttccctcttcaagtaaaaccttttcccaagtctctctcctgtcctttcaggaacacttcccattagggtttggctccctttgctcctccaaaagcactcatcagtgccctcggtgtgccaaacctgggccaagttcccaaggtgctgacagcagatgtcgccctcctgcacaaatgccttaaaaaaaatcttggctttaggaaccccacacctgcctactccccctgccccagactggctcccctcacctacctgaccttggagctgggactcagcaggctcggtattcaagtcctcctcctctccagccagtctgggtccactgtgagtggacatctcagatgctgacccctgccccacagtctctcgacaactccaggctcatacacctgatgctggcctcacctcataggcacctatggggtctcaactgctacatccagacaggctctgacctcctgctgcccccatgtctgccctaccttgtccacagccaccctgtcctcaccctgaaatcacccccaaagcctgctctctctcacatgccacatctaagccaccagcaaaccttgctggttttgctttcagctgccaagggatgctgacttgggccattccactccagtgccgggtctcacatgggtggcctgctctgccctcacctccccctcaaggctattctcaactcaggaataagaatgatccgctaaaacctacaccacatcagcgcaaaccctctcaaggctcctccacactggcctcacccaccaggcctcactcccttccctccccatggctgccccactcctccaccctcattgctgtaccctaacagcatgtccgccccccgccagggcctttgcactgctatttgctctgcctgaatgttccttccccaggtatctcctaggcttgtatctttcctttctgcaaattcactcaatgtcaccagatcaccaaagcttcttctcatcaccagctgaacaatgccactcccacccagacaccacctaactctcttccctcctggattcttctgtacggtgttcctgatcagccccatggtatagacttcactcacttgcttttctattgtctgtccccttacccgcatcccacaaaatcttcactccaagaaggcagggggtctttctttaatctgctttgatcactgatgatgcactgccagtaacaggatagtatctagcactacttctgaatgcaacatgcacctgtgtgagctacctggcaggtgctgcactaagcgtttcataaatgttgtatcacacaatttcattgcggcagatattaagtcaggtatttactatgtattcaggccttcgatctccactctctcagattacgcacagaaaagaatgggataaagcttccagggcaccattctaaaaccattgtaggcagggagaccctgaccacactaaaactgctgtcaatctcaccagaagccaagaccctgtcctgttgtctaactggtctcaagataacattccattatgaaatcagaatggggtgcagtcatgaaggcagtaacatcaatatcacatgcctctaagtttaaatcaaatgccaaaaccacggactactcgtactatacagagtagttgtttattgtgtataatcaagatgaaaaacatgtatttgctgagtccacttaaaaggcaacctcaagctgtgccaggcagctcatagattttctggcagagctgcctcaaggaggtccccaccacccttctctgtgagctacagggtgctgctacactgggggcacagtggcctgtgcctgactgggggcaggctgcttctgaactggcactgccaggccatttccttccactgcagttgtggaaacaatgattcatgtcattgatcatagaaattctgattagtgatgaataggccaggcgaggtggctcacacctgtaagccagcactttggcaggccaaggttggtggatcacttgcgcccaggagtttaaaaccagctgggcaacacagcgagacctcatctctactaaaaatacaaaaaactagccaggcgtagggtgcacacctgtggtccttgctactcaggaggctgaggtgggagaattggttgaacctggaggcagaggttgttgcagtgagattacacgactgcactctagcctgggtgacagagtagaccctgtcggaaaggaaaggaagggaaaggaaaggaaaactgctaaattacaagcagaaggtaacaaaaacaaaaatctaaccaccaaataaaacactgggttgaccagaatgcagaggcagtgtaggaggtaagggttcgggctttagagttagccttggcccgccctcaccccgcactctaaagctgtgtgctgcctgatcacctccataacctctcggagctgtgggatccccctgtaaagtaggtgggcaataccaacctgagatggcattgtgagaagaaatgaagtcgctgtcccatgactagcacggagaactgctatcaaggcacagattaggactgaaggaaggctgattccagccacccacctttcacaaggaccttaagctaccatcactatgcaacaacagccaaggctgcggggacaaacctgctgtttggctaacattgggaggatgatgtcagcttctgtcgagacagtcgcttccacttgtcttcattctccttgtggcactgctgcaggacagaatgaacatctccaacacctataagagcgtgcacaattagaaagtctgctgccaagagcgcctttccacccctacgtgtccgtctgttatacttgtcccagttcagctggaagactcaggatccaaacagatgtgatcccagcgaggacagggggacactaatgcaacccccactcatgacatgagaaatgtaggggaatcagaacgaaacacaagttcctctagggcacatacaggtgcacactttgctcaggaggatttgccatcattgttatttgtatagaatttgtaatattcacaatcagagaaaaggcacaacatgaaaatcaaatgtatattaatctttggcaaactcaaacacagccttgactaaactattctgcaggtggctcattgcctttgtggacattcattcaattctgtgttctctgcagaggcaatctactgaagagcacctgcttcccagaggtaacatggttgagcacaagtttattagtgatcatttctaaacagacatatccagagctcacgaacatgtggctgatgaactcctctccatgacacccacccacccaagcagctctgcctgcaccacctgcttgccagttgctcattttcagacctctttatgatacatgtacttttgcatgcaattatgtgatttaattaggcattaagtatttaattaaatactacaggggttcattaaatatgaatgaacaaagaaagtgctgcttcttatgagaaaagctatggctttatgaagttcaaagacaaacagctaaaaagaattgacaaaataagtgagggctagacaacagtgcagttaaaagaaaggagaagtcatttaaaaagagagatttctgcactcagccttcctcaaatgtctttgaattcttatgccactttaagaaaacaaaaccagaaatcagctcaaagaaaagaccttagccctatgtcaaaatagtggtaaataaatatacaaataaagtttttatttcaagttgagatttctatcattttaaggtttctaccatcttgaccaacactgtcaattgattttggtcctcgttttggaaaagagggcctcactatcttgaacgatctcgtgactctcagacaggagtcaggtgaactcctgtggctgtgcccactttaaagataaacaccaggctgggctggtggctcacgcctgtaatcctagcactttgggaggccaaggcaggaggatcacttgagtcaggagttcgaaacagcttggccatcatggtgaaaccccatctctactaaaaatacaaaaaaaaaatttgctgggcatggtggtgcatgcctgtaatcccagctactcgggaggtgaggcaggagaattgcttaaacccgggaggtggagcttgcaatgagccaagatcgtgccacacactccagcctgggcgacggagagagactccatctcaaaaaaaaaaaaaggatacacccaacaacacctcctgccactgcacctccccaactccaccacacccccccaccccccgctccctccccatccccctgcaccggcatctacccaggccccagaaagcccaaacctggttaaagtaacacagttaacagtgagcgttaccacatggcacttccttccatctgcacgggtaataaagtatccacgacagttccaacatacattcctcttacctgatggtactggatgagctcagtaacattgacaccaccacctctttttgggtttcaagctcttttcctgcatcagcttatttgttcctcttaatacaaagaggtcgtggactatgggctgcagagccggtatggcgtggggacaaaagggtacccttatcaggcatttcatggaaattacatttggaaaactgcctcaacatctacaaaatgctttcaagaaataaagaaaacccttacacatacttggtttaggtaagagatgaattaaggttatcaatcattataccatgtggaaggtcaaagctcttccctgaacactgatcattttgtgatgacttctaaaaaaagaaaaaaaacctagggctcctaaatttaacaccacttctgaaaaaaggtgactcaaattcaaaagtcaatttgaaaatgataaactttccaaataaccaaaacagcaacattcctggtctcaagaataatctacttgattatctgaaaagacaataaagacttccacataatacatttagtcaaagccactggattatttgcttttttaagtaaactcactctgtcattagatagataagggactttcccccaagtctattttggtctaacacaggagtcaaaataaattaactggtctactatgaccacatataaaaaatataagaaatgcctttcattggcacacaggcacactctgaccctcaatgtcatgagacataggaacactgacccctcagtgacacatacgctcacacatgagcacacacacagagcacactctgaccccctcagtgacacatacgctcacacatgagcacacacacagaggcacctctgaccccctcagtgacacatacgctcacaaatgagcacacacagaggcacactctgcccctcagtgacacgtatgcacacacatgagcacacacacagaggcacactctgacccccagtgacatgtacgcacacacaagcacacacacaggcacactctgacccctcagtgacaacacacacgtacacacacacacacgcgaggcaccctctgacccctcagtgaagggcacatgcaaccctctttgacacacacacaaacactctgacctctcagtgacacatactctctcggccctgagacatgcacacacaggaatactcactgacccttcggtggcatgcacgcatggtatactctctgaccctctcacagatgaccaagcttcccagcacaaagtactgggtgtgttgcctactgattttctgtccaaagaccctccaagtccaggaaaccaaacacctatgccttaataatctatactttggctgtgtgaatctgaagcccttgtgaggccgtggcaaacacaactggcttagctatgtaaacactgagaggtcagccaaggccctgcctcgcaacacagccggttgatgctcttctgcacacacgctgagtcgaaaagactctaagtagtagtgccatttcacatctgggagtttgcaagggtcttaggatgtgtccctgtcaaagttcaaaagcctaagattccagcaaaggagtcagggaggggtcaatagggcaatgctggaagatcagttcaaaagctcaaagaaagatttgcaactcattcataaaaccacactagctccttccacaggctggggcttgcacagctggccatctcctgggttccttatttaagctccagcaaaatcatcagcaaaacagaaagccctgaacccaagtcaaactatatctccaataccactggatgagagtcaaaatttaattcacggcaagttcgatttaagaatttttagtgttgcatcgcttcttgccttttggctaagatcaagtgaagaacttttagcgtttcatgtgaatgaacaggaacttatattcagaatctatctgtaccttaggttatcttactgtttcttgaatttttttccctggaagattacaaattgctgagagtaaagaatatgctctcttctcttttgaaacgtctctaccagtaccttcacatacacagacacacatgcagagcctgagaagcacatggctgccactacaacgttcaaagtgggtatatgaaaacgaacactgccaagcacatcacgacaccgaagcgacagtgaaaggtgtgtcccgttaccatgtgtcacagccttccttccactggccatgagccatcacagagctgaatgattttaggaattccaatgatctgttttgaatgatagcgttataagatagtaataccaagaagaaaaagatgtttggaatgattgcctctgattccctaaaacaaaaacatccatttagacctttcttttaaaattaagatacatatcaatataagcaaataaaataattcatgattcaaccttgacagcaagcacacatcaagctaacaggtgtccggatctactctaaccccacccctgccacagtgcatcccatctgtgccctcgcgcagagcaggacatgtgtaaaggttcggaggcagcaggtagaaggcacccgacggcacaggggcacacagctacgatcttcctagctctcctctgcctctttgctcttgaagaaattgaaactcaaagagaaacagtaacttgccccaaaacacagtggaggtgtcatgtaattagaataaacacatgtttccagaccccagggaatctgggaacactttccttctgcactaaattttcctaatacaatgtttattaagcattttaggtactaaaagaattttaacttttaataattataaactgtaatggactagcaagaagtattaaaacctcaacatctagcaagaaaaagctgcagagatacaaatgcataataattactaaagacaaccttatataaaactgctttctctaagaagtttaaaaactagtgctccaccacaagatttcattccaccatctgtcaacacaattaaatctttgaaatgtgcaatgaatactgacaacatatggaattttcagatacataactacttcaaacaagtcttgagatatacattaatttttaagagaagcaaaaatgcacagtatgttagcagatttccatttaaagaaaacagcaaaaatgcctaacagtagtttaaacattcacttataacctaaattacatgtaagtacacaagaagaagaaaaaaatctaaaataataaaatgcattacctgaactggcccacttcaatgtattcaaactgtttcaatacaaagccaataaaccctacaggaaggaaaataaaatttcacatcaataataggattaaaatgtaaaaaccaggttcttttcctcctgcttatctgcataaattttaaataaaattcttgacagctgataaattgactataagcataactctattctgaaatcagcctagataattgcagaacacatccaggatcccctcaacaactttactataccctgaggtgaaatctcattggaaaaacaaataataattccaagagacatcagacaatacccaaaattacaccttggggactcatctgttcacgtaatggcagatagggtggcacagattccctgaaactggtttagtaataagatacccaaagagtcgaccttcgtcccccaaccatctgagaggcgacacgtaagggctgcatgggagccattttgtgtcacactgtattccctgcagctgtcagctttcccaacctgacggggagcttcatggataaagcatggagcatatggcctggttttctcagagcctctgggcagaatgcaaaatacagcaggagctcaataaatctttatcagcatagagttcaatggtttgtctgttctatgttctattcttgttcataaaactgtcactgtactgaatcttaagaactgggagaaagggaccggttgatgaaaggcaatcagaacaaacatgaaaccagagcagtctttgttcttacagaatggaacaaatcagggctctggcttcccttggggtacccgtgcccccctgagagccgctcctctcagcccctgctgcccacagccatagaccagggcttctccccagtcagcctctagtgtcaaaggaaaggaaaagaagttcccaatgactatttcctgaggagagcaatggccatttagacggattttcttcggacaggttttgtgaaagaaagatgaaagcatcaggccacgcaaagcccaccccttgatgcctccttcattaaaagcagaccccaggccgggcgcggtgctcacgcctgtcatcccagcactttgggaggccgaggcgggcagatcacgaggtcagggatggagaccatcctggctaacacagtgaaacctcgtctctactaaaaatacaaaaaatagcctggcgtagtggtgggtgcctgtagtcccagctactcgggaggctgaggcaggagatggcgtgaacctctgaggcggagctggcagtgagccgagatcgcacccctgcactccagctgggtgacagagcgagactccatctcaaaaaaaaaacaaaaaaaaacaaacaacaacacaaaaaaaacaagcagataccaccccaatacccactgtggaaaatcagtgttgaccgaggccctcagttctcctagggaaacagaccctttcaggtgagtaacagtgctgacaggattacagatttacgtctagaaggaaatagagaagtgtaatatttctaactcacaaatattccaccccacataagaaagtagcccaagatcacggctcaaaaatgacagttaaattttgacgtgaaaaggcagtttcatctgcagtgatttaactgggacgaatcttgaggaaaatgtgcacatgaagggacaggactagccagaatctggtgcccacagcaactataggaggaaggtaagcagtcaagaggggaagcgtgcaaatgcttgtgcagagccacacagctcccacatggacccaggagcacgggtctcagttactgtcctgctaaattccattcctttttaaagaggtaatgaacctgttagatagcttgaaactgcagatgatcaattatggtaataattgataatcttttaaactaactctagattttgcaaaaatgttccccaaacaataaatcttaattgtatccacaatttaaattcaaacttattttggaggggaggcaagtggatgggacaaacctttggaatccctaacagccaaccccaggttagccttgagtccagggagctggggcaaggatgctacttgctgaggctggctatgccccaggccttctgcaccagctaggtgcatgaaaaagatagcagcagcaactgatgagggaaacatgcagaccacatttctttaaagtagatttcagttcttttagggtaatttgtactaaattaggaacaggtatgatggatgaaagataaaagtgcaaacctgatctgaatccagaagacagtaattaacccgtaactgaaccagctgcgccagaaatctaaaacctgcttctgtaactgcacacatgttgtagtcgtgtactgttttaaagctttataacaagaggttcaaacaaacgaatgtgattatgaatagcattctataaaaaagaaaaaagaaagaaagaatccataagtaagccttcaactaaaagcttcaagcaaaatacctgaaagtctcagctccagtttcctctctagcactgacacgcctgagttcacatgccacaacggcaccatttaccttatctgcacggttctttgtgacactcgtgaggtttgtcttcaacgggtagacactttctggaggacatcaaaccatctgccaaatgggaataaaagggaagcaagaatgagaatatctttaaataatctcctctgcactcagatatactcctgctcaaaccatttcacattcacacgatcagaacgtgtcagattgagaaacaacttgaaaggccactcaggtggcagcatcgccctcttcagataatgacactctatttagagtttacagctgcctgacgccatcaagtctcctcactcgcagaaggctactcaagtctgagcttttttctgctacagaaactgactactcagcccagtcttaagtgagatttgagagaaaggtgaaggtcatttaaagatcagtaatttagaagaaattacatgatttttttggaggacaagcctttaaaatattacatcaatgatatcccttctaagaaacatatatgaaattaacccaaacatgcacacactacatgcttattaataccccaaatggttacagaaagcattgaaacagacttactcctgaactccaatatatagtaagtacatcactaacatacagcctggaacatgggtattttccttgctcctgactctagtgttttaattgtagctatttaatcgctaaatttataaaaggaaaaaaagggattctattattgctactatacagattagcaactcaaatacctgttcatacttaagcaatttaagaagtcctgtatactaggcattaaaaacacaaacataaatttaagtgaaagaggccgggcgcggtggctcacgcctgtaatcccagcactttgggaggccgggacgggcgatcacgaggtcaggagatcgagaccatcctggctaacatggtgaaaccccgtctctacaaaaatacaaaaaaaagttagccaggcgtgatggcaggcgcctgtagtcccagctactcggaggctgaggcaggagaatggcatgaacccaggatgcagagcttgcagtgagctgagatgcaccactgcactccagcctgggcgacagagcaagactccgtctcaaaaaaaaaaaaacaaatttaagtgaaaagagacttctagtcataaagctgacaaaacacaaggtaatatatcaagatgcttctatggccttcacacacctctgaacaccagcactactgtgctgctatgagctgttctttcatccttgttacaggcctgaaaagtgccaccaacacatgccacaccacttacaggtcctgtgctttgaatgggtggggacattatgaactgcattctggtttgctgaccactttggcaatgagagctggctgcttctcagcccactcagtgttcctcctcctctaccccacctctgagatgtgtaagtcccaagcccatctcactcactggccacacacttcttggaggccgggctatgccttaaatcatctttgcatcaaccatatatatctcctagagttctcgaatacagcagactattagaagatgttcgctaacatttttcgtttttattcttttacaagtatttcctgcttgctctttcgtgcttccaccaacgacagcattcttgccacaactgttccccgaggtgtcgttctcctgctccgcctgcaccatgttcctcaggctggcgtcagcgaggcctgggtgaagtgggtgtacggggccatgaagcagtagtggtacaagcctggcctcaactggaggagccaaggcgctgtgctcggccttgtgacttgctggggttggaagataagcatcaaactgggaggccaagtttgtgccaaagagagtcttcaacaactacagtgaaaaaatgaggcatcaacaatgtggcgtgaacaacacttttaagaatctcccacacaaatatcaatccatctgtaaataactggatatgttagcaaagactcacagcgtgaaattcttcctgtgatcactattaatacctcatgagatattgtatgaagtgctgtttgtaccttaaataggcgtttgggtttccttgcaattctaaatgagattgagcattctaaacagaaactccgagggatggaagttaactagcgaggttgcagaggagcttctggtgtcctctgccctccacagtgaagacctcgtcctcctggggagtgaagggaaggatggcctcttggctcaatcatggactggccaaaaagtgctgcgctggaccccacaatcctcccagctgattatgccaacagcgcctcctcttaaggagtagcagcgttttgctgtcatacccgaacgtcttaacagaagaggaaagaatgaagctcttacttgttgaacacaaacagttgccatcattggttctcgactaaagcggatttcaggtatcctaggatctcttcaacacactgtagaaagacaagtgagacattaacgactcagagatgacccgttattgtacgaatcctagacagaaattgaaggtacaagatacttccatttaaattgtgtaaatagtagaggaaaatcagaggaaagttttcaatttcttatttgaacagtcagtaaaaagtcttgaaatccaagttatatacattacaaccattctttctgcatttatgtatctgttcattcactcattaattcaataaactgttatcaagtacctgtgtctattaggtatccagtcctgttcgcagggcaggaattcagaagtgtgcaaagcagctagagccctgcatctgtagagcccctgaatatgttcagtgaacacaactatgatacagcatgtgtgatttaccacaaatcagtcctagaattgtcttaaaataatctgcaaaaatgaccaataactaccttaatgttactcttctcacaagcatttttatcaacatctataacgagattacagcacccaatgtccttttcaagaatcaagaaggggctgggagtggtggctcacgccgtaatcccagcattttgggagatcgaggcaggtgcatcacttgaggtcaggagttcaagccagcctgaccaatatagtgaaaccccatctctaccaaaaatacaaaattagccaggcgggtggcgcacacctgtaatcccagctacttgagaggctgaggcaggagaatcgcttgaacagggaggcagaggttacagtgagccgagatggcgccattgcactggagttgttacctggcaacaagagcgaaagtccatctcaaaaaaaaaaaaaaaagaatcaagaaagaagaagagctaactcaaagagcgccaccattctgaatgcctagatacctaggcattcagaatgcacgcctgtttcaccactgcctggctaatcacgaactggtttccatcagctgctaaaagccacaccaattagactgaaaatgcctctctctccacttgtttaacaaaatatcctctactaaaagcaatagattcttgttggtttcaaatactcaagggccacacatttttaaaattctgaatgctcaaagtatattctaagtgtttaaggttgttcttgtcagaattgaatttgtcacaaccactttttgtttttactagctcccagcagatacccaatacatgttaactgaaaaaatacaaatagaacctgtgaatcactacttgtctaacaaaggactttaacaaatgtgtatggatgcttgatgtgcaccagaaactgaagccctggaaaaggtgagaaagcatgctgtttctgcctttcaagagctccccaagtaccagggaaccagggctctgctacaaatactaatatcaatgtaatagagtgagacttccactactgagcacaatgagggtgagggactgggtttacctcctgcctgagacaaccaaagcaaaccaaaaaacaaaacagacaaaacccagagtcctaagacactggacatgagcaatgaaggacagtgatccctgggagacgagagactaagtcaccctatggctgccccaactcgctgctttgagagagttcctaggctgtggcacaaggagggggacaggcaaccctctgaattgaagaggtgctgagaatctaaggagaccaagacagcccagttcataagacagagcaccagagaagagaaaacaagacagagagagctctggagatcggggaaggtccctctcgagtactcagcagagatatgtgtgtgagaaaactccctgaggcagggaaagaagcattggaaaggattagaaggagcagagctcagcgctcacacagggctaaaagtcactgttctcagcaggcggactggaaaacccaaactttctggttcattaggtaggtactcaggatggtcttgcctcctaagcatggtacctaattattcctaaagaggaataatagtccaaaaaaaaaattagtcctaaactaagcactgctccaacccatctgacaaattaaaagcaagacccaaaagagtaaaccatctatatgtaactcaactaacctcagaacaaagtcaagaagatctatgggaacacaaaaatatatagcatccaacaaagtaaaattcacaagttgggcatccaataaaaaattggcagccatacaaagaggcaggaaaatacaacccaaaagaggagtatcaatcaaccaatgagaaacaccaagaactgggaagttattagaagatcttgaactagcagagaaggatattaaaacagttattacaattgtgttcacaaagctaaacagaacacagggagacatttttaaaagacctaaatcaaacttctagagataaaaacaaaattgtgatatacactgaacaggggccagacacggtggctcatgcctataatcccaacactttggagaccgaggcggatgaatcacctgaggtcaggagttcaaggccagtttggccaacatgtgaaaccccatctctaataaaaatacacaaattagccaggtgtggtggcacgtgcctaagtcccagctactcgggaggctgaggcagaagaattgcttgagcctgggaggtggaggtgcagtgagctgatatcgcaccactaaactccagcctgggcaacagagtgagactgtttcaaaacaaaaaaaaaaatacgctggacaggattaacaacagattaacagattaacaacaggtagacactgtagaagaaaagatcagagaacttgaaaacacaataatagaaactatacaaacagaaaacacataaaacaatcaaacactgaaaagagcatcagtaagctatgggacaaactaagcaatcattcaggaaatcacagcccctttaagagagggaaaaaaggagggaggcgggcagaaaaaaaatctttgaagaaataatggcctagctgggtgcagtggctcacgccttaatcccagcactttgggaggcccaggcgggcagatcacgaggtcaggagattgagacctcctggctaacacagtgaaacctcgtctctactaaaaatacaaaaaattagccaggcgtgtggcaggcgcctgtagtcccagctactcaggaggctgaggcaggagaatggcgtgaaccaggaggcagagcttgcagtgagccaagatagtgtcactgcactccaacgcaggcgacaagcgagacactgtctcaaaaaaaaaaaaaagaaagaaagaaagaaagaatggcctaaaatttccaaactttaaaaatactatgaagccacagacccaacctcaataaacccaggcacagaaacacaagatataaaaaaactacatcagggcatatcattatcaaatcacccaaaacaacagtataaagtctgtcacccatgctggagtgcaatggcatgatcatggctctttgcagctcaacctcccaaggctcaagcaatcctcccacctcagccccgagtagctgggaccacaacgcatgccactgcggccaactatttttgtttttctttttgtagagacagtttcccggttgcagataaagtcttaaaccagacaaaacatataaaatggaacagtaaggagttacatgaaaatcgtctataatataatgcaaaagaaaaatccaatgcataatacatttcaattatgataaaaatgagtatggaataaataaggattagaagacaagaaaaaacattacctgtcaaaatgtggaattattattttttattcctagtgttgctatttagaaaaagaaaatgattctttttaattctaaagtctctgtgcctttaaatcctggaactaggtaaactcacagaagtcgaagaaaacctgctcatacccgtcgccacatcaagctcacctctccagctacacttgtgtcagacctcaacacccagccccgcacacatgcagaggcctatgcatgttggtgcaggggtctgatgccttcacctaagcaaggtcacagataaggctcaatagtttgtatatctcaagctggcctgacaatctaagcatctggatatctttccagctgcctcagaactgctgtgtggagaaagagatctgaaaccttgccatgctgtgagtcagtgagggagattcctcaaaacagcaggggccaagtgcaaacaagaacctgtgaaagcttctaccctacatatccccctctaaagaccacggataaaaactcaacaattaagcaggtgaggcttccaaagtacaaacaaaagatatgcgagaaagctaaaatgggcctctgtcttgaaacagcaaaaaagatgaacttagaaaacaaaaaaggagaggtgagtaaatctacctttaactgtaaagacacaggccagagaaaagatgcttaattatccagttattcttatgccaaatgtaaaaattttcagagatgagctattatctttatgtacctttaaaaatatatacatacacacacaaccatatggctgatttcagaatataaagatcaactaacatcaatcttcattaaattgtgacttattaataatttactttattatttggataaggcagcatttgatacattcactgactgtaactgaaaaacagcctttctatatatgacagtcataataataaggttaaaaaaaaacccacatacaaaaaagaaatcttactatttaaagaatcccagttagatgatttttatttcagtataatctcacgttcaatttaaaacatatagtattttccattttgctaaaatgtgttatacatggagactgctgccactaaaaactacttattaagcacagtggtttagggcaaagagagggagatctgaaaaatggctgggcgtggtggctgacacctgtgatcccagcactctaggaggctgaggtgggtgatcacaaggtcaggagttcgagactagcctggccaatgtggtgaaaccccatctccacaaaaatacaaaaaattagccaggcatggtggcaggtgcctgtaatcccagctactccggggctgaggtaggagaatcgcttgaaaccaggaggcaaaggttgcagtgggccgagattggccgatgcacgtcagcctgggcgacagagcaagactccacctcaaaaaacaagggatgctccaaaatggccgaataggaacagctccagtctacagctcccagtgagatcgacacagagacaggtgatttctgcatttccaactgaggtacctagttcatctcactgggacttgctgacagtgggtgcagcccacggagggcaagccgaagcagggcggggtgttgcctcacctggaagcacaaggggtcgggggacttccctttccaagccaaaggaagccatgagtgactgtactgaaggagcagtacactcctgcccaaatactgcacttttcccacagtcttcacaaccacagaccaggagattctctcctgtgcctggctcagcgggtcccacgcccatggggccttgtcactgctagcgcagcactctgaaatcgacctgggatgcaggagcttggctgggggagggtgtccaccactgctgaggctagagtaggtggttctatgctcacagtgtaaacaaagcacagggaagctcgaactgggcagagcccactgcagctcagcaaggcctactgcctctctaattccacctctgggggaagggcacatctgaacaaaaggcagcagacagcttctccagattaaacatacgtgcctgacagctctgaagagagcagtggttctcccggtacggcattcaactccgataatgaacagactgcctcaagtgggtccctgacccccatgtagcctgactggggacacctcccagtaggggccaacaaacacctcatacaggcagacaccttcgtgctctggacgatgtttccagaggaaggatcaggcagcaatatttgctgttctgcagcctctgctgggatgcccaggcaaacagggcctggagtggacctccagcaaactccaacagacctgcagcgaggggcctgtctgttagaaggaaaactaacaaacagaaaggaatagcatcaacatcaaaaaaaggacacccacaccaaaaccccatccgtaggtcaccaacatcaaagaccaaaggtgataaaaccacaatgatggggagaaaccatagcagaaaggctgaaaattccaaaaaccaaacacctcttctcctccaaaggatcacaactcctcaccagcaagggaacaaaactggatgagaatgagtttgatgaattgacagaagtaggcttcagaaggtcggtaataacaaactttccgagctaaaggagcatgttctaacccatcacaaggaagctaaaaaccttgaaaaaaagttagactaatggctagaataaccagtgtagagaagagcttaaatgacctgatggagctaaaaccacagaacgagaattttgtgaagtatacacaagcttcgacagccgattcaatcagcagaagaaaggatatcagtgattgaagatcaaattaatgaaataaagcgagaagacaaattagagaaaaaagagtgaaaagaaatgaaccaagcctccaagaaatatgggactatgtaaaagaccaaatctacgtttgattggtgtacctgaaagtgatggggagaatagaaccaattagaaaacactcttcaggatattatccaggagaacttccccaacctagcaaggcagacaacattcaaattcaggaaatacagagaacaccacaaagatactcctcgagaagagcaacccaagacacataatcatcagatccaccaagattgaaatgaaggaaagggcagccagagaaaaggtcgggttacccacaaagggaagcccatcagactaacagcagatctctctgcagaatcctacaagccagaaaagagtgggagccaatattcaacattctttaaaaaaagtatttcaacccagaatttcatatccagccaaactaagcttcataagtgaacgagaaataaaatctttacagacaagcaaatgcagagattttgtcaccaccaggcctgccttacaagagctccgaaggaagcactaaacatggaaaggaacaaccagtaccagccactgcaaaaacatgccaattgtaaagactactgacgctatgaagaaactgcatcagttaacgggcaaaataaccaataggatcataatgacaggatcaaattcacacatagcaatattaaccttaaatgtaaatggctaaatgccccaattaaaagacacagactggcaaattggataaagagtcaagacccatggtgtgctgtattcaggagacccatctcacatgcaaagacactcattggctcaaaataagggatggaggaagatctaacaagcaaatggaaagcaaaaaaaaagcagggattgcaatctagtctctgataaaacagactttaaatcaacaaagttcaaaggagacaaagaaggccatacataatggtaaagggatcaattcaacaagaagagctaactatcctaaatatacacgccccaatacaggagcacccagattcatgaagcaagttcttagagacctacaaagagactccacccggtaatagtgggagactttaacaccccactgtcaatattaggcagatcaatgagcagaaaattaacaaggatatccaggacttgaactcagcactggaccaagcggacctaataacatctacagaactctgcaccccaaatcaacagaacatacattcttctcagcaccacatgcacttattctaaaactgaccacatagttggaagtaaaacactcctcagcaaatgtaaagaacagaaatcacaacaaactgtctgtcagaccacagtgcaatcaaattagaactcaggttgagaatctcactcaaaaccacacaactacatggaaactgaacaacctgctcttgaatactactgggtaaataacgaaatgaaggcagaaataaaaattttcttggaaaccaatgagacgaagacacaacataccagaatctctgggacacatttaaagcagtgtgtagagggaaattatagcactaaatgcccacaagagaaagcagaaaagatctaaaattaacaccctaacacacaattaaaagaactagaaaagcaagagcaaacaaattcaaaagctagcagaagacaaaaataactaagatcagagcagaactgaaggagatagagacacgaaaaaaaaccctccaaaaaaatcaatgaatccaggtgctggttttttgaaaagatcaataaaataggtagaccgcagcaagactaataaagaagaaaagagagaagaatcaaatagactcaataaaaacgataaggggatatcaccaccgatcccacagaaatacaaactaccatcagagaatactataaacactctacccaaataaactagaaaatctagaagaaatggataaattcctggacacatacacctcccaagactaaaccagaaaaaagctgaatctctgaatagactgataacaggttctaacttgaggcaatagttaatagcctactaaccaaaaaaagtccaggatggattcacagccgattctaccagaggtacaaagaggagatggtaccattccttctgaaactattccaatcaaagaaaaagagagaatcctccctaactcattttatgaggccagcatcatcctgataccaagcctggcagagacacaacaaaaaaagagaattttaggccaatatccctgatgaacatcgtgtgaaaatcctcaataaaatactggcaaactgaatccagcagcacatcaaaaagcttaccaccacaatcaagtcagcttcatccctggaatgcaaggctggttcaacatacgcaaataataaacgtaatccatcacataaacagaaccaacaacaaaaaccatatgattatctcaaagatgcagaaaaggcctttgacaaaattcaacagcctttcatgctaaaaactctcaataactaggtatcgatggaacgtatctcaacatagtaagagctatttatgacaaacccacagtaatatcatactgaatgggcaaaaactggaagcattcccttcgaaaaccggcacaagacaggatgccctctctcaccactcctattcaacatagtattggaagttctggccagcgcaacaggcaagagaaagcaataaagggtattcaaataggaagagaggaagtaaaactgtcccgtttgcagatgacatgattgtatatttagaaaaccctattggttcagctcaaaatctcctaagctgattagcaacttcagcaaagtctcaggatacaaaatcaatgtgcaaaaatcacagcattcctatacaccaataacagacaaacagagagccaaatcatgagtgaactcccatcacaaatgctactaagggaatgaaacacctaggaagacaacttacaagggatgtgaaggcctcttcaaggagaactacaaaccactgctcaaggaaataagagaggacacaaacaaatgaaaaacattccatgttcatggataggacgaatcaatatcgtgaaaatggccttgctgccaaagtaatttatagattcaatgctatccccccatcaagctatcactgactttcttcacgaattggaaaaaactattttaaacttcatatggaaccaaaaaagagcctgcatagccaaacaatcctgggctagaagaacaaagctggaggcatcacactacctgacttcaaactatatacaacactacagtaaccaaaactgcatggtactggtaccaaaacagatatatagaccatggaacagaacagaggcctcagaaataccaccacacatctacaatcatctgatctttgaaaacctgacacacataagcaatggggaaaagattccctatttaataaatggtgttgggaaactggctagccacatgcagaaaactgaaactggaccccttccttataccttacacaaaatcaactcaagatggatcaaagacttaaacataagacctaggaccataaaaatcctagagaaaacctgggccataacattcaggacataggcataggcaaagacttcatgtctaaaacccaaaagcaatggcaacaaaagccaaaattgacaaacgggatctaattaaactaaagagttctgcatagcaaaagaaactatcatcagagtgaacaggcaacctacagaatgggataaatttttgcaatctacccatctgacaaaagattaacatccagaatctacaaagaacttaacaaatttacgaaaaaaaagcaaacaaccccatcaaaaaatggacaaaggatatgaacagcacttcgcaaaagaagacatttatgcagccaacagacatacgaaaaaatgctcatcaccctggtcattagagaaatgcagatcaaaatcacaatgagataccatctcacgccagttagatggcgatcgttaaaaagtcacgaaacaacagatgctggagaggttgtggaaaaataggacacttttacactgttggtgggagtgtaaattagttcaactattgtggaagacagtctgcgattcctcaaaggtctagaactagaaataccatttgacccagcaatcccattactgggatatacccaaaggattataaatcattctacgataaagacacatgcacatgtatgtttatgtggcactagtcacaatagcaaagacttggaaccaacccgaatgtccatcaatgatagatggattaagaaaatgtggcacatatacaccatggaatactatacagccataaaaaaggagagttcatgtcctttgcaggcacatggatgatgctggaaaccatcattctcagcaaacttcacaagatcagaaaaccaaacaccgcatgttctcactcacaagtggaaattgaacaatagaacacatgggcacagggaggagaacatcacacaccggggcccatggggagtgaggggctgggggagggataacattaggagaaatacctaatgtaggtgatgggttgatgggtgcacaaaccatcatggcacgtgtatacctatgtaacaaaactgcacattctgcacatgtaaccagaacttaaagtataataaataaataaacaaatataaataaaactgaaattagccaccaaaaaaagaaaaagaaaatctacgagacttttaactcaggctctgccgctgactttctggagataagtcagagactatctgtgtcagagaatatgactgtcaaccccagctctgttactcctcaggcacaaaagagcaagtcacacctcccgccccgcccccttacccgtctgttttcccctttccacttgaaaaggtcaagttaagaaataaaggactctacaaacacattttgaacccactgattttccaaactaaactgggtctaagctaatacatgataacagacaaaaatgaatacaaatagaaacttccccctaaacttcatggctaaggcagagtcagacttgggtctgtgacgcaagcacgtggggcagggaggagtctcccggaggcaccctggagaaccaggcccatcctagatgaactcagcccagaagacgcacatcaagtgtgccagccacaacccaagagaaaaaacaagacacaaaccttcccaatgtcctgcagtgtggccagctctagtatctggaaagaacatccaaggctgagcggagaaaccctccaaacttttccgtgctgttctgaagtccagcgtgaccttgggaaggtgaaggagagaacacacggttactggccctgtcacgattcataatgtacaaccaaagacacaaacatcgacggctgcagcagatgcctccactgtgcgcgccgtacactcaccttgcagggtgtgtctgcgtgtttgttgtcagcactggaaaaatttttggaaagaaattcctttcagatagctatacaaaaactactctttcaaaggctttcagttacactggcgctactggaagaaataattcctaactttctttcataatgagaaaaaaggttaaatgtccatcataatcagtatctggtatgtggtatatcaaaaaatagaaaatactagtcctattccttatacactaggatccctgggagaaatcactgtcaaattcacatagggtggttcaatttggatacaataaaatattaaatcaggtgtaagatgtgttaagattctaaggatttcatgtaattaaattatacagcaattctattttacagactcagagaatgggtcagaccaaagacatgcataacaagaaaggtaaggcgagactgactaggaaaataaatattgtaaaacactgcctcagaaaagaaggtgctcagtgaacataaatctaagaacccttgtgaagagaagctttctctgggcgaagtcagaagcaggcaagagacagacacagaaactgaaatgtgagtggatctaaataccatgactacgctagtcaacctgggtgtgccctaaggccagcaaaggaaagaaaaatccagcagtgacaccactgagggtccaaggaacgaggtgatgtgtgatgtcatgtgagatgaagagcccagggaagaaagggttctcctccaatatgcacagcatctgacctctcctggacaacaggtaagtgggagggaaaagaaggcatggaattctggaagagaagttcaccatgggaagttctagctctcaaagaagggaaaagaggtcatgagatggaattaagatgaaaaagcttccaggtcttcagaagagctgcaaaagttctgtggagactgaaaccaaagcaagaaaccagggaagacaaaaggaatcagaggagtgcaggaagggccaacaagaaatggggagtggagacgctgagcaactcagcagaaggaaccaaggaaaccagagcaatactcaaagatccagcaagacacgccaggcactccaaacgcacttcagctgagaactgcgcagcaggagctgaccgcggggatgacagagcaaaggaaacaggagtccaagatgcagggaggccagaattacagcagaacatgctggagttcagggtattcaggaaggaaaatataaacagatagcaagcactaggagcatggaaaggtgccctgaaattcaagatgatatggttgaaaacaggtggaaaagaagtatcttctctacggcatttttcaacatgccgtcttcgctttgggagctgacatgagaaccatgcagcttaaagagaccccaaaccttgtaaaatagaagactttcatatcttccaaaattatcaaacatccttcagaaaataagccacatacgttgataaatgattttcaggggaaaaaaaacccataagaagtaactattagtaacaaaaacgaggaatacctgaggattcatttatcaagaaatgtgcaagagctatgtgaaataatcttaagttttttttaaaatcctttaaatttcatgtgcttctgaggtaatttaaaaagttctgacaaataggaaagcatcccacattctggacagggtgacttaacatctgaggtataagtttccctaaatcaatctacaagtagaagttgattctattgttcacatcccaaaatcaataagaagaatatccagaaaattctaaagaacaacaggggaactgatcccctcataaataccataagctacaataattaagaagtatacttgtagccgggtgcagttgctcacacctgtaatccagcactttgggaggccaaggagggaggattacttaagccaggagcttgagaccagccaggcaacttagggagaccctgtctctacaaaaaatgtaaaaattagctgggtgtggtggacatgccggtagtcccaggtactcaggagctgaggtgggaggatcacttgagccctgagctgcagggaggcatggttgcaccactgcactccaacctggggacagagcaagactctgttaaaaaagaaaaaaaaaaaacaaggatgcttctaatagatgagcagacagatagattgaataacaaaataataaatgaaactactgaaactagagaactatgagaatgtaagtaactcagccaattagtgcagaaaaattcttctgtaaacattattggggacaaccaaaaacaaaattaaattagacacatacttcatatctaacaaattgcagatgaacagaaaattttaaagtaaaaaaaaaaatgaactaaaaaactaaaacatccctagacagaaaggctggctcttggggtatctggtgaacagtttcttacgctgacataaactttccctagctgataacaagtggccaccatgcccagactatttgaaacacatggtttatgccgaacacctgcttttcttctgtagtctggaattgtggctcatgttaggcagagggtacctgcaggaccagcatgttgctgttttttgtgtgagcctcacgggagggaaggaagcctgtacacggatccctccagactccacagggccacttccccctataacctggctgcacatcctagctctgtcactgtaatcaatctagctgtgagtacaaacaatatgaaaatccaaaacacctgtatgatagaagctatcataacaaagctgaaagacaaacaaacttgaaaaaactaaatgtaactcatatctcaaagggctatacatcctacaaatcataagaaaaacatcaactatccattagacgtaagtatgtgtgatatatatttttaaaagatgcagaggcccataccttgtagttagcgtgtgtagctttcagacatcatgcagtttgaggtatgaaggaagatgatagaaactccccagtgatgaggattacttgttgtaacaggacctgaggtatcagattgtctagaagctttaaaaatatgcacacaaagataaacttttagatcaaaataacttgccaagttttaaagagattactggaaatcagattttttaaagtattctagtatgaaaatattcaagtatttcctctgaccttttgattactagaagtaatgagaaattgactaacaaacataagtagagcctaagtactttttaaatacaaaataagaagagcagtgtgcacagttgttttgttatgattgcttgtttgctttgtgaaaatcagttagagaatcataggagcagctgattcaaggaccactggccaattccagaactctctgagcctaagattccttagtggccaacaacttcatgagcacaccaagtaatcaaaagggatgatgtaaaaatgttttaaagacggcaaaggcacaaacattatcattaaaccgaactaaatattaaagtgccaagcactatatacaactattctacttcagtttgaagactttgacttggagtccttagtttatttaattcatcagaaagatgatagtaatatactgataatttacacttgtaaaggctgaggcttttcaacaggtcaatcttcctcctgtactacagtcatccttagaaaagagcatcttttaaaacgcttgaggccgggtgcagtggctcacacctgtatcccagcactttggcaggccaaggcaggcggatcacttgaggtcaggagttcgagaccgcctggccaacatggtgaaactccacttctactaaaaatacaaaaattagccaggtgcatagcatgtgcctgtaatcccagctactcaggaggctgaggcaggagaattgcttgaaccgggaggcggaggttgcagtgagatgagatcgtgccatggtactccagcctgggtgaagagactccatctcaaaaaaaaccttgaatgtgttggtcaaggatacaaaatttcatttataacaggaggaatgagttcaagagatctactgtatagcatggtgactgcagttaatagcaagtaccatatgcaagaaaatcactgaaagagtagattttaagtgttctcaccacaaaacatgatacgtgaggtgatgcacaggttaattagccattccacaatgcatatgtatttcttctttttttttttttttgagacggagtctcgctctatcgcccaggctagagtgcagtggcagaactcagctcactgcaacctccacctgccagattcaagcaattctcctgcctcagcctccaagtagctgggacgactggcgcgagccaccatgcccggcttttttttttttttttttttttggggtatttttagtagagacaggatttcaccatgctggccagtttggccttgaaccccgacctcgtgatccgcccacctcagcctcccaaagtgctgggattacaggtgtgagcaccacgcctggccaatgtacacatatttcaaacatcatgttgtatattacagatatataaattttgtcaattaaaaataaataaataggccgggtacagtgactcatgcctgtaatccagcactttgagaggctgaggtggacggatcacgaggtcaggagatcaagaccatcctggcaacaaggtgaaaccccgtctccactaataaaaaatacaaaaaattagccaggtgtggtgtgcacacctgtagtcccagctactcaggaggctgaggcaggagaattgcttgaacccagaggcagagcttgcactgagccgagattgcaccactgcactccagcctgggtgacagaggagactctgtctcaaaaaaataaataaataaaataaataaataaataaatagccttgattaaatgctatatacacaaaacaaatgggagaaccatcactggcccctgggtgccaagagcagcgtgagaatgggtctggagggagactgtacagacaggtggccaggcgtcccagatacagaggcagcagcagtcacttcatgctttgccaggctcctctcctgcccctgccactgccaccgagagcagtatggatgggaattcaataaactgcagtcacacctaaatcctagcccttctgttctgaccttttcatgggtaaaaaaaggtcctccaaacttgtgaatggtttaagtcctccaactcagatgactttatccccactttctctcgcctttagctcttccaaatgtaatattccatttccaatcagaatttttgacatatcagaatcagttttttcactcactacactattcctaagcatctacaccacttcccttactgaaaatcaggaggcctctccagccatacctgcaaccagggaagcataggagagtgatgctccatgctagggctggaagcctggagctgtaggggctgcatgtcagccagtggcacttagaaatgcttcagaccaaaaggtggtcgtgtacatcagtcattagtttctaatatcttgaaccgcacctggagaaactttctctcatttactgatgtgtattatatttatttctctaaaacaccaagttacttaaatcctatgttctacatgacagatgctgcactcatgtccctcccttccccacgctgtttcctacctgcacggcctcactgcctttcttgggactcaacggtacagatgcttgttctcctggttctttctcttcccctttcgtcggatgggacttagagaaggggggtttgttagagaaggcaaggctgctaaaatagaaaaacaaaaacaaaaaacaaaaaaacaaaaacatgtgatggaagtataaaaaactgaaaattagaatatttggttttaccatttattaaaaagagctaacccatgtcatcattttgttcttggaccctgatatgtacagttcagacactgtacacattttatttactttacccacacaatgatacatggtagggactggcccacaacttcctaacaggtgcacagaaatgagttgaagatggaaggagccctcagggagcccccaggcccatgccctccaacagcaacaaccagggcattctatgttggccatgacgccatgacatgaaaggggtacaaagcagattttttttttcttttttgagacagggtctcactcgtcacccaggatggggtgcaatcaatttcattgtagcctcaacctcctgggctcaagcaatcctcccacctcagcctccagagagatgggaccacaggcacacgccacatcacccagctaattttttaatttcttgaggagaaggatctcacactatgatgcccaggctggtctcgaactccaagctccagtgatcctccctctcagcctcccaaagtgctggaattacaggcatgagccaccgtgcccaacccaaagcacattttaaactcctgtttctaaaagaggaaacaggctcagagatgaagtaacttattcaggtcacagctggttaccagcaaagctagaagtcaacaaatccagatgtattcataaagctcaactatctccaatacacaacacatgagagcatatagaacatcgagactcccaatgcttaggaggcagccatcatggagcagagtgaaggcaagatgactgacatgtggaattgaggcctagctctgctacttactcactccctgatcttagaaaagtgcttgttatggtttcaattctatagtcccccaaatttatacactgaaacttaattaccagggtgatggtattaggagtggggcctttgggaggtgactgggtcatgagggcagacccctcatgaatgagattagcaccatatataagaggccccacagagcttcctcaccccctcaccacatgagggcaaggcgaagtcctggatcttggacttcccaacctccagaagtgtgagaagtaaattctgttgttgagccacccaggctatggtattttgttatggcaacccatgctgactaagacagtcaccttaaccataataggatgaatggctacaatcgggtgcatggactggaaggcatcagggaagaatgcagacagtaaatgaaaggttagccgggcatggtggctcacgcctgtaatcccagcacttgggaggccgaggcaggcggatcatgaagtcaggagatcgagaccaccctggctaacagttgaaacccatctctactaaaaaaaaaaaaaaaaaaaattagccaggcatggtgacatggcctgtagtcccagccactcgggaggctgaggcaggagaatcgcttgaacccgggaggagaagttccgtcacaatttaaaaaaaaaagaaaaacagagaggctgctacactgaaaacctgcttggtagaaggcaccagtcacaagctcactgactgtatgagcccatccacagtaagtccagaagacgtagagtcacagagacagaaggcaggttagtggctgcctgcagctggagcatggaggttttgggtaaagagtacagagttcctttatgggttctaaaactgattctgtgatggctgtacaactctgtgggcatactaaagagaatgaattatatactttaaatggggaattatatgaattatctcaagaatgctgtttcctggctgggagcggtagctcacgccttaatcccagcactttgggaggccgaggcgggctaatcacgaggtcacaagttcgagaccgcctggccaacatggtgaaaccccgtctctactaaaaatacaaaaagttagctgggtgtgtggcaggcgcctgtaatcccaactactcgggaggctgaggcaggagaatcacttgaactgggaggcagaagttgcagtgagctgagatcgcgccaacccactccagcctgggcgacagctgagactctgtctcaaaaaaaaaaaaaaatcaaaaaattagctgggcatggtgggtagcctgtagtcccaactactgagaaggctgaggcagaaggatcacttgagcctgggagatgaggccgcagtgagctatgatcatgacactgcactccaagctgggcaacagaatgacacctatctcaaaaaaattaaattaaattttttaaaaaatgctgtttccaaaacaaaaggctgtgcagtaatccaaatgagatagtatatcagtctggaccagaagtggcagagaatataagtatgcatatgtacatgtattatgtgtccatgtacaggtgcatgcatatgtgcagaggtcccaaactttttggcaccagggaccggttctgtggaagacaatttttccacaaaccaggttggcgggggatggtttcgggatgaaactgttccacctcaaatcatcatcaggcattagttctcataaggagcatgcaacctagatccctcaaatgtgcagttcacaatagggttcatctctgatatggtttggctctgtgtccccacccaaatctcatgctgaattgtaatctccatgtcggaggtggggcctggtgggaggtgattggatcatgggggtagtttctaatggttggcaccatccccctggtgctcctttgtgtagcaactccccctacaggcactctcctttctcctcctctctccctctcaatctttctttttctctctctctctctgtctctctctctctcccttctctctttttcctgtgggccatgtgaagatgtgcctacttccccttcaccttctgcatgactgcaagtttcctgaggccttcccagaaacagaagcctgtacagcctgcagaacgtgagccaattaaacctcttttctttatatgtctcaggtatgtctttacagaagtgtgaaacgaactcatacacgctcctatgagaatctaatgccaccactggcctgagaggagataagctcagatggtaatgcttgctcacttcttcctgtgcagcctggttttttttttttttgtttgttttgtttttgagacagagtctcgctctgtcgcccaggctggagtgcaatggcacatctcggctcactgcaagctccgcctcccaggttcacgccgttctcctgcatcagcctccaggtagctgggactatgggcgcccgccaccacacccggctaatttttttttgtattttagtagagacggggtttcaccgtgtgagccggaatggtctcgatctcctgaccttgtgatcactggtctcggcctcccaaagttctggaattacaggcgtgagccaccacgcacggcctcagtccggtttttaacagaggttggggacccctgcatatgtgcatgtatatgtgcatgtcatgtatgtgaatacaaaggtacacactttcttctcgcaaaatatttagtaggggaaacaaagacttggtgagtggaaatgaagacttgtggtgacctgtttctagcttgataagacaaaagtggggtaaatggggcaggggcagatgtggggaggaggacagaaagctgagctcatacaccgtgtctgacatatccacaaatcagctatatgtaagtgtcacggggcagctggctcattgaactgcagctccagagacaggtcctctgaggtccctcatctagacactgaagacggagaacagccccgactctcaggctgccctgcccaatactggagccactacccacataagttatttaaatttaaatttaatgaaaattaaaccgaatcggggttcagttcttcagtcaactagctgcatttcaagggctcaacagctatatgtgtttagtggctactgtcttgcctgcatagctatggagcactgccatggttatagaaaattctgccactctctagaacagcactgcccagagactacaaagagagaagacggcctaggacagagcctagaaagcatgtgctgggggcaggaaggactgaacccagtgactggggagtggcaagtgggtaagggaacacccagaggccctctgaaagccaactgaagaggacactcaagatgggggtagcagcctgcaggatcaaagagggaaaggcaggcaggaccagagcagtgcccagagatgtaaagacatgatctggcgggaaacgctgctatggagtgtggcaacagaaaccaccagcaggggttaaggaaggaggctgaagtagtagacagggtccaggccaagagagccaaagaagccttgcaaacaaggtcacctcagagcagtgggaagctctgtgggctgaggctgggactctccagagatgtttgcgagaagggagaagactgatggcagctaaaggagaatgggaagttagtagggagatttttaaggtagaagacaaggcaaagagagagtaatcagatataaacagtaagtgaactggtcttcttaggctgggcgtggtggctcatgcccgtaatcccaacactttgggaggccgaagcgatagatcacttcaggtcaggagtttgagaccaacctgaccaacatggtgaaaccccgtcctactaaaactacaaaaaaattagctgggtgtggtggtgcatgcctgtaatcccagctgaatctgcctcgagaggctgaggcagaagaatcgtttgaacccaggaggcagaagttgcatgagctgagatcacaccattgcactccagcccaggcaacaagaatgaaactccatctcaaaaaaaaaaaaaaaaaaagtatgtgaactggtctatcttaaatccattgtacaaatagtaacatttgttttgaagttgattttattgcttcacagaaaagcaaaactgtccctgagatggcagaacattctacaaccatggaaatgctccataactatgctagccaggacagtagccttaaccaagatttaaggagacagcaatgaggtacttggccaggaacatcaattctgagcttcttggctaatgctggaaacctaaaactaaagctaggtatttccctcttagggataacgtgactgatgatactaaaagagctataaaacacatggtcacatttttttcttcttttggaagagtctgactctgtcacccaggctggagtgcagcggcacaatcaaggcttactgcaactccgcctcccaggttcaagcaactctcttgcctcagcctcccaagtagctgggattacggcacgcaccaccatgcccatctaattttttttttgagacggagtctcgctctgtcaccaggctggagtgcagtggcacgatctcggctcactgcaagctccgcctcccggattcacgcattctcctgcctcagcctcccgagcagctgggactacaggcgcccgccaccatgctcaataatttttttgtatttttagtagagacggggtttcactgtgttagccaggatggtcttatctcttgacctcgtgatccgcccacctcggcctcccaaagtgctgggattacaggcttagccaccacgcccggcccaacccatctaattttttgtatttttagtagagagggggtttgtgatgttgcccaggctggtctcgaactcttggcctcaagtgatccacttgcctcagtccccaaagtgctggaataacaggcacgagccactgcacccatccacatggtcacattttgtgttaaatttagtgtcacaatctgagcaattttgttcatttaaagcaaaaagagaataagaagggacagattactaaacaaaggtagtctggaaacccatagtcattaaggct

SEQ ID NO: 5085 - DNA, 46410 bp, Homo sapiens
tatgaagatccttgggattatattgggcctgtctggataattaaggataatctccctctcatctcaggttcagttgattagcaaccctgcttccatctgtaaccttaatcccccccttccatgtaatgtaacatgttcacaggttccagggattgggacatggacatcttggggggtcattattgtacctactacaatttttaaggttgctttatgactgcaaaagaaaactcacatggtttaaagaaaagcacacttacagtttatttaagaatttaaggttggtttgatcactggtgatgtaatcaaagccccaggcaggccttcttcttcttccactccaccatattcagatgcctcctttcatctccaggcttgtctcctcatgattgcaaaagcaccatccaaagcagaaggaaggtggcaaaggagccttctcctccatgctgctttttgattaggaaggagaactctgacttgctctgtggttccatggcagagaggaaggtcaggcagcccagctatgttgacaactcaagctaaatttgctgctagaaatcaggaaatcatggatggtggtggaagggggagatgcgtagggcctggtgtgcccagggcagagcagcaggtggccaagagcctgtcccagaaatgccagttcctgggtgggatcacgctaaggtgggtcatcagtatataggagtggtgttcagggcagccagaatcagagatcagcctatagctgggatcaaagatccatctgtggtagggtcaggggtcagcatgtggctggggccagcctgcaaccaggatcatgagtaagtcataacatgggtcgggactcagttcctggcttgagtcagagctgttctgtggctgaggacagaggtggactgtggccaggatcagaagtcagtctgtggctggatcagggtcattctgtgttggagtcagatatcataatggagttgggatcaatcagtttagtcttctctgtctgtcttctctctgcatctctgcttctctctgtctcattctcctttgctgtaaacacctgttggagctcagcaacttgggtccatggggaagagggaagttgagtctgggcaaggtcctataagcccggtatggaagaacataagggaaaaagagaaaaatgtcaggaatataaagatattcctagaaaaatgtcaggaatataaatatatgtatgtatgatgagaaatgaatgatataaaacgcaaatacgcaaacactgactctgcatgtaaacaacacacagaagtggcacaaacagaacaaacacaagtgggttgaatgatgggattgggacaattttttgtcctggattactgttctccattctgccctttttgtaataaagtcaaattaaatttagaatgtcattatttcctcaattatgttttataccctcacctcccacaaaatccacagacatattcagtgtaatattaggataatgttagcagactaggcatggtggctcacatctgtaatcctagcactttgggagccgaggtggatggattgcttgaaccctaggagtctgggactagcctaggcaacatagtgttccctgtctctacaaaaaattaaaaaacaaattagccaggcttagtggtgtgtgcaccgtggtcacagctacttgagaggctgaagtgggagaatcacatgagcccaggtgttcaagctgcagtgagccgggattgggccactgcgctccagcctgggtgacagagaaagaccctgctcaaaaaaaaaaaaaaaagaagaagaagaagaatgttagcaaatacttttaaggcattactatttgcaggcatagttctttttttttgagacagagtcccacttgttgcccaggctgagtgcagtggcacaatctccgcttgctgcaacctctgcctcctgggttcaggcaattctctgcctcatcctcccgagtagctgggattacaggcacccgccaccatgtctggctgattttgtatttttaatagagacagggtttcaccatgttggccaggctggtctcaaacgcctactcaggcaatctgcccaccttggcctcccatagtgctgggattacaggcgtgagccacttgcccagccgcaggcatagttctaaggacctcacaggtactaacatatttaattctcacatagctacatgaggcagatattataatgattcccattttacagataacgaatcaagcacgagaggttacacgctggcctggcgccacacagcatatctaatggacattaggctctttttctggtgctgggggaatttctggaaaatgcagagatggaagagaggtgggatcggggcaggcgggtggggaatctcccaggccaagttttctgggcacggcctggacctggagctgctggatggagcaggtgctgatgctgatgtggtcaccagagggcagcagggaccagggagctacttcctcttcacaccccctccacccggggcggtgcccctgacttgtcaataaacgtcgggaaacaggtgggatttggtggaagaactgacacggtcccgccaccatcacaggcaagtaagcttgagagcagcctggtgtcacctggcctccacccaccacgtcatctgctgctcacccaccactgtggcgtgcagagtactgctcttgtgtgccttttaccaaggaggaaatttagcccagagtgggcaaacacttttcccatggtcacacagcttggaattggaaaggctggactaaccaggcagggtgagcgcagagcccttgttcctctgagtctctgttctgagctggaccagggaagatgatgagcccatggtatatacagggcggttagctaggactctggtttgagcctggctatgccactcggtaacagcacatcgtgggcaagtcccatgcagcctcatcggtgccgggaggatccagtgacgtcaggcctccctcgtggtgggagctcaaacacttgctggttttttgttttttcggtgttttgctttttgttttttaattaataactttcgtgggaaaataaagtcagaaaggttgttcaaccggatgttcacggagatactacgccttcaaaaacagcgctcatttcgtgatcgcccacacagtgccagatgctggggcggggatgggatttccgtggtttttcttcactttcctctttatatcttcaggctttctctgaataggaaaaggtctcacgtgctgatagagtaatcagaaaaatgcaataagccactttttgtaaaaaaaaaaaaaaattcagatgcactcactgccttcctcccccctttccccctcccctcatcccccacaattctgtgtaaaggcagggctgagggagtacccccaaatcaacatctctgaaagctccccgcaggggcccaggccactcagcccactctggcgctgctacccaggggcgtcccctcctgcctctggtccagccccggaggctgaaactcccgcagccggcatctcactgggcctatgacctggacttttcctacttcctgcagggtgggggccagcctgagttgggcccacctgatcaccaggtcttctcatccctctgtagcttcccaaagcccagccagttcagtaatagttgcgaggccaacaacttggatttcttttgcctaagatcctttgttgggctcccagtcccattcatctctagcagtcaaatatattttctatttgctgcctaatttttaaattagatttctcgagacaatgctcaggcaaagtggattcgagccgacatctgcgtaggtgtcaggatgacaaagctgatatatcacggcggctgggagctcttaggtcagacccgggttcaaatcctggcccaggatttcctagctgtgtggttctaggctaatcctcaacctctctggacctgtttcctatctgtaaaattgggataatcattgagcctcccaactagagctgtttggagacgtaaagacacagtggctggacggcacttagcatattgcttggccctaaacagataactattttttttaaaattatattttattataaagagcttttggaggcaagaagtccagaaggctagttaggctctgccattctctgggtgactttgggcaagtcccttttcctctctaaaactgttttccatctgtaaactgtgtgatttgggcagctaaagggattgattttggcttagaacaagttttttttgtttttttttttttttcctgagacagggtctcactctgtcatccaagctgggtgcaatggcacaatctcagctcactgcaacctccgcgtcccaggttgaagcaattctacaactcagcctcccaagtagctgagattacaggcacccaccaccacacccggctaatttttattttttggtagagatagggtttcaccatattggccaggctggtcttgaactcctcactcaagtgatacacccgcctcagcctcccaaattgctgggattacagccatgagccatctgcctggcgcaaggaggtgtttctaacaaacatcaggctgcatgtgaggtagagagctcccatcatttccagtgtagtatgtaggctcctagagcaggaaggaatctaaaatggccaacccctcaagtgtgaaatcagggcagctactcagagaagcaaaagtgatacagacatagggcttcaggttcccagccttcccatctaaggcccacaccatccctctgcctgcctcggattgaagcgcagatcactacagagagcctgggtgatggagacactgtctggattccactatgatctgttgctaactagctgtgtgaccttggcagtgtatcatcagccactgttggtgtctgttcctgtcttcttggtgtgccagagtctctcaacacctccaactctcagttgaagaatttttttttcctggagtagctggaagtgctggagaattaatgctcctggaagcagctctagccaatgacagatgggagctggtggacaaataccccagctccctctcctttgcaggcaaactgggcatgtgccatgcatggtcttccagagatccccggcaggtaagcatcagttaccatgctggtaatctgttgaataactcacccttttgtcagaggtttatttaaactggagcttgaagaggggctgggtaaaatgaggctgagacttactgggctgcattcctgggaggttgggcattcttagtcatagaatgagacaggaggtcgtcaccgatacaagtcataaagacctgctgataaaacaggttgcagtaaagaagatggctctaacccaccaaaaccaagatggcacaagagtgacctctggttgtcctcactgctacactcccaacagcgccatgacagtttaaaatgccatggcaacatcaggaagttaccctatatggtctaaaagggaggcataataatcaccccttgtttggaatataattaatcaataaccataaaaataggcagccagcaaccctagggctgctctgtctacggagtagccattcttttattcctttactttcctcattaacttctttcactgactctatggactcgctctgaattctttcttgcatgagattcaagaaccctttttggggtctgcatctggacccctttcaggtaacactttcttggtttgtgtccttcccgcctcagttccccactaccttagcagggtttcccgggattacttcctaaatcaactattgaatccttgtatggggaacccaaacccagacggcaagtttcttaacctcttgcatcctgttcctctggatgggtgaattccaggagttaacagagacacagcactcacagcagtgtctgaggtatgtttggttaatacataaaaaataaagagacaaagaaactttatttatacaaactccaccccttctgttccactctcctcagcaaacacagataacaggtgatgaaactaaacacacagacgagcattactcaacccaaggttcccgccttccctagcacctgaggtctggccaacatgcagggtaactggtgccttatgcctgctgtctggattgcccggcccacagggggctgagcatatttattctgggggttccatgcatacgaggagcccccagccatacagctggcatgggtgtttggcagcaaattgtccctgctttagtcacagcaatttttcatgtccttgttgctccccttaactgaacaccccttgacagccgggattctgcctccagcatcaaccaaggaagctctgttaaatgaatgagcacctctaggcaatgaccaccctccctgaagttcatttctcatcgatttcccaaggccgcccaagtcattcccttgatggctgtgttagtttcaggctcggcttctagttcagtgagacagaggcaggtgggcctccatgtgggccatgatcggtgggcaaaacatgccttgggcagttacaacagggacagtctgctgcagaagctgtgggggagcagccaacaactcgttcacaagtcgaggtgcccaagggcctcagttttcctgcagggcctgccgtggggcacggcgacccagtgccctctactctcatgggatgtggcgagccagcccaatgctgggcggggtccagtctctgcagcccagtgttaggccaacgtcagtgggccaatcaccttcataccatggttcttcaagtcttttggaaatctgccagcctggctgcctccaggaggtggcatttcccaggcatggataagccctagtcctcatctgcagactcagcacaagaggacatgcacctaagagaccctcatgtatgtgggtcccacggagacaaagttccgattttgggggtctggcttgagctctgagcattgccaggggcaggatggaaggatgataggatttactcttctctgagatgcccgagggtgccagggaggccggacacagactggccccagtggaaccccacctggagaggggtctggggccctcaggggggttgtagggggcgagacctgtctccacagcagcagccacagcaaggactggccatgacaggggtctggccaccacctcctggccatgacactgtttcaggtggccgcacaggtggcaggtaagggctgagtagcaatgccactgcccaggctgtccacaagggggtctgtggcctgctcctggggaagtggggctttggcatgtcctctaccttttcccccggctccagacccaggtgctctggggagctgttgggagatgtgagctctgcggactgcgaggtggctccctgtccagtccaaaggtgaacaggggacagggactggggcagggtccccagggcagccaggaatgaggtcttggaaaggctatacccctcttccccactgctagccccaaacccacatttctctggggacacagcactgtggcaagcaggcttgagaaggccttgtaaccagcctctcctgggggacccaagcccaccccgcactggcctgggtgccaccctgctccaccgcatgtacaaactcctgatagccactgtgggggccgagacgggggctgcagctgccccatgctggaggacatttcggcggaggatcgctcccaggtttctggctcaggttggggcacagtggttggctcagagagctgggggacaagggcatctcgggttctacttcctccaggtgtctggccagcagtgggtctggacccagcctctgggacacggtgactggctcagggagttgctgaagctgcggtaagcagggttgcctcgatgacgaggggcgtctctgtgcaagtcaggttgtctggactctgggtcgggctggcagaggacttggctccaggtggagaggctgctccttgccccagggaggtgcctccttgggcctgcacttgggaactcatcccagggcatgtgagcactcgtacttcccgaaggtggaagaggcatgactcccccatgtcctgctggcaaaagcccccattctcctctccgagcaggtccggaacaggctctctgttagccgggccacaatgccctcccttccctcctggaagtcatcctgctgctctcaggcgatgcacagaagctccctttttcttcctctacctcctcctcctcccacactccaccggggcctcaaacaactccacacatcgcaccacgctgatgctctctggcagaggactgtcttgctgatctccactgggcaccatgctgattttccagagccctggaaagcatctctttggcagccttgtgaggatcttcatcccttttcatgttgtgctccagaaaaagggcaagagcttggtaagacaattcttccagtgtctgcaaaagcaaaggttggtcaggttcagtttcgacacttgaaaaactcctattcattcttcaaagcccagcctgaaatcacctgtcctgatggctgtctacttcagacatgccttctaacgttataatcagtaattgatcatctatgttgctagaatgagaaatccctgagggtagggtctgtgtctttgggatttcgggacccagcacatgtcctgggcaccaaatacaagctcagatctgttgagtaagaaaaagtcttatggatgatgataattaaaagcaacaccattatcccaagccatgaccaattagaaagatatggaagccgggtgcggtggctcacgcctgtaatcccagcactttaggaggctgagggggaggatcgcttgagctcaggagtttgagaacagcctgggcaacagagcccaagccgttcaaacatctctacaagaattaaaaaaaaggaaaattagctgggcatgttggtgtatgatgtagtcccagctacttagaaggctgaggctagagaatcacttgagcccacgagtttgagctgcagtgaatcactgcactccagcctgagggacacagcaagaccctgcgtccaaaaaaaaaaaaaaaaaaaaagatgcgggatcctagggttgaagcagggtcctggaccccctttgtttctggagtatggaaaggtccagcaggccccagggaagaagctaaggaggccacagtgcggggcaacacagcgagagcttgtctttacaaaaactttttttggtattattttttttagacaagagtctcactctgtcgcccaggctggagtgcagtggcacaatctgcgctcactcaacctctgcctcccgggttcaagtgattctcatgcctcagcctcctgagtagctggaatacaggcaaaaaccttttaaaatagccaggcgtggtaatgcacatctgtagtatcagctctcgggaggctaagatgggaggatcacttgagctcaggagtttgaaggtgcagtgagcttgatcgcaccactgcacaccagcctgggccacagagtgagatcctgtatattaaaaaaaggaggggagtgttcaggatagtggctatttgccgacaagtatacaattaggtcaagatttaacaacaggcacggctgctctggttgttaactataacagcactcccaaggggtatcacatgtacctgacacaccagtgaaactcagggggcttggccagcagtccacgtttccagaaacccctcctcctgccgtcccttgaaggctaatgtcacagggcaattaccgaatgcagggagagaaggcagacatggagctaggggcttgcctctccaattctatcaccttcccaatgctgcaggctgtgacctaagttcagatacatacgggcacttggctggttcctggcctcgggccgcttctcccactgtgacccctaaaatacagagacagccaatgaaagagcagagtggcttgcagcccggcctggagtacggcaatgctcaggaaggggtacaagcctcgacatcacaagatcagaagtccaacaggtcacttacgctttctgagcctcagattcctgggaattaatacattgtcctaatatttacagggactgtggtcgatggcaaaagtggccacagaggagtgtctgaatctcctcccatcccttgaatctacactggccctgggacttgcttgggcccataaatgtgatggaagtgatatcatgccagtgctgcgcctaggcctcaagaagccttgggactcccacccttgaaaactgagccactctgtaaacaagcctgggccggcctgctggagagtagaggcacatggctcaggcacctgcactgtcccaggtaaaagtcagccaactaggctggtgcagtggctcacgcctgtaatcccagcactttgggaggctgaggtgggtggatcatctatattaggagttccagaccagcctgaccaacatgaagaaaccccatctctattaaaaatcaaaattagcctggcgtggtggcacatgcctgtaatcccagctacttgggaggctgaggaagaaaattgcttgaacccaggaggcagaggttgcagtgagccaagatcacgccattgcctcctgggcaataagagcaaaactccgtctcagaaaaagaaaaaaaaaaaaaaagccaatgtcagacacggagggaggctacggggacgggtcagctcaattcagatctgcccagcccgcccagcccagcctcccccgccaccctcactgctgagcccagccccaaatgccagcctgagaagcataagctaaataaagttgttgtaaccctctacatttcggggtcatttgttacaagcaaacactaactgatacataaatggcacttggtatttgcaagaggctggaatatgcatttatatgtattgtctcaataaattccaatatctgtcctaccaggtaaacactgttatacccacaagaggaaactgaggctcagagaattaagcaacttgctcaagtccacactgccatgagtggcagagtcaggattcaaagccaacaccactagattccagagtccctggaaaagaaggaccctcagaccttctcttctagacaggacctataatccccctttctcctacctaggaactctcatcttgctcaggcaaaccccacccactcacccacaggaccatcgccttgggaagctgactccacccctggcttaggggtgggatacatttcaggccaatgagaacccggagggatttgctagtgcttcgggggcagtttcctatgcttaagaagaagacacagaaagccgtcaccctctccttcctccactccttctggcctctagccctggtactggcacctccccaggaatgacacagtgatgatgacccaagggtcattctcccaaggggagggaaaaaaacagaaaccaaccccagagaagcccaccccaggctgggattgccaaggggaagggcgggaaagctctggtctgctaatgacctcattcggcttctgcctctgtctcccctgcaaccctcctgctgtctatttgccattccagaagccagtgaaggtccttaacagcccaggtgttctgaacacacttcttcatgtacacagtcccacatgtcctcatccacgcctactcctacctgagcacctggattattatagccacgaggcggctgcgggctgggttgggaatctgatcccaccatctttcttaatcctgaaaaacaaaaggaaaaggtgttgatctctgaattattgacaggtgacgctcctcccataaaagtggtcgttatcaccaatacttatttggcatcagagatcaggtgattagtttctggaggtcaaaccactgactcatcattctaacctggtgacatggattcattgctaaccctattctacagatgaggagagtgaggcccaaggaggtggagtgacagctgtaggtggcagagccaggttcacactcccgcattctgttacccagcacagagttcctgagaggccacctatgtcctcagtgggaatgagaccccaggggattaggaaagactcaaactcagagagaggattctaggttcccctcaacaatccctttttcagagcagctgagggcaaagaccagggaatggcctgggatggcctgggaagctgggggacctacggagaaacacaaccttctctcttcctggcctgcctggggccatggtgcatcatcactgggaggtaaggtcctcgaccgcttctgaattagcctctgcccatggtttcaataaataaacacatatttattgagaccttctatgtttgactcactgtgcctggccctgaggccacaacagtgaacgagacaaaatgcctgccttggtgaaactgaccttcaagagggaaagatggatgataaatggagacagaatgcttatatgaggccaggcatggcggctcacgcctgtaatcccagcactttgggaggcaaggcaggtgtatcacctgaggtcagaagttcgagaccagcctggccaatatggtgaacaccgtctctactaaaaatgcaaaacttagccaggcatggtggcaggcgcctgcaatccagctactcaggaggctgaggcaggagaatcgcttgaacccggaaggcggaggttgcagtagctgagatcgcgccactgcactccagcctgggggacaacatgagactccatctcaaagaaaaaaaaaaaaaacgaaagaaatgcttatatgaggtcattcattcatggtaataagtgcatgaataaagataaaggggtagaagttcaagatcagcctgggctacataagtgacagcagtctctacaaaatgtaagaaaattggccaggcacagtggctcatgcctgtacccagcacttgggagaacgaggtgggtggatcacttgaggtcaggagttcaagaccatcctggccacatggtgaaaccccatctctactaaaaatacaaaaattagctgggtgtcgtggcacacgctgtaatcccagctagtcgggaggctaaggcaggagaatcgcttgaacccgggaggcaggattgcagtgagtcgagatcgcaccactgcactctagcttggtttttgagactccactcgtcccaaaaaataaaataaaattaaattaaaataagaaaattagccaggtgtggtggcagcgcctgttgtcccagctgctctggaagttgaaatgggaggatctctttagcccaggaatggaggctgcagtgagccgtaaccgcgccactgcacttcagcctggctaacagagtgagccctgtctaaaaaacagaacaaaacaagaaaccaaagacaaagaacagcaaagaggctgcatgctgggatatagtgatggggagtgggaagaggtacaggtgatggggaaactgaggccagagcaaggcgatcagtccaaggttgctcggaggcatcagtgacaagatatggaggggatttgcattccctgcctacctagtgtgtgctgggccaagagtgggcactttcatcaatctgttaataatccttagccacctctaatcctgacttagtgaggttgagcttgctagtccctttcagagatgggaggactgaggctctgagacaccatgattccaagggctggcaagagcctctggaaacgaggctccttccaccacctcccagccactcgccactcatctcctccctcgcctttactgtgatttggcctcttctggctgatgaaatatgttctcaccatcactgtcatctgcaaagcaggaaccccaggctcaggggtttcagcaacttgtcggccgccagctaccagctccaaggccaggattcaaacccaggtctcctgactccatcagggcaatcgtcgcaattcctctggctcctaccacatgcccccaaatgcccccagttgcccaggcacccagtgtttaaggggatgtgggatgactccatcttgcttatccctggccagctcattctccccagtcgggcccccctcaaattttccctccttggagagccttatcctggtcccccttgcaaaaagaccccagaagatctctggcctccaccctggtctagtgcattcagagagtgggtcactatgaaaaccacctgtttgtgattgatatgtattttcagtctccccagtaggatgccggtttagaaatgtggagtcctggttgggtgcagtggctcacacctgtaatcccagcactttgggggctgaggcaggcagatcatgaggtcaggagttcgagaccagcctgaccaacatggtgaaccccatctctaccaaaaatacaaaaaattagccgggcatagtggcatgcgcctgtaatccagctactctggaggctgaggcagaagaattgcttgaacccgggaggcggaggttactttaggcaagattgtgccactatactccagcctgggtgacagagtgagactccgtctcaaaaaaaaaaaaaaaaaaaaaaagaaaaaagtggggtccttgtcgatatgttctcagctctctctcaaggtgtgtagtagctgctcagtaaatacgtattattgactgagaggactgcaaggggcagactagaggggcaagtccctgccaccctgcactccagagggactgctcggcagactgggcccaggactcacttggtgatgctgacatagcacaacaggcagacggccaggatacaatgcaggaaacgctgacgcccagcaggaggtgctgctcgaagggctccctgtaggcggaagtgggaggggaagccatgagctgaggtcagccatggtacagcctgggctccacttccaggactggagacccagggtcaggaccctcgtccgagaccctccacgatctgaccgccaccacccctccacctcatctccccaccactctccctcttgcacattgagtcctcgtcacccggccacctcattgccccctgctcctccaaagctcagtgccacctccagatcttaaactgctgctctttctttccggaagcacagaagtcaaatgcaccaacttaggagccggatggtccttgctgtgtgacacaggacaagtcccttatcttctctgtgcctccgcatcctcatcgtactatggggttaatgacagaattgatcgtgcagggctgttgcgaggatgacatgatgatcaatagataatgcactcagaacagagtggcctgtccacatcattagctgccatcatccaacacggttgacttctccttgttcactttcatcgtcacattctccaaaaagttttcccgacaccctccctaccgttgccccctgcccatcgctccatccccttcctctgcttttatttcttcccagcactcactgtcatccagatccatgtgatttctttctttctttatatgtttctttttgtctctccctccagaatgtcagctccacaagagtggggatttctatctgctttttcatcgccgattccccagtgtctagcacagggctagccatgtaggaggaactcagcaatatttgctgaaataatgaatgagggtcccatacattgttatctgtttcatacaagctagtcccttccccatgccaatggcagatgagaatcaattcaaaactttcccaagcacctggtctgtgctgggttctggagatacagccatggagaccctgcctatggagctcacagcccaggcaggagacacgtggctcaactgatatccacagtgcaggatgagcaatgctgagagggcgtgcggtggcagggtcagggtactgccagctgccactgcacctaccacgttgaagaatctctttcattgagttttcacgacagcccttactcctcccattatacagatggggaaactgagcagtcttcttcactcaacagctttttcctctctcccttgtcagggagccatgcccacctaaggcttgagccaatcacgattatcctgttcctttttccaggcatttgagttcccagcttccttgcaatgagcaagtaataacagtaaccatgtaacatgtaacagtcttggccaagagatgtaaggggaattttgctagggaagcttctagaaagatgtttgcttcctgattaaaaagagatgcacaaggtacactctctcgtagcagcctttcctttccttcctgctttatgaagacagtgtgcaacggccaacctgagggcatgggtggcaagtctaaggatacaatgccccatgtgaaggatggcagaagggaagacagcagaagggaagagatatcacttggctgcttacaaaacccagtaggtccatttgtaagacttcattttatgtgagataatcaatatttcactgcgaaagacctgtgggatacctcactgaaaagagttgtttctgggatgtaggttccagtgagaaagttcccagcctcctttgtggctatgtgtagtcatgtgaccattttcaccatagaatttgagaggaagtgatgcggcccacttccgggctgtctgctttcaagaagcagagtgatctccataatcacgcctcttctgctggctggatacagacaatggtggggccctaggcagggattcttcacttggggttgatggaccaacatggctgcaggtagaattcaggggttgagaacttggatgggaaagaaattacatctttactttccctaacctctcacacctagctctccttccattaagaatggaggaaggggccaggaacactggctcccacttgtaatcccgcactttgggaagccaagatgggaagatcactggagcccaggaggtcaaaagcagcctggcaacatagtgataccctgtctctatttattttaaaattttaaaaataaaataaaatacattttaaaaaaagaatggagggaagagaccccagtaatgacagcatcagtgatcctgtcccagcaaaacaaaactcacagctattctcatatcacatcacaatttcagtatcataaagattatttatgcttatctactttgaaattacagtatttatgcgagctacccctagaacttttatttatagatcttaataaagaagcacatatatctctagattaaaaatgtgtttaaatttttataactgcatttcaatacaattagtttcctctgtagttctatttattttattttattcattgtatttatttatttttagagatgggctcttgctctgtcacccaggtgggagtaagtggtacgatcacggctcactgcagcctcaaactcctgggctcaagtgatcctcccactcagccttcccagtacctgggactacaggtgcatgccaccatgcctggctaatttttgtcagatgggggtttcactatattgcccaggctgggattttatgtatttaaaaatattctgaatgaggtccataggcttcaccaggctgccaaaggaaaccaggacacaaaagtaggtaaaatctttgtcctggagaatgatggcaccacaagatggaaagaacctcactccccagattctacagggagggaaaccacctacaaaccagcaacattcacgttagcttgttacgtgagcagaaatatattcctatagtgttaagccatggaaattgtgggcttgtgtgttactgcagctagcctgcctacctggcagatacaccacggcaggtgtatctaatggcaggattgccattgaggcatcctatgatataaaagcccagagactcagccaggggaagtgtctggccacagggaagaatggagagtggagattaccattgcttaggcctcttgatactcacagttgtgccattggtgctggggctccactcactccaggtggtgttatagcactgagcccaggccctcaccgtgccctgtaggaaatcccagacttcagggtgctggctgcgatgcggagggagggttcaggtaggtcacgttatagattctgaactggtagagaaaagggagatgttagggcaccagcgggggcgaggggcaccagtgcccaccctggttgctgtcgttagctgaccccaccatgttaagagccaccagcctgggtatttggttgttcgtcctgttcaggccattgcttgccaccctgtaactgtgaccaggctagagcaacatgcgtcaggctcctcgactaattagctgtatttacttaggcaagttgtttaacctttctgagttttcgtgagataattcaatctcatctgaaaacaagggtaagagtccctactaccacttcctggctgtgtgaccttaagtaagtgactaacctctctggacctcaatgtcctcatctgcaaaatgaagataataaaagtgcctatccccttcccgcagggttgtggtgataaggaaatgggttaatatacgtaagtatttcaaatgggtttggtatacaaaaagcactgggtgatctttctaaaggactggcagggtcgaggcactctctctgtccttcatgggcttcctagtgtctccatggtcaagtccaaactcactggctagaatccaatgctctgcccaacctagcctctactgagaagtgacttccaagatctattttaagtaaacaagggaagatgcagatgtgtatgtgttctctgcttctttttatgtttttgtttgtttgtttgttttttaaagagagatggggctgggcatggtggctcatgcctgtaacccagcactttgggaggccgaagtgggtggatcacttgaggtgaggagttcaagaccagctggccaacatggtgaaactctgtctctactaaaaatacaaaaattagctgggtgtggtgcgggcacctgtaatcccagctactcaggaggctgaggcagaagaatcatttgaacctggaggcagagattgtggtaagctgagatcatgccactgcactccagcctgggtgacagaggacgacttcgtctcgaaaaaaaaaaaaaaaaaagagagagagagagatggcacagtgatactgcagacaaacctaagatggccccgatgatccccactttgaatcacatctttgtgtctctggtcttctcgagtgtgggcaggacctgctacttgtttctaacccacagaatatggtaaggtgatgggatatatagaggatttcatggatgtgattatattacagaagactgtaattcctacttgctaggcaagtctctctgccttgatggctttgcaaagggcacatgggaaggattcagggttaactacaaccaacagccagcacgaaactgaggctctcagttcaacagccgccagggactgaatgtcaccaatattgtatgagcttagaagtgacccttccccaattgacctcagatgaaactgcagccccatcccacaccttgattatagcctcacgagactctaaacagagaacctggctaagctatgtccagactcccaaccacagaaactatgagataataaagggtgttgtttaaagctgtgaagctggtagtaccattattatgcagcaatagaaaactagacagcgatgactgaacacacacatttgcttgtatagacataagctctctctaaaggatcacatgccctctgcctgccctaaccttgcctccctttcccttctggcaagagacagacacagtggtcagtctctgggaagaaaaacaggaggctggagtcgggagagaaacatgtttcattctaagtccttttgtaccatttgtatttttattttgtgtaactattacttttaccctcaaaaaagctttaaaaagtgatacatgaacgctatattcatgactgaccctgatggcaatgagcaacctgagttctcatcctgtcacccctctccctgcgagatccagggctatgcactccctctcctcttcctcagcccccggcagtttcttcctggttactggcagctccatttcgcttgtggttggaagcacatttggggaaacctggtgcaaagtgagccaaggggaggtttttcacaagaaagaagcaaagttccaaaagattgctggagcaactacagagagttcagagttttcctattacagagggagctgagggtggggtgtgagttgtggggagactggggaaggagagaaaattctcactctcttttgtctttctttctaaacatgagcaaacaagaagcaacgctagatgtaagttaccgaagaaatcttacaccctggaagggagctgggaactgggaaagttttactaagaaacaaaagagaaatctgagcttccaaagaactacttgcggtttgtctttttttaacaagaaggacaggtgtttgggagaccatctctgagagaaatgtccatgggagaaaaagagcacaggcttgggagttcaaatactgggtgcaaatctcagatctgggctggtgcggtggctcaagcctgtaatcccagcaccttgggaggctgagccagggggatcacttaagccaggagatccagaccagcccggacaacatggcgagaccctgtcgctactaaaaatcaaaaaattagcctggcgtggtggcctgtgcctgtagtcccagctacctgggaggcagagtgggagaatcacctgatcccaggaagtcaaggatgcagtgagccatgatcacgcccctcattccagcctgggtgatagagtgagactctgtctcaacaacaacaacaacaacaaaaatcagccctgccatttccagctgtgtgaccctgagcaatgtgcctggcacatagtaggcaataaaatatggaaaccattatgaggcaggcattcagggctctaactaaacttttggcttgtttggtgctttatcgctacacatattcccacatcccccaaccccataatcctcaaacatccatgaattttcacacccataaaccttttatcatgcagttccctctgcctggtctaccttcccttctttccccatctagaaaactcctatgcatccttcaatgcccaagccaaaactcccctccactatggaaccttgcctagaaattatctaggggaatgaatgagtagctctagcccaaaattctatagtaagttcctaatgtttctttctggaatttatcccactcagtatggccacagttggtgcctgcagtgctgtggcagatgcaggtggacacccgcccagcttttagccatcgggtttaggtgcccactgcttaggacagaactccactgcctgcaactccagggcaaccctcattagtctaagccaattgtgccaatcccatcacctggcctatcattcatcaaggggagcatgtggccaagctctggccaatcactaaattctttatgttcagctctgttctgggaagggagagatggggtatctcagttgccactgttccacccacaagagaagctggattcattcttctgcctcagacctggtatctggaggcctgtggcatccctgagcaccaacaacccctaagccatagcccaggcatgctgaccaatccaatcccatgactggcatctggtgcacgtcttaaacctggctggcattttagccagcacagtcctgcttcctcttccccagttcccctggggaagccactcctgccttattttcagttcatctggtttggatggagctgagccacctgcagccctagaggcaggtatgtgactcctccctggacaagcagggccctccaccgcaccctctctccacccacagccagtgattggttcagaggctggcacagcatcgaagccggccactgagcagcagccttaggactcttattagaaccgtcaagaaaaaaaacccttttccactgtggctttgggatgtaggcctggagcaactagtaggcatatctgccactacatggggaagagcctgcctaaaaacgaagccagtacagaataaagcagggcgcagagctggacggttcctagaagctggatccagccatgcctgaaggcagatctagaaatatgaaaatattaataacatatctttggactctgaaggtggtacctttctcttccccccagcccatccttggactctctgtaggtcttgcacaggcctggggcatgagaaggagatttattgaccaaacaaacttgccccactctctagcatctgtgcactccttccccccatgccccccgctttctgacctctgctgtgtgagccaactgccccattcctgctctttccccatacctggcccagtgcaaaggggaaaccagacctgagagatataaatcgacacccctggcttggccagattgagagaagcagtgacagacaccagcatgggagcttaaggtggcgggtgcctgctccctgagagcaaccaggcccagcctgggcccctgggatgcacagagccggccctcacaaacctcaaggacaaatgacagaccagtgtgtgggacagcgggcagatggggatctctgtggcctggggcctcaagagaaagggcacatggcttttaggacacatgtgggccaaacaggggagctcatcgtatcacacaccttgtactgtcatagccctgtgggcgggtgctcttgtcactcctgtgtacagatgaggaaactgaggcacaaagaggttatgggatatgcccaacatcacacagctgcgagtggcacagcaggcattggaatgcagccctgtgggaccccaggtcccatatgtccaagagtgtccctccaatgggaatgtgaggaaggtggattcagggtggggaaacatgggtgcaggaaatgacctccccgcacaccagcagaaaaatagggggactcagccacccactgtgacggcccctgccattactgacctgatagtttcctgtaaatcctctcgccctttttaaagtgtcaatacatgtacttaagaaggaactccactggccaggtgcggtggctcacacctgtatcccagcactttgggaggccgaggcgagtggatcatctgaggtcaggagtttgagaccgcctggccaacgcagtgaaaccccatctctactaaatatacaaaaattagctgggcacgtggcaggtgcctgtagtcccggctgctcaggaggctgaggcaggagaatcgctagaaccaggaggcggaggttgcagtgagccaagatcacgccactgtgttccaccctgggtgacaggtgagactctgtctcaaaacaaacaacaacaaaaactccaccaacactactgtgaagggatgtcaggaccagcttccatggggaacaaccaacaaactgatcttgttttcttgggaaatctaagcctggggtgtggcctctgctctcttcattaagaggaattagtaaacgagtcagtgtatggggacttcctccttaacccgttggcctcaaaagggaactgacacgggtcactgctcttgagtcagtattattctcttcaataatagggttattcaagtgagctgtcaatgtgcacctacgatcacttgtgtcccccaaactgggaaacacagatgtggcccacagccctactttacagaggaggagcggcatgcagagataactccccttctctgatgtgaggggtgggggccaggaagcaaagggacttgcctagggcagagccaggtgagaagccaggtctctagctctgggatttgctatccagccccagggcttgcctcccaggctcctggctccagggactggcctctgctggtcacccaccctgttccccagaggtcacagaaaaacgtcaaagcatgcccctcacatctgccgggtcgttttcactccaaatgttgactgcataggtgagatgattataaggtaattgtcagggggatacgggttgctccaggtcagcagcagagtgtcggagacattgtgtgaactgtcaggtttcctggggccctgggtttcactgcgggagaagcggcctctattgaggatctatgcagtgactcccccatcacccagcccagccccggcctacaaaccacagcaccacccagatttttggtcgacaaaacctccatagcatacttctggagcaccacacagttcagagccatagcaaagaagattataataacaataatgttgctaaaattctacatagactttagtgtttattaattaccctttttttcttcttttttgagacagggtcccactctgtgcccaggctggagtgcagtggcacaatcccagctcactgcagcctcaatagcccagggccaagtgatctgcctgcgctgggctcccaaagtgctgggattccaggcatgagccaccgccctggtctttactaaccacctttctacagtgaaggcaaagtgtatgagccaaagtaaccaaacttcagccttttaaaaaatctttttatttttatttatttttatttttttgagacgtatctcactctgtcgcccaggctggagggcagtagcatgatctaagctcactgcaacctcttctcctgggttcaagccattctcctacctcagcctcccaagtagctgggattacaggccctgccaccatgccagactaattttttgtatttttagtagagacggggttttaccatgtgtccaggctggtctcgaactcctgacctccggtgatccgctgggctcggcctcccaaaggctgggattataggcatgaaccaccacacccggcctcaaacttcagcttttacagctgctccttcacacctttggccacatctctgtactttatgatgatttactgagtatttttcttattttgattcatctgttttaaaacttggtctcctttgaagcaatcatatccatgagacccaggtttttattcctgtgatgcatgtcatatcatgcatcactggaatacaacgcatgtttaaactcctgtcaccacagcccagcaagctcaagggggattcctgcagggactccgggtccagaagaaggtcagccttccacggtcaagaccatccaaagccgcagcagctgaccagtgacacagaatggaaggaatgttcccagttcggttttcaatcagcagcaggcatgccttcagcaagcacacctcatctcaatacgccttcctgggcacttaagttcaggggtggaaacactgggctgaagggggcttggtggtctactgcgaccagctccgtttcaaaggtgggaggatgaggcccaggcaggggcaggaatcccatcagatttgggaaaatacaggcggcttcctctgctgttgctatgaccccacctcctcccctgcccaccccaccctcagcccaggcagctggggaacacacccagccacccctgccgcactccgccctgctcaccatgctcgctgggcttaaggagcccttccacagcagctgctgcccagcccacaggtccagtgtatagttatccgcctgaccacgtcatccatgagcaggtggcacacgcaccccgcgcctccgttgttctcaggacacacgtgtgggctctgcagacacaggggctgggttaggctggtcacctgtaggctggtgggccccacagctgtgtccgggacatgcctccaggaaccgcatcagactcttccagctcccgatcacggatgtgaggacagatctgggggcttgggagcggccagggtgtgctggggagccgactagggttgcctctcttgctggccacagcctcttaccacatgcaccaaggatgtcctcacacctgcctagctgccggccctggtcctgggacttagcttgttcctgaaagccatgaaagggaagaaccggtggcactaattaatttagaacaacataagctctgcatcgcaagtttggccatcgtaagataattccaatgttccaccttaacagccaacccacatctcacggctaggccaggggtctgcaaactttttctgtaacaggccagatagttaatattttggattcaaaggccacacaatttccttttttttttttttttttggttatttgtataaatttaggggtacgagttttttgttttttgtttttgtttttttttcctgagacaaagtctcactgtacccaggctagagtacagtgatgtgatctcggctcactgcaacctccacctcctgggctaagcaattctcccgcctcagcctccctagtagctgggattacaggtgtgcgccactacaccagttaattgttgtatttttagtagagatggagcttcaccatgttggccaggccggtccgaactcctgacctcaagtgatctgcccacctcggcctcccaaagggctgggattacagcgcgagccaccacagtgcccggccttacaagtgcaattttgatggcaagcctcagatctttctcactggatatgctgcctagtggtgaagtctggggttctggtgggtccgtcacccaatggtgtacactatgcccattaagtaacttctcttccttcacccctctcccaccctcccagtcttcaatgtctgttattccatggtacatggaataatgcccatgtgtacacattattaactcttacttataagtgagaacatgcagtatttgactttccatttctgaattatttcattaagataaaggaggaggccgggctcagtggctcatgcctgtaatcccagcactttgggcgctgaggcgggtggatcacctgagttcaggagttcgagaccagcttggccaacatgataaaaccggtctctactaaaaatacgaaaaattagccgggtgtggtggcaggcaccattatcccaactactcgggaggctgagacaggagaatcgcttgaacccgggaggcagaggttgagtgagccgagattgtgccactgcactccagcctgggcaacaagagcgaaactctgtctaaagaaaacaaacaaacaaacaaacaaacaaaaaaaaacataaaggagggccatgcagttctgttacaactacagcagccagtgtgttccaataaaactttatttacaaaaacaagcatgggccggatttggctcacgggccatagtttgccaatccctggactaagccaatggaaaaaagcacagcccatctaccttagaataatcatggaataccacctttactggtgaaccctcatgctggtgtgccgtatatccccagtctgccccgtaactgtgtgtcttgtgtacgtgatatgtcctgggcaccagtgtaacgaagcatcctgtgcaccatggagtagcccagggaacacctgactcctatgccatgtgtcctggtccatccaccatcacagaggactccactctcacaccgtactcctcaatcaagggtctagtccagtggttctcaaagtgtggtctgggcccacaggtaaaactcttttcatcataatacagggacgttatttgccttttcactctctctcatggcgtacagtggaattttctagaggctacatgacctgtgatcatgtaattgatctgaaatttgttgaatgcgggcttgcatgttgttgggacttaaaatttctccattttgggccggtacagcggctcacgcttgtaatcccagcactttgggaggcggaggcaggaggatcactgagcccaggagtttgagagcagcctgggcaacacagtgagacctccatttcagtaagaaaaaaatttttaattgttttaattttttaaaaattacaccatttcttcattgcaagttctattaggtaaacatagaatgatgtgttacctacaccaaagccctttgggtcctcactcattttaagtgtgaaaaagggtcctgagaccaaaaagtgtgagaactgctggtctagtccagtttccagccgtatccatgtgccacgtggaccaacactcccaccatgcgctccactgtatctacataacatgtccctggagatgggacctcccctctaacaccatataaacagcagcaaacatactcagcatcctgcactccagcgcaccacctggacccagctcactcttggggcaaacctttgggcacaacctccccaaacctccagctccagcgcaggcttactcggagagcagaaaaccagctggtacaacaggcggagctcggtgctgcaattggtgggaccattcatcttcactcgcaagtagagatgctcatgtagtcggagacgcaggtgggctcctgcaagaccttctgttccctggggagacacaggagcagcctgagcggcccaggaactcaatgcgtgaggggacttgcacccaaacaggaccaaggggaatagcacaaaagcacagtgcaggcaaagttgaggccagcgcccacagagctggggccaggaccagggctgctggagcttcccagctagtgtgggatgactgtggaagctgaagaaatacccatgggtgcgggggccattagacaagaacgaccaagtgcacctttatctcacacaaacttgacaacttgttcttggccaaattaaagggaaatatgtagcagtttaaggagtgccattccatcacaccaagcctctgccctcgagctagggaagtgccacttccccatttgcccactatctgcgcccctctttgtctccaccccttttgccctctctgtgctcaggaggctgataccacagtcttcatcaccgggtacccttggccttagtttccggttgggtttggccaatgggagagaggagatggatgggctggaggagacacggggtccttctcctttcagcgccctcctagcttgtcagtggccatggcaggactggaatggcaggatgtacactgagtttgctaaaccacctgagcatgagaccactcaggcgcctcatgctcccatgctcagtgccacgcccatctcagctgacaacaacttgcataagggcttacatgttaaggagctgtcttagatagcaaataaatattccaagcttatctcatgtccaaactaactcctgattcccgcccctccccaaagtaccttctcttctggcatccttctgcattcagaaatgacaaccgcgtccttcccagtagtttaggtcagaaatcttggagtcatcctgccacttctctttctctgtctttcacctcaattccaatctgtcctcaaatctacctcccaagggatccggagcctctcatctcctccactccagacctccctccagacctcctggcttcaccctcttcctttctccacacggcatcctgaagagtcctttggaacataatggatgataggatcctctgctcaaacactgcaaggtcttttttgattcagccactctgtcaccttgctaccttcactgctccctcctgctgctcactctcctccaccacattccctcctgtgctcaacctcccgccaggctcagtgcagggcctctctgccaagaatgagccttccccagacatctcacggttcccgcttcctccaagtcagctcaatgaggccttccctgacttccctactttcactgcaatcccccccactccacccagcttccccaaccccctcttatgctgttctgtgtttttccccatcaccttctctttttttttgacagggtctcactttctcacgcaggctggagggagtggcgcgatcacagttcactgcagccttgacctcctgagttcaagggatcctccccctcggcctcctgagtagctggggctacaggcgtgcactgccacacctggctaatatttattatttgtagagacaaggtctccctatgttgcccaagctgacctcgaactcctgggctaagcgatcctcctgcctcggcctcctgaagtgctgggattacaggtgtgagccactgcaccggctcccatcactttctaacaatctttagaatttactgataatcagggccacttgtcttggctgtcccctcccactgcagtgtaatctccataaggccaggtgacatactgcaggacctggcacgccattaatagccaacaaatgaatgattgagaagtggtgacttaccagagctgccacctgcagcaggaccaggcagctcacagggaacaggagcccagagcaaagccacccattgggagatgccaaggcacctgcagagagagaggaagcaggttagtgctgacctgtgttccagcagagctcatcttattcaatatgcaaccctcccctgccctggccatttatttgttgtttgtttgcttgtttgtttgtttttccgagacagagtctcgctctgtctccaaggcggagtgcagcggtgcaatctcagctcactgcaacctccacctcccgggttcaagcgattttctgcctcagcctcccgagtagctgggattacaggtgcccaccaccacacctggctaattttgtatttttagtagagacggggtttcaccatgttggccaggctggtcttgaacttcgacctcatgatctgcccctctggtcttctcgaagtgctgggattacaggcctgagccacgcggctgcccagccatgccctggccatttgtgtctctgccgacaacaggtcctccacgtcacagagctctctctataatcatgaaacaacacccagacccacaaagtccagagggtgactacacaacaactgtcctgggagatgcttctggatgtggccttccttggacaaccctctcacatgtttctctgattatttcctgaggtttaaatacctgctctgtcactgactagatggaaccttgagcaagctgtgcttccatgcctcagtttccttatctataaagtgggactaaaatagccccatctgattgaggtgttgtggggattaaatgagctaacacagacagagcccccaacagtgaccggaacactttaaagtctcaagtaacgttacaagtcagcttagtccattaggctgctataacaaaaataccttagagcaggtaatttacaaagaacagaaacgtattctctattgggtgcaatggtgtgcatctctagtcccagctactcgggaaggtggggtggacacttggagtccaggggtttgagaccagcctagggaatatagtgagacctcatggtgaattttgaaaaattgttttaaattttattattcaggccagacacagtagctcacacctgtattccagcactttggggagccaaggtgggtggatcacctgaggtcaggagttcgagatcacctggccaacatggagaaaccccgtctgtactaaaaatacaaaaactagccgagtgtggggcgggcacctgtaattccagctactctggaggctgaggcaggagaatcgcttgaactgggtaggcagaggttgcagtgagtcgagatcgcgtcattgtactccagcctgggcgacaaagcaagactccatctcaaaataaataaataataaataaataaattttctaatgcatagtctggagactgggaagtccaagatcacgacactaggagatccagatctggtgagagcccatcctcacggacgatgccatgctgctgtgtcttcatatgacagaaggggcaaacacacttcttcagcccgttcataagggcactaaccccattcatgaccaaccacagagccctcatgattaatcacttctccaaaggccccatctcttaatatgactacaatgggatgaagtttcaaatatgaatttgggggaacacattcagcccatagcaccagctattatcattaagaaaaaagttcagaagccaggtgtggtggctcacacctgtaatcccagcactttgggaggctaagggggaggatggcttgagcccaggagttcaagaccagcctgggcaacagagtgagaccttactctacaaaaattaaacaaaatcagccaggcacggtggtgcatgcctgtaatcctagctcttgggaggttgaggtgggaagatcgtttgagcctgggatgtcaaggctgcagtaagccagaccgtaccactgcactccagcaagaccctgtcataaaaaaaaaagaaaagaaaagaaacagaaagtttgggaggctgaggtgggcggatcacgaggtcaggagtttgagaccagccggccaacatagtgaaaccctgtctctactaaaaatacaaaaattagccgagtgtggtgggcacacctgtagtcccagctacacgggaggccgaggtgggagaattgcttgaacccaggggcggaggttgcagcgagccgagaccatgccattgcactccagcctgggtgacagagtggactctgtctcaaaaaaaaaaaaaaaggaaaagaaaaaaatgctaagaagcagaatctccggagtcaagtgtgtacttttccccagcactcctggtacataacgtcaaataccctccaaaagtgtgtactggggccgggcgtggtggctcacatctgtaatcccagcactttaggagtcacaaccagcctggccaacatggtgaaacctgtctctaccaaaaatacaaaaaaaaatagccgggcggtagtggcgcgtgcctgtagtcccagctactcaggaggctgaggcaggaaatcgcttgagcctaggaggtggaggttgtggtgagccgagatggcaccactgcactctagctgggcgacacagtgagaccctgttgcaaaaagagaaaaaaaaaaaaaagaaaaagaaaaaagaaaacagcacgcgctgggttatattccctgcaacatttcaagtgcccatccttccttcccgcttgggtctctctcctgggatcttattcaaaaaagcagctcccaggctttgtctgctagtgagtagttctttgccattaacagcatttctcttttggtgctctggctgtgttctgtggcacaggaatggttccaaggctaacctcacaggcttgcagcaaacaggaacggggtgttgcctctgaagcactgtgtgcagtgtctggggcatcataagaacttaaggccactcaggagctctaggcccctgctggatgctctccgagtgacttgggcacacttgaaggcctccccccagcagggctccacctccctctccacctgggcccagcacccatgcatcctacgctgccacctacacttcttcttcttttttgttttttaacattttattttattttatttcatttatttttttgagacagagtttcactcttgttgcccaggctggagtgcaatggcgcgactcggctcactgcaacctccgcctcccaggttcaagcgattctcctgcctcagccttctagtagctgggattacaggcatgggccacacacccaactaattttgtatttttagtagagcagggtttctccatgctggtcaggctggtcttgaactcccgaccccaggtgatccgcctcctcagcctcccaaagtgctgggattacaggcgtgagccactgagcccggctgccacctcacttcttaaacacaccaaactcagtcccacctccatgccttttctctctctgtcccctcacctggagggaccttcccttcctccctttccttttttttttttttttttttgagacaggtttactctgttacccaagctagagtgtagtggcacaacctcgactccctgcaacctcccctcccgggctcaagcaatcttcccacctcagcctcctgagtagctgggaccacagatggcaccatgaggcctggctaagtgtttgtatttttgatagagatggggtctcattatgttcccaggctggtctcgaactcctgagttcaagcgatctgcccaccttggtctcccaaagtctgggattacaggcgtgagccactgtacccggcccttcctcccttacgcgtgcttttccctcttcccctaatttatgatggtgcaaaatcaatgggtgttcagtagaagcagtacttgagcacccatacgaccattctgtttttcactctcagtattccataaactacacaagctatcaacactttataacaaaacaggctttgtgttagatgactttgcccaactgtaggctaatcaagtgttccgagctaagttaagctataacgttcagtaggttaggagtatgaagtacattctgacttaataatattttcaacttatgatgagtttatggggacaaaaccccatcattagaaacatctgtgtatgagacacataaacacactcacatatctccataatgaataaattacccaatacctcagtgtgcatgtcagaaaaacaaggacattctctgcataatcacaatacaccatcgaaatcaggaaattaacagtgatgcatcaccactatctcatccacggcccctattatgttttgctaattgcctcaataatgccctttatacgtccaggatgcaatccaagatattcatcacatttgattatcatgccttcctagtgaccaggtcttggcttctaaatactatctgtactgaaaggaaccagagcgccttagagaaatagctgattccaggagaaggaaaataccagataggcttggaattcttgtgccagacaataaggaagtactcagcagctagcctacctggacaaaacaggcacattttgagcatcaaaatgaatattatggtatccacttgtacccttggagttaaagtccaggagtctgtattgacatagatcaataaatggaggaggccggtgcagtgtggtgtgtgcctgtaatcccaacttcttgggaggctgaggcaggaggatggttgagcctgggagttggaggctgcagtgagctatgatcgcaccaccgcactccagcctggcaacagagtcagacttcatctctaataaataaataaacagggaagaagggaaagctctttttactatgacagcctcaaagtaactccctgcaaaacttgtattgtatattaactaatagtgaaaatacatatcaatgaacgttacaatacagaaacctggcagacaccaccttcacaagtgatctaaactcaccaacaagaatgggacaaatccccaacatcacctccctgaaacattcctgagaagagcacagcatgtcttttcctgggttcctgccaaggatgcatacatcattggaaacgtcagacaaatgtacaccaagggccagtctatatacaagaactggccgctgtcctcacgaagtgccgggggtgcaaaggacaagccagcgtgggacatctgtccctttttaattgtctgtcatcctgacagccagggtctgtcccattcactgccgagtccccagtatcacaacggtgcctggcacataggacgtgttcagtaactgtttgttgattaaattcattttgacatgatgtggggcccctaactggctcagcatgaggctgcaaagctctctctaggggaggctctgtatcggctcaaaggttgaactcgtcttccttgctgagagttacaaaagtaaatctcaagtaaaggaggggcgggaatggggtggtgggttcctgacactgatttccttggcagtcctagtaacttttactctcacaactacacagatgcccacagtatcctgtggcagagtggcaaaggtgtcactttagcctcaattatgaataaagagaaacagagaggccaagacgctgtccaaagtcacacagcagaagactttcatggtaaagtcctccagggaaacaggggatcaacaaccctgtcaagattcactaaaacatcccagcatggcgtcaggattgatatcctaatctgttgtggaaggcacgcccagacttacgcatgcccatgtgcacacacacgtgccgagctagcttctcagggatgtgtgggtgctacatttcaggagagatcacagatgcagtggagaagaggcttccctgaacatcagaggcaaaaagaacaaagatgcaggtgagtaaaagattaaaaagataagtgccaggttatcgcgttcaagtacacggcaagaggagatgatttcagttcccattctaaatcaagagactcctggctgggcgcggtggctcacgcctgtaatcccgcacttcgggaggctgaggcaggcagatcatgaggtcaggagatcgagaccatcctggcaacatggtgaaactcagtctctactaaaaatacaaaaaattagctgggcgtggtggcagtgcctgtagtcccagctactcaggaggctgaggcaggagaatggcttgaacccgggaggggagcttgcagtgagccaagattgagccactgcactccagcctgggtgacagagcaagatgtctcagaaaaaaaaaaaagagattcctgaagtggtggagttggaaggggtctcagcgtcacctgccaagctcaactgccaacctggacaaggatgtcctgcgaacaccccacttctacatgctgctaggcagtttcagcccatatgccaccacagatggagcaatcactctcaggctcagttaagcagagccattggaaacagcctccttatgttgagtcaaggctttgtgtgacaaaatccctgcttgcccagcacttaccttgtacttgacactttgctaggtgctttagagtattacctcaccgaatccacacaagaatcctgaaaggtaggctgttatcccaactgtcagctaaggaaactgaggccagagaggccaaataacccatccaccaggtcccacagctggaaaaggtcagagctagaatcagaacccacgtttgtttgcttccgagcccaccgtggattcagtataccagttccttcaatctcatctcctaaaactgcaggctgaacccaataagatgaataaaatgagccgggcagagttggccatcctgcttgtcaatttcaaacaacagttccgaagtgtaggataagaaaatctgactgagcagcagaaaagtcctgaggattttatcatctcaaaatctccaaaagccaatggtgaagcagcaacttaaaaaaaaaaaaagagtcacccgggtcatattaacagaggtatccatttatagactgttacatctcacaacagcagaatataattctcctcaggttcatgtggaataatcaccaagacagaccacattctgggacataaaaaaccttaagagattgaaaacattagaaatcacacaacatatgctcttaggccacaatggttcaaattagaagtcactagcaggaagaaagccagaaaatttccaagtatttggagattaaaaacacacttccgaataacatatggatcaaagaagaaatcacaagagaaactaaaaaatttttaactaaataaaaatgaaaatatagcctatcaaaatcggtgagacgtagcaaaacagtgcttagagggaaatttatattattgaatgtatatcttagaaagaaagttctaaaacaataatctgtttccatctagagtactagaaacagaaaagcaatatatgtctaaaacaacagaagaaaaaaatacaaaattggagcatacatcaatgaaattaaaaatagaaaattaacgaggaaaatcaatgaaatcaaaaattggttcttcgaaaagatcaatgaaattgataaactctacctaggcgaatcaaaaaaatgagagagaaggcactaattaataataatgtgataggcctggctctgtgtccccacccaaatctcaccttgaattgtaatatgaattgtaatcccacgtgttgggggaaggacctcatgggaggtgattagattacgggagcagttcccccatctgttttcgtgacagtgagtgagttctcctgagatctgatggttttataaagggctttcccccctttccttggcgtgtctccttcctgacgtcatgtgaaaaaggatgtctttgcttcctttccgccatgataatatgtttcctgaagcctccccagccctgcagaactgtgagtcaacctctttcctttataaattacccagtcttgggcatgtccttagagcagcatgagaacaactaatactattgtaaattaaagaaaagttattagaggtggcacatgcctgtagccccactactgggaaggctgaggcaggaggatcacttgagcccaggaggttaaggctgcagtggctgtgttcatgccactgaactccagcctgggcaacagagaaagatcctgtctcaaaaaaaaaaaataaaatttttaaattaaaaaaaagtggcactatataatgattcgggagttaatctccaagaagatgtaaataacaatccttaatgtgtaggcaactaacaacaaagggtcaaatatgtaaggcaaaaactgagagcagcaaggagaaatagagaaatctgtgtgattattcgaataatactattattggataataatagtattattactattacttcaactcttttggtatcgacagatccagcaggcagaaatcagtaaggacacagttgacttgaacagtgctgtcatcaactggatctaagtgcagtgtgcaaccacaacttggcatccctttggaaggaatactctgtcatgtatgacaacaaccaacacagagagggcctgataatcccaggaggcctagaagtctttacctggaaagctctgccctcctatactgggcagcctcaccattcacttaaacaacagagtttaccacatgccaagttttcttttacatcttttacatacaagaatgcatttataatctatgaaataggtaatattattttctccattttcagatgaggaaaccaaggcacaaaaggctgagtgatttgtctgaggttgcacagctgtgacagtcatgggtcttaaatccacactcaagctccaaagctttggttcttaactactatctgtctagaagtcagagaccttatgttttggggatcaatgacctatctgagcatctaatgtaaaccccaaaccctgtttctgcaaggtgcatacacttaattctgcattccattttaggggttcacagaatccctgaagccaagtgaggacctcaggtcaaaggcctgtcctctaagcagtgggcagcttttgagggtcttgagcaggggagtggcaaatttttgagaagtctggggggatgtgggcagttagcagttgtgcagatgaggctcaccctgcctcttctccacatcacagccagagccattttaaaatcaaaatgagaccagggccagctcacacatccaatgccccctggctcctaaagggcttcttccaggggccacagatccccagggggttcacagctcattagagaagcatctctgacttagataaaatccaagccctagagtgaaaaaagccagttcccagagtacacaccccgtgactcctttatgtaacatacttgaaatcacataaccatggaaatggaaaacacatcagtgggtgcaggggctgagggggtgggtcaggaagggagttggatgtggctataaaaggagaatttgaccatccttgtgatgatagaactgtgctggatcctggctgcatacacaaacctatgccgtataaaattgcatagcactaaaccacacatgcgtacgcaaacacaaaaatgagtacaagtaatcgggaaatcccaataaggtcagtagcttatatcagtgtcagtatcccagctgtgatctgtattacagatttctacaatcttgccctcggggggaacagcatagaagcaggggtcttctgtgatttctttttctttttcttttcttttttttttttttgagatggagtctcactcgttgcccaggctggagtgcagtggtgtgatctcggctcactgcaacctctacctcctagctcaagtgattctcctgcctcagcctccccagtagctgggactacaggcaagccaccatcccaactaatttttgtatttttagtagagatggggtttcatcatactgaccaggctggttcgaactcctgatctcaagtgatctgcccgcctcagcctccaaaagtgctgggattatagcatgagccaccacgcccggcttctctatgatttcttccagctgtgtgtaaatctttaatatctgaaaataaaaagtttaatttaagaaaatgaagaaaagagccaattcccctgctttccctctaacattcccctcctatcccctctccctcttctgcaatcctccattggcctcaccctgggatacactcccagctctcccttttccaagcatttgcaccagaaacacttcagagccttctctgacccccctcaactaatgcgggccctccctgtgacttcttatcacagcacctgtttatgtctgtcccagtacttatcactatctctaatcagattaatgaggttacatgatgaatgtttattttatttcaagatgcagatagcaaagatagctttgactgcaaaatgtttcaacttccctagatttttttttttttttttgagacggaggtttgctctgttccccaactggagagcagtggcgtgatgtcggctcactgcaacctccacctcccgggttcaagcgatcttgtgtctcagcctctcgagtagctggaattacaggtgtgtgccaccacacccaactattttttgtgtttttagtagagacagggtttccccatgttggccaggctggtcttaaaccctgacctcaagtgatccacccgccttggcctccaaagtgctgggattacaggcatgagcactgtgtctggcctagattaaaatatgccataagaaaaagacagaactcaagtgtgttgtccatttttgcattgctataaagaaatatctgagactgagtaatttacaaagaaaagagtttaattggcttatggctctgcaggctgtacaggaagcatagcacccgtatctacttgcttctggggaggcctcagggagcttttattcacggggaaggcaagaggggagcaggcgtcatggtgacagccagggcaagagagaggagggaggtgccgcacacttctaaacaaccagtcttgtgagaactcactcactatggcaaggacagaaccaaaccatgagggacccgtcccatgacccaacatctcccaccaggacccacctccaacactggggatcacatttcaacaaggatttagagaggatgacatcccaactatatcagcaagcaaaagactagaaaaaggtagcatctacattatgaacggttaatggccttaatatatgaagagttcttacaaatcaataagcaaacatccctttaagaaaaataggcaaagaacataaatggttcacaaaagacatattctccatcagatgtgaaatagccacctcaatatactgctagtttttcaagttgggagtatataggtaacctcaaatttaaattatgtatttgtctataaatgcattgtttgcctccctctagagaccacaagccccatgagggcagagctttatgtctgctgtgctcactgctttatcccagtgcctgaaacagtgcctgacacaggcatagcatgtgtacaataaacatatattaaagaatgaatggtttaaaagtcagcaataataggctgggcacagtggctcacgcctgtaatccagcactttgggaggccgaggcaggtggatcacctgaggtcaggagttcaccaacatgtgaaaccccatctctacaaaaatacaaaaattagccgggcatgatggtgggtgcctgtatcccagctactcgggaggctgagaggctgaggcaggagaatcgcttgaacccaagaggcgaggctgcaatgagttgagatcacaccattgcactccagcccgggcaatagagcaaagtctgtctcaaaaaaaaaaaaattcagcaataataaattcaacaatctttttttttttttttttgagatggagcctagctttgtcaccagtctggagtgcagtggcacgatatcagctcatgcaacctccgcgtgggttcaagtgattctcctgcctcagcctcctgagtagctgggacacaggagcacgccatcacacctggctaatttttgtatttttagtagaaacgggatttcacatgttggccaggatggtctcgatctcttgacctcctgatccgcctgcctcagcctccctagtgctgggattacaggcatgagctaccgcacctggcctcaataatcatttttaaacagaaccaggtcccaagcttttgtccatagttaactgtatatgcagtacttattttgtgccggccctgttctaagtacttacaatatattaatcaatttggttctcccaacgaccctatgggtaggtgccattaacattcccattttactgatgagaagactgaggcacaaaaaggctaagcacttgctggtggtcacagaaccataacctaggcattgtcactccaaaatccacgtgttaaggactgtggttgctgacccttgaaatgcagtccccaaaaccctggaactttgtccgggagccccactggcctgagacccattggcctgagacccagagacagcaagtgacaaggcaaggtcacagagttaggaagcagcaaagtcagtgaaggccgcagccaggaaatgagcaaagcatgggcctgggaaaacacgcccgccaccaggagaacacacttgactcacttttttaaaaaactcgggggagattaagtgattaagccttgaaatgtcagaagccagcagcagccggaagcgacccagcaggactcttcccgaacccacagcgggtggcaggggggcagggggcgaggactgggggcgcacagggggcggtacaggccttctgctcttcttccctctgggcagaaacctggcttggaggaggggctggttctgcagacaggatgcaagcacctctgtgacagtggcatgtggagaggaatccagggacagcaggggcctcgggtgggggctggggctttgggccgctgacccctgaaactccacgacagaaactggcctgaaacctcagctcctgtggcgaatcagttagtcatgctacttataagaaaccagcccagagcttcctctggcttctgggaagctgggctgggctggcaggaagctaggcatgcacttcttcctgggacagtaacctaccagaactggggtttccagaaatggcagccacgtcggtggccccactgggatagtaaggcagccaggccagggccccagaatggcccgggatctgcctggttggctccgtccccagcccaccagtgggagggaggggaggcaacagactggctctgcagccaccaggaacacaaatcggcccctccaccaacagcacccaccagcctccctgtgggcctgctgtggctcaaccatcctacccacttgctcaagtacctcacttattctccttctcttttttgctttagagacagggttcattctgtggctagaatgcagtcgcaccgtcacggctcagtgcagccttgaactcctggctcaagtgatcctcctgccttagcctcccaagtagttgtgactacaggcacacaccacatgctcgaataatttttaaatttttgtagagatggggatctctctctgtggcccaagctgagtgctatggcacaatcatagctcactgcaacctcaaactcctggcctcaagcaaacccctgcctcggccttccaacatgctacaggcatgagctgccgtgtccagccatctcctcattattcttgctgtgggtgttttccaagtactgcctatgtgctggctattacagatgcaacaggccattcattcattcattcctttcttcttttaacaaatatttgagcaaggaagaagtgccagagcgttttgagcaaagaagtgacatgatgagactttaaaaaagacctctcttgttgggtggtgggggcacgggtagaagtgggtagcagtgaggaggctaccacactggcccagagagaggtgccagggctcacaccaggctgcggagatggggaggttgagaaggggctgattctagatctgtgttgaagacagagcccacaggatttgctgacaggatggatgctgtgggcgggagagagaacaggaaggctaataggagtcaagaatgattccacagccattggcctttccaagatggcggcctgtgggggtagcccgtgtgacaagccagcctgctgggcaagcgcaggacttcagattagcagaggaggctgttagcaggcgctcagggaagaccctccctctcctagagggtcaggtttctttatcggggatgcaccagagttctctcggggaggggcccacatacagcaggcactcaataagtgagcatgtgtattttattttattcttattttaacagtatacagtgtttccttggtgccagacactggcctaggtgctttaagccctccctatgaataagtataattattaaacccattttatgattctgaaggttctttttttttttttgagaagagtctcactgtgtagtccaggctggagtgcaatggtgggatctcagttcactgcaactctgtctcccaggttcaagtagttctcctgcctcagtctcccgagtagctgggactacagtgcccacaacaacgcccagctaatttttttgtatttttagcagacacagggttttgcctgttggccaagctggtctcaaactcctgacctcaggtgatccacccacctcagcctcccaagtgctgggattacaggcgtgagccactgcgtctggcagattctgaaggttcttatgaagggcggggtgagggagggaatgagggaagacccagcgaataggcaggcaggagggaggcacggcccacttcccaccctacaagcggggcccttggctggagcaagggggagaaggacggctgggatggcagctggaaggttggcaggccagggacaacaccgtctgccaagccatgcagtagactcaaactctgtctctagggcagtggggagccagtgaaggctcttaagcagggaggagcgggctgagctgagagctggcgaagagggggcaggtttgagcctgtttgggagaggaggcagcagggacttggtggcgcttggtggggaaagcaggctggggagagcggggaagagggaaagtggcctcaggctggggtggtggggaggatcccagggacccttcccacgaggagagccgagaagagaagcagatttgctggggaagaccacgcgctccggcgcactgtgacactttgagtccacacagtcaacaggcaactccatccgggatcctggaagccaggccttcttcagaagattccagaggcccaaaggaggaaacagagcctgaggaaactgtgtccagagccacctacccaggaacagcagccagcctggcctccatctttctgcaacctgttatctgctttatttctctgcaatctttgtggcatattgcacactcgggccttatgtgtttggtgtcatatcccctactgcaaggccagctcacacaaggccagtgtcgatcccgctcacagcctctccccagagcctagcacggtgcctggcacacagcaggtgctccatgaatatttgctgatggaagaacgacaggatgaattcccctggctgtgagcagggaggcctggttggtcatcccaattttccacctctccctgctgggcaaacactagcaaatcctggcttggagtcccctaaatgtcctaatgcaggcacagatctcagccacctcggggccctgacctccagagagctgttatcgactatcactcactgtcctgagcagcggacaatggcctcttggcgccagggtgtgattagattttgactgtcttagtgacagctatggctcctagctggcctccttcttgagtctgcagaggtcactgtgactggccacgtgtcccctcttccttcagccatgagaggccagccctgggcccttctgcccttggtttcgcccctccccaactgggtgcaactttgctcacagccttggcattggttgtaccagtctcactaacaaaaaaaagcacttgaaggctgggcgggtggctcctacctgtaatcacagccatttgggaggctgaggcaggtagatcacttgagccaggagttcaagaccagcctgggtaacatggcaagaccccgtctctaccaaaaatacaaaaaaaattgccaggcatggtggcacatgcctgtagtcccagctactaagggagatgagcaggaggatggcttgagcccacgaggtcgcagctgcagtgaactgtgatcatgccactgactccagcctgggcaacagagtgagaccctatctctaaaaaaaaaaaaagaagcccttggcctcactcactcacttaaccatggacccaatccaa

SEQ ID NO: 5086 - DNA, 100000 bp, Homo sapiens
cctgctctagctgagtattttacaatcattgcaaagcactagcatccataaaaaatgctatcttggcatccataaaaatggtattcatggctgggcgtggcagctcacgcctgtaatccagcactttgggaggccgaggtgggcggatcacgaggtcaggaggtcaagaccatctggtaacacggtgaaatcctgcctctactaaaaatgcaaaaaaaaaaaaaaaaaaaaaaaatagccgggcatggtggtgggtgcctgtagtcccagctactcgggaagctgaggcagaagatggcgtgaacccgggaggcggagcttgcagtgagctgagatcacgccactgcactccagctgggcgacagagcgagacttcatctcaaaaaaaagaaaaaaaaaggtattcataaggtcctcgagggatgatgaaatgagtaacttgacaaatctttggggcttgggaaagtctacttacatcacttggggcagggcatgacatagcatatatttgggatacacatgcctgacagccagtcttcatttgaggaatctgggatcaatacatgatccaaatcttggtactgtgggtctgcatttggatttccatgtggatttcatttcggccagggctggagttactgtccctgttatgatggtggtgctggtgacctatggggcatcctaacttccttcccaggcagatgtcccgctgcattggccaacatgtggctccaaaactagacttaaaaaagcataaagatgttccctcattgatggggacaatctgagccatttgtgttttgaaactaattactagcccacctatcaagagctatagtgtgctcctgaatatgtggtcagaatctgttacagttatcacagctattgtccttttcccttgaacaatgctgtagcaaaggcagaaacacccatcttccaatatgtttcccagggcccattacattaactggtgtccacaactttgcctctgtattccaatcattcagctgcagaatcctgaagcatccatcacattttgaggtcccaccaacatattcttccttttctcattttattatggcataaattcattgcaaaagctatgacagaagtgactgtccctgtttatattgctataagggaaatgagtgggtcaaggaccatttgcacaaacagaaagatgaaactgcaaatttattagaaagtataaaaattaaaaaacaaaaccaagcctaaccaaacacaaaaagcaacgacacacaacctttccagtttacattaactttgagcgtcacacatattaaccacttagttgcattttttaaaaatgtcaatttcaaggtagagggagctgagtaggtaataggccagtcatcacagtgtaactaatttaatgctaaaataaaacacggatctatttgagaaaaaaagagatgagactattttctggttggcgtagatttaggcaatgtataaaaagcttcctggttggaatgagttaaaaaatattgctggccactaatgtgccatcttggttggaaaacaaaccccctcccccccaaaaaaaccctgccgctttggtgtcctatttattatttttaaaaacattcattaaaaaaatcaaatctataataaaaatgtccctgtttgtttaaaaaagcattagtaggcatcccttatctactaaaaccatttgtttttcctaagatgctggaagcagaaaagcgagtgagattaactcactgcgcaattaattaaaattagaattcttcctctaaacaacttccagagcaccagaaagaagaaggggccccatcaaagggagaaataagcccttctgactcacaggagatgaaatgttcagccagagttctaacacattctggcttcatcaaaagttctttattggattactcagaaaataactcaagtgctattttaaaaatgaagatacaggcagctaggttcctttccgtttttctttctttctttctttcttttttttttaaacaaaacaaaataccagtggctagcttttctgtaacatcctttggatttggttaaaaaagaaagaaaagtctacagaacaggatcactgaatgccactttagccccacttcctgcggctctgttttaattagcgtcaaacaggttactgaacatttcttcagctgcggaaagaattctgaatgggtgacagctgcccggagtggctctacctggttccattttacccctcatcgtcagtgtggtttcttgccaaacaacacctaacgttttaccccttattcctgcagggagcgggccctgtggctgactggacacagagaaaaaaaagaaaaactagcacaaacatagagctatacacggagggagagaggagtccctctttctgcttccttcaagaacttgataaatataacctcaaagtgcaacaatgcacaaatgtctggcacacaggttagtctggagtgacttttatcacggggctcagcggggcaagggtgtgatctccttttgcatctttctttggacctgttaaaggaaaaacaaaaaaagagacagctttcctatacacatataaatagtcccttaatagaagggaaaaaacaaacacactgtttcaaatgcatttctaaaagatttaaaatagatcaaatggaaaatcttgactccaaattgtctcttgcccatgtgtctcagaggagaaactatgggatgttgggagaggcctgaccctgaccctaactctaactagaggtgctggtattggaccttgggaagaggagcgtgcacagtgcagggagccaggagagcttgctggaggtattgacatggctctcacctgtgatagaaaccagtgtcctcaagtccaaatgcacaggtaaaaagactttgcaagtgttaagggaactttggaggccagtgttgaggctgcatgaatgagcaaacaggctgggtgtgggccacagggacatacagccaggtcagactttgggccaactcaagtaggtcctcattccttggctacgggcaggtcagctgggagggtgacagtccagaaaccagtaagtggctgtagagccagggcaggtgtagggtcttggcagcctgcattttaggagctagaacttggataaactcatgggaggggctccctgcctattttaggatgaggctgatgattatgctgctgaggaaagctctcagaatgagcattcttgggcaaatttctaaagccagaattatacagggtagatggtttcagagtccttcacaaaaccaaaataacgttgcgactgctaagggtgttactcacgtccaaagttttctttggccactgactctgctgaactgggggcacaaataggattgtgcaaagcaggttttgatgctcaaatggaatttttttgggggggtgacatccagtgatggcctcctggttagatcatctaacccaaatccccaaatgctataaggtactacccagcagagagaattgggtccagcgtctcctgcacttctgagcatccaatatagacagaaacattgctctctcccagcctatttcaatactgttttatatgctgtctctccaaagaaacagaataatgtgaaaaatgagggtgtgatctcgggtcccaagggaagagtgaccgacagaaaagacgcacaacagatcatgtcaactgagacgccagaaaaacatctctgaagctgggggaggaggggaatgcagagatagttaatatcccaaactgtaacttgagacaccctacaggtgcttaaagagcttcccatgagcacaaattgttagaatggcaacaagtcagagagattaacccatatggactttggaataactgggacttatacttcttcagtgccctggctggctcagagtccctgggctcagcagtgccctcctgggggccaggctgccccgggctgtgctggtgtcttccacgctcaggaggctgctggctgcctgggagctggcactgttggcactccggaccgggagcggtaggggggcaggtcggcttggttcagagattccgtgtcagaagatagggcggtggaggaaggtcataccacgcaggcctgtgatggggacagcaggggggcagggcaatggagacaggaagagaagagaacacattagggccaagataagccaacttcagccatttctgagacagtgtttccagtgcgaaatgagatttttccctccaagtacaaagacaataattcaaggaccaggaaccacatcggaacagaaaaggccagtgtgttctggctggttgtgttgaccggacggtgccaaaaccacatcctctgggtagaaccagaatgaggtcgcccacaagtccctcggctcaacctgggtggtttggcattgccactctgctccatcagccaaaaccctgtggccaagaggctgggctggtatcttgactgggcctctgatgggaacatggaatggcatttctattgaaagccaactcttcctggctatgaactggggtgagaggacatcctccaacacctcggtctgtatcggcagaaggggcttaaaaggaatgaatttaacagaaaagaattttattttctagctctcatttactgaaggcttctcatgagccaggcactttgccatgcccttacattccttaccttatttaatgctcacaagaatgctgggaggtgggcattacttcatgcctgttgctctggtgaggaaactgaggcacagggacattcaatgtctggcccagctcagaaataactggtaaacagcaatgctgggatttgaacccacgcattctgtttccagatcagcaattttaaccttaccctatgctgggtggtccaaatgaagaggttatgagtgggactttattaggtgaggaaggtcctgaattcttacacttatttgcaaagagatccttaagcccatcctctcccctgacctctgaaactttattcaccttctatgaggaaggaaaacgaagttcaataatgtaagagctgccatggaagagggtccaaggaagagcccagtcaccatcagacacggccagcaaaatgtctaatgccatacacggcagagcttgaggaagagggatgctgtcaggaaacgggcccactgcttgcttcaactacagaactctgcttcctggctttatacaactgggagttcttgtacaattccatttgcaatgtggtactgcttaaaaaagcttgaaaggctcctttccacctcctttattttatagatgaagccaagcaaagttaaggaactcactgttctctcattcattcacttcttcatttatccattcatttgacagatattaaccaaaccttcacatgtactgggcactgctctgcagtagcaggtgaggctcagagctagtctgtggccgaacatggaccagcgtgacattcccaggaggagcaggccaggatcctaactgtatgttctcagacaagtcatttaacatcccagagcctcagtttcctcatctgtagaatttggaaattcctgatttgtgcaactatcaccataatccagttttggaacattcctatcagtttcctcctcagcgaggtgctaagaggattaaatgaggtgatacatgtagagaattttgcgaggaccggcaaatgtcagatgctgccactgcctatagcagctgaagccaggctcttggcaagactaagaacctcagtgtgtgcacctattcccctccccgcaatggatgacctctcccgcctcatctcttccatccagcacacacctctggtccagcaaggcctcggagtaggagggtgggggcctacttccgacgcattctgctccgcctggctggccacatactggatgccattattgagttgtaggtgacgttgcagtggtgggggtggtccaggaccaccaggcgggacagcagcaagggtgctgcagccggtgcacgggcagcgtcatgaggttgttccgcttccgctggtggtcaagaccagtgccagcagggccaccaccagcacaaaaatgacggagctgccgatgatggataggtgatgctggggtaatacacaagttggttctctgaagtcacaaacacctgcccacgccgggttctgagaaacccaagagaggagagaaaagagagaaggttaccagtttggctatctttgtgtttcaacatcagccccagaacttgcatgcgaatgttcacagtagccctattacaatagccaaaaagtggaaaccgcccaaatgtccaccaaccgatgaacggataaacaaacgtggtacatccacccaaaggaatattattcagccataaaaagttaataaatactgatcatgctactgcatggatggacctcaaaaacatgatgcagtgaactaagccagacacaaagatcacatattgtaagattctgtatatacaaaatttccaggaaaggcaattttacagagcagaaagtagattagtggttgcctggagtgggaaagagaatggggattaacagtcaatggtatgaggaatcttgttggggtgacgggaatgtcccgaaactggtttatggtgatggttcacaaattggtaaatttcccccccgcaaaatcactgaactgtaaacttaaaatgggcaattttaagtactgcaaataatatctcaattaagttgttttaaaaagtatcatatgctatcagggaacaggagtgagagttcttgtagcagaaatccgttctttagtagaaatgtataaccacctcaggaacacaggtagtacctctggggtcctcatacctgcaaatcatttatttcagccaggcttcacatggagcttttgggatggagagccagcacagcccaggctaacagcagaactcctgggctcaaatcccagcccctcaaaacttgcttgctgtgtgccctttggaagtttaccctctctgggctgcaaaatggagatgtaatagtgcccagttcttggggcttctgtagcctgaaatgagtcaatactcatcaggcccctgaacatagctatacgttatgctctgtagtgcatgtgttcggtacatacaagtacatgattcattatttatttatttatttatttattatttgagacagggtctcgctctgtcacccaggctggagtgcagtggcacaatctcgggcactcaacctccgcctcctgggttcaagcaattctctcacctcagcctcccaagtagcgggactacaggtgtgtgccaccatgctcagctacttttagtgttttagagatggggtttaaccatgttggccaggctggtctcgaactcttgacctcaagtgatccaactgcctcggctcccaaagtgctgggattacaggcgtgagccactgtgcctggccaagtacatgctttattcacatctctctgcctcataacaactccatggggtaggtggtgtgattctcctttttttttaagatgaagaaaatgaagctcagagaagtcagttcccctgaccaaggccacacagttggaggtaaggagttgtgcgtgagttgagtccaggggtctgacttcagaacctggccccacgttctgctctacatcacccgaataagacctgccaggcaatctgcaggcacttcctcggagttccagggtgaaggtctggtacacatcccacccctgcaggttgctatcataatagcctctctccacacatgctaaggagccatacttcaagcacccaggtaaggagcttcccagtcgcaggacacacctggctaccactgtaaggtccaggcaggtggaggaaaccaggggtccggctggggacccctcatctttacagagagctgccactacctactgtcatggcctagctggagaataatctaaatgcagctcaagtgagtaaacttggtggccaagaccctgtccttgtttgcctgtgaggcagtgaggaggtttcagtgggtccacaggggtcaaaatgtagccatgaatagcagcagtggcagcgactacaggtgactcatgtcctctgtcctggcatcggctaaggctttactccatccctcatcactaggtgtgcgtctgttttgttcactgctgtatccccaagagtaggatggtgcctggcacatagtaggcactcaataaatacctgccactcaatgggaaaaaatctgtttattcacatgccctagtaaaatgagtgctgttgttattgctatttttagataagcaaattgactcagagaggtgaattattttgtctaacatcacctaagaaggagcagaggaacaggactagaatctagatgtttctccttcaaaaaaccacaaacctgcgaaaacattgacttctcttcttttctgatataaacattttctgattccccaaatgatcccaattgagacaaatgaggaccttccccttcaaggtccggctctgtgtgttaatttgtctctccgccacacccaaacacagactaaaagctacaaagattctccaagtccgtggtggtcactcttcaatgattcattgcacagaaagaagcaaataggggcccagcagaaaaacagaatcatctgcactacaattaagggagggaggcaattttggattttttctggagacaattagctgtattcaaggattctactggagttttgtctgttctcagtgagacaattagaagctgggtggggcttgtgtatgtgtatgtttcagaattctggcttaaactaaaataacttctttattttttatctagcagggagagctgtagagttaggagccttgggggaatcctggagccactgctctagctgtttgagctcaagtgagtcacttaactcttagaagcctcaccctcctcgtctggaaatggtggtggtcctgggtaaacaacagtatccgtgtctccctggactatccagatgtagagtataacatatacacaagtgctgagcacagtgcctggcaagggtttgcctcagtctgctagttctttcttgtaacaaccaccactacaacaaaataataattattattatataatatataatatataattatataataatgataaaatagacataacataaaatttaccactgaaccattttaaagtgcacagttcagtggcgcttaacattcatacacattattaacgttccacatgttatagtgcatccatcaccactatccagctccagaatttttcatcatccctcataatgaacactagattttagtgttgctgttcttaccattatcctcaccaacttctcgcactgggggtagaaagctgggggagccacctctgggggatggggctggggagaagatatgacagactgagttccattccagtgagatgtattttttttattttttattcctttttaatgttaatatgtattttttgagacaaggtatcactctgttgcccaagctggagtgcagtggcggatcttggttcaacagcttcaacctcctgggctcgagccaccttcccgtctcagtggctggactacaagggtgcgtcacacaacctagctaatgtttgcatattttgtaaagacggagctccctatgttgcccaggctggtcttgaactcctgggctcaagtaatctatccatctctccttccaaagtgttgggattacaggcgtgagtcaccactcctggccagtgaaatgtattcttaaaggaggaaagtgggtaaactgtcacacagaaaacaaatggtccagagattttaaacgctgacttctgtgtaaacacgtgaggttttaagaatacaagtgggagccctttaaaagcatgggatataaaatgcctgtggaacttaatgggctcacttatgtctccgaaagcaggtctcttcagacctctcttcactttggcaggcgagacgcagcgatcacatttgcctgagaattatgatgttgcataactcagtggtgcctgctctcgtttttgctgtgtgtaaaatgtctcttgtgttaattcattaactaggcccacttttcttaagagcttaatgagcctgctggcaaattactaatatcagagttgcctaggacctaagttccaagtgcataatccatggataagaagtttccatttattctggctgtccctcaagctaatgcccttgtgctccactgtcaagatcttgaattcttgtcctgtacgtgccgcttcgactgtactaattccaggcaatctggtactacctagaaactgctgttctatcaagactgccagtagctccacagctgcctgtggagagcaggctgtgttttgtacaactccaggggtgctcttcacctcaaagtcattacatattgtttagttatcacgacagccttctagcagatggcagccaagtgtcttgaggaggagtactttaactaattcactcagaggtgctgtctggaccagcaaaggcactcaagcagctgacattgtgacttggtgttctttcacttccaaaaaaatcccctcctccagatgcaaattaaattcctaccggataccatttttcgcctatcagattggcagaagcaaagtttgagctcatatctgctggccaggtctcaggcaaacaggtatattcgtgcctggtatatatgcaggcatggtagtgggagggtaagtcagtaccaacccagggtggtggaggagctaataatatatattatataaaaatgtgcatattctttgagattggccaggcatggtgactcatatctgtaaaccagctctttgggaggtgaaagtaggggggatggcttgagtccaggagctcgagaccagccgggcaacatagggagaccctgtctctgcaaaaaataaaaatgtaataatttagtaaattgctgggcgtagtggcatgtgcctgtagtcccagctactcaggaggctaagaaggaagattcttgaacccaggagtttgaggctgcagcgagctatgaccatgccactatgctccagccgagtgacagagcgagaccctgtctctaaaaaaccaacaaacaaaatgagcattcatgaagcatggttcataacagcaagatatatcagaaacaatccaaatgtttatcagttgcagccggctaaataaattatggtgtatccgtacaatcttgtacctatttttaaaattagggaactctacatatactgatatggaaccatgagaaggatatataaataaggggaaaaaagcaaattcagtagagaatgtatagaatatatctggaaagacacaatataaccagtaacactggggcttccaggaaggggaatagatgcttgtggagagggagatttactttttattgtttactcttcctactttgtagcatttgttctgtattatctattaaaaaaataagcactctgtcttttcctttaagacttgcccaggctgatggtgcatctcagtttctttatttttatttttagcataaggtcttgctatgctgcccaggctggtcttgaactcttaggctcaagcgatcctgcacctaagcctctgagtagctgggattgcagcatgtgccactgcacctggctcagttccttattgtttcctgtccttctctccctgtaggtgcttcttggggttcaggcctcactgttcatgctcacttggagaccccttactgactcatgagtccctgaggacagcttccaatgccccagcctgacctcttttttttttttgagatggagtctcactctgtctcccaggctggaggcagtggcacaatcttggctactgcacgatcttggctcactgcaacctccacctcctggttcaagtgattctcctgcctcagcctcacgagtaactgggattataagcgcatgacaccaccatgcctggctaattttatatacttagtagagatggggtttcactatgatggccaggcagtcttgaactcctgacctcaagtgatccacccacctcagcatcccaaagtgctgggatacaggtgtgagccaccgtgcctggcccagcctgacctcctaagtccagaattcctgtttggaatattcattgcccttcaaactgactcttcctcatccctttgaaaaactcctacctgcaatttttttagaagtattttttttcagtttgttcttcctccagattatatattttaaagttagatttattgaggtacaccttaggcataataaaatttgccctttaaaaatgtgccttagatgaattctgacaaaatgaaacagtcacatgtcctcttccacaatcaagatatagccctttccatccccacgaaaggtattttgtgcttcttgtggtcaatcttctcccctcatccaagcctctggaaaccaggggtctgttttctgtccaaatagattcacttttttccggaagccatataagtggaatcctacagtatgcagtatcctacagtatgtaaaaacaaattttacatagtcctttgcatcaattctttcttaatggtttgtgttttttatattctattccattgacttctttcactcagcacactgcttttgagattcatccatgtttctttgagtgttaaatttcattcctttttgtccctgagtagtattcagttgcatggatgtatcacaatttgatccccagatgagggagggtactgggctgttcccagtttcaggaatgctggtctttgtgctacatatattttcatatttcttgggcatacatagggctgagagatttctgggtcatatggaagcatatgtttaactttagaagaaattgtcccactgttctccaaagttgctatagcattcccatccccaccagcagcaatgtatgaaactgtcagtcatcctgtgtcctcaccagcattagtaataccagtctttttaattttagccatcttaataggtatttagtggtatcttatgataccacttaaaacctcttattgaggttttaattagcatttcctaatgactaatgatggagcatctgttcatgtactgatttgccacagcttatcttctttaatgaagtgtttattcaatcttttgcccatttttaaattggtttgacattattattggatagtaagagcattttaatgttctgtgacatagtattttatcacaaatgtgttttgcaaatattttctcctagtcttggcttatcttttcattttctttacagtgtcttaaaaagagctttttggtattttctttttaagactagtcaatgaagaaaacgtttcaaaacaaatttttatatagtcatttgcatcattccttcttaatggtttgtgtttttctatattcgattcaaggaatcttcccctaaatcttgtttagaagaagtcttatagctttagcttctacatttatgtctatgatccacagcaattaatttttgtttatggtgcaaggtaaaggtcaaggttcttttcatctccccatttagcttccaatttttctaacaccatttgttgaaaagcctatcctctcttattgaattaccttgcacctttgttgaaaatcaattgaccatacaagtctgagtctattcttagactatctatttgtatgattgagctatacaactatctttatgccaataagggtgttgttaactacagcttatagttaagtctcgaaatgaggtagtgtgtcttgcacgcctttttcccccttccaaaataactttatttctgattataaaaatccatgttcattatttaaaaaaaaataatatagaaaattcaaggcagacaaaatgtcccctcctctcccctaaacctattaggattctactagactggtttacagtttggtatagaccatgagctggcaaacttttactgtcaaggaccagatataaatattttatgctttgtgagctacacaagtagataaaagctgtcatggacaatatgtaatgaatgaatgtggccgtgtcccagacaaactttatttacaaaaacaggtagcaggtcgatttggcccactggccatagtttgctgtctacccacagcatagatctttgaaaactgcccctatgcttgtacacacacgtacttttcttcatgttatatggatacttcagcatgtggcatctttccttggctcccacacctttgtgaaagaacagccacatagtatcccactataggataaactacagtttatttagccaaacctctattgaagtacctttaggttgctccccattttgctattacaaacaatgctacaataccattcaggcagacagtgagggtcatgaggggggggccagtgatctttggtcactgatgcaattatttctttggatgaattcctagatgctgatgtttacctggccatctggtctgccaggtttgaaaacttggggttgtcttgaacatttcctttttctctgtccacatcaagcaaccaagtatggtcaatttctactgtgctgtgttctccagcctcttaacctcacgtccattctcatggccacatccaggcccaggccaggaagaaacctccgtgagagtcttgccacctgtagcctcttcggactctagtctttttgcaatatcccacaagtctgaacattacccaggactgtgttgctgtgtaattcttgtagaattcttagatcaaggaacctcagtggctcacatcaccctgtttggcctgtcgttcacagacagcatgttccctgtgattaatttcccagcatcaacccccagaagggcatggggaaaagtccaggttggaatgaggaacaccatttgccttgtgacatgtcctcattcctgatttgaactaaaaatgatactaataatactaacaaccatcaccaccatgcatatttactttgaactcaaaacaagagtaaacataatatcatcaccataattatcctggcagctcttaccctattctcataatatctgatgtgttttacacattctaacacttttaatccttgcaccatctgtattgagtgagtagtgtccctccaaaggtatgtccacccagaacctcagaatgtgaccttatttggaaaagggtctttgcagatataattaaggtaagagtttcaagatgagctcattctgaattgagagagctttagatccaatgatgagtgtctttatgagagacagagaaggagatgacacgaaacagacaagggcaaaggccatgcgaagttgaaggcagaaactggaatcatgcagcccaaccaagccaaggaacaccaagaattgccagcggccccagaagctaggaatgaggcatgaacagactctccctcagagcctccagaaagaacaaaccctgccagtaccttcaatttgacttctggcctccagaactgtgagagaataaatttctgttgtttcaaagccaagtttgtgtcatttgttatggcagccctagcaaacgaatacaccctcctatgaagtagaccgtttccaggtgaggaaatgggaacacaggttaaggaacttgcccaaatactccctatacctgagaattattaatagctattatcagagctagctagtagagaaaccaagaggaacccaggaagctagttccagcatctgtactcttagcccaaagctttatttcattttacatatgtggctacttaccattaagttctcggtgggcaaagaccaggcttgctccttcttggaaccccactcgggctcaccacaatctgggaaatacaacaggtactccacagtgttttttgatattggtaactaactctgaaacatgtcaacatggtaattcacaatttcttcacttacagacagagtcaaactacaggaaagcaaacatttcaagaagaaaatgaggataacctagatgctgagcaggagcactgaacctctttcttctactcttcctttgatatacacaatttcccttcttctttcaacaatcctgtgaagtgtgccattttattaacagagaggttaagtaacttacagaaggcatagagcaaacaagtggtacaactagtctttgggtgcaggagtctgaagtcagaatccttgcgctatcctgaatacttctctctgctccctcctctcctctgtcccatttatcctgacatctgtcacctcactgtactgttcttgcaatggggtccctttccagtaacttcaatgatactcaatcttagagtctgatcaatatactggaagtgtcttctgtgggatggcaagaggatttcatgaaaaagagtaccttggtcaaacaggtgtgacaacgactggattagacaagtaaaccccttcccccctccttttttgtagctgtttggagggaaggtacagagatcaaacttctagattcaaacctcagccgtgtcactcactagctgtatggactaggaaaagttacttgcctctctgtgtctcaaaatcctcacctttaaaatgggataatagaacccaccccctaggttattttttggataaaaagggaaaatatgtatagaaatgtttaaagtggtgtctggcaaaagtagcatttgacaaaacttttagttattatcaatagctattattacaagacttgtcgagcctttactaggcaaatgtccactgtgactcttcatgaaaggatgtgattatttcctaacctcagtgctaggctgagatggacagaacatacaccatattccaaatatgtgcattccaacattctagaagatatcttctcacaaatcagaaaggggaatccctggcctttgggcagctgttggaggaagctctgggttgcagctgccgatggaagaagatgaagctgagagacactatcttagccccatcctctcttctcgtgatacagtgaggcccaggtcccaggccacatagttaaggttcggcatcatcatcactgatggccaagcactgggagcagctcctgagcataagtgagagatgccactgtgggggctgtatgacactctgccgcgtcttacatttgtcaaaactgagcatgcaggagctgatgctgcagaaattcacaaggagtccaaaggctgccctgttctgttcttgggatctgcgagtttgtcacggccccttgcataatcagttcatcggtgcactcctgcctgtgaaactttattacccggggaaatgctgagtgtgcacacttggagcttagagtgcagaaaactttctgagtaatttaggggaacgggctgatacagaatcactgtaacagggctcccaagggggagctttatccaccatgaacaaattcatggcttcttgagatttagatctgaacacaacgaccctgacccaacaagctccagcatcttggagggcagggctgtcgttttgcacacactgggttcttgttctccagacactgggctcttgggctccagtcccatgcaggcaggatgagcatgcccgaaaggggagcacaagacatatccgatgccaaacgggctctgcacaccagcctcaaccaatccccagtcctggtgcctgtgcttcataatctccctttcccagccactgtcccttccacctgcctccactctggctccccgtagtgtcttttccaatggctgcagggtgctccttctaaaaacattcatctgttcatgtcactcctcagctcaaaccttccagtggcttctcatgtactcagaataaagtccaaagtccttaacatggcctccggccctgaataatctcatccccgttgctactctgacttccactcctgctcctccctggcgctgctgcagacccgttggcctccttgatgtggttctggaacacacccagcatgcacctctacagggcccttgccgtctgcttagcacgaccttccagggcatccgcatcactcacaatccattcaagactctactcctttctggcccaccgacatcactctccatccccccacccactcgtctaccttcacagcactgttactgcctgtcattgtacattctatttgtatttaatgtctctctttcctactggaatagaactccctgagggcagaactgaattctgcttgctcaccctgaatccccaaagctccaaatagtaaaaatttgctgggagaagccggcagagtgtcctaactctgtggccctgtgaagtcttggcttgtgcatctttcctatgagactccatgcctcatggccatcattccattcagcctcacaggtgagaaaaagaagactgagagaagtgagtcatttgccccaggtcacacagccaggaagtgattgagctgagacacgagcccaggtcttctggccaacacccagagatgacacatggtatgagggcaggtcccactcaaccagttttccggtgatctgttttggggaagggaaaaccacccttgtggctgaaatattcacactgttttgatgggcactggctgagctcaagatttatagagaaaacacatgttcactgtacaaaacagtctcatccttctagaatcttccttctcacaaatgaggtgggatcaatgtaacccttcccagaatcatctagagatccaccaactcgcaggaccaaaagtgtggggccagtgcaggagactcctctcccaaagtggccaagatggtgccttgacatagtcactccaggccaacccgcagactggacctgggtctgcccccactcacagcccttccaggacttcttatttgccaaggtcaagtcccacgccctcatcatgaaggtcaaagctcttcacccccactttctccccatctcctctctctcactgcctccttctctagccagccacgcctagaacaacttgcctgacagtgcctaaatcctgtcaacgctgggccccacagccttctggtttaaaagaggcaactgaagcatttaatgaagggacagcgggattaaaattgggactgtaaaatcaggatgaacaattgtacctgccacaaagtttagatgaacactgaagactgttttaaatttgagccgagtgagcgactgtgagcttgcttctgtagtttccttttacctggacgaagagtctgacccttccactagattaaaacgggccttgggagtgctgaatggcagagaagagaaaacgctgctgaagggaggcagggagaacagttgggattcacaggggcacagagcctccaagctgtgatgcatggaggggagtctggctgggtccacaattcattcgtccacttggagagcccagatcctgctgggccctgtgctcaggtgcggggagcaggcctgaccccaatggcactcccagggtggagcggccctgggggtcccatttcactcctgcatgcctcctaccatggcctctgccacatggcagccacactttctcaagcctggaagcatcaagggattgtctgggccactgtaaacaagggcatccccacatccaccctgactttcctgtctaaaaaaagcatcccatggggctgagcgcctttgcggatccctattccaagcacatcacccatcccaatttagatgcggattgaaaagtttaatttaaagggcagaccagcaaatgactgaatcaaaagagagccatgaaaacccgctgaaccattaccatggcaactcaagttgctaaaattaactgaaaagagggtgatggaaaactggagctgcgcaacctcagaccggccacagcaggggccatcctggccccaagcagagggaaatgagagaggagacccatctgccaggatgctgggaaccaggaccattgaggctgggagacaagtgcccgaggattaaattcaaaatgagagggagggaaagcaaggggaggggagtggaagaggaacagggagggagagagggagggagcgagggggagagaaagagagggtgggggagagagagacagagagagaagaaagttctaaactgaagaccgaatgaagtgacacttccctggaaattttcagtcattcttattccaaaagactgcagaggttttctattgcctaaccactgccatcctttgggcaaatgggagcagggagtctccctgaaagctgcatccatcctttcaataagtgctactgaacagccaactggtatcaatggcccctaatttctagctgttcaccccagagagtttcttagaatggaggaaagcccccagcagtcccagagcttttgaagcctgctaagagctgctgtacaccctcagaatttgatctctgtgtctgatgagaagggcccagtgataagccagggagtcgggtggctaatggcctctttgctaagacacagctcagggcagttgcagaactggttggagggtaaggcatttaattggctgtttaagatagaaagggcttttttttttttttgagacagggtctcactctgttgcccaggctagagtgcatggcattttttaagtaggaattcagattgccactaaaactcagtgagagggtaattggggctagggcccaggtggcctttttagaactctgctcaattgtgtcattgcttcagaaatgcaacagaagaatgcagtgaaaatgaggggtaggagttctttgctacctctcctactgcagccacaaaagcagcagaagccaatgagagacagcacgggaagggggtgggacttggtaagagctcatgcacctgcaccgggatcaatctaatcattctacccatccaaagggaaaccttgaggcatctgtctcctctgcatcgagtggcttcgccagatccagattcctatatatgaatcctgggctgctcctgcaggccacatctggaaatgactatccatgcctctggaatttgtgaataaggaaggctctaaagaactactatttctattgcttactgtagctatttacctgagtgtttggtggaagccgcaaaattaaatgcttagcagacattctttgaactcaatggtagttggtttctggtccagtaataaggcttggccaattacaatacaatagtttattgagctgccgagtcagcagccagagcgaatactgctaactcaagcaggatgcagggagcggagagctttgatcagtttgtgagtgtggtgtaatcacacacaaatagcattgcagggaaaagcaaccctaaaaactggagagagaaaaatctacttcaggcaggccattgttgcaaataaaactcacttgtgggagttgggaaagcaagtatcatcattaaatagcaattacaatcctgggcagggaccccaggcagtcactggagctgcaggcctcagtgttaaacctggttccttccttccttttccattcatgtccaactcaggggcaggtcctgctgattctgcttccataatatggacaagttaccatcatctgttgcatggattaccatgtgaacctctacttggtctcccatttctgatcttgcccctctccaatccattttccacacagcacctagaaagctcgttttagaaataaataagaccatggtatgtttcctgctttatattcccaccaagcattgctcacttactggaaatacaaactcctagcaatggtttagacatatgatctctacaagaggcccttgctcttctacaacctgcctgttagcatcctgtgttctagctcaggggtcagtccagcctctgtctgctttcatagataaagttttattggtacacagccattcccattcattatgtatatctatggctgctttcatgctacaatggcagagttgcatagttgagacagtgactctaggcccatcaagcctaaaatacaaactgacccaagaagggctaatgttaattccttgaggaaccaatactacaatgaaccatgagcttagagatgcacagcttttattcagcttatagtcctttgggaagttactctaatacacaaaatgcggcaatcagcatgaggtaactataactgtgtagaaaataaatggagaaatgaagaaatcaaggaagaaatcaagcacacccctctccgctatccctccattagctcttttgctttttgttatctgtagaagtaagctactgaaatgtcctacaggaaatggcaaacttggtctcaatcttggctatgaaatacctgaacagttaaaatctatctgttcttgccaccaccacctccctgggtggttgagcaatactgcctgcctggcaatcctgtcttctgagaggtacttggatgtctcatatttatacttcttgaaatgaagcttggtggagcatttgaatgttctttaagacaaggtgctggaggctctattccaacaccgtgggcctcctgggcagtgggtcactgaacccggttgttccataatagatgaataactaagggtctcgggctgtggaggattcaaagttactcattcaattctataaagaggaaataaaaccaagtatccctgggccgctttagaatccctgttgaaagccctcgaaacacctaagaagactggagagctcagacaagcattttaaacattaatggggctgtgtttaaaacaagaagtgaagaaatcaaagtcttctgttgccaacagagggcccaagctggcctccttaggaagggaataaaaggacctacaccgtctgatgtgatacaaagatgaatcccacggagggcaggagcagaatgaattcactcattcatcctacatttcctagcacctactaagggccagccaggtgccagaagattctgagccactgttatggggcatgagttattggggaatggatggggactctgggaacctcaggattaccatggctaagattatttaaaatatattttttgaataggaaaatatgcatgattcaaaattcaaaaagtaagaaaggatttgcagacaaaaataagtcgtttcatgtatctctctcctagccatgggcttcccctccccagaggcaacccttggcaccatttattttgttcagtttcttttttgtgaagccttccaggaatagtacaggcatatatagcacatatctatggttttaacatgcatggttacaccctgatttttttacttaattaagacatcaatacatacttttaaccaattaccattttgtctatttaataaatacctatacagactttctatatgctaggttctccttttttaaaatttaattttttatttggagataagttagacatacacaagagttgcaaaaatagtacagtttggccaggcatggtggttcacaccttaatcccagcactttgggaggccgaggcaggtggatcacgaggtcagtagttcgagaccgcctgaccaacatggtgaaaccctgtctctactaaaaatacaaaaattagccaggcatgtggcatgcgcctgtaatcccagctactcaggaggctgaggcaagagaattgcttgaaccgggaggcgaaggttgcagtgagccgagatcacaccattgcactccagcctgggtgacaggcgagactcagtctcaaaaaaaaaaaaaaaaaaaaaaaagtacagtttctgcaaatcctcatctaggttcccctagtgatgatccctttcctaaccacagaacaactgctaaaactgattaaccttggaacaactgtattaactaagttaatagaattgattcaaattttgccaggacccacatggcattgatctcctctaatcggtgacagtttctcagtctttccttgttcttctgactttaatactgtgaagaggatcgagaagttattttgtagaatgtccctcaatttggtttttctgatgtagtttcacaattgtgagaatatatattattgaaaagagtatcagagctattcagtgtatcccatcaggggatacctgaaatgcattcactgatgatgttaactttgtcactttatctgccaggattcttcactgcaaagttactatttctgtctttgtagtcaataatattttgggggagattctttgaaactatgcaaatatcctgtttctgcttaaactttccccactaattttagcattcatcatggactttgcctgctgcctgcagcaaatattactgtttgttctcatggtgttttttcccccctatttccttgattccttctacatttcaataattcaatttttctataaggaagatttgctttctccaatttatttattaattatttatttactcagatggacttgttatttaagctactctctgagttataaaacccaatattatttgaatggttccctccaaaatacaagtactgccaatgtaatggtactgaagggtgaggcatttaaggcgatcaggccaggaaggctctctcctcaggaatgggattggggcacttacggaaggggatcatgcaatgtttggctagctgcccttcggccacctggggacacagtgattgtcatcgtagaggatgcagcaatagggtagtatcttagaagcagagagcagccctcgctagatggcgaacctgctcgcgccttgatcttgaacttcccaggctccagaactgtgtgaaacaaattctgttctttatagatgattcagtctcaggtattttgtcacaccagcacaaaacaaaggcttattatttattttgttgctcaggttgtttcacctttggccacggggaacactttcaggtggctcccgcatcctttcaatgcacctccatgttcttatttttttgttgtttggtttggggctacttgtttactttctgggagaagatgcttcgggctcatcttgtatttcccagcccaggcctagaatcaactctaactcttcttaatagctgcatagtgagtgtgccatttgtgggatgtagaaatgatttatttataaccaggatctatctatttccaaacttttctattatatcttttatgataaaaatcctcgtaggtgggctgtttcatacataagcagttgttaaagtaaacctaagcatttacaaagacctaggaggccctctctgagcagcccccgtgttctctcctgccctcgctccagatgttctattcccttccccagtgtggtggacaacctctgaggcactcctccaatgcctgccttttgagattcatgcccttttgtgatccctttcccgtgagtttggttggacttatttctcacttttttttttgagacatgatctcactgtggatacaagccttcaatagcccttcacactccaacacccaggctggagtgcagtggcacaatcatggcttctgcagcttcagccttccagccttaggtgatcctcctgcctcagcctcctgagtagctggaccccaggtgcatgccaccatgccggctaattttaaaaattatttttagagacagggttccttatgctgcccaggctgatcttgaactccctctgtttcccaaagtgttgggtttatggtgggaaaaaccacacccagccatttctcatttctaattaatgaaagatgatggaaatagatgtcacttccaataccaggttatcaaaggactgtggtttccgttccatcttagctactgctcttgatcattttctcgtttgcttgctctaagaaccatgatgtgagctgccctatgagaagtccacgtgcccaggaacagagggaggcctccagcaaacagatagccagtgaggactgaggctctcattccagcaacccacaaggaacggaaaccccctagttgaaacttcagtgagaccacagttccagcagacagaagaagtgcaatcacatgagagatcctaagccagaaaactcgtgtacaaaaagtagaatcagggtcgggtgcagtggttcatgcctgtaatcccgcactttgggaggccaaggtgggtgtatcacgaggtcaagagtttgagaccagcctggcaacatggtgaaaacccgtctctactaaaaatacagaaattacccgggcttggtggcggggcgcctgtaatccagctactcgtgaggctgaggcaggagaattgcttgaacccaggaggagaggttgaagtgagccaagatcgcactactgtactctagcctgggtgacagagcaggatccatctcaaaaaaaaaaaaaaaaaagtaaaatcaacaagtcttgctagtgacagggcttacaggtaaatcattctagaggtgcttccttcctaggactgacgctctcttgacctcgttaagagcctgatgctctcttggccaacatgacctcctgttcacatctggccagccttcagattcaaatggccactaagccactttctccttgacttctcccctgagttccctaactagaataaccacgctctgcctctgcctcccactgtgctttacctgacccatgtcatggcacacttactctctcccacgttgtagagttacggacatagctagtcttccgtaaagcaaacataaacttgtcaagggctggattctcctctcagtcatgtttataacccatccctctcactgtaagcacttagctcagccttgcacatatatattagtattctaaaatatctgtaaagctatatgtagtaataagccttaaatgatgggttcaggaccaacaggcagccccagcacctacgcatacagtattaactcttagaagcattattatcaccactcgatatttcaagaatgaattttgcttctctaacaaggatgtaattttctcgactcttcatgattttcctctccaattttgaatttctaagttgagaagaaataagaaataactccagaccaaaagttgagggcctctgcttaattctgctattttcatacatcaagtgcttcttctggtgatacttccacccagagaacaaggagacaccgctgttaacaccaacggaaaatctgtactggagacccagggagcagaacttccaggcaggagcataaacaagattcatgtcaattaatattctactcatcgctttgagcatttgctggccaccctatcattgccggcaaagctcctcttgtaacagtatctattccaattgcactaattgaacacacaaatgagggagataaagggagactcagctaattgtttttttcattggcttccgaggagaaaaacccataatcagtcataattacaaacttccctgtggtctcagcagcacaggccccaaatggagctattctgaggcatcttgcttgatggcaacaacagctcttaaacccttttttgatctgtaaagactttgggggaataacaggagatgtgtggaccttcttgcttccttctgcttacatccctcaacttcacaccttcagctaaagaactgtcatctgtggcatctccaccattatcaattctctctgtggataaaagtccttcaaagcccttcatcagggacaccaagacaatgacagggctgtgtgaagccggtgactgtcctctccttggaattcacttttcaagacgcagaggggagcacgaaaagagccacaatactggcttttcctctaggaagagaaagctgtaagctgccttggggcattcataatgatgacagtaaatgtggggtaagctcagctaaaggcaggaatcccccggccccacggagaacacagaaggctttgttgccttaatctgtcctaaattcgtaggtttctgttaccattaagaataaggaaaaccaaaatgaacagaacatggcgctggagtcccagctgagcttggaaactataaatttagtttcctcttagtttcaagtcacttataaatgaagaggaggaagaacctgggaaccgaggggaagatgggggctgtgcattagggcgggggcaagaataggcggctccagcctgtgtcataggtgctcaagggacttctgcagaacaagtgccaatgtgacaacccaagtgacttctggcaggagacaggaatgtccaaatactgaaatgatagcttaggaaaactttgcaaattaagaaccagaggaaaactgaaaccattaaagaagaaactccaggccggcactgtggccacgcctgtaatcccagcactctgggaagccgaggcaggtggattacctgaagtcaggattcaagaccagcctggccaacatagtgaaaccctgtctctactaaaaatacaaaaaattgcagggcgtggtggtgggtgcctgtaatctcagctactcaggaggctgaggcagcagaacgcttaaacccgggaggtggaggttgcaatgagcagccattgcactccaacctggatgaaagagcaagacttcatctcaaaaaaaaaaaaagaaagagagagaaactccaatgacatcagaaaaacccaacatgccaaagaagagcacgagttgtctaagtgtaggagggacatgggggagaagaaggaccaagcctggaactgtttggccactggttggctcgtttttccactttggccaactacttaccttctttgtacctcagtttcctggtctctttatgctgccccggattagcaggaagagatggcttggacctgacccccttgctatgccatatttatgacaaggggtacccaggatgttctgcccagagcctccgattttcctctgacatgcacattgtaaaatgttctgtctcacttcaccaagtttgcccataaatacattcagcccccaaattgctttaacacagaagaaggaaattgcttcacttggcaaaaggttctccccgggtcagctaatggcagctggtatgtacgtctgtgatggattttttttttttttaaactaaaagccattgtgcttatgagaattggaaaagtgccgttgaaccagcattcactggggcccatcctggcccctctgtgagctgtaactgccttcagaaatcacacactattccagaaagtaacagctgacctcaaaagtgtgcttcccaaaccaaagaaagtcactagctgagatgttgtgacctaacagtgaagggcaagggtggagaagccttctggggttatgcatttggaaatgagaagctcagacaaatgctccatgttaaataaaaacaagaccccgtaatcattacagtgagggacaatctacactctttaactctttgctgtggagattctagaaagttctttgcaagtatccaaatatcatccatgtgccgcctggggaaattttccaagatgtccaacactcgcactccggctcttaccacagtgagcaaaattaaagactgcctttgttgggccaggttttcctacctgttggatggggcccatggacattaaaaaggagttgagacgatgatgcactgacatccaacacagaccacgactctggaggctgacagacccatgtctgaatcctggctctacgatttattggctttgcactgtggcaagttacttaaactcctgagcctgttttcctcatctgtaaaatgaaggatagagcatgcatctcatgaggtgtttgtgaagatcagacatggtcgttataaagtatgtagacagggctggacgcgggggctcacacctgtaatctcagcacttttggaggctgagatggaggatcgcttgaggccaggagttcaaggtcacggtgaactatgattgcactaccgtactcagcctgggcaacacagtgagacactgtctctataaaaaatttaaaaatttgctgggcaggtggcatgctcctgtaaacctagctactcaggaggctaaggagggaggatcgcttgagccaggagtttgaggtcacagtgtgctatgacggcaccattgcactccagcctgggcgacgagcaagactctgtctcttaagacaaataaaaacacataattaaataagtatgtagcacgtgcctggcaaacagtctaaggggtcattaaatatttgcagctgctgctgccagtgccacatcacatccccctccgccgtgtccttcttcctagctccctgtcagggtctgactttacgacttaggtgcccctgggacatctatctgtagtatgaaggtgaccttggaaaaacaaggagatgcatgaattccatctacagcctaaactggggacttacaataatttccttcttttttcaagttgaagaaaaatgaaaagtggggacttacaataatttccttctttttctcaagtggagaaaaatgatagtgaatgagtggcacacagcacacagatctcaggatctgtggttcaatctccctctgccatttgctacgcaagtgactctgaacaagttcctcaagtctcaaactcggtgactaggaagatgaaagatgcatgtcaagtggtcagcatctctggcctgtaggatggctcaaccgtgagaggtgctgttactattattattgggtattcctgctatagtccaatcctacatcctgcattatagataaagatgtcccctgccaggcgcggtggctcacacctgaataccagcactttgggaggctgaggcgggtggatcacctgaggtcaggagtttgagacagcatggccaacatagtagccttctctactaaaaatacaaaaattagctgggcgtggtgtgcacaccttttattctggctactctggaggctgaggcagaattgcttgaacctgggagtggaggttgcagtgggctgagatcctgccattgcactacagcctgggcgagaagagtgaactccgtcttaaaaaaaaaaaaaaaaaagatgtccccaggaagtacccaaggaggggtcttgacacaaggtggaaatgaaacaaagtggcatttgcataaggctgagctgtgcttattgccataaaaatctattccaaggtattgctgttcaggtcacacctggacaatgatgcatgtatgcctaaggtccaaggaagctagaaatctgaaaattaaaggaagagttgagaaaaacacatccgcgactgcctcctttccagcaactgcctcttttatattttggggtgctatttgttggaaagactttgctaatagtttgaggagactacaacacaacacaaggcaggcttgccggctaagccagctagaagtttaattaaatacaattgcttgctgtgtgttcctttcccaatggtttcatgcatattcatcgttgtaattatggaagtgaaaaaatccacgcctaattatccgtgctccccatctttcacatgcctagaatttttgcataatgactgttgaaattaattcaagttagttaattttacactttgtcctttcaaaacttaattgaaaattaatttaaaagtacaaaaaaccccacaaaaacccacaacaaaaaaatcccactaccaggcattatggcaatctggtttttcagacttacaatgggcactaaaaatgtgatgtgattacttctaacttgatgcagtgttgtacttgtcaagctataataaaaggccagtcccataaatgtctcagaactacatctctattttttctaccatacagcaacaaagacttgtattgagtggggagggctgtagtggtccagctgtcttctggttgctggtttatcatgttgtccttcagaaattacatctcagccttcaaagaagaccagcatgtggtttccattgtcactccatcacacttctaccttaaataactctactggtccccattttcaggacccaactgcaatctggcatgcaagaaactcactttcatgctcagcaaaccaacagaaaacatttctttctccccctctgttactgcacctgttcccatcaggtcttttatttgagttactcccactaatcctgttttggggatccctctgcgcgggaccaggaaggagacattgatcatgtgtctaccatgtcctgcactgagcttcagcataagcaagagtttcatttaatttcatcacctaagagttcctgacatataaatcttcattatttcttgactggctgattgatagaagaacacttactgcaagcccatgggttgacaccatcggccccactttgagagagaaggaaaggcaagttcagagaaattaagtatgctctaagttcacacagccagcaagtggcagagcgggcatttggtgccaacactgtcttccccaccccatcaccatgttgcctctccatccttttcctgatggcctgccatcttggcagttagattttagcttttgccagctgtggtatcttggccatgcctttcttgaccctgagtcctaaaacggattgttatggactgaatgtatgtatccccctcaattcatatgttgaggtcctacccccagtgtgatggtggttaagatgaagcctttgggaggttagggagtaatgaggtctgagagtgggacccccatgctaggattagcgccccagtgaagagggaacaccggagtgctgctgaggaggacgccatgaaaagctggctgtctataagccaggagggcccttactaggactgaattggcgggccttgatcttggactttcagcctccaaaactgaaaatttctgttgttaagccacctggtctgtttttttaatttttaatttattattttttttagatggagtctgctgtgtcacccaggctgaaatgcagtggcacgatcttggctcactacacatccgccttctggttcaagtgattctcctgcctcagactcccaagtagctaggactacaggtgcatgcaccacacccagctaatttttgtatttttagtagagatggggtttcaccatgttggccggctgttcttgaactcctgacctcaagagatctgcccacctcagcctcctaaagtgctgagttacaggcatgagccaccacacctggctccagtctatggtattttgttatggcagcctagcagactgtgagatcattccacagttttattagatgaccttggttactcactttattcatttggactgactcagggttaagctgtgagaatataaaggaaaatataagagaaaaatcactcaagagggagaagacaactctttatgacacaaaggaagctggacgggctactgttagaggttgaggcctgtgacatgctaagcagcggctgtcaatccacctggaatgagccagaagcgtgtgcgcgcacgcgtgcgtgcgtggtggtgtgtgtgtgtgtgtgtgtgtagaaccaagcttcctgctactcctaacattatataacagggaccctcattgagagatgtcttcgatgtaccacagaggagatgaatgaatcaacttgtattgagtagatgaggaggagaaagaggggaaagcaaattaacatagcacaaagacattgatttctttttaagcccatagaagtatctctataaaggtgactttcgtgatctgagccttcaacaatttcagaagaaacaatccatctctaagaggctcctaagattcgggagtctcttaagaccctaggagcaaattctttaacagatcctttagtgctctggctccaggaatatgaaaggtattttaagaaataaggtgctgtgccgggcgcagtggctcacgcctgtaatcccagctctttggtaggccaaggtgggcggacacgaggttaggagatcgagaccatcctggctaataaggtgaaaccccgtctctactaaaatataaaaaattagccgggcgaggtggcaggcgcctgtagtcccagctacttgggaggtgaggcaggagaatggggtgaaccccggaggcggagcttgcagtgagccaagatcgcgcattccattccagcctgggcgacagagtgagactccatctccaaaaaaaaacaaaacaagaataaggtgctgtgcctgtggatacatttttcctccaaatgtgtaaacagaggctttcatccagataagcccataaatgttgatgttgatcacaaacctaaatgaagtgttcagacacgccataaagcctctggatccaatttgcacatcaggagaatacactgtaaggtacctggagctctaagcaggtgccaggaggtagccttgcaaatagatggaagtccagagctaggtgttgccaagagctgtcaggtgagagtgaagaaggctggctctagaagcagaaccaccctgctcatgcagaggcaggagtgggatgggggggaagcaaaccaggcacggaactgagctggaggtctgcagtggctcttggctctcaggatgttggtcctgctggctgacacagaaaggtacctcagcatgctgcttggtaaagacagcacattagtggacagtatatcttttacgagagaggatgccatttatgttgatgagaaagtgtgtgtgtgtgtgtgtatttctaaccattcaaaagaaggtgtagagggctatatatagcaaaatgttaataatggctatgattggatggaaaattatatgcaatgtgaagggggtattatttttctatattttctgagttaatgatctttattgaattaagacctctccttcatctcaggtcaatcatctgctcttcagaaaagcattgatgaccttcatgcttatgacagatccccttattcatgttcacctaaatctagttatcttctttcatcatagcacatgctagagttatacatttactacaatcttctgtttgtttggtttttttagagacagggtctccctctgttgcccaggctggggtgcagcagtacaaacatactcactgcagccttgaacttctgggatggagcaatcctcttgcctcagcctcctgagtactgggactacaggtgtgtgccaccacgcccagttaatttctttttttttttttttaagaatggggacttgctctgttgcccaggctggtcttgaacagctggcctcaagccatcctccgcttagcttccaaaagcgttgggattacaagcatgagccactatacctggtctatagtctttattcagtgtatgcctccctcaggaaacttggtgctccataaggacaggaaccatgggggtatagtttcgctttgttttggtggacaactttgttcccagcacctaataatagtaagatgaaggtaacagtaatgagatcaacagcagagcagcaggagcagaaatggcagcagtgcagctaacacttgcttagtacctgctaggtgtcagaccccaaggacttcgttatgaggcagtatggtcaacagccccattttcctgaaggggaaaccacagcacagaaagactgtgtcccagcacaacctcacacagttatcaacccgggcagttggactctcgaatccatgcttggactgtgatgctacactgcccttttacccagcacttaacttcacacacagaggcacctctaaatatgtattaaataaaagattgatcacacattcctttttacaatcctgaaaaagtctctccgtgtttggatgaggggaaatacaaaatcactcctctgggaatgaggcagcagaagaaagaggtcgttctgaaaaaacagagttttctggaaagaagtgttctttttcagacagagtgcttgactctgaagaaaaatgccccatacatggttcacacaagtcctaatgtttttatttttctgaatgcagaagggcgtagggaatgatggggttcagtggcattctctttagaattctacagccgggactctgggctcaagtttctatcacttgataaagtcaagagttgtgttccttttaaatgaccaatgaaagtgaagcaatctctcatttgaaaccttcccaagctccagtaagagagccaggtcctagagaatggatagggagctaccaccagggttaagatatgcaagagccttgtatgtcgcatgagggatttgggtaaaaccatgtaggcattactgatcctccctcaaaaaagcaggcagaagtggttatatttgcatggacttagcagaacatgactgatgcagagctgaagagccccacgtgcattgttagctagaaatatttaacggattaggacgcgtgtaccagcagacagacctgatttaagtttttcacatgatatgaattctccagggtaaacccaacatgctggcatcattccaggttaaagcaggagataaaactggaagaattcaactgctccattcatttcaaacccagaaagcgaggctctccttatagcttattgtttcagattagcgtatgtaatgttagtgccacactgaataccgatgagatggggcctcacttcataagcatttgatatgtttaaactgctaccccatttcaaagcctatggaaatcatcgcacatgacaacttgtcctacaaacggaatgcaaaagcgtgacttcaccggctgcaggtgagcttctctctttctctctcaccttctagtcatttttaaatgtggaggaaaaaaatgtgcttttccaactcccttgtgtcttagagtaagaaaagaacacattttctaccatttccaccatttctggctcatgccaaagatattagataactcagtaaagccagatgtatcctattcctgcagagctcagaaacagacccagctactaggcagctgtgaaatagagcagcagtctgtcagatttaattaggccagctttttggatggggtatgcttttttttttttttgtcttttggggaggcattttggcaaaaagttgggatgggctgactgtggcttagtatgtccttgaatcagtgatgcttgactgatgggaggtagcagggggtaacttccctttctttacgtgcagatgcaaacacaagtaaatatagacccagaggtatctgaattttatgcacatatggggaattaaagtggcatgtctctggctctcctgtctttcctgcttcaatgccaaattcaccatgtcacgctgggtcaagtgtcttgggtgactgaggaggggagccacagagggatttagaatatattttccttaagaacagtgactcaaagtcaggccatgaacaaatatacacaggcacaagtcgatgcatcgaagggctgttttgcagccctttagtctggcttttagaattatgagtccttctccctattttaaaatgttcaattcctattcagctgttctttctatactctgagccttatcatgaaaagctacttgaatgttcaaaaggaattagacggtgggacttcaggggccaacacagagaatcagttggaacaacataaatggccaataacaggggatgagctggaccctgccaatgttataaacagtggttaggtgtaactagaatggtggtgttcacagtgtgcttctgtccataagaaataggttttcatggacttatgtgcaatgccaacatagtacgatgcttctgaaaaatgcacaactttccctgctggctcaacatcttcctcatcctaccactattcatctaaatactcctactgttactactaatgatggtaatgatgatgatgaagatgatgatagcgccgtggctaacatttaccaagggctttctagaagctgatgtctttatgaaatgttctaatggattaccaacctcatttcctcttttaaaaagctctataacagaagtatggtcctcatcccactttgcacatggtaagactgaggtacagagaggtttaggaactttcccaaggttattggaagaaatgcaagcccagtgatgagctgtctgactccagagcccattctgttaatattttagactactgccttctccgcctaattgtcaggtctgaacaggcagggaccacatcgtcttagtatcaccgtattgttgtaaataaaattgtgcttgacacacagcaaatctccaaaatctagtattgtggactgaatgaatgagtcaaggatgacagagttttagagaactggaatccctgaacattgcttattttttcagatgggacaaagctattgtcttcattgtgtcctactggtaggggtatggttgagttctaagacaagtggattcacactgggtttctggcaggattgtgaattacagttgggcaaccatgaacccatggagaataggactgtatctaatcacaagactccaagtcctgggagtaaaccatatgcccagtggtggcaccaggcttgccaacgacatctccacacaggaaacctgagataggacctggaggatatggtggtcactaggtggtgaaaatgttcctgaatttctctccttccagatacacaataggattacacttccctggcccttagaagttctgatctggctaggtgatgggctttggccagtgaaatgtgagtggcctgctccctgggtaactaagatgagagacgcctgccctactaatccatcacggacctacaagcaagtgggaaacaaacctctattgtttgaaactgctgagacttgggcctgtaagttacaaagcaccacctagcatataccaactcagggggctaaggtacacagacaaaacatccggccctgcacctaaggagcctgtattctggcaaagcaaaaaaccatgcacaaatgaaacaaaaggggaagggaactgtaatatgtaagcagctaaatgccagatgtgatactaagaacttatgtaataataatctcatgtgttatctcacctctcaatgtccccatttgtaaactgggataatgacagtattcccagtttataaattcctatttggtgagaacattgagaagtaaaatacattcccaagatgtctcagctagtaagtggcagagctaagatctgaatccaaatctgtagacctccaaagcctcaagccctttccactacactcggtggcttttcaggacaaggaaattactcaaagctgcatgagaccagtgctggctatagccccaaaggctgctaagacaaggataaaggaatgaggagggtaaaggtgtcagggcgaatttttgaaagaagtgggtttcattcaaatcaattattaaaactaagtggtgctcttaacaggagagctgggaggggcatgcgcaacatctagcacacagaggcagtaggcacaaaggtagatgaggaataaggtgactggcggacagaaaagatgcaaagcacacatctcagcgtgcaaagctttaaataacaggctgggtgtttcgatcttctaaccgcagtgggctcctcagcaggtgtgggaagtgataaaagccggttgatgtaaaattgttctggcgactgtatgcaggatgagctacagcagaaagagggaggagactcagggtggccagataagctattttggtggccagacaaaaggaaagtaggcctgattaggagagaagctgtggaaaggaaaaggcaggaaagtaataatcaccttcatgaattagctctcactagttgccatattttgggctaagcaatttgtatacattggctcacagaatttcccaacactctcgaggatgcagcattacccccattttacagatgaggaaactggggccggagagattccgtgattttcccacaatgatacagcaaatataatactgagttaatagcaatgtatgataggtgctaaaagcatatcctaggtcttctttaatgttacaacatagacatactattattcccattttacagaagagaaaatggaggatcagggaagtggagtaacttctctgagttgcacccagctagtaagtagcaaggtccagatttgaactccgttgagtttggtccaaagtccatgctctgaattgctatactcacgagcatgtgcatttggcccctgaggcttggctggtttggccggggagcaagtggcaagatctcatctcaggaaaggagtctccatattcaccctaaaaggttccagggagacaactccggtaacacattctgcatttggagttttaatggaaggtgtcacaattcatgccctggacctaatccaggttgcctaggagtgtgaggaaaaagagaatgaattcttatcctgcacatatgccagatatatgcatgtggctttgcttgaagagcagggcagcattataacttaccccacaaagcggccttgtgatgctttgtgtggacccaaacccatttagatggcacttctgccttctcctctagtttgtggtagaccaaaagctcagaattgggtttttcaaaaaaccactcatcctgcagttacctgcagagaaaaaagcaggtcacaggcttctgaaatgttcccacagcatctgtgcttccatcattaaggtggatcaagattgggagacaagtgggggtgcagtggtcttctgcatgcccagatcatctgttgcaggctagagatgcttgaaagaggtttttgtttgatagctcacgtttaaagtgcaagtaggtcacagaccaattgttcctaccagcgcattcttgaaattccacttttatttctatcaagtaacatgtgcacacaatttaaagagtcaaatagttgtaagaggcttgataaaagcgatgcattctttgaccctcatcttccagaagtagtcattttctactattttggttagctctttgaaagcttactgccttatctctaaatagcatgcttgtatgctactttgtgattctttatttgaggaattatctattgtcttcccactctaaaaggtgaggatttagttctagtttataccatctctgccactgccacacatatgcccattttcaagccccttagttagacagtaatacagataatcactgtttttattatcttgatcaagaaaatgctacagatgaacaacacagtatactatgatttgaacacttttcttcctgggaaaacaaaagtttccccctccccattttttagcattccatatatttctcaataattcaaacacaaagtctttcccagattcataaactcttctcaacgaattcaaatacattaagtattctatcaatttcttctttgtgcgtgcggtgtgtgtgtgtgtgtgtgtgtgtatatatatatatatatatagagagagagagagagaagagagagagagagagagagagagagagagagagagagagacagggtcttgctctgtcaccaggctagagtgcagtggcgcgctcatagctcaccacagcctcaaactcctgggttcagcaatcctccaatctcagcctctggagtagctgggattgtaagcgagcaccaccacgccagctataataatttttaatttttctgtagatatggggtctcagtatgttgttcaggctgtcttgtattcctggcatcaagtgatcctctttcctcagcctcccaaagtgttgggattaaggcctgagtgagccaccatactacttggcctatcaagttcttcctatagaaatctctcccacaccttcggatccaccactgtctggacaaagggctcccaggcctgatacacagccgcaccctgtgatggcccttcagtgtcattccagaggctccttttcactctctaaggttggtccccaatttcccatatcctgtgtctttctttttcttggtttactcccttggttttggtgaccgtatttattagcagcttcttgaaaggactgtatgagagtaactttttaatcattttgaaaatgtctttatagtacagaacttgagttgaaacgatttgtttcagaactgtcttccatgtccaatgttattgagaagactgacaccattttgattcttgaacctttgtaaaaaccttactttcatttatgtatttatttttgtaatgccctctctagaaacttgtaggatctttttttgcccaatgttctgaaatttcataatgatgtgtttggtgtggtttactgtcattcccaatctgagcattaggtgggctcttttctgtctgaaaaccactgttctttggttcaggagcattttcttcaatttctcattttttttctctcttctctctagaattcctacgatttgatatatatctcctaacccggtcttcagtttttcttattttcaatttccttgtgtttttcaccttctgggatataccttcaaatttatgacctaactttttccattattatgtttttttgagacaaggtctcactctgttgcccaggctggaatgcagtggtgcaatcataactcacgcagactttaactcctgggatcaagcaatcctcccacctcagccaactgagtagctaggatacaggcatgtgccgccacacccaactaatatattttttaaattgtttgtgaagatgggtctcactatgttgcccacactagtcttgatttcctgaccttaaacaatcccaactttttaagttaaatttctatgagtcctttcctgtttagtcctttaaaagaggggaggcatcttattttatttcaaggattctgtatcttcagtcatcttttaggtttttctgttttaagtttcttctcttgatatagcctgtttccctccaaaatgcttttctcctctttctcctcctcctccctcccccctccccctagatgtgtgagtgttctgtctttcatattcaaggtttctgtcagtgtcaaatgtctggtgatccttggctgacactcatttttaagtgtgggacactaaaaactatgtggcacatatacaccatggaatactatgcagccataaaaaaggatgagttcatgcctttgtagggacatggatgaagctggaagtcatcattctcagcaaactatcgcaagaaaaaaaaccaaacaccacatgttctcactcataggtgggaactgaacaatgagaacatttgacacaggaaatggaacatcacacagtggggcctgttgtggggtgggggaaggggggaggaaagcattaggagatatacctaatgtaaatgacgagttaatgggtgcagcacaccaactggcacatgtatacatatgtaacaaacctgcatgttgtgcacatgtaccctagaacttaagtataataataataaaaaaaaagtaaattcgtggttacgtaggcctagggtgtagatggggtgcagggggtgatagctaaaggacaagggttttttttttcttcttcattttttgagtggagtctcgctctgtcacccaagctggagtgcagtggcacaatctcggctcactgcaactccgcctctcgggttcaagcaattctcctgcctcagcctctcatgtagctgggatcactgtgtgccaccacgcccagctaatttttgtatttttagtagagacggggtttcaccatgtggccaggctggtcttgaactcctcacctcaagtgattcactcacctcagcctcccaaatgttgggattacaggtgtgagccactgcatccagcctaggggttttctttttgaggtgaaaaaatgttctgaagtttatagtgatgatgcttgcaaattctgcaagtagacaatgcaggatggttgcaaattctataaatatgtttaatgtgatgatggttgcaaattctatgaaaacccaaattgtacaatttcaatgagtgaaagcatgctatgtgaatgtcttaataaagctttattttaaaaaatggaaaaaaaaaaaaagctcttggttgtgggcttcaccattagatgatcagttgggccacttcattgacatccaatctcttaaactggtgagttttcccaaagaagcttttataaactcctgcttagaaggaatatgagcctggctggctgtgttctgggacctgcttgaggaaaagggctagtagtttcaatgttcattatgttgacttatgctaaatccctgtttcagaaacggacccccattctcagctgtgcttcatatctggtattccagagacctgtctaccctcagcagagagtaagctccagtcttctgcctgggtgtgagaggggcagtcgctggctgtgtagcatagggaaggaatatgaaagtgtcatagcttcctaacgaaatttcaacaatcttcccatttttagcccatctcttctgtttccagagttatctcaagttgccaattccaggccttctggaagtatatctggttgcctcttggttctcctgagtgccagcttagaatccattttctgagttcactaatccagtcatagctcacccatttgttctccagcttccacattttttttttttttttttttttttgctggttttcctctccttttctttgtccctgtggattaccctttaaaaaaccattcttttagaggaaggaaacagaggtaaatgtgagtattcagttaccactttaaactacaagttttgaaggtaggtagtcatatcatttactcccctcaatattgaaggcacctggacttcccaggtaagtgatactaatggaattctgcgtgccctgtctgcggtgaccaatctcttctcgatgtggtgcacttttcaacatagaaagcatgctgggcaatagtaagaaaataggggttaattctagctctgattcctactcatcgttatccttggatcatttgtagtctcaggataaaaaccaccaacctatgtactttcagggttcttagtagatcaaacaggataatgactgtgaaagcacttcaaaaagcacaaagtactacagaaacacaggctttgctattacttaaaaacctcactttcatctcttgaaattcaatctaacgttatttggcctgtcttcaggagacagaggcttgtctccagtaatcatataaatcatccttgtgcattcaaaagaaatgtcctgtagtcacacagacatatgacttgggatagtgtttctcacctaccaacactgtccttgttgctaaaaccagccggtaccacagcatctaaaacaaacaccccagaatccaagattttattgcggagaagggataagtcagatgaaactcttttggggggtccatttcacaatgtgtctgcttctcagctgagctgtatgtccaccttgactaaagttgaaatacggaaaaaagagtggttaatatatccaaacagtggatatatgatagccactgaaaagaatggggtggcagtgctctatgtagtgccatgaaagatgttttgtaggattccgtcctataataaaacaacataaccctatatatgtgtaggtatttttctatctacacatctaatatttgtattatataggcacatagatacacgacatgcatatatagaaaagtctggttgattttcaccaaatcatgctggtcacttctggggaactgaaaacaacttttgctttttacttatatagttctaagcagtttgctctttctcataatatgcataggttacttctgatcataaaaaggaaagactaaatgtaaattaaaagagtaaaaaaaaccctaggatctgagaaaaaagtaaaggtaataggaagccaaggaaagatggatataggagaagaggctaagaaagggccagaattagcaggagttgggggcaggtcacacacatctgctagagacgtgcaagcagggtatctcctcccagctggtaatcacaaatggatcccctgtgggccatggcaaccacctgacatttatgcaagctccactatcaacttaaggggaggaataactcattttttaaaaacttgtaatttccatacagcaaaatgcacacatcttgagtatacaggctatgacttctgaaaatgcatatgcccacgtaacccacaggggggctcattttaaacaaaatctcatagccatagcaagtgcatgaatctgtaggagatgagctcactcagccacgatcagtcacaggaatagtggtgagtatgggattcataccccatccgtctcactaattctgaatctggacctgcctgtagtgctatctagtcttctgactgcatttcccagagatctcctgattccttgtactcctatttgggtttctcctagctcagtaactcacatgtctcttggcaatgaacatggtaacccagaccacacatgcaatcagtctggcaagaatgtactggcctgaaaagatttttggatgtgaccaactctctcaaataagccagctaccattgtcaatttcccctttcaaaatgggagcgttagctcctgtgactcactgcaagagaagactattttatagacattgccggcaactgctataccgtagtttctctgggctagcataataatcatgatatctcatatttactgagtgctattacatgtcaagcattatactctaagtaccttacatgattgatctgtataacaccacatgagataggtaccaccattatttccacttcatagatggggaactcaggcacagagatggagtaacttgctcgaggtcatagaattaaaaagtgatagtgtgaggaatgggaacccagcagttggtgactccagggtctgtttttatctgcaaggctatactatactttctctcattagggaaggacaggcagaccagggttttaaagtgtcacctcctgtctccctggctagagcttctttgcctctgtggcctctaatatataaaaatgtcaagtccatctttcttctaaaaaaggtaaatatacagtcatctctaggtattgctagggtcacaaaggcgtctcttagctcttctagacataaagccaacagagcataatgcataacagtgctttatagccagaggttttttcttgttatttcttctctgaggagttggctgataaatcagacttcaccagtagagaagatgtgtgttttcaagggtgactttcagaagcagagtgaagggcgagcaataatgtggtaagagaggcatccttcagaaccagtggcaatctcacctcgagaggccaattaatccatgtggggaataatgaactcgacagtgagggagcccaggtacaggctatctccccacttttcaagacagacactggagcactctttccagctctcatttatcagtctcagtggtgaacacaagcatcttgtgccactgcattcctcaaactgcatttattgtctagaggcacatggtgatcggacagggaagactagcccaagttcatctgaacagctgtggttcctataccctaaattctagcatctaaagatttttaccttttatggaatcccctttgtctccttctaaaagtactattgatctttttattgcattaaagttactggtgctttaagacttggtccatctcatttgagtacctggaaacactctagggagaacaaaggtgaaagatctgggcaaaggtcagtaaaatttctacccaactacaggccagaggacagcttcagttttgtctctccaacatcatgggctgaataaacagaggaatggttctataattctagcgcagagacttccagttctagtaatatgcgagctatatatgcaaaccatctcccctactggggaaaaaacctaattctagagtaaatatattttttaagattcttaatatcatcaaaaaagtaaaaaaaaggaaaaggtaagcattggaaaattgaggcaaattttcttccaagggcaatggtgagctagaccaacttgagtttagttttgccaaaaattgagaggaacattaagtcaagatccagggccaaagtggagagtcaaaggagaccctctgttatgcttggactccaaagtgctaatttttaaggtgaggatgagcagaaataaaccttctccagatcagaggactgtggagaaggctgtctttgcaacaaattaacaagggagatgtggaaggatttattcaccatggatggccttctcatggattgtatacttggccttgcattactcagatggtccagggaacctcaaaaacttggtttgaaatggtccgaactggtagtactcctaggaacctgtcagaagccaacctaaatctctctggagaaaggatcttttatcacagtcttcaatgaatttccaaaaataatttttcaaagacaatgagtaaatacagtcaaaaatactaagtactggaggatccaggataccatgagtagaccagtaaaacagcagatatcagaaatagacatgtaaagacttcagatattaaaattatcagacctaatataaacatattactaaatttcatgaacatattagtaaattattaagaaataaaagcaaacttgaatatgtccatctgcagggaagagtaaactattaaaaaatgatggaagactggaccagtggctcacatttgcaatcccagcactttgggaggccaaggtgggtggatcacctgactcgggagtttgagaccagactgaccaacatggagaaaccctgtctctattaaaaatacaaattagctgggtgtggtagcgcatgcctgtaatcccagctactcgggaggctgaggcagagaatcacttgaacccggaaggtggaggttgcggtgagccgagatgtgccactgcattcaggctgggcaacaagagcgaaactccatctcgggaaaaaaaaaaaaaaaaagatgaaaatatttggaaaaagaaccaaatagaacatctagaagtgaaaaatactgtagctaaaattaaaactcaatggacccacttaaccgtagattagacacagatgaaaaaagaataaatgaatgaatgatagctcaagaagaattattcagaacgcagcagaaagagacacaaaaagagaaatatggacgagaggttaacagatatggattgaggtgatctaaaggaaattcaaattatgtgcagaatcacctttggagcttattaaaacatggattctggggctctaataccactctttgattcttcagactaggttgagtcccaggaacatgcaatattagcaggtgtggtgtccactatactttgagaagtattagagtagtgacatctaggtggtaaagttcagaagttaatttttcttcttgtccaaactagactaagtttttcacccttcactgactgcaaccttttcatcagcatagctggacagagtgtgcaatatttctccacgtaatatggtcaacatgttttacttaatccaatagaggtttagataggaaaatcaaaacatattttgaaaaccagtatttctactttccaaagcaaaaaatcttttacaaagcaagtaatcacaccctagttctgctttgataggttgaaatttattacctttgcttaaattaaggtttgtaaaagtacatgctgctttttttcattcacaccagcttgtgaagtgtctcccaaaagttaactaacaccgtgtgtctaggctggatcacttaagctctctgggtctcccaccttcccaccatcccaccgtctacgtccaccatctacagtgcctgggaccctgtaagtactcaaaaactagaagccattattcataatgataaattcaattttgtattgtggtcccaactggataggcccccttcttgtttcctcaccctttaaattccttgtgcttcttcaaagacaacaacttcttgacacaactgtcttagctagctccttggtttaatgcttaatatcaggctctgcatgtgtttaacaaaaaccaaaagttgcattattaaactgagacacacagcccccagtcattccaggaatgccttcccaaagaacagaagacaatagatgaagggggatgtctgtggtttgtcatcatggtcttctctgcagacggtagcatgcactattaggggtctgcaagagcttcaacagggaactgaaggtgagtgcaacattccacaatccctactccaggggaagtgaacaaggggcttgtggaatttcagatccaagaggaggagcaaatctcccaggcctgcaaatgctctaataagcagccaacgttgcaagattggagcccactcactccctgtcttcttgaaggggaaatcaaatgaggagagaaaaaaatagtttgttgaaatgatgccaaaattttgagccaagaggaccgaattctgaaggtactcaaaggtactgtacttctacctatatttctctactttctaagtctctatactaccttctttttttttgcgggggcaggtggaggggagagtggtcttcttgctctgacaaacctaacacctcttggtgataagcactatgtagtttcaagcctcatatattctatctggaaaggctgattcacaaacaacctcacaccctggacacaattccatcctggggatcatttccaagaagaggaatgcggagtcacctcctatttaaagctgatcaatttctttaccttcattctctcacttcaatgatttattactggctacttccaccactcctgtctagataagctcctccttctgttatctgcaggctcagatcagtgtcaaggccaaagtcagagagggagggaaggcaaataagatgcttcctagcagctaaggtcactcagtctgactttttatttctgatgctttggtcaattgtgagataaggatgtgcatatgtgtattgaacagagagagaaacagtgagaagagaaagtgtgagagacagagacagaaacagagagagagaggagacggttgacaactgcttccatcctctcatccccactcagggccttctaactaacaatttaatgacacttacatttcaaaatgttatccaaccattagtaattgaggaccttttcagaaacaatgttgggctgcttctcaggagagaaggaaagctgtaattagaaatacggcagtgtattcaaagaggccaatttaattagtcgattttaatttaatttaggtagggtctatataagacagctcatatccaccccacagcaggagatgccagaggcgtttcggaggctccatgtgaaaacctagggtgctgttcccagggacggtctggactttggagtctgaaggcctaagcttgagcccctgccctaggagcttggccttggaaaagacacttcacctgactctgtttcctcatctgcaaaatgtgataataaagctacctacatttcaaaggctgataacaggattactgggaggtgatgctttccagcacttaattagctcagggctcaggacacagtaatttgtggaaaaatagctgcaaaagacagagaacaataagcaggggtagtgaggaaggcttattttttcaccttagtcctgaattcttagaatttttttttttttttaccatgtgtaggtattacttttgtaatgaaagcaactagttattttaaagactagccagagttttgaagtggtgccagcagttaatacatttattgggagaggtcagcatctgatcgttaaaaagttaacattgagccacacacggggacagagtcaccaatctctgcccgagatcagctacccaaggccacactgaatttcaggaggtatatatccctagctgagttcctgatgtgttctttctgcaatgtgtgcccctgccccatcttgttactggtagctccgtccttccatttctttaggccaaaaaccttggtgccatccttacgattctctcacactctacatcaaatccacaagcaattccaatggtctctactttccaacatggcccgcactgaccgttcttaccacaccaattggcacacgctggccttggccaccaccgcaccccacccccaacctccacctaccccttattacagccagagtctcccatctgctcctcatgtccaccactaccctctgcagtctattctcaacacagcagccagatgatcctgcaaaatatgagccacatgagggtactcctccactcaaaactgtccatgcgctccgtgtccccagagtagaggcaaaagtcccttcaatgcctcataaggcttcactgtctggcacacgctcctgtcttcagctgtccccagctcccgccactctcctcgcaggcctccttgagcacctcctacttacttctacatgtacagtgcctctagactatacgtccatgaagacagggattgggctcattgtattcactgctgtacatccagtctctaagacagaatctgccacagggcaacactcaacaagtgtatgttgagtaaatggcccaacagaaaggtgttctaagaaagccacacagcagttgtgacctctgcaactcaggtcctctgggccacaagcagaagagagtgaaaggcagacaaatcccagctgaagaagagctgctgacttaggatggaagagaccttcaacaatgctgaggatgaggaaaaatgatagtgtaccgaggcaggtaggaaccccctggaaccggatgcagaactgaatgtggcactttgggaagaaaactgacacagcatctaccctgatcgtgcgttgggctggccattttacatatgttgttttttgtttgttttgattatttattttttgagacagggttttgctctgttgtctaggctagagtgcggtggtgtgatcacggcttatatggcctcgatctgggttcaagcaagcctccgacctcagcctcccaagtagctaggacacaggcaagcacaggctaccatgtccggctaattttttatttttttgtacagatgggggctccctgtgttgcccaggctggcatcaaactcctgggttcaagccatcctcctgcctcacctcccaaagtgctggaattataggcatgagccaccgagctcagctacatccgttgtttattcactccctgcagtggcctaaaaaggcaagtattatcccattttacagatgaggaggtgcttaggtctgcacaactagggaactgaagaactggattcaaactcaactttatttggccactgccccagtggttctcacaaggtgttttagtagcaatgaacttctgagctgagaccttgtaaaaaatacaggtttctgggctctaaccttttttttctgagacagagtctcacttgttacccaggctggagtgcagtggcacaatcttggctcactgcaaccaccacctcctggttcaagtgattctcctacctcagcctctcaagtagctggaattacaggcacctgctacactcccagctaatttttgtatttttagtagagatggggtttcaccatgttagccaggctgtctctaactcctgacctcaagtgatccatccgcctcagcctctcaaagtgctgggattcaggcatgagccaccatacctggcctatctgggctctaccttttcattcggaatctccaggatgcagaacaagaatgtgtacttagtgaacaccctgggattcccatgtcagccagagattctgtctccctgcttcattgttgttcaagtcagggaaaagattaaattacagagacagtcctgctctgttgagaattcaatgcagttcacaattaaggacggcttctgatagcaaagcagacagcccatactctgggtaacaaggcatgcttttacttctatgacctcaagacactacaatcaaattggtggacaaatcaaggtaggcaagtgtcaggaatacaagttctccacataagtgatggaaaagcagtataaattacatgctatggatgttcaaaggcaggagggatggagggtctctggcacagaagtgaaaatcagctcatgattcatcaggtaggtggtatttagtcttgaaggatggaaacaactttagcaagtggagatggagacagaatatttcatgtgagggaattagcgctggtcagtggaaggagagaaactgcaagatctttttgggtaatgataacaatccagttttgatggggcatagaggtggggtatatgtccactggactcaaatgcaggctctgaatgccatggtgaggagcttactcaaaaggggcatttggaaggggtttgagtggagaggtaacaactgagaaaaacaaatatgacactgagtgtaggatggatttggcgtagacggaatgaggaggtgggaagaccactgggcagatgaaccatggaggtcaaagaagtgggcaggttccaggagagaaccctcagcagttgggctggcggcggggaggggaacagtggaaactgaaatcctggggtggagaggaggttgaagaaactctcactgggaggccttaattttctccatagagttggaggcaagggcttctgcaggatgagactgagggattgagaacaagtggtataaaactgtggtagcatcaaaaaactgaaaatagggaaaaatggtggtgaggagcaggactaacttgcagctcccactcagaaggacagaacagcatgtagaaactcacatctgaactttagctccaaaaaccaccacaggaacacagcaggaaagccacaagatttcacaaatctttgaaggaagtggcttgccactgcaaactccatgagacagccaaaaaacaaaaatctgaattcagacaaaagacataatctcttaggagctctatggcactgcctatggcctggaaacccaaatacttatccaggcgaccttaggttgtatcagctgatgctctcttgaaagatcacctccttgctggagtccaaccaatcgggagcacaagcagcatttgtgaaaaccagggactatacaaaattacaaccaaggacagagtccacttcactcccctgctacctccaccgagcaggtgctggtatccacggctgagagacgtgaagatggatcacattacaggactcttgactctctgcaggcactccctagcaccagcctggagtccagtagctccactgggtggcagacccagaagagcaataacaatcatgcagtctggctctcaggaagccccatccctagggaagagggagagcaccacatcaagggaccaccctgtgggacaaaagaatctgaacagcacccttgaacccccaatccttcctctgacagagtctacccaaatgagaaggaaccagaaaacaattctggtaatatgacaaagcaaggttctttatcatccacaaaagatcacactagccaccagcaatggatccaaatcaagaagaaatcactaaactgccagaaaaagatctaagagctcaattgtttagctactcatggaggcaccagagaaaggtgaaaaccaatttaaagaatttaaaaagtaatataggatatgaatgaaaaaagtctccttagaagtaaatatcatcaagaaaaacaattacaacttctggaaataaaagacacactcagagaaatgcaaaataaactgaaattttcaacaatagaatcaaacaagtagaggaaagaacttcagagctcgaagacaagctttcaaattaacccaatctgacaaagacaaagaaaaaagaaaaaaaaaattgaacaagcccccaagaagtttgggattatgttaaaccaccaaacctaagagtaattggtattcctagtaagaagagaaatccagaattttggaaaacgtatttgagggaataactgaggaaaactccctggccttgctagagacctagacattgaaagagaagaagctcaaagaacacctgggaattcatcacaaaaagataatcacctagacacatagtcaacaggttatctgaagtcaagtgaaggaaataatcttaacagctgtgaggcaaaagcatcaggtaacctataaaggaaaactatcagattaacggcggatttctcagcagaaaccctgcaagctagaagggagtggtccagctttagcctgattaaacaaaacaattatcagccaagaatcctgtacccagtgaaactagctccataaatgaaggaaagatagtcttttttagacaaagaaatgctgagacaattcacactaccaagccagcacttacaacaactgctaaaaggagttctaaattttgaaaaaaaaaaccttgaaatacaccaaaatagaacttccaaaaagcataaatcccacagggcctataaacagtaacacaatgaaaaaaagaaccccacaaggtattcaggcaacaactagcacgaggacagaataggacctcacatctcaatactaacattgaaagtaaatggcctaagtactccattaaaagagaaagaatatcagaatggataagaattcaccaacagcagacaagtatctgcgtcttcaagagactcacctaacacataaggactcacataaacttaaggtaaaggggtggaaaagacagtctatgcaaatggacaacaaaagcgagcaggagtagctatagacaaaacaactttaaagcaacaatagttaaaaaagacaaagagggacattatataatggtaaaaggatagtccaacaggaaaatatcacaattctaaatatatatgtactaacaatggagctcctagtttgtaaaacaattacctctagacctaagaaatgagatagacagcaacacaataataggggggacttcaatactccactgatagcactagacaagtcaagacagaaagtcagcaaagaacaatggacttaaactataccctagagcaactaaacttaacagatatgtacagaacatctacccaacaactgcagatatacattctattcatcagtgcatggaacattctctaagacgaccatataataggccacaaaacaagtctcaacaaatttctgaaaactgaaattatatcaggattctctcagaccaaagcagaataaaattggaaattgactccaaaaggaacccttaaaccatgcaaatacatagaaattaaataatctgctcctgaatgatctctgggtcaacaagaaatcaagatggaaattaaaattccttgaactgaacaataatagtgatacaacctaccaaaactctgggatacaacgaaagcagtgctaagaggaaagttcatagcattaaatacctcattgaaaagtctgaaagagcacaaatagacaatctaaggtcacacctaaaggaactaggaaacaaaaacaaagcaaacccaagcccagcagaagaaatgaaagaacaaagatcagagagaactaaatgaaattgaaacaaaaaaaattacagaagataaatgagacaaaaggtggtctttgaaaagataaacaaaatcaatagaccattagtgaggttaaccaaaaaaaagaagaagctccaaataggttcaattaagaatgaaatgggagatatttctagttctagatccttgggaattgccacactgtcttccacaatggttgaaccagtttacagtcccatcaacagcgtaaaatgttcgtatttctccacatcctctccagcacctgttgtttcctgactttttaatgtcgccattctttttttcttttcttttctttttttttgagacggagtctcgctctgtcccaggctggagtggagtagcacgatctcagctcactgcaagctctgcctcctgggttcatgcattctcctgtctcagcctcctgagtagctgggactacaggcacctgccaccacgcccactaatttttttgtatttttagtagagacagggtttcatcatgttagccaggatggtctcatctcctgacctcgtgatccgcctgcctcagcctcccaaagtactgggatttcaggcgtagccactgcgcctggcctaatgatcgccattctaactggtgtgagatggtatctcattgggttttgatttgcatttctctgatggccagtgatgacaagcattttttcatgtgtctgtggctgcatgaatgtcttcttttgagaagtgtctgtttatatactttgcccactttttgaggggttgtttgtttttttcttgtaaatttgtctgagttctttgtagcttctggatattaccctttgacagatgagtagattgcaaaaattttctcccattctgtaggttgcttgttcatctgatggtagtttcttttgctgtgcagaagctctttagtttaattagatcccacttgtaattttggcttttgttgccattgcttttggtgttttagacataaagtccttgcccatgctatggcctgaatggcattgtctaggttttcttctggggtttttatggttttaggtctaaatttaagtctttaatccatcttgaattaatttttgtgtaaggtgtaaggaagggatccatttcagctttctccatatggctacccagttttcccagcaccatttattaaatagggaatctttccccattgcttgtttttgtcaggtttgtcaaagatcagatggttgcagatgtgtatattatttctgagggctctgttctgttccattggtctgtatctctgttttggtaccagttcatgctgttttggttactgtagccttgtagtgtagtttgaagtcaggcagcatgatgctccagctttgctcttttggcttaggattgtcttggcaatgcaggttcttttttagttcctatgaactttaattctgtgaagaaagtcattggtagcttgatggggatggcattaaatcataaattaccttgggcagtatggccattttcacgatattgattctcaaagatctagatcagaaccagaaataccatttgacccagccatcccattactgggtatatacccaaaggatttaaatcatgctgctataaagacacatgcaaatgtatgtttattgtggcattattcacaaagcaaagacttggaaccaacccaaatgtccatcaatgatagactggattaagaaaatgtgcatatatacaccatggaatactatgcagccataaaaaaggatgagttcatgtcctttgagggacatggatgaagctggaaaccatcattctcagcaaactatcgcagggacaaaaaacaaatactgcatgttctcactcataggtgggaattgaacaatgataatacttggacacagaaggggaatatcacacacctgggcctgttgtggggtggggggaggggggagggatagcttaggagatatacctaatgtaaatgacgagttaatgggtgcagcacaccaacatggcactgtatacatatgtaacaaacctgcacattgtgcacatgtaccctagaacttaaagcatataataataaaaaagaatgaaatgggagatattataggtgataccacagaaatacaaaagccattcaaggctattatgaatacccttacacacacaaagtagaaaagctagaggagatgataaatttttggaaatatacaaccctcctagattaaaccaggaagaaaaaggaactctaacagactaataacaagcagcccaattgaaatgataattaaaaaattgccaaccaaaaaatccaggcacggacagattcacagttgaattctatcagacattcaaggaagaattagtacaatcccactgaaactattacaaatgatagagaaatagagaattctccctaaatctttcttgaagccagtatcaccctaacaccaaaaccaggaaaggacataaccaaaaaataaaattcagaccaatatccctgatgaacatagatgcaaaaatcctcaacaaaatgatagctaactaatccaacagcatatcaaaaagataatccaaccatgatcaagtgagtttcataccagggtgcagggctggtttaatatacgcaagtcaagaaatgtgatacatcacataaacaaaatcaaaacaaaaatcatatgatcatctcaatagatgcagaaaaagcatttgacaaaaatccatatcccttttttattaaaaccctcagcaaaatcggcatagaagggacataccttaatgtataaaagccatttatgacaaacccacagccaacattatactaaatggggaatagttgaagcagtccccccgagaactggaacaagacaaggatgcccgccacttctattcaacatagtctggaagtcctagccagagcaatcaaacaagagaacgaaataaagggcatccaaattgtaaagaggaggtcaaactgttgctcttcacttatgatatgatcatatacctaaaaaacccaaagactctggatcttctagagtctcctagatctgacaaataaattcagtaaagtttcagatacaaaatcaatgtgcacaaatcagaagtactgctatacaccaacagcgaccaagctagaatcaaatcaagaactcaactccttttgcaatagctgcaaaacaaacaaacaaaaaacaccttaggaatatacctaaccaagaacatgaaagacctctacaaggaaaactacaaaaactgctgaaagaaatcacagattacacaaacaaatggaaacacaccctatgcttgtggagggtagaatattgtaaaaatgactatattgcaaaagcaatctccaaattcaatctaattccatcaatatattatcataattcttcaaagaactagaaaaaacaatcctaaatttcatgggaaccaaaaaagagctctcatagccaaagaaagaccaagcaaaaagaacaaacctggagcatcacattatccaacttcaaattatactataaggctatagtcaccaaaacagcatggactggtagaaaaacaggcacatagaccaatggaacagaatagggaacccagaaatgaagcaaatacttgcagtcaactgacctttgacaaagcaaacaacaacataaagtggggaaagaaacaacaacataaagtggggaaagcacattctattcaacaaatggtgttgggataaatgacaagcctcatgtaaaagaatgaaactggatcctcatctctcaccttatacaaaaataactcaagatggatcaaagacttaaatctaagacctgaaaccataaaaagtctagaagatacatcagaaaaacccttccagacatgggcttaggcaaagacttcatgaccaagaacccaaagcaaatgcaacaaaaacagataaacagtgggacttaattaaatgaaaaagcttctgctagcaaaagaaacaatcagcagagtaaacacacaacccaacagaatgggagaaaatcttgcaaactatgcattcaacaaaggactaatatcgagaatctacaagggactcaaacaattagcaagaaaaaaacaaataatctcatcaaatagtgggctaaggacacaaatagacaattccaaaagaagataaacgtcacgcctataatcccagcactttgggaggccaagacaggtgatcacgaagtcaagagatcgataccatcctggccaacatggtgaaaccctgtctctactaaaatacaaaaattagctgggcatggtggcatgtgcctgttgtcccacctactcgggagctgacgcaggagaatcgcttcaactcaggaggcggaggtttcagtgagccaagatcgcgccctgcactccaacctggcaacagagggagactccgtctcaaaaaaaaaaaaaaaagaaatatacaaatggccaacaaacgtatgacaaattgctcaacatcactaatgatcagggagtgcagatcaaaaccacaatgtgattccaccttactcttgcaagaatggccatcattaaacatcaaaagataataaatgttggcatgaatgtggtgaacagggaacacttttatatcgcggtaggaatgtaaactagtacaaccactatggaaaacaatatggagattccttaaagaataaaagtagatctatcatttgatccagcaatttcattactgggtatctacccagaggaaagaagtcattatataaaaaatacacttgcacatacatgtttatagcagcacaatttgcattgaaaaaatatggaaccagcccaaatgcccataaatcaacaagtggataaagaaaatgcagatatatatgtgtgtgtgtatatatatgtatatatacgtatatacatacatatatactatatacatatatacgtatatatgtatatatatgtgtgtatatatgtacatatatgtgttatatatgtatatatatatatacacacacatacacaccatggaatattgttcagccataaaaggaacaaaataatggcatatgcaacaacctggatggagttcaataccattattttagtgaagtaactcagggatggaaaaccaaacatcatatgttctcacttacaagtgggagcaagctatgaggaggcaaaggcgtgagaatgatataatgcactctggggatccagagaggaagggtgggaggagggtgagggataaaagactgcacattgggtacagtgtacattgctcggtgataggtgtaccagaatttcagaaattaccgctaaagaacttatccatggaaccaacagcacctgttccccaaaaacctattgaattaaaaaatttaaaaaatacaaaaacctaaaatagatttacccccatgatccaacaatctcactgctgaggatatattcaaaggaaaggaatcaggataccgaaaagatgcctgcactcccatgcttatgcagctctattagccaagaacgaaatcaacataagtgcccatcaatggatgaatagataaagaaaatgtggtatgtatcataatggaatactatttagccacagaaagaatgaaattctgtcatttgcagtaacaaagacaggaactagaactggaagacattaggttaagtgaaataagccaggcacagaaacacaatattacatgttctcacttacatgtgggagctaaacaaaattgatctcacagagggaagagtagaatgatggttaccagaagctgggaagggtggcaggggtgaggctgggataaagcagtttggttaataggtacaaacgtaaagttaaacagaaggaataagtcctagtattcacagcgcagtagggtgactacagttaacaataatcatatatttcaaaacagctagaagagtgatttggcatgttcccagcagaaataaatgataaatgtttgaggtggtggatatcccattaccctggtttgatcattatgcattgtatgcatttgtcaaaatatcacatgtaccccaaaacactacaatcattatgtatcaataaaaaagctcacagatcaataagaaggatttgtttgccccaggaggagcaggggtccagctaatgctccacaactgtagtctgcactcacccaatcagaaataagacaactcttctgggagagtaaaaaagcagggtgactcctataatggaatacagtcattcctcatatgtcattctgcacagccatgcttcaacctcaatgtgaaaccttttaaacgtgttcagctcaaagcatgatgtgggctgtgttctgtctgaagtccatctcaggcagtcctgaaagtcatcttaatttgatgaattagagagctgagaaatcacaacattggaagtctgatttctccatgctaccattgttaaggggaacccaacttttccagggcaatttatctcctcaccaccgattttggtcgatactccctggctaatgttgaagtcactggttcagacttcggctctaacacacacacaactgttgctaaaaagtgaaatgagtgacatttctgctttgcttgctttgtggaggctaccctattgatcacaactgggatttacttaaacattcctagcagaaaaataactcctgattctatctccttctgaaaatgccaacaaatatgctgaggcagtaaaaaaaaaaaaaaaaaaaaaagaagaaagaaaaaaacggaataaaatcattatccatcccctctacaaccatgttgttttgttaatattataactttaattatttctcggttcttgacagttcacgttgttggtctaaccctcaccccgtattgattctcctcctgtaaaaacaagcatcagggaggcaccaaaaattgcatgctcaagcttagtgctatgccaggggttatatcatgcatattaaatctggacagcatttaggctaaagcaatcttagctttatatcttgttggtttttaaagaaaatgttaatgaaatatacattacttatggcagacagcatcccagtggggtccatttcaattagtatagtttgttcaaataaaaagcaaattcagctctcctcatttgtcaccgggctgccctgcaacctgaaggcagggccagaagagaaagtagagagaatatcgatgagcgttttcagaccaactcgggagtctaagaaagaggaggggattctgaccaattcattcccacccacagtgactctgaacttctcttctatgagaatgacaaagattttagttggtgcaccttccagacactgcatccatgtgtcaaggtggcaaattaccagaaagtcaagcattctggctttgtgatgatgttcttaggtctgttgtaggcctatgtcttgataccgtgctagcttcccagggctgctgtaacaaagtgccatgaactgcgtggcatgaaacaatagaaatgtattctggaggcccaaagtctgcaatcaagctgtcagcagggcgtgtccctctgaaggccctaggaaagagtccttccttgtctcttcctcgctgctggtggttttggctatcttgggtgctccttggcttgtagatgcatctggtaatgattctactctttactccattggatcaattgtgtttagctctcaatctctgtttctgtcttcacgtggtcctgtagtctgtgtccaaaattccttcttcttacagggacatgagacatattggatttagggccaccctaatccagtatgacctcatcgtgatggttaattttatgtgtcaacttagctaggcatggtaatcagcttttagtccaccaccagtccagatgcagctgtgaagatatttcttcaatgagattaacatctctgagttcaagcaaatagtgtgggcgggcctcatccaatcagttaaggctttcagagaaaagactgaggttcccgggaaaagaaggaattctgcttccagactccttctgactcaagactgcaacatctactcttctcttggtctccagcttgctgacctgcctgcagattttggactagctagccccgaacaactgcatgaaccaattccttaaaataaataatatcattctatctacatcctattctattaattccattttcctgaagaatgttgacctaaaaccatcttaacttgattacatctgcaaaaactatatccaaataaggtcacatacaaggtgctgggtggttatgaatttatggagaacattattcaacccagtacagatatggtaactagagcctcgctattcaaatggtgcttggatcagcagcagcggcatctcctgggaattgacagacatgcattctctctggccccatcctggacctactgaatcagaatcttcatttaacagatccccagatgatttgtgtgtacattacaatttgagaagtactgggctagaagacatgtttccaaccatttacagtatttataataaaaggcttgaagtctagacattgtaaagtcagatagctctaaagtaaagggtcaaagaggaagaattaagaaacaaagtagaaatacagggaaatttgaaataagtcatctctcttattaatcaatatacaccttaccaatagtgaaaataaataaatatttgtcaaacaaatggacaaaagaatacatgaatgaaatgggctcttgtaacagaggttttctaacaaactggcttctatttacaaggaaagcctttaggcaaagagaaaaatttcatttccaccctccagagtccaggtcacctttcccccttccatgtctcctgagaggcactgccatgccgatgtgattaccttgtgacagtgtctcacttgaatactctgtcttgctctaggctcccactgtaactcatgttgacatggagcaatgtttcatttccaatccatatgtatgaatttttaatgaactgtgtcaaagaaatcaaatatttccccctgcatcccactctatggaatcagattttgaccttctgccaaacaactataaatcatgttcagcgaaagagcaggaaccaggggctactgcacatagattagccagtcaatttccctctgtcacccttcacctaagctgtctaggatgggagaggagggaggagaggagaggatggaatagagaaggaaggaaggaaggaaggaagggagggagggagggagggagggagggagggaggaacaagccagtcagcctagaaaagaaatataaacagtaggcactcaacggttactaaaatattaagccataaaaatgagatcacttattttttgaaacctgggtgatcatcttgttaactgaatctttggatcattaattccctgcttctgtaatttggtcttatatttcttcatgtaaatgacttaaaactggggggtgggagggggaggtgagaagtttgaaaaagtagaatgaaataaataatttcctttttcaagagcactttcctagaatttccaatgaactatgcaaaacaagcaggaccttcctaaataaaggctcaatcaacacttagaagggagctgcaattagatacatttcttgcctagcagtgcaagaatgattttttaaaatgataatatcctatgttggcattacgtgatgaaaaaaaggttctatcaaattgcttgtgggggtgtaaacagatatccattggataacaagttagtaatataagtgtaatgggccctaaaggtgttcatacctcatataatcttacggtaatctatcctaaggaagtaattcaaaagacgaaagcaaaaaaaaaaaggttaaagccatcacaacttcgtctacaacaatgtattgacaaaatctaaatgttcatcaaagatgtgtggctaagtaaaataagatgcacccatttaatagaatatcatacaaccattagaatgcttactaagagtttataacaacatgggaaaatatttattaatataagtgggaaaaaagtaggatgtaaaactgaataaaaagtatcacggttgcaagaacaaaaagcctccatgcctaggcatggaaaaggatatgggaggaaatacgccaactgctaatagtgattatttaggaagcaggaaatgtgggtaaaattttccctgttctatattttccaaacatcctgtaatagtatatgtacttttataatgggaacataagattttattgtgcttttgaaaagcaagtcgttgtataagtaaaattctaaaagatatctctttcaacaaacaatagcaactgggtcatgctaattcaaggtgaagcacatttgtaaatatcaaattttctaatctaacatccagatcgggacatagaagaatctggcgggctgcctgctcgcaaagcttctatctctgtccaaaacctgcacttaagaagttaaaggaagagtcagagctgtcagctttaagccagtagattctagatgattcaaatagctgtcatagacactccatttgctaaagctcactcactggaaggggtctgccacacagggctgaagaacagacacacggatggacagacatggattatatcggacctgctgcttgccagcaatcatccccactcacagcattttcctttcttggcaagtttgtaacttaaaagctaccaactctcgcttttttaccctgttcaagcaaaaaattttgaagcaaccatctgtgcctggaaatgagcagcaatctaagaccatatgcaagtgcaggggcaggggacaattccatttgagtgatgagtttattgataaatgttctaagtggctgactcttgttcattttaaataaagcaacacttgggtattttaaataggtgaaacagcatcagcagcaggcgcttgtgatgagcaaacccaacgcccatgtgcttcacataagacatcttaacaattttctcaccatggaagcttgtatgagatgcacagggacagagcgtggctgagattcccagggccaaccatgatatcagctcctgtgtgacctagaggatcacccagggcagtggtaagaggcggaaaatggctccttctagaaagatgtcttaattcagttctgtcaccgatttcctctctcccactggaagctctaggtctctattttcttaatccagtcaggcaggacatagatcaaacagtgaaaactgaagccactcagcactagggacaaagatgaaaacgggagcaaaattgagtggctcattcagtgctctaaaccagtgaacttccaccatttgagacactattcccccatatatgtatatttccattatatacatgatcccgtcaatctatatatcaaatctaaagctttctttcttcctgcccttcttcccctccccttttccctttctctctcccttttccctcctccctccctcccttccttccctaaacaatcaccttgcacacatccctctttggaagactttctaaacactcaagtgggttatcaaatgggtgcaggagtgaaggggtgggaaaggcaggcatttcctacctttacagtcttgcagagggaaaccatcctgaaaaggatttccacataggttggtaggtatcttacatcaccattctccgaaatctatttacctacactgggcacttactatacccagtcacacatcatatgcagggaagtaaggctaggcttcattaatgtggatccataagctaattcaaaccaggctgggctaagccacacctcggtgctgtgtattaagaaaatgggtctgctgaataatcagagtggagaaagtggcagcagtcagggggatgtttaatgctggaagggaatagactcttttcaggctccatttatagccaagcaatccatctaccaatacaggcaagttcttatccagacattaaagcaggcaactgcctgtgttggaaatcaaccaaactgcttatcttcagccttccataattccagaccttttgctgatccgccctggcttccgcctaatgcgtttgcattgctttttctgctcccacttttagcccctagagtttaccctatatcaaacacccatgaagacacacaggcaaggcagtgagcagatctttgttttaactgttggggaaggaagaagctgtttggtctcttgggtctgtatttggcctgctgaacatcacgctgctgagcccttgtggataggatccagatataacgacaaccctgtttccccctttgctttgaaatattccagaaagggagactgtcatgagaaggggatgggggaagctgcaaagtagccaatgcattttaaaaatggagactccataccaaattgggcatttccattgcaaatcagcattcactgggcccaccattagccaagctcaggatcctggctaattaagtcagtctcagtgggaagctatagacttagggaccacggcttagctccagtctgagaagctcacggctaggctctgcttcattcttcatgcaatgtctagcaaatcaaagctaatgtgaggagcacaccacagctgactgggcctcccctcagtcatgtgcactcaaagcccagggcaccactgatcacatgtcatttccctgcattaacattctgtctgggttctagcttcacactcaacaagttattgcaagctataaatcaggagacgaaggacagggtggtgtgccaagacatgttctcaacatggtgcacagtgacagaaaccatcttaataatgcgatctttagagactcaaggaagtcggacatgctgtcatttctcccttgatgaggaatcctgccagggagaagtgactgatacccaattcttcaaaaatgcatctttctaaaaatgtagatgaaacttacaaaaatagcttgatgctcctccaactcaactttttccccagcaccctgcccccaccgtggcttaaaaatacacgccaggaatttatatttggttcaaagttgcttagcacatcgaggctaaatacagctatacaccaattttgcttccaaaattacttacttgtaaatgtataaaaccgttaacggaagatttatagttttacttcagttctttcattactgatttgcagagatctctctaggggtgttatttttggatatttctaagtctgcggactgcacaactctcgatagatgttaactcatctcagagagcctcatcgtaactgaattatgcatctcattcatttaaacatttaatgaaccccatgaagcattaagtacagcagggcacacaaagctgactaaggcaagggcttgtgtctcaagaacttacacttgttctcagtcatcttgtaagctgggagatgtgttgatacagtgctaaatttagtggcaaaataaaacttccctggtctgaagcccaggttgtatatgtctacaatgtatcttaccgctcttctgtaagaggaatttgccgggactgaagtggagttggccttgaagattgttgtactccatccatccatccatccatccatccatcccaaaatgaatcaaagaatgtagactccacaagggtagggatttttatctgtttcccccacatttataaacactctacagatatgtatttagaaatatatctacaggtatgtatttataaatacatcatatattatatgatggcctgtctgctatttgtaaaagtttgtatctcaccctgctagcaggaagagttgccagagcctgatttctacttggaacaaaatcactctgaagttccatttcctcattagaaaatggggatagtattatagatgccataggattcctgggaggaatcaaaggggtatataagaaatgtactttacacacagtgcctggtaccctaaagctcttgactaatgtggatatcttcccctctctgctacaggaaagggaaatcagaaagaatgggaagccctcactgtcacagaaggagagacgggcattctgagagcttcaagatcctgcttctggccaggcgcggggctcacgcctgtaatcccagcactttgggaggctgaggtgggcagatcacctgaggtcggcgttcaagaccagcctggccaacatggtgaaaccctatttctactgaaaatacagaattagctgggtgtggttgcaggtgcctgtaatcccaactactcgggagggtgaggcaggaaatcacttgaacctgggaggcggaggttgcagtgagcccagattgcgccattgcactccgcctgggcaacaagagcgaaactccgtccctccccacgccaaaaaaaagatcctgtttcatttcgagttctcactaagtcattgtgtgactttgagctggtcactaacgcgttttcagcccgatttcttctatgtgaaaatactttttaaaactgaaaaccaatatgaaagggtaaagatacctatgaaaagaaccagacagcattattttattcaaagatcctctctgacaagcaagttcctgggttgaacgatgggccaaaaattttttaagggaaaaaactgacccctgagacctcattaaaagaaagataaactcccaggaaccatattttattttttgctgcaaggctaatatgggttaagaggaaaaaataactgctgggataagcattcatgtatcttataattaatatttcaaggaggatttggtgcaacaggggtcgctaagctgccattcactcccacgggcttatctcctctggctgggaaatcacgctggctttctgtgagcgtgattttcccccaggatcactgggccacgtccctcgaggctggcccacacaaagggcagaggggactgagaacaagatgcggtgcctgcaatacgtcccacaaaacagcaagctggaattttatcacgttcactcaccaggacgttcattcaccacacagattcaggtttattctttgcatctcaggcaagaaagggaagggagatgcttttctttctgtcagactgtggcttatctgcctcgctcacagccgtaaggccacggatttataaattttcctgcaacggtcttatcaaccactagcaatgtgcgcaacgtgggactgagtgttttcaagggggtcccaacaaaagccctgcggctctgtgttctgatgagttgccggaggactcactactgggcagggaacataagactcaggcttgggatgaaggagaggaaggaaccgtcctggccctccagggtaggggtggttattctgtgggcaaggtcataggcctttgccaccttgattcttgttccctgagttctcctttttttttgagggctcgctctgttgccaggctggagtgcagtggcatgatctgggcttactgcagcctcaactcccaagctcaagcaatcctcccacctcagcttcccatgtagctgggactacaggagcagtcaccacatctggcttttttttttttttttttttttttagtttctgtaaagacggtgtttactatgttgaccaggctggtcttgaactcctggcctcaagtgatccttctgccttggttcccctgggattacagcagtgagccaccgcatctggctcctttttctttttagagacaggtctgactctgttgctcaggctggagtccagtggcgtgctcacggctcaccgcagaataacctcccgagctcaggtgatcctcccacctcggcttctccagtagctgggactacaggaaacaccaccatacccagcaagttttttaaaatttttatatagatgggggtctcactatttgcccaggctggtctcaaattcctgggctcaagcgatgcttcggccttcgtgtcctaatgctgggattacagccatgaacgaccacacccggccaagttctttttcaatggaattgtaacatgtatcactgtcactatctccttatctcactgttcttcttcttcctcatttctatcaaatctgagtaacagttcagcccttcctttaatttccacaatttaagaaagcagccaaacgtacaaaattacaattagaaaaactggtgttctcttgcacagtagggcagctatagtaataataatgtattgtatatttcaaaatagctagacctttctgaatgtagtcaccaaaaaaatgacacacatataaggtgatggatgtgccaattaccctgatttgatcattacacaagtatacatggattacaacacattgtaccctgtaaatatgtacaattattacgtatcaataaaaaaaataaaagacagttgtagtaagaagaggctatcattttaacagcattaattcatcatttattcattccacaaagtcttcagtgagcatctgtcacaccacaggcactgctccgctgatgggatatgatgatatacagaacagaaattcctgccctcacagaatttacatggagtgggcagagacagagagtagatataataaaaagttatagggtatattgtttgggagagataataaatgctgtggcaaaaaaaaaaaaaaaaaagcccagaacatggtaagtggaacaagagggagcggggttggtgatgggttgcaattttaaacagggggtggggatggggatgggttctccttgagagggtggcacctgataaagagctgaaggtggacccttgggtatatgaagacaggtgttctaagtgaacagaacagcaagtgcaaagatcctggggtgagagagtcttggtgcatttgaggaagagcaagggggctttttccttaaaattcaatgaaactcaaaggaattacccccggacagtgacgtgcctggaactctcacagctgaggcagctctcataaccatgtgctgaggctatcttcatagactatcccactggaatgttttttcaacatcaggtccaaccaaatagtataataagtacagaaactaacatagtgggtcagggccagcataaaacaaaagaagggaatagaatgtattaaaaaatacctgcgtcagtgtgctgaatgtagaatgcttcctatctgtatatttgtgatataaaagtagttcttattgtaggttggggtccaaatgcttaacagctactaaccaacaggttaccttctactgagtccccaacttgcctccttgtgcagtgccttctgctcccagaacctggaagcatctacccgtgacagatctagattcctttaatctaagctcaaaaagaggctcagagagaaaaagatgtttcctcaaccaccagacctgcctgtctcagcaacaactgaaatggagacactccgctccctccaaaagacagacacccgcttcccacccaggggctacatcttcctgtgatggtcccaatggctcctactccactagattttaagacactcaaaacagagacccgcaaaatagtaggggctcccttcccttatcatacccccaatccacagagtggagtttaactcatgggcagtttgctggaaaataactccctgcctaaccaatgttcatctgttctctgggccaagaaccccatggttcatttgggactttaaaactgactaaataaaaagaaattttaaaaatcaacaaaagtgcaacagaaccactcaaagctgcaatgtgggaaactcttcaattaactccctctcaagtttttctcttctgacaaaccaagtttttctggcatcccccagaggtctccctttatctggacaactcattttgagttttggactacatcctgcactaagcaggaaattattaatgttcccgtttaaaggcatgaggggcagagatcctctatgatggtttcgggggtgcaggaaactgtatacaatctggagacccatcagccccttacagcattactgggagcattctgaatggggtcctctctttccagcagagaccaaaagattgcccttaatagaattgtttaaattgcctaaaattgctgcttctatccaggctgaaaattacagcccttacgctgtttcccatcctctccccagggttactcagtccccagaggagatctgtactaacaacatcatcaacaaaacctgaatgtactttgtgtgggaaaaatatttgcagcttttcaaccagatccgaaaaggcagtgactgacatacacacgtctcccaaatgaattcagattttcctttttttttggcatgacaaaacaaattaccagcttatttatgttgccttctgaaatgttacaaatcaaatgctaaaaatctctgaaaccatatctgctgaagatgatgaatgctgatcttccttctttgtcattttctgccagctgggtgggtccatgaggaggggaggggatgatgaagaagttattgttgccaaataatgccacatcaggtgtgagtgttgagacagtcatttccttaccttaactcccctctaagagaaggctgtgtggggtaaacaaacaaaacccaatctgtgtatatttcaaggacgtagatcttctgaaaactctgtttactgcagtgagacagcactgccttgggagacccaacttctttcagctcatgctacaatggcaaatgggtggacctgatccaagtggccctgtactgccccatccatgttctgcaaggcacctggccctacccagggtcctgctgggcagagctggctatacgaacaaacttggctttgagtttgcagtgacaatgtgtatgtgcaaacagctcttcagttggggatcgtgcactccaaaggaatcacaagctgctttggattcaatcttgaagcctcaaccaagactgcaactactggcggtcttttttatcccttcaggtgcttagctgttgatgaggttatacaattccactcagtacgttcttctcaacgaaagcaaaggacttctgacacatcgcaaggctctcctcgaatcagcagagtcaatctcttgtatggagtctctaaaaactgctccctgggtgatctaatgtgcaactaggattgagaaccactaaagaaatggcgaggcagaacacgactcactaagaacataatttcccagctcaaagctctttcctccacagagccctgcaggtggccaatgctactattgctggctcagcttcttaaaggcagggggaaggcaggcccaggacttttaggaccaagactaggctccaacagaggattttctagataggcgcatcccactctagtttcattgaaaaaaatcttgctgcgcacctactatgagccaggcgggtacccctgggaataaaggggtgaacaagaggcccctgctgtatcctaaagtgatggataactatgttcttgaacaggctaagtgctttgcattctctcattgtctcatttaatccttaccactagtctgtgaatacgtattattatccttattttacagaggaagaaactaaggctcagaaacattaagccattgctcaaggtcacacagctgggaaataacacaagtctgacttgttccaggcacggaggcagcgtggggagaaaacagggagcaaagatgagctggggaacagacgcggaagtcaataaactatgacttcagcgggctctctccaaacaaagttttagatgaaattctttaaacaagaggaagaaaataatttggaatttctggcaacattttgaggcagagcttcaaaggacccgataaataatgaatgtcactgaaaggccacagagcagaggggcagaatcacatgctcgcctgccaagagctgctgaagaaagaaaatacttgacagcgtgatctgtgggttgttaacagatctgaaaatctttctaggtcagcagatttcctagacagctgtgatccactctggggagctgtcagccattgattaattcctaatcaatgagaaagcaaatgatggcaaatgaaccagctgaactggaaagattgtgggtctggggtaaaaggccatcctcttcccagcagaattcaagtaagggcaagggtgagagggtggaaaacagggaaatggggaagaggaggagctgcccaggaaagaggacaggaagggagagagagaagcagacagacagatggactgggcctaaagcagcatgagctcctgggagagggacttgtggtagaggccaggggagactgcctggggtccctggtggttggtttgtccatgatggaaaattttgtctcaaatgaggctgtcattaggagcacatggatgtccctctgacataagttccaagaaaattaaccaataggaactgaatgaaagacatgaaacagattcctaattaagttacctgactccagactgactgcagctgcaggtctgaaatgggtttgcatgggaggctacaggcagtatggaatgggggaaaataacggggttttggtcaattaagttcaggaaacacaggttagacaacaacaaacaatttcttttcccacgacttctctaaacctctgttgtgatttctaagattgggaaagtgcctcccaaattcagtgaccacaggcggagctgcttgtggatttagggttctaaggaacatgctttaggaaagtacttgggtacaaagggaataagtggggtccaagagcccctaggctgtgccacctggggctagtcatctcttggacactaacagtgggtcaccatttacctgtcctggctcacccgcagctgggtacatcagtggtggtagtatcatgggcacattcttcaaatttaagtcccccagtgtttaaaggtgtgacttactttcagtcggtgtggcattctctgagctcaaaattgggatctttaagaatgccagaatgcgagagaacattctggatgaactcatctctttacaaaaaaagaacagaggccgaggaagtcaagcagtttatgccaaagtctctgggacaactcagtgttgagacacaactggaacccgaggcttctggccttcagtctgggatgaaggtgcctctcaactcccccacaccccactgaaggcacaattccaaccaatgtttaaaaacttagaagaaagtatccttgaactgttggagaggtggtaaattctactttcccatggcccgcctacctctgttagtctatcgatgacacttgcacatgatttatcctgttaaaaaaaaacattaacaacaaagcaagctagagaaaccccctaatggcaggaatttaaacatttgcccaccactagacaaataaatatgcacatagctgcattcctcccttctcctttgttcaagaagcagaaaaaataaggccaaaagagagcacttgggaaatgggtcactgggattgcaaaaagggatgttcacttagccattcaaaatgtgtcttgctaattaagaacatgtacttggtaacagggtctactttatgacaaatttacagacagatccagaaatagatcaaccaaggtaatccagagacagcctcaatgtcctaagagagggaggggtgccaactgacccagcaaaaggtctgggaaagagagatacccccaactgtgttcaattaaaagttctctcccacagcaaccagagccagccgtgctcagacagaaacttatatggaatttactcatcttgcttgacaataatctccggtcctcctgggctcaagtgctttctgcagcaatgttaggtggcatttattcactcctgaagttacattcaacaaatatttgctgcaggaggacctgttctgagaagtggggataccacatcacaactcagagttcctatgcccatggagcacatcctggtcaagcacccccactatgctggcatctctcggcgtcctccaagaacccgaagccattaagtgttactaacccctttgttgagatcctgaggctcagagtgagaaaataacttgccacaaatccatggtaaatggcagatcaggagtggaacccaggtgagcaggacctcagagtattcatccacaaaccttaatcatcctgcctcaattaagaaaggagactgcttgattgtacccttgactgaaagcttcctctcctctttgttggaggtccccaagagcaccccaattgtgaagatttgctaagaggactcacagactcagcatatacttgtactcacaggcacaatgtattagagcaaaaggttacagagcaaaatagcatggaaaaaggtgcatggagtaaagtctgggggaaaccaggtgcaagctgtcagcgtcccaactatttatcctaaaacagacctgctatttcaacttttttctgcacaccttctgttagaaaagctgatctgtgcaaatggccaaagggagttggaagcagacaaagccaaagtatagatgaaaccctccctgaaagaagaatggatgaatttgtaaaacagactatatgaggatttttttggtgggagtgaatagggacacgggtaggggctgggtgatttcattataaagaggtttggaaaggggaaagcactggcaccagcatcagaggacctaaggctctgttgacttaaggtcaattcctatcgctaacgagctgtgtgactgtggccaagtcacttaaccctctggttttctcatctgtaaaatgagacgaaagctgaattagataaacctctaatggttttctgtctctgatagcatctggttttataactgactagagattttctttaaaatggaagattccctggtgaatttagaaaatgactcaattccacacagctttcaggagcacgtgtacacaaagtgagactcatctatggattctttagctaaaggaaaaggaaagtgtgtgttgggggaaagagagcatttctcagccaagtggccaatttgcggtttcagttcccttaggagggtttggaaattcagcattccttggttctaccagtttttacctcactcaggaaaagggagtggatgggctggtttgggaagctggtggtggtcacagaagtcactgcagacactttgggtaattttctccaagtcatccagctaaagtgttggggtcaagtctatgaagctctctggtgccccagctcatgatctagcatttccttgtagtggtactaagagacaagacaatagtaccagtgggctgggaggaactgtttattttccttccttttattctattgattgattgtaaatctagcctgcttggtagaattcatgctagcgccagggtctctactacagacactgatgttaactggcactagacaggactggggattttgaccaatatacatttatcaagctcaatggggaggtggaagactaaaaacaattcaaagtgggatcccgccctcacggaacttagcatcattaaggagggagcggagtgccatggaaagaccatgggctttggaaagagacctgagttactacagcccagcccaattgtttactagctatgtggccctgggcaagaaacttaacattgtagccttagtttccttcttcgtaaaatggcggtaacagagtccaactgttagggctgaattatctatatgaaggtcttggcacagtggccagcagtgcctctcttctgtattcgatgaaatggcaccccctgaagttttgcgatgtgcacccctggcccatcttactacacaatacgtgtattgtgtagtaagtgctcaatacacagtagctgctattatgactgtctctaatgtaccatgtgggtacatcagagctgggatagaattcaggtcattcccagatatgagcatgatcactgaaacagcaccatgtgaattacaatttgaacaattggaaacctctggcctggctgactggtgagggcgttctagacagacagaaaagtgtgcctgaaaggtgggaaaccaaggttgttcagaggtgcctatgggtgcatgtggtgaacagatcagacctcggagaactttcctgtccagtaagagattcagctttatgctactggcaatgaggggctattgtgtgtttgaaacagacagcaagacaagcaggactgggctttcagtgacaaggactggaggtcaggaaggtcattagaaagctactgcaaaagcaggaggtagagagaaggccagaatttgggcatgggattcagcttcaacaagggatctttctttctttctttcctttttaattttttatttattttttttttgaaacagagtcttgctctgttgcccaggctggagtgcagtggctcaatcttgctcacggcaacctctgcctcctgggttcacaccattctcctgcctcagcctcccaagtactgggactacaggcgcccgccaccacgcccggctaattttttttgtatttttagtagagtggggtttcactgtgttagccaggatggtcttgccttttttatttttttttaaagagacaggtctcgctctaccacccacgctggagtgcactggtacaattataacacacggcagccgggactcctgggtgcaagtgatcctcccacctcagcctcctgggtagctgggactacagcgtgtggtaccacgcctggctaatttttaatttttttgtagagatgaggtctcactttgtgccctggctgttctcaaactcctggccccaagtgatcctgctgcctcagcctcccaaatgttgagattacacgtgtgagccactgtgcctgccttcaacagggaatctttaaagagtatattcatgcctcatttatggaacaaatattgttctcagttctcagataccggtgtccagacagacacagccactaggaggcaacatggttcttccctagagatgggacaccacacagccccaggtaaacgataccccctgcagcctggtggatagttcaagaaagctgttttggggatgaaaaaggacaccccaccttccacctcatcctaccacactccctattccaccgttcagcctgccctggcctggtgaatgccaaagcaatgctgtaagagagacccagggctttagcctcaattcagccacattcatgagtcatgagtcatgaggaacatgagtcatgaggaacagcatgaggaacacattcatgagtcatgaggaacagacgcagagcctcaatggggccccaatcagcaagggatgcacctgccccagcacttctggaagctctggcactgtgttcagtgcctcataccctggtcaccaagccccaggagatggttttctacccaattaccaactgagacaacgtggcaggacactacagcgctgggagccacagaccctggccaccagcccagaagcagctcacagctctgacattttcaacaggtagataggagcagcgaacagattcaaactcccttcatcctcatctctcaccagctggacgacactgctgtgcagggacagcgtctcagacacgacggtgcttcttgaatcatttgtctttctggggccttccaagttgggttattttgtccatcctttctagcgactgcatactgatactttctttcccctttttctcttgcttcctgccacttaactttatccaggatggtctttgcatttgttgtgcccacaactctccaaccgctatcttttgtagattttatctgacagatttcattttaccttctgcacaggcatctgaccatccctgacgtctgatgtcttctcccctcccaggcctgagtgcctgatcattccctcaagatcttgcagaaaggccatcttccctggctactcccaaatggagttcaaagctcccctttttgctaccttggtactcaacagaactcatcatgtgggcatgagtctgtccctcttcttagtaaggagtttccagacgctgtggccaggtgttctctctttatcatcccagtgtgcgacaggggcctggttcatcatacgtatcaacacagttggctaaatggatggatgcacaaggtaactgaatgaaggaccatttcactaacttcatttgtctctcctagagcagctgccaccacatctgttacaaaaccttcaaactgaaatgttacttcaattcctttccaacactttctgctacccaagccaggggatgcctccttcacagagctggtcatctgtgggtagcagaagacagtgaatgcaccatgtccctcagacctttgaagatatagcttgggagtcttgctggggtaagtggtcctggctccattccctggctgcttcatgttcccaagggtcatacaaagacccaagtctgagactgcagaaaaccccaagacggccctatctccttctccttggctgtcactcgattcccacccaaacctcctccaactccatgactctaaacacaggatagactgaagcatcccttctagttctactggtaaatataactgtcagaagatttttccaaaagcaggcagtggagaaaaatcataaaggcagcaaagtcctcgttagggaatagaaaagttggatttgccacaaatgaaccgagatgcccctacagtcaccccagaaaatacaccctgagtgtatcgagaagtcatctgagcactcgcagatgtctccttcccgcttccagacccctaaagtgacagggaggggttaaaacacaaagatcacagggttgagaaccaaggagaggaccatcactgggctcttttctaaaatccctatgctagatatataacatttatttaataagaaaaacagaaacatgaaaacaatctggccaggtgtggtggctcacgcctgtaatcccagcattttgggaggcgaggtgggcagatcactgaggtcaggagttcaagaccagcctggccaacatggtgaaacccgtctctactaacaatacaaccattagccgaggctggtggtgggtgcctataatctcactactcgcaaggctgaggcaggagaatcgcttaaacctgggaggtggaggttgcagtgaccaggattgcaccactgcactccagcctgggcaacacagtgaaactctgtctcaaaagaataaaaataaaaataaaaaacaactaatggaaaaaaggaaaagaaataaaggcccaggcataaagactcaagctggtggctcacccttgtaataccacagggcatatgcaaagtcaggattgctttgcagtgatgtaagaggtcagaatcacaggagtctggcaactgcagtgtcagtacatcataccacagccccatgaggagatattctgaaacactgattgttttaggaattgtaataacttgagaatgtgtacatgatactatgtgtagggggttgaactgtgtccctcaaagttatgtccatgttctaacccctggtgcctgtgaatatgactttatttggaaaatgggtctctgcagatgtaattgagttaaggaactttagatgagatcatcttgcatttagacttaccctaagtcaaatgactggtgtccttttaaaagtaaatagaggggccgggtgtggtggtcatgcctgtaatcccagcactttgggaggccgaggcgggtggatcacaaagtcaggagttgagaccatcctggctaacatggtgaaaccctgtctctactaaaaatacaaaaaaattgctgggtgtggtggtgggtgcctgtagtcctagctactcgggaggctgaggcaggagaaggcatgaaccagggaggcggagcttgcagtgagccgagatcatgccactgcactccagctggatgacagagcaagactccgtctcaaaaaaaaaaaaaaaaaaaaaaaaaaaaaaagtaatatgggggccagtcatggtggctaacgcctgtaatccagcactttgggggccaaggtggtgggtcactcgaggttaggagttggagaccagcctgactaacacggtgaaaccctgttctactaaaaatacaaaaattagctgcacgtggcagtatgcatctgtagtctcagctatcaggaggctgaggagagagaatcacttgaagctgggaggcggaggttgcagtgagccaaaccacgccactgtactccagcctgggtgacaaagcaagattccatctcaatcaatcaataaataaaataaaataaaataaaataaaataaaataaaataaaataaaataaagtagaggaaatttgggacacagagacaagaaatcttgggactccggggagaatgccaggtgaagacgaagcagagattgcagggatgcgtctacaagccaagaaatgccaaggattgctggaagcgccagaacctaggagaaaggtatgcagtgaattttccctcagggtccgcagaaggaacaaccctgctgatgccttgatttggacttctcttctgaactgtacgagaataactgtctgttttttaagccaccaaagctgtagtaatttatgcagcctgaggaaaccaatatacaatatctatgatatgtagaagcagcttatatagctctttacaggataatttcaattatatggtagaaaaggatggacaatgggtgtatattactcctataaagagagaaaaggttatgagaaaatacaaaaagtttgccatctcttatcactgatggattatctaaaagcaaagccttgctgcatgtagcagttcttactttcatcggacatttgatattcaaaataatccagggaggtaatgcacagggtgacattattctgattttatgggtgacaacttgagttggagtgtgatcagaggctgagcagtgactgagtctgaataagaatttaggtcttggtgcttctcaccagcaccattcatttggctatttacctggtgttatgggctgaattttgttctctcctaaattccttgttgaagtcctaacctccaacacttttttttttcttttttttattgatcattcttggggtttctcgcagagggagatttagcagggtcacaggacaatagtggagggaaggtcagcaataaacaagtgaacaaaggtctctggttttcctaggcagaggaccctgcagccttccgcgtgtttgtgtccctgggtacttgagattagggagtggcgatgactcttaaccagcatgcgccttcaagcatctgtttaacaaagcacatcttgcaccacccttaatccattcaaccctagtggacacagcacatgtttcagagagcacagggttgggggtaaggtcacagattaacagatcccaaggcagaagaatttttcttagtacagaacaaaatgaaaagtctcccatgtctcctctttctacacagacacggcaaccatccgatttctcaatcttttccccacttttccccctttctattccacaaaaccgccattgtcatcatggcctgttctcaatgagctgttgagacacctcccagacggggtggtggccgggcagagaggctcctcacttcccagtaggggtgccgggcagaggcacccctcacctcccggatggggcggctggccgggcggggggctgacccccccacctccctcccggacggggcggctggccgggtgggaggctgacccccccacctcctcccggacggggcagctggccgggcggggggctgacccccccacctccctcccagatgggcagctggccgggcggggggctgacccccccacctccctcccggacggggcggctggcgggcggggggctgacacccacctccctcccggacggggtggctgccgggcggagacgctctcacttctcagacggggtggctgccgggcggaggggcttctcacttctcagacggggcgttgccaggcagagacgctcctcacatcccagacggggcggcagggcagaggcgctcccacatctcagacgatgggcggccaggcagagacgctcctcacttcctagatgggatggcgccgggcagagacactcctcactttccagactgggcagccaggcagagaggctcctcacacccagacgatgggcggccaggcagagacactcctcacttcccagacggggtggcggccggcagaggctgcaatctcggcactttggggggccaaggcaggcagctgggaggtggaggtgtagcgagccgagatcacgccactgcactccagcctgggcaccattgagcactgagtgacgcaactctgtctgccatcccggcacctcgggaggccgaggctggcggatcactcgcggtaggagctggagaccagcccagccaacacagcgaaaccccgtctccaccaaaaaaatacaaaaccagtcaggcgtggtggcgcgcgcctgcaatcgcaggcacttggcaggctgaggcggagaatcaggcagggaggttgcagtgagccgagatggcagcagtacagtccagcttcgctcggcatcagagggagaccgtggcaagagagggagggggagggggagggggagggggaagggagagggagagggagcctccaacactttagaatgcgactgcatttggaggcaaggttttcgagaagtgattaagctaaaatgaggtttttgttttgttttgtttgtagggtgggcctaatctaatgtgaagacatagcaaggagatgccatctacaagccaaaaaaaaggggtgtgggagaaaccagacctgctgacaccttgtgcttggacttccggcctccagaacagtgacagatgcatttccgttatttaagccacccagtctgtggtattttgttagcagccacagcaactaatacacttaggaaggctggaacacacagtctccatacctgtttctctttttccttggcattctccctgggctcaaacaggaagtgggaaaatacataatttccaggtacaggacctcctgcccaatgaggttatttctgagctaacaacagccaagacttttggcaagtctattttggaagaaggtccgccctgaaccgtggagaaagagagtggtcaaagccacattcactgatgtgccagcttcttctggtttctcattcaaggccaccacgggaaagaggtagaggagccaggccttgggtttcctttctggccagggagttctttgtgacttttaagcaggggaacaaggctgccggagacagcgcgttgtgcctggggaacaggttcacaggctcacagagagattgggttcagatgctggttctgatcactcctaggtgaccccaggcaaaatgctttcccgactgagactcaatgtcctcatctgtaaagtgaagttaaccccacccgcctcactggtgatatgcatctgcaatgttaagcacttagcatagtgcctaccacatagtacgtgtttaataatgtttgttatgtatattaatgaaaaggttcaccaatttggctcctttttcaaatgtactaaatcccattggggtggtttgcctcttttcccctgggttccatgagcctgggagctgatttttgcgtgactgcacagtgctttcagatttccaattgttttttccttcaatatttaaaatcaagagctttcacacagaaattccaacctctggctcctttagataacctggaagagtagtaatgcagaaagcgccctcctgcttgaaaatgcctggctgcagctgggttgggggttccctttggtgtggcacgtgccctccaatgagtgtgagtctcacttcaccggctgcacgggtgcaccactgcccctcccacctggcttcttttagacgtttgtgcttaagactaagtcaggaggcgggggcgggaaccagacagtgggttcagcatgcactgtggatcaagtaaccaatcctcttccactcagactaaagggctaagaggtgctgaaggttgaggacatccagactcatgaggagccaggtttaaggctggtaggtgaacagttgtcctagtaagaattcaacccaaaatttcaccagcagctactaaacggaatatgatgacaaatcacaaacacacagcagactacagagtaggaacaaacaggcacatggatattcttgtgtctatgtcttcttcagctacttaatacagctgggatgtgtgaatgagggagactgcagtctaccctttcatcagagtaaaccatcagagaggtcagaaactaaggagtgactctagtgtgtcactgcattcagagttcccaaatggaggtccacagaggctgctaaggatgggcaccatctgtccggaaaccccaccatggctggatggcttccccaaaagtgaagaagggggaggcgactggaagcaagcaatgtggtttatttttccttagaaaatggaacaagttagcctgcacatcctgtctgagattcgggaaaggtcccaattgtatggttaaggaaaaaaaagaaaacaacctctgatactgcaattcacagagcagatcgatattgcagcttaaatgggaatttattgccttcagaaatgcagtgaggctatgcactgtgttttagcctgccttccacccaactattctgctgacttcctgtaccctggctgctccagccagctacctcttcaggtaatggagagtgctccattcagagccgcttgtctgctcgggccgggggcacctggctcactccacgtgttgccatagaaactactatttgaacatgcccttcatctatatgggttagcgtacatcccttcttcacccatccctgctccctttactgactgattccctactcccacccccaccaaattctcctattctggctacgcctagaccaacgacccagtaagcatgtactaaagttgatcagatgcactacaagatcaaccccagacctcaggacagggatggggctgtgggtttccattcaggcagctgtctccatttcccggagggatgcatccgcttccacatcctccccagccttccaagacgcacataaaattcgatccctgctttctctttacttttatctctgctgtgtgctctggggagtttttacaaacaaacgaacatgaacttcaaggtatggagagtgtaaatcactgcaaactctcccaagctccaaatgctacaaagctacttagccaaggaccaaagaaaaactcgataggtgattatcttattaaataaacattatcctgcctttgcattgcttcctagttgacagagcattttcaatatattactgccatcgaatccccatgacagcccatacaggaagcagggctagtaccaccatatctccattttggatggaaccattttttaaaatacagacacacacgcacacccccaacggagagagagagagagagagagagagagagagagagagagagagagagagagaaagccaacagcacccagaattaaaaccagctaggattttgtcacatttccattaattatttttacattagtagtacctttcggataaggcaaagaaggatgctttatctacttcaattgcatgcctgctcacccctcgtgctcctaggtaattattttcttcagtttgttttgcaacctgaagtctatttttaatactttcatagacacatttctatctatgataaataaataatattggttccatatgcttttaaagtgtacacaacgtcaggcacggtggctcacgtctgtaatcccgcacttagggaggccgaagtgggcagatcgctcgatcccaggagttcaggaccagcctggcaacgtggagagaccccatctctacaaaaaattagctgggcatggtggcgcacacctgagtcccagctactcaggagactgaggtgggaggatcgcttgagcccgggaagtagaggcgcagtgaaccgtgatagtgccactacaccctagcctgggtgacatagtgaaaccctgtccaaaaattgatgtgctgcatggtattccatcacaggatttgtcaaatcccctacagacagcatttagatggtttgttaatttttcatcattaccaacaatgaggatatgaatgagcgttgcgcatcctcttctacacaggccaaggtattctctggtgtgagaagggtcctgccatttggtttactttgccctgcctactagaagaagtgcacatcccctcataggctcatggttcccagatttccccttctgcaaactgcccaggtaagtcttcgttaagaacaaacatgccatttcagaggtaacaaacacagctttccaagacaaaacaaatcatttcccttgtcctgctctcactgctgactgttcttttcatggctgccagaaggaatatttacttttccctagcatgtgcttagcccaataagagatatgtcattttccagagcatctccaagcatgtaaggctgactattcttgactcagccttcagggctgccacagaagaaccaatcagtgcccagctctaccccacagcacattcacttcggctggattcctgttgccaagccttccaggggaagagaggtgccccctattctttccatactaggttcttcccaacatccattctcaaagggcactccccgctatcccttcaccctcgtctcctggagataatttaaacacaggccacagacagacaggacaccaactgccttcttgctgccctcccgaaactggcagggtttggtggtttatggggagcgcacaggtttggactcatcagctgtgtgactacgggtaagttacttacccgctctggcctcagatatctttcctgttaagatgagggttgttgtaagaattagagaaaatatacagaagcgactgaaaaacatcaggtgctcaattcatggcaaccaacagcaagccaggaggccttgttaaaaatcaatacagcaaacaaggatctgctctgtggagacagagaagttacaagtggtccaaactctttaacagtgagacctgaatggggagacaaaatgaagacacacacaaccaaagttgggatcatctataattgacggatgaattatgcggactggaactgaagtctcatggagaaggcaggatgttaagttgggtctgcccccactcccaggggacatttggcaagtcttagagacattgttagttgtcacaacttagggaccagggtgctactagtatctaatgatagacctcagagatgctggctaacattctataatgcaacaaagagtttgccagtccaaagaccagcagtatcaagctaaaggaaccctgagtagggccacaaagagagaagagcatccaggcaggctggcagcacagggatagcagggagtagaagtgagagttgcattttcctggattataaggacatttatctggcttaagccaaggccaccagctagggcataatgggtggagaagaaagggtaggcaaggtgtgtataggtaaacagtcaggttccctattacatagggttacatgttaccctattactgtgctctctgcacaggcaggactcacagaatcagagaagttaactagaaaacaccatccagaccaagggtcttaaactttctaccaccacaaatcttcatgtccacctacccctcaaaccccccaagcatcacatgttctgacaactgccatcttctaaccagaggcattttccaagtaagatgtgtaagggcagcttggtagcaaaatctgtcacaaaatgcagctattaaatactaattaatatgattcccattttttactaatcataaacaatgtcactgccaaaccaagcctctgacctccatgagataatgggtgttgctatgaagttgagtgagtccagtcaaaggcaaagacatcaggcacttctaattaatactgaaaatagtctagagccacctccaccaatatgtttgtcaagaccttactttgggactctttgatttggtcaactactttattgcacaaaagataaaagagactatcaataaaaactaactgatctattccgcatcatgtgccaggcactgtgctaggcacgacacacattatctcatttaatcctcccaccacccaaggaagtaggtactattagcaatcccatttacttgcctttcagaaatgttaggtcacaaagttaagaaaggtgagagtcaggatttgaacccagatctctctgaatccaggcccatgttcttgcccacaaggcaatagatggttcccttgcagaggacagcctgctggttcactgccagccttggacccaactccctgatcttcaagcactcagggtgatgcacctcaatgcaacagattaaagggcccctgagttacgtatggcccagtaaattccacccttaagagtggtttgacttttaaaaaaactgaacactttcctcttatctcatgttaaaaaataatggcacagctgaactagagacgtctgtgaatacagacaaaacagttacccatcacagaagcaataaatatgtaaatggttacccattcctctgctcactctgccttcatctctgcagcaggaagagcggcagcaacggcgtttttcaagaagtggtttaggattatgtggtggaattacatttatctattcaaaatataaggcttgctaattaggtcataatggtactcatctatcattgaatttggagcatatactgtattgatctacaatgttgtccacgggcacaatgtgcttataataccagcttagctgtgccgagctgttctcatgaaacttcaacctcctggaaaccaattaagtcatccaggctgactgcagatgagtggcatgttgctattacactgtttccattagactgctagacttgaatgcttcaccttcagaatctttcccctggattttgtccagagttccaaattgcagaggatctgctaattctgatgagaggttacagataaaatgaactcatgaattatgtcattagaagttggttgggtaaaaactgaacttgtaggtatgtgaattgagcctacatctgaaaaggtgttcaggcaggcaaaggatattaaatgttctggctaccccagcagtgtcagagatgtcccttatttacatacacaaacagtgacagaatggtcccatcacaaaccatttcctggtcaacctcagttcaggttgctggccagtgacaaatgaggcttagcatgctgagttatgttccatggacctcttcctaatatctatgctgaattctggccctgccagatttgctagttgtagggctttgggtaactgtgttaggctgttcttgcattgctataaagaatacctgagtctgggtaatttataaacaagaggtttaggctgggtgcggtggctcatgctgtaatcccagcactttgggaggctgaggcaggtggatcactcgaggccaggagtttgaacccacttggccaacatggcaaaaccctgcctctactaaaaatacaaaaattagccagcgtggtggcacacacctgtaatcccagctactcaggaggctgaggcacaagaattgcttgactcaggagacaggggtaaccgtgagctaagatcgcgccactgtactccagcctgggtgctaagactctgtctcaaaaaaaaaaaaaagaggattagttggctcacagttctgcaggcttacaagaggcatggtgcaggcatctactcagcttctgggtgggcctcgggaaactttcatcatggcagaaggtgaaggaggagcaggcatgtcacatggtgaaagcagaagcaagtagacagagtctggcgggaggtgccacacacttttaaacaaccatatctcaagagaactcatatcatagagacagcaccaagccatgaaggatccgcccccatgatccaaacacctcccacaggccccacctccagcactggggattacaattcaacgtgagatttgggcagggacaaaaaccaaactgtatcagtaacttactttacttctctgtacactggcctcaattgtgaaatggaaaaacaggatctaccttgtggggttgttgtgaagtctacctaagacagtgtatatgaacatctggtgcacagtgggcactcaggcttttatgcctcaacttaatccttctgagatggccagcatgccccctgcagcacacattcatgaaggccaatcggcatagagcacaggaccagtgtacacagattcatgtgcacagatgaactgggttatatagaaggaatatcttatctgaaggaataatgctagcaggtccttcagagctagagtgttggtagtgttgatccacgaatgtaactccaagaaataattccttggttgggtacttttggaaaatgccaaatactgtactcccacttagggatttattttttcttcttctttttttgagatggagtctcactctgttcctgggctggagtgcagtggtgctatctcggctcactgcaacctctgcctcccgggttcaacgattctcctgcctcagcctcctgagtagctgggattacaggtgtgcaccaccacaccaactaatttttggatttttagtagagacggtgtttcaccatgttggccaggctggtgtgaactcctggcctcaagtgatccgcccgcctcggcttcccaaagtgctggggttacagctgagccaccgtgcccaaccccacttacggatttctaaagcatccaagacttgtagtagtccaaaacaaagaaatctgtttgacttcattttacctggggtttttcatgctttttaaatactgttttgggagatgggtaggtgatgccatgaaggagtttatcattttaaacactcagataatgagaagactcagaatgggaacagaaggcaggaagaaggaaagcaaggtcagaatgttgccacccctcaaggcttaggggccagaaataacaactctccagaatcttcccaaacccagccatggggaaagggcaaaaagccagcaatcaatctttcaagaatcaaaatgcacaaactggaatgcagaggcacgacttttcccagacatttccctggacttctggctttgatcgaaagaccagagacaagccacagcaaaactctgtgcttattaaaccgtgtgtttaaatgtttatacagaaaagttgagaggctgcatctccaggctgagtcaaaagaaggtggaagctagttatcccaagtatccaccaaacatcactcttcttttgctgcacctacaacagtgaggagaggagggaaagagagaggggaaacagggaaaatggagaaaagaagggtgctgagagtgagaactggggacataagagtaaccaggagagaaacctagaggcaggggagctggaagagtcattagtgtttcaccccctttaataccctcatggtaccaggcagatgatacctcctgtccccagagagccggcagcacccaccaccaacttgccaattctgagctattcttcctgcgcagatcaaaagacagacttcccagcaagaggggaggttctcaaaagcaagttaaacatactgcaactgaatgagcccaagagggaatgaatgattccatttctcaatgaggtccgtacagatgcccaatgtggctgcagctaccttcagctgaaaggctgggctcaggcttgcaaaactacactgctgccttctccatgagatgtgaagggggcctacaagagttccctcgaacaaaatgccatatctcatttcccacacaccactgttaagatgatatgtaaaattccctctcaagcttgagagctctggatgaagaaaccacttccttcagacatgcaaatgctgcagacctatggagtgagaatctatgattaagcagcctaagacatgacaggaaaaataagatcaggaaactcgatttttacaggaactgataaaagtgcttattaatatcattagtgcttattaaacctaatgacaacagacactgcatattaaggagactatcagtaacactttacacatcttaaattgcaatcattaggagtgtacaatgcatttcaatgtatccccctgctttctggaagttctccggatctcccttttcagtttccataagatgctgatattatgatttttgccttgtggaggtaacatgcagacaaacaagattttttccccagtgtctggttgcccatccaaatgctgatgtccttctgattttatctccattcctgttatacttgatccaaaattatctgggtgctatgcatgcatgtgtgtgtatgtgtgtgtatacatacatgttatatatatatatactggaaatctgaaagagggaagaaggaacaaagccagatttttctcagctttcagttctttaactagaacagacatttaagaacccacacccaagcagaactggaccattttatccttcgtgtagaaaatgggccgggcgcggtggctcatgcctgtaataccaacactttgggaggctaggcaggcggatcacaaggtcaggagatcaagaccatcctggctaacacggtgaaacccgtttctactaaaaatacaaaaacaaaattagccaggcgtggtggcaggcgcctgtggtccagctactcgggaggctgaggcaggagaatggcgtgaacccaggaggcggagcttgcaggagctgagacacagcctaggtgacagagcaagactccgtctcaaaaaaaaaaaaaaaaagaaaagaaaaagaaaacggacttgggctgggcatggtggctcatgcctgtaatcctagcctttgggaggctgaggcaggaggactgcttcagcccaggagtttgagaccaacctggaaacagagcaagaccttgtctcagttttttccaaaagaaaagaaaagaaaagaaaagaaaaaaaagaaaagaaaggaaaagaaaatggactcaggctgggcatgatggctgacacctgtatcccagcattctgggaggctgagacaggaggactgcttgagcccaggagttcgagaccacctggacaacatagcaaggccccatctcaactaaaaaaaagaaaaaagaaaatggacaatggacttggccttcttaggccataaggaagatgaatcatcactgcaggagatgccagaaatgcaaaaggagagctaagtaagtttaagtttccagataaaaggtaaacaaaggtaaaattaatgagcacataccatgggccaaacactagacaagaggctgttttaatcagtatctctttatcctctcaaaataaaaaccccaaaacactataaaactcattctattatccccaaaggggggaactgaggctggggagaggaagtcacttgcccagggtcacgtggctgggaagcacagagctgaggaccaaactcaaacctgctgactaacgtggtgctcttccctctgtataacggccccgcatgagtacgttacttatgagtgcgttaaaacaagccaaaaaccccacatggcttaaaccgctgcattcacttgacaagcactatgtaaggtcctctcctatcgggacttaaggcgctcaaaagtgatgtatggataggaagaaaaaacgcaacatcacctgaaacccaattaaaaatccatgtgcttctgagtcctgaacaatttctctatcacaaaatatttacttggctttgtgacctttgacaaaccacccaacctttgtgtgccccagttttctcatctataaatggggaaataatgacacctactccttctgggttgttgtgtgatttaacaaattttaatataaagcactaagaacagtgttgggcacacagtcaacactgtgtaagtttagccacgtgcattattgctcttattagataatcacacatcattgaagcatgtgtacacacacacacgtcacacgttttctttttctcttctctcacacaaaaacgggttattgagacacattttcaacaagagacagtggacttggcaaaggagcctcttaatgcagcctcctttattttccgtttccgctctcctttataaataggtttggcaaactgatgcttaatagcttaatatcgggtcatattaatctcaccctgtctgaacttcaaagggacacactgttctgactgctaatgaatgaattttagttgtaagtttccaagggatcagagctggaaaaaaaaaaaaatcccagctatttaaaaagacaaacatctccttggtgctcttttaaagctatttgggttttacagagcatcgccccaagcaggggaaatccaacagccttagcctggccagcacaaggtcccacagagctagatggcactagaacatgctcgaaacaaagaccacccagcacctaagctcctctggcctttgcccagcccaccccaggccccaggtgggttcaatgaggcaagatgtgtgatataactatacaaactggaataaaccatgcaaatgttagaaactataaataggagtcaaggaacaatattacatgcttggacaaaatacacccaggtattcttttctggatttcaaaaggcaatcatcacaataattcagtacttaatgctactgagccatacacttaaaaatggctaagaagtaggttttctgttatgtatatttcaccataatttttttaaaaggcaaagcatccccataataggaatagtatagtgttttcattcctaagaaataaatacaataatgtagtcagttccatctcttactctggtataatgtattctagccccaaagcaacaaaaaagtagttatttacaaactggctcgttccaggacactgccaggcagctcatacctctgttcatttcgaaaactcactttatataaataccaacctccctatccttgagaaggctccgaagcaggttattccatagagagaaagctcttatgccccaaaccagctttgagatgcgtctgctgctgcctgggcctcaccatctccaattcatttgcgtggaaaggcaagacagctcgtttaagcacagatactggtggtggggtgagagctgggagaacagggaaagcctctcaaggcatgagc

SEQ ID NO: 5087 - DNA, 30914 bp, Homo sapiens
  misc_feature (5714)..(5782): n is a, c, g, or t
  misc_feature (6596)..(6614): n is a, c, g, or t
  misc_feature (10586)..(10605): n is a, c, g, or t
  misc_feature (21019)..(21173): n is a, c, g, or t
  misc_feature (22821)..(22839): n is a, c, g, or t
  misc_feature (25219)..(25462): n is a, c, g, or t
  misc_feature (29169)..(29496): n is a, c, g, or t
atgtggtggctcatacctgtaatcccaatactttgggaggctgagacaggaggatcactgagtcctggagttcgagaccagcctaggcaacatagaccacatctctaaaaaaaaaagcttgaaaattagccagtcatagtggctcaggcctatagtcccagctacttgggaagctgagggtgtggacggcttgagcccggggagtcaaagccgcagggagcttggatcacaccacttactcctgcctgggcaacagagcaagaccctgtctcaaaaaaaataaaaaataaggccggcacggtggctcacgcctgtaatcccagcactttgggagactgaggtgggtggatcattgaggtcaagagttcaagatcagcctggccaacacggtgaaaccccgtttcttctacaaaacaaaaattaactgggcatggtggcaggcgcctgtaatcccagctacttgggagtttgagcaggagaattgcttggacctgggaggcagagattgcagtgagccaagatcatgccactcactccagcctgggcaacagggtgagactccatctccaaaataataataataataacaatgaaaaataaattatgagttcacaccaatattttccactcaaattcaggactgcagaggtctggggtttgtatgtctgttttaatcagttttattaagatacaatttacatacaataatttacctcttttaaatgtacaaattgatgagtattgacaaatgtataaccatctccacaaggcaatgtagaaaattttcatcaccccttaaagtccttttacacttttttttgagactcctcagtagtaaccactgctaaatttatcagagaactgcacacctggattgtattttgaagaacttccttccaacccaattgcttttaataatttttttatgataaatttttacccaaatgttatagaatttatttacaaagaaatttcgtaagttgtatttctcctactggtgtggattatgctaaggaaacaggtctggagtcatgaaatccttaggtgtctaatttttctaactgtaagtttctgtgctactgcagatctcagttactgtctctggtggtgggtgtgtgctgggaagagtcagaggtaaggcactagtccatttccttccaggacagttgagaaagaaggaatgaactccagtcatcacaaatccactgttgatgattcctctggccaggtctcccctttaatccttagggagaagcaacactgagaaaagataacttcttcttttttttttttttttggacggagccttcctctgtcgcccaggctggagtgcagtggcgcgatctgggctcactgcagctccgcctcccgggttcacacaattcttctgcctcagcctcccgagtagctgggactcaggtgcccgccacctcgcccggccaatgtttttgaattttttagtagagacggggtttatcgtgttagccaggatggtcttgatctcctgaccttgtgatccacccgcctcggcctccaaagtgctgggattacaggcgtgagccaccacgcccggccaaaagacaacttctttagtgtaatcccccatccctgagagtagaagaggcagaaggccaaaaagtcgaccacacatgttgcagctcctcatcccagcaagatttctgtgctgccctggtgttaccctgcagatgccccttttcccagttttctactggattattggtctttctcttaatgatttgtaaaagctcaaatattatgaaacttcatacaatatctgagacctgggctcaaaatacagtcatgcttcactaacagtggaggtcactgtttgaacagcatagagtgtactcacacaaacctagatggctagcctgctacacgcctagggtgtgtgggatagtctattcttcctagggataaacctgtcagcatgctactgaacactaggcaattgtagcacaatggtaagtatttgtgtatctaaagtgtctaaacatagaaaaggtacagtaaaaacacggtattatagttttttgggaccccatttatatttggtccatgaatgactgaaatgttattatgcaacacatcatggtgttttctcctagttattcttttttttttttttttttttttttttttttttgaaatggagtcttgcttgtcgcccaggctggaatgcagtggcgcgatcttggctcactgcaacctccacctcccagttcaagcaattctcatgcctcagcctccccagtagcagggactacaggtatgtgccacacaccaactaatttttgtatttttagtagagacggggtttcaccgtgttggacaggctgtctcaaactcccaacctcaggtgatccacctgccccatgggattacagacgtgagccacgcgcccggcccctagttattctttggatttagtttatgatttctaaatgtaatttttaatgtttcatctaattaaatgatttatctaattaaatttaacaatcctttatgttttctggttgtgagtcatacctataaaagtcctccccacttcaagattatttttaaatcccctgcaattcttctagctcttctgtgactacatctatcagaattaattttgttgtaaagaatgagtaggagtccaacttttttaatgtgattctcaagtttttacaatatgttgaataatccatttttccccattgatttaagatgccatatttatcctatactaagttcctgtacatatttaaactacatctggactttccgttccattgttctacttgttcaatcacatacaaatatgttgtagagacagggtttcgccaagttgcccaggctagtcttgaactcctgggctcaagcaaccttctgccttggcctcccagggtattgggattataggcgtgagccaccacacccaccctattgttgccattgttctagttgctgtgatagaggaaatgttgggaggtggtgtatctgcacctctgtgtcctgtgtcatatccctgggccttccctctgacccagcagcatctgaggtctactcactttgcactgatagtgtcttgcttcaattgcacaatacacatgttcacttttgtcctggggtgtttgcagtgcctggggtgagacactgaggtaagcctgcttggaataccacatgctagtctagaagtgggggaggtgtcgctttctggggtgatcctcaaccagtgacgttggacaccagtggataaatgcctctcactatcaatcctcaagtggacaatactgagagaggctcttgggctcttcagaagattccagtgggctcatgtccagctgcccaccacaggctcaactcagcaaaacaccctggtactggtttttcccatggcgcattgggcctgcttctagggccacctcctacataaatgatgtgcatagaaggccttatttcaggctctgctttcggtctggtccaggataaaacaagcgaccagaagtccctagaaagcagcctcagggaacaaattaccccctagggatggatggcaacaaggactcccttgctggtgataggtaggcagtagaacccttagaacgccacagctccacaattcctaagaccttcccctgccatgtggaataggtttagaaagaaatgaggcactagtggacgccagcattccagcacttgaaaggtttgggcaatgctaattatgtggattgtgaagttaattggcttctcttagctgccttagaagattgcaaggagaaaatgagaggctacggttcagggcaagctgtgaaaccctgatgacaggtttaagccactctcatttatcacagccagctggaaggctgtgctgaaagccaattccagatctgatcgaaagggtgggccaaccatggaggagatggagtgagcacatctagcagttcgctctgctaacttctgacactgacagggacggggtaggccttgggatgtggacatttgaaataagaaactcccaatgcccgcgagcgctcttgagaaggagaacagcccctcttattaaagacctcacatgaggcaggcgcttcacaatattttttaaattattgtggtaagttataataacataaaattttttaccattttaaccaattttaggtgtgtaattcaatggtattaaaacattcattcatattgccgggcgcaatagctcatgcctgtaatcccagcactttgggagccaaggcaggccaatcatttgaggtcaggagtttgagaccagcctggccaacatggtgaacctcatctttactaaaaatacaaaaattagctgggcatggtggtgggtgcctgtaatccagctacttgggaggctgaggcacaagaatcgcttgaacccgggaggcagaggttgcatgagccgaaatcgtgcccctgcactccagcctgggcaacagagagagactctgtctcaaaaacaacaacaacaaaactcatattattgtgcaaccatcaccaccttccatcttttttcagaacttttttgtctttccaaactgaaacgctgtatctgttagccagtcactcctcgtttcccctgcccccatcccccaggaaccaccattctatttgcttcactacattttgcttgtttctttaagatccatccttgtctcccctatagcttaataaccagggtcgggtctcagtaagcctgacagggtaaaggcagttcctgatgtgagtggcaattgctgagccacacaaagatgcagcatctgcggacgcactcttccaggagccagaggagcccacagcagcgtgggtctagcgtgctgaggtggtgagcgtggatataagactagatcaggaaatggagggccaggcgggtggctcacgcctgtaatcccagcactttgggagtccgaggtgggcggatcacttgagtcaggagttgaagaccagcctggccaacatggcaaaaccctgtctctactacaaaatacaaaattagccgggcatggtggcacacgcctataatgccagctacttgagaggctgaggcggagaatcgctttaatccgggaggcggaggttgcagtgagccaaggtcgtaccatggcatccaacctgggcgacagagccagactccgtctccaaaacaaaggaaatggaggtttagttcatgtcaaggacacctggaactggccctaaacatgcatgatgggtctccttgaagcttgatcccacaggactctacagctgagtggtccaatacaggatccacagcaaaccagaggcatgctacattctgagggaaatagggtagttgtacttgttaaaatgataggattttggattgctgggttaaataaaatatattattccaattcatttcacctgtttctcttcttttctcctttccttccttccttccttttcctttttcttttcttttcttcttttctcttttcttttttaacacagggtctcacctcctggttgcccaggctggagtgctgtggtgcgatcttggccactgcaacctctgcctcccagatttaagcgattctcgtgcctcagcctcctaagtagaggaattacaagtgcccgccactgtgcccagctaatttttttgatttttagtacagacgggtttcaccatgttggccaagctggtcttgaactcctgacctgaagtgatnnnnnnnnnnnnnnnnnnnnnnnnnnnnnnnnnnnnnnnnnnnnnnnnnnnnnnnnnnnnnnnnnnnnnaagtgcccatgtggctgacattatatttctattgggacagtgctgaccagtggaaaagacatggagatgccagacaggtgtgagcagaatattgaagagtcagaaggctcagagaaggtgcatgttcggatgaatttattcttggagaccctttatttactaaagcgattcagggccggcacggtggctcaggcttgtagttccagcactttgggaggccgaggcaggcagatcattgaggtcaggagttcaagaccagcctggccaccatagtgaaaccccatctctactaaaatacaaaaattagctgggcgtggtagcgggcacctgtaatcccagctactcgggaggtcgggcatgagaatcgcttgaactgggaagatggagattgaagtgagccaagatcgcgctacgaactccagcctgggcaacagagtgagactccatctcaaaaaaaaaaagagagagacaaagagaatataaaaggccacgtgaagacagaggcagaagttgaagggaggcaaccacaagaatgtctggagccccagaagctggaagaggcaaggagggtcctccccacaacttttggaggagcatggctctacagaaatggttgctctaagccaccaacttgtggtcatttgtggcacagccctaggggactaaaacattctccctcccccacaactcaactctgtgggctctctcctggcagcacatcaaggcacacctttggcattagctaaatctggagggctagctaaatctgaacatcaatgaatatcaatatcttttttttttttttttttttttnnnnnnnnnnnnnnnnnnnatgaagtcttgctcttgtcgcccaggctgtagtgcagtggcacgatcttggctactgcaacctctgcctcccgggctcaagtgattctcctgcctcagcctcccgagtagctggactacacacacacaccaccacacctggctaatttttgtatttttagtagagatggggttttgccatgttggccaggctggtctcgaactcctgacctcaagtaatccacctgcctcgcctcaagtttgctttttgttcatggaaatcagcttcataaaaagcatcttaccctgagtgtagtttgtttctgtaaatttcagaagttgagttcagaatagacatatccagatttatagaatcacaggcttctgaaatataaaagggaaaataatttacttaggatatgtgaccagaaggctgtttttaaaaatcctatttctagtagctgggtggcctgacagaaccaggtattactaattttttcctggactgtgttaaataatttattcttgaaaatgttagctgggcatatgcctcatgcctgtaatcccaacactttgggaggccgaggcaggaagattggttgagccaggagttcaagaccagcttgggcaatatagcaagatacttgtctctatccaaaaaaaaaaaaaaattagtcagacatggtggtgcacacctgtagtcccagctactcaggaggctaagtgggacgactgcttcagcccaagaggtagagggtgcagtgagctgagattgtgccactgactctagcctgggcaacagagtgagagtctcaaaaaaaaggagaaaggcaggaaagaaaaaaagaaagagaaaaagaaagagagagagagagaaagaaaagaaagaaagaagaaagaagaaagaaagaaagagaaagaaagaaaaagaaaaaataaagagagacagaaagagaaagaagaaagagagagagggagggagggagagagggaaggaaggaaggaaggaaatgtttgagagtgatcctgtatcctcctctctgggttttttttctatgacattcccccaccacatcttccctcttcctcaccctccatctcctgatgagatttttttaggagctggggtgctggttgcattggttccttgcagtgtgcctgcattgctcccatccaccccattaacgggctcctgagcccctgaatataatgacatcagagggaccacctgtctcatttcaccagtacctcttatccaacctgtggctcaccttgctctcttggtgccacctcctggaacacgggggtggcatatgtagctcctgggagtgtttggcctctgggcaaaagataaggaataggaattattgggcaattatgtgaatttctaagcgcatgagggcagtggaatagactctgcagaacatgctcacatcttgggctgtggaaacacacggcctggatcccacttctggcacagattcctcctcttaaaatgagaatgacataaattgggggttggtggcgtttgtgttagaaaaggtcggtaattgctcagcaatgcgtctggaatgtggccatgtaggctgggactgttccattgtcagctatgatagggtttgactgtgtcctcacccaaatcacatcttgaattgtagtccccataatcccacatctcatgggagggaccaggtggagataattaaatcatgggggtggtttctgtctactcttctagtgacagtgagttagttctcacaagatctgatggttttataaggggtttccccttcccttggctctcattcttctctctcctaccgccttgggaagaaggatgtgtttcttccccttccaccatgattgtaagtctcccgaggcctcccaagccctgcggaactgtggtcaattaaacctctttcctttataaactaccccatctcaggtatgtccttatagtagctgagaatggactaatacatcagccgaggcgctgggtcttgtttactgcaaagcaatatgaatgcctgctttgagaggtgaccgtgaaagactgtgaaacacagtgtggatcattctgacagatgtgaaaaatctccaagatacgttgttacatgaaaaaaaaacaaaatcatggtgtgaaagtcatacctacaatatgctacaatcactaccatttgtttattatacacacagaattctgtggaaggatttaaaaaactggttattacccctagaaagtgggactgggcatcaatgacattgaactctatcccttttgctccaccccccactcccgtatgtctgtacaaccttacaaaataaaaagacaaaaacctgaaaccacccaaaacacgcaacaaagttctcttacttcttgtttttcaaggatatttgcatagattccaacttccatggctgtgtctccacggtcctgggcacattatttctcatagcttttcctacgtaaataggtaggaatcatcaaattaaacaattcagccacatttttctcatctcctcggccaaggagcagaattccctcaaagttctaaacagagagtgacttgctccaatggcccaaactgttgtctaacaaaggaaaactatagctcaacagggagtctagacaccgctcctccaagccaggggctgttctgatttattttccggccttcagaggaacatgctttgcctatcagattatgcctgaactagccagacttatttctttccttcgctgaagagaatagtctgtggaagctttgtaatatcttcaagagagtgtaatggcctattgaattctttttttttaagatggagtctcgctctgtcgcctgggctggaggcagtggcactatcgtgatctcggctcaccgcaacctccgcatcctggtttcaagcgatttcctgcctcagcctcccgagtagctgggattacagttgtgcaccaccatgcccagctatttttgtatttttttgagacggagtcttgctctgttgcccaggctggagtgccatggtgaatctccgctcaccgcaacctccgcatcctggtttcaagcgattctcctgcctcagcctctgaatagctgggattacaggcatgtgccacaatgcctggctaattttttgtatttttatagaggcggggcttcaccatgttagccaggctggtctcaaactccagacttcaggtgataaagtgctgggactacaggcatgagccactgtgcccggccagcctcactgaattctatttagctccagccagtaatcaaaaatattaatgccacttttgcaagaacctggactttttaaagaaggagaaacatgtttttaagacatatgagatgtgggccagggtgcagtggctcaccctgtaatcccagtgctttgggaagctgaggtgggaggatcacttgaagccaggaattcagaccaccctggggaacatagtgagaccttgtctctaaaaagaattttgtaattaaaaaaaaacaaaaaactgtaatcccagcactttgggaggctgaggcaggaggatggtttgagtcaggagttcaagactagcctgggaaacatggtgaaacctacaaaaaaaaaaaaaattagcaggcatggtggtgcgcgcctgtggtcccaactactcaggtagctgaggcaggaggaggctgggaggtcaaggctgcagtgagccatgattgcaccaccgcactccagccttgggtgaggaagtgagatcctgtctcaaaaaaaaaaaaaaaaaaaaaaatgtcaggcgcggtggctaccagccccagcactttgggaggccgcggtgggcggatcacgaggtcagaagttcaagacagcctggccaacatagtgaaaccccatctctactaaaaatacaaaaattagcctagcgggtggtgggcgcctgtaatcccagctactcaggatgctgaggcaggagaaacgcttgaactgggaggcaaaggttgcagtgagnnnnnnnnnnnnnnnnnnnnaaaaaaaaaaaaaaaaaaaaaaattagccaggagttgtggtgcatacctgtattcccagctactagggaggctaggtgggaggttacagtgagctatggtggcaccactgcactccagcctgggcaacacagtaagccccatctctaaaaaaaagaaatgaaataaaataaaatcttaaagatgcatcagattataacttgtgacctctgtgttcaagttttatgtcaactgagtccctgacttctctgagtgtgactctctggagatggttctcaattggttctcttgccagttctgacaatatctccaggcccattccacaactcagaacactgaggctcagaagcaacagcctgaggggcttgtccacagccctcagcttgctgatgggggccagtgctgagacccaaactgtcttttgtgtaaacttcatatccttctgcactcgtgtaccaaatgaaaaaaccactttgaaggcttaaccagggtggccataagacgtgaggaatgaaaagcagtaactgggctgagtgcagtggctcatgctgtaatcccagcactttgggaggctgaggtgggaggatcgcctgagtccaggagttcagaccagcctaggcaacacagtgagaccccgtctctaaaaaacatttttttaaaaaagcttaactgaggcttctaataacattgacaagttttctgctggatgtagcacttaaggtgggaagagagaaatgatgcttttttgtttctgtttttgtttttttgagtctggtgtgtttaaaaagttttttaaaaaatcttatagtagaatagattatacttctacattgaaaatctagaagcatagaaatgtagaaataaaaaatatgtatatattaggttggtgcaaaagtaactgtggccgggcgtaatggctcacatctgtaatcccagcactttgggaggctgaggcgagcagtcacctgaggtcaggagttcaagaccaacctgaccaacatggtgaaaccctgtctttacaaaaatacatggtggtgggtgcctgtaatcccagctactcaggaggctgaggcaggagatcgcttgaaccagggagacagaggctgctgtgagccgagattgcaccactgcactccagctgggcaacagagcgagactccatttcaaaaaaaaaaaaaaagtaattgtgggttttgcataaaagtatggcaaaaattgcaattacttatgcaccaacctaatattttcaatacttcagccccaaacaattgtaaaccttttgaaggtgtcttttgtgctaatgggatgacgcttgttgtcctcatgcactgaacctcccctacgtatgtggcagatctagagtcactcaaggcaagctctcgcttgaggcacttgcagtcaggagcagccgcaccacttgcagcgcccagtgcaaatgaacactgttcacaggccttaaacttgtgtttaattaagaacacaagttcttggccggcacagtggctcacgcctataatcccaacactgtgggaggccgaggtgggaggattgttgagcccaagtgttcgagaccagcctgggcaacatagtgaggccccgtctccatttaaatagaataaaaaaagaagagagagagagagaaaaaaaggaacacaagttcttaaagtcagaccgagtacatctttcacaagcagtcatacgaggaaaagggcctcttgtttaaaaacataataatttcacacccacgttcctagcattattaaacaatagacaaaaggtggaagcaaccgggtacccatgggggataaatggataaacaaagtgtggcgtatttatgtacaatgggcattcttcagtcttatcaaggaaggaaattctgacacatatgacaacatggatgaacctgaggacattaatcgaagtgaaataagccagttatgaaaggataaatgcttccacttccagaggtgcctagaggagtcaaactaatggagatagaaagcagaatggtggttggcagagccgggggaagaggggatggggagctagtgtgtaatggggacagagtttcagtttgggaagtgaaaaagttctggacatggatggtggagaagggtgcatgacaatgggaacgtgcttaagccaccgaactatgcatttaagcaggttaaagtggcccatttagtgttatgtatattttccaccattaacaatttttaaaagagcgtacaaaaaattatgaagaatttcaagatgcagcgggagcagtggctcacacctgtaatcccagcactttgggaaactgaggcaggtggatccctgaggctgggagttcgggaccagcctggccaacatggtgaaaccctgtctctactaaaatacaaaaaattagctgggtatggtggcggaaacctgtaatcccagcttcttgggaggtgaggcaggagaattgcttgaacccaggaggcggaagctgcagtgagccgagatcgtacactgcactccagcctggggaacaagagcaaaactctgtctcaaaaataaataaataaataataaacaaataccaaatgtggagttcttcttggcacagggccctgtgtgacagcacagctgtacgtctgtgaagccagctctgcttgccctcaaacagaaaaggctttccctggagaagaattaccctctgcatgaaccgttcaggaagtctattccattcccgcccccctttctctgttttcctcctattttcattttctccctattctatttccaatccccttttctctttctctcaccctctgtcctgctgtctgtatcccaagcccacgggaaaacgggtggtaaagcgataaaagaacttacttgttttgtatttgggcagtacccaaaaagccagaattaggattataccaccagcaacagtaataaccctggaagtagtagcttcagacagaaaggacagctgtcccgcctggaagaagaccgcatccattggtgaccatagcattttcttttccaatgacattagccagtaagtgttttagaaaaggtgatgtctcccaagttaaccaatgtactatgcaccaggttcccaaatggtcatgacatctaaaactcacgggacttattagtcaataaagttctgactgggcgtggtggctcacacctgtaatcccagcactttcggagatcaaggtgggaggttgcctgaggccaggagtttgagaccggcctgggcaacatagtgaggccctgtttctacaaataaataaataaataaaaattagccaggtgtgatggcatgtgcctatgatcccagctctcaggaggctgaggcagggtgatcgcttgagcccgggaggtggagactgcagtgagcttgattgtgccactgcactccagcctgagggacagaaccagaccctgtctctataaataattaataaataaacaaaaataggttgagctcagtggcttacacctgtaatcctagcactcgggaggccaaggcaggtagatcacctgaggtcaggagtttgagaccagcctggccaacaggtgaaaccctgtctctacccaaaatataaaaattagctgggcctggtggcgcgtgccttatttccagctacttgggaggctgaggcatgagaatcgcttgaacccaggaggcggaggtgcaatgagccgagatcgtgccattgcactccagactgggtgagtgagactccatctcaataaataaataaataaataaataaataaataaataaataaataaaataaaataaaaaaaaataataaagtttaaaaagtcatgaccaagcacatcttccacaggggccacccaaagaaagaaaagcagcacagaatttaacaggacgaataccagcaacatttctggggtcatgagcccagaaaagcctgggtgtttactgggcaaggccctgagccctggcagcatgtttcgtgtatccaaacaactgccagttgttgagttttagctgcaggccagacactgtgttaggcactcacctgtgttgccttatttatcccattggcatcactcccattttatagatgaggtgagtaggctcagggaggtgaaatgactttcctaaggtcacacagccagtgaatggaagggctggactcatagccaagtgcctgactccagcaggctgcctcacttgttagaccacactcactaataccagggcgtgggctctgttctgaggacctggctgggtgaagtggtcaatgtccaatgtgccttgtgcctttgctaacctagtttttcttttctttctttttctttttctttttttttgagacagggtctcgctctgttacgcaggctggaatgcagggcacgatgatcacagccactgcagcctcgacctctcaggctcaagcaatcctcctacctcatcctctgagtagctagaccacaggcatgcaccaccacacccggctaatttttttattttctgtagagacagggttttgccatgttacccaggctggtctcaaactcctgggctcaagtgatctgccagccacaccttccaaaatgctggaattacaggtgtgagccactgcacacgacctagttttccttcatcctcctaccttgacaaatgcaccttcagaaggacctggaaggtcaggtttgaatctgaattctcagactttccagagtttggcatcaggacgtggcagcatggacagaacccactgagtcccgggctgccccgctcccgacctgggctctgacctgcaccctaaggggccttgcagcacgtggacgccccagcccacatgtgcaaacaccatccacaccccccataaacagctccttggctcaggttcagggatgctcatacccttactgtgggccaccctcgggaggatgagtgggggagagactggtacaggccctggaaatggcttctgatctgattgggcaggggatttggtccaggtacctagagtgtggagcagaaaagtgggagtatagggttcaggtggctgctccccacggctccctgaacccctcagcctaggggaaggtgcatagcctggaggtaccagccagagcccactaaacacagggcttggccagaggcctctcttgccctgagccaagggtgtgcaggagtctggacccatcatcattagcagtggagcaataaacagccaagcaggagggatggtattagaaatcagtacaagatggccaggcacagtggctcacagctgttatcccagattttgggaggccgaggtgggcagatcgcttggggccaggagttcgagaccagtctggcaacatggtgaaaacccgtctctactgaaaatacaaaaattagccaagcgtggtggcggggcctgtagtcccagctactcaggaggctgaggcacaagaatctctagaacctgggaggcaaggttgcaatgagctgagatcacaccactgcactccagcctgggcaacagagtgacacctgaaaaaaagaaaagaaaagaaagaaggaaggaaggaaggaaagaaggaaggaaggaagagggaaggaaggaaggaagggaaagaaaggcaggcatacaagaaggaaggaaggaaggaggaaaagaaagaaaggcagacatacaaatgatgaaaaaacaaagaaaactaaaagaccggcagttctaagacagatgcaaattggaaaggcagggcagaaagttttgccacaagtcccctcctgctccagtttctaggcctttctgtggttcctttatggcagaaagcaaccccatagagtttgcatggactctaccaaagagacccttcaagtgatctgccagccacaaccttcaaagtgctgggattacaggtgtgagccactgcacacgacctagttttccttctatcctttaccttgacaaatgcaccttcagaaggacctggaaggtcaggtggccatggtgggaaatggtgggcagaggagcagctgcagtttctggaagtgagttcagacctggctgaaagaactaggttgctcttacctgttgagggcatggtgacagggtgactgtatgttgcatagttaggaatctgtttttagcttcacacctatactcttcctcttctccaggattcttcttggttaattaaattcagcaggctccctgtcatacttggaaatagctggtgatatggcaacatggtttcaaagaaagtgtaattgatgggcagcgagccattgactgagaggcaatgtaatgttattgtcggtctgtttctgtttgaatgaccataatgttcagcactggggaagtcaccgggtcggaagaatgaaagtgaacatgaaaaggataaacagactgggtgtgctcactcagaccacaatatgagtggaacccttactccactccaggctgtggaaccaagatgaacgacccccttctgagaagtcaagaagttcacggcccactgggaaaggccaatgggcatgtggccaacccgtgcagtgtgttgttagccgaggttctcagctgagtgctgagaaagccagagagtggaggcatctctctgctttgaggaattggggtgcaagcttgcccttcctagaattcacaatcttttattgttaataatgaatataattttgtcaatgatccagttctaagtatgaagctgagagtgcttttttatgtttattttttatagacatagggccttaccatgttggccaggttggcttgaactcctggcctcaagtgatcctcccaccttgaattcccaaagtgctgtggttacggcaggagccaccacacccggcccaagaagtgcttttattctcaatccttgtaaatttaagtgggtttttttaatccaaaaatatcattttcttttcaatgtatttatttattcagagcagggttttgctctttcaaccatgctggagtgaagtggcacaattatagctcactgtaactcaaactcccaggctcaagtgatcctcctgcctcagcctctgtagctgggactacagggcacactgctggctaatttttaaatgttttgtagagacagagtctcactatgttgcccggctggtctcaaactcttggcttcaagtgattttcccacctcagcctcccaaagtgccggatttcaggtgtgagccaccatgcccagccccaaaaatatcgttttctccaactgtactttatttatagaactcagctgcacaattatctttcacttcctccaaagagcaggaagtaacctgctaactagattcaagagaaattctcaacaggaaatgggtctgctacactctgttagtcatagcctattctatgacctaacagaaaaacccagctatacattttattatatatataataatgcattaataagacagtattataggaaaggaagaaaagctgttaagtatctatcagtgccaggcgtgccagtcacatgatctcatttgaccttcacgacagtcttgtagtgtggtagtatcatgcccattccacagatgaaccaactgtgcttcagagagattgagaaatttgccaaggtcacacagctagtaaatggccgagttgggactgacttcaagagtccacacttaaaacaattttttttttatttactttcttttctgttttgagacggagtctcactctgtcaccaacctggagtgcagtgccacgatctcagctcattgcaacctctacctcccaggttcagcaattctcctgcctcagcctcccaagtagctggggattacaggtgcccaccaccatgctagctaatttttgtatttttagtacagacagggtttcaccatgttggccagactggtctgaactactgacctcaagtgatctgcccccactcaacctcccaaagtgctgggattacagcgtgagccactgcagccggccctgtgttctctttaaacatttgatgagtgagcactttggaggccgaggtgggcagatcacgaggtcaggagattgagaccatcctggctaacatggtaaaccccgtctctactaaaaatacaaaaaaaaaaaaaattagccaggcgtggtggcagggcctgtagtcccacctactcgggaggctgaggcaggagaattgtgtgaacccgggaggcgagcttgcagtgagccgagatggtgccactgcactccagctgagtgacagagcaagatcatctcaaaaaaaaaatttttttttgatgagtgaatcagtgattaatgaatttgtgtttaggctcatagtttcaacccttactgggttggagacaacactatgttttaggcctcattaaaacccagtagtacaattgcttgcatggagtaggtactccgtagtgcctattgatctggctaactgaagatgatacagttttataatctaccaagatagttttattaccagactgtgtattaccctaacaaattgcaggaaggtcgtgcacaaaaaacatatgaactgatgggcttatgctgagtgcagcaggagtctgaccactagagaataccatcagctgtgttcctgccctcaatatccatcgtattccagtaccatgtttgcagggattttccccctccttcttccttttctttcacaaggaatatactcagtttatgtccaaagatcattgggattttttttttcttgaacagggtctctctctgtcacccaggctgcagtgcagtggtgcaatcacagctcactgcaccttgaactcctgggctgaggcaatcctcccaactcagcctcctgagtagttggcactaaggcacgccaccacgctcagctacatatatatattttttaactttttgtagacacacagctccacatagttcccaggctggtctcaaactcctgggctcaggtgatcctcccgcctcacctcacaaagtgctgggattacacctgtgagacagcgcacctggccaagataattggtttaacctggagtccgtagcattctctaaaaccttatgcagaaatttgtatacgtagtttttgagcatttctctggagaagatattcattgctatcattggattattaagacagttataactaaaaagctaagaatcactgagctacagcaatgtcacccagtagaactttctgtgatgtgggaatggtctacatctgtgttgtccaatgtggcagccaccagctacaggtgtggctacaaagccttgaaatgtaactgagactgtggagggaaattttttatttcatctaattttattgacttgattttaattatggcacgtgcttgtaatccaagctattcaggatgctgaggtggaggatctcttaagaacaggagtttgaggctgcaatgggctttgattgcctgtgagtacctctgcactccagcctgggtgacataggctattaaataaataaatgttggccaggagcgtggcacatgcctgtaatcccagcactttgggaggctgaggtgggtggatcacctgaggcaggagttaagaccagcctggtcaacatggtgaaaccccatctctattaaaaatacaaaattagctgggcatggtggtgcatgcctgtaatcctagctactcgggaggctgaggtggggaattgcttgaactcgaaaggcggaggttgaagtgagctgagatcgcaccactgcactcagcctgggtgacagggcgagactccatctcaaaaaaagaaaaaaagaaataaaataaaaaaaataaacaaataagtttaaacagtaccgtactggatagcatagacatagaggaccaccaagagttatcaggaagtcagggtccctacgctttgaagactccaggtataacatacattgttacctagaagccttctctcctcccacaggagtccattatcaaggtcaccttcacggtgaggcccttaatgctaggcagtaacaggcttggggtaggaaaatgggacagaaaaacaagaagtagtgagatgtggctaggcaggaagagtgctagcggatggggcccctgacactaggaagcggtgggaaaggcgtgaggctttgaagaccctctccaaggggcccaaggcttcaaaaaaaaaaaaaaaaaaaaaagcgatttttgcccacacaatgggaatcacagaataaagttctagaaaagacctccacaattattgttgagatataagacttttgcctaaagatataaactattatctgacatggtcgaaagtctttgaaagagaaggtgaaacggaatgattaagatagagaactcactgggcatggtggcttacatctgtaatcccagcattttgggaggctgagcaggcggatcacctgaggtcaggagttcgagaccagcctgaccaacatggtgaaacctgtctcaagtaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattaaagatacttcctgttgaccaggtctaaaaataaataaaaaataaaaaaagaataaagctgcagtaacatactttccaggttcttaagtgttcacaaggatcatggagagcccctcataaaccagaaagcaccctataaattataggggctccaaggaacaggcactctacttaccgaaatcgtgaagctgaagtcacgactgtattttgaacagctggtaacttgggctttgcattgtaggggcctgattcatgggcttctgtgatgcttaggttaaaaatcgcaggttcacctttccatcctgggttcccaggtgtgtcttacgtcgaaacaatgaataggtgatctgcagtgtttgttcttatgggaacaaaacatagatacattttgacccttcataaccaccttagtcttgagtccaaacatggagaagggaattctgaaaaacaaaatgacacaagaaaaagtccttttaagatcctggccgggcaaggtggttcacgcctgtaatcccagcactttgggcggccgggcaggtggatcacttgaggccatgagtttgataccagtctgggcaacatggcaaaacctgtctctactaaaaatacaaaaattagctggcatggtggtgggcacctgtaatcccagcactcaggaggctgaggcaggagaattgcttgaactagggaggcggaggttgcagtgagcaagatcatgccactgcactccaggctgggtgacagagtgagactacctcaaaaaataaaataataataaataaaaagttcttgaagttgggtgtggtggttgacgcctataatcctagactttgggaggctgtggtgggagggtcacttgaggtcaggagttcgagaacagcctgggaacaagtgagacctcgtctctaatttttaaaaaacaaaacagaacaaaaaaaaaaaaaaacatagctgggaccaatggatggcttgggtggaagacagatttagactcttcaaaaatgttttaaaaatgcagtaaactctcctcccactctttgatctggacaattaacattttctcgtcttatataagctcaacttttttttttttttgagacagagtctcactctgttgcccagctggagcgcagtggcaccatcttgactcaccacagcctccaccttccaggctcaactgacctcctgcctcagcctcctgagtagctgaactataggcacacaccaccatgcccagctatttttgtagttttggtagagacagggtttcaccatgttgtccagggtgggggggaactctgacctcaagtgactgcctgcttcagcctcccaaagtgccgggattacaggtgtgagtcctgtgccccgccatataaactcaactttaagacaagacctaaactacctttccaaccaatagccatccctaagttttttttatctaggaatgctagagcttttgtggccagtaaacataaaaagatgctcaacttcacaagtaatgaggcaactgcaaattaaaacaacactgagattcatttttcactcatcagattggtacaaagtttaaaaatgattggccaggcatggtggccatgcctgtaatcccagcaatttgggaggctgaggcaggaaaaaccnnnnnnnnnnnnnnnnnnngatctcttgagtccaggagttcgagaccagcctgggcaaatggtgaaaccctgctctactaaaaatacaaaaattagctgggcatgatggtgcgtacctgtatggcactactaggaggctgaggtgggaggatcaattgagcttggaaggtcgaggctgcggaaagctaagtcgcaccactgcactccagcctgggcgacagagcagagactctgtctcaaagaaagaaaaaaaaaaaaaccctaaataaaatttaaaagtaaaagtgattatatccaccactggggaggggtggggaaactcacccaccgttggtgactgataggatacgatcagccttgttgggaggcaacttagcagggtctgtaacaatttaaatgtgtatgccctatgaccttgcaatttcattctagaatttcattctacagagatgctttcaagctctcatgcatccacaaaggacgtttgtacaaggatgtttattgtagcattgtttatattgcccccaaaaagcagggcaataaaaaggatggttaaacgaatcatggctgagtcttaaaataccatgcagctgttgaaaaagagagctaaggctggtgtggtagctcatgcctgtaaccccagcactttgggaggcagaggcggaggatcacgaggtcaagagttcaagaacagcctggccaacatgatgacaccccgtcttaccaaaaaacaatacaaaaattacccaggcatggtggcacgtgcctgtaatcccagctctcgggaggctgaggcaggaggatcccttgaacccaggaggcggaggttgcagtgagccagattgtgccactgtactccagcctgggcaacaagagtgaaactctgtctcaaaaacaacaaacaaaaaaagataacgaatataaagtgactgttgataacggctgcttctggataggaggggagaaggattggaggaggattgtaacagaacttttacattttatacagtaacaacaccaccttggctatcacttacggatggtttaccatatgcctggcactgtgacgaggagcgggattgtctcatttgatctgcacactagcctaccaggtaggtgcttttattagcccactcacagatgaaataaattacagtgtctcacgcctgtaatcccagcactttgggaggccaggtgggcggatcacgaggtcaggagatcgagaccatcctggctaacgatgtgaaacccctctctacaaaaaatacaaaacattagccaggcttggtggcacacgcctgtagtcccagcactcgggaggctgaggcaggagaatcacttgaacctgggaggcagaggttgcagtgagcgagattgcaccactgactccagcctgggcgacagactgagactccatctcaaaaaaaaaagaaagaaagaaagaaagaaagaaattaaggtcaaactgggtatgtcatgagctcaggcgctggctagtaactagtagaaccagaggttagaccacttcccaatgtatatttctagtgtgcttgaattatttcacaataattctgtgggtttttttattttgttttgtttttttaagaacgaggtatcactatgttgttcaggctggtctcaaactcctgagctcaagcaatcctacccattagccttccaaagtgctgcgattacaggccggaggcaccacacccagcctgtgtttggctttctagttaaaacacaacaaccataaaacaacaataacaaggaaagttagaaactttcattgtgaaaacaaatttcattatttttctcactgagtctcagaaaaaaatgctgaatcccctccctaaaatcattttattttaaatgatagataattgaaaagactgttctttgttgttcataaaagctcagaaacacttttgaatggacgcttatgttgcaatcagactgttcaccacttcagtgaaaatggtttcaataagaaagaagtaaatgaaacttaccatttgtttcattgcctcacaatccaatacagcttttctacctgaaacagaaaaggaacacgataagctcactttccacatgacacgttggcttggaggttcgagcctcagaatgataaggggggttacaagtgacagaagaaaatatgctccagaagaggagcctgttcaaatggctccacatctcccagttgaagtccaagacggggtcagaaggcatagtagaaccacagtggtgagtcatcggagaacttcctctttttcttagccaagttaaggaaatcagagggtttggatgaggttgcataatactggtttgttcgaccaatctgtcttcctctgtgagttcctataagaagaggatatttggtagattgccactccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaaaaggagtttggtggaagtttatttagtctttggaagcaaaccgactgtcttaagcagatacatacaaatattgtatcaaaatgcctgctttttttttttgagactggcctcactctgtcacccaggttggagtggagtctgtgatcatagctcattgcagcctcaaactcctgggctcaagtgctcgtcccacctcagctcctgagtagctgggaccacaggtgtgcaccatcaggactggctaattatttttattgtaaagacaggggtctagttgcccaggctggtgttaaactcctgagctcaagtgatcctccgcctcagcctcccaaagtgctgggattacaggtgtgagctactgtgcctggccaaaatgcctgcttttgttaaacgttgattcctagaccccactccagacttactgggtttcaagccaggacgctgatttttttttttttaaacaagggccctgagcaattcttacgcacagtgaggctgagaaatatctgtacaaggtgctgctgcctcagtgatttctgaatcaagggagcttggggacttgatattacggcaagccctccagtgccaggagatctgaagtaggagttacttagatcagcctttgaaatagaacgtgcaggctgggtgcggtggctcatgcctgtaatctagcacttcggaaggctgaggcaggcggatcacccgaggtcaggagtttgacaccagccggccaacacagcgaaatcccatcactagtaaaaatacaaaaaacttaactgggtgtggtatgcgtgcctataatcccagctacttgaggggctgaggcagaagaatcgtttgaacccggaggtggaggttgcagtgagccaagattgcaccactgcactccagcctgggtgatagagaaaactctgtctcaaaaaaaaaaaaaaaaagtcagttgaaatagaatgtgcagagccactcttgatggagtggagatcaccaaaaggatagaaaggtatgactatagggctaggtgggaagacagctggttgacacttgcaagaattgacaggtccaccaagagaggaagcaaggagtgaatggctggggcagccttgagctgggacattcatctctgtaccttaggtcccaagattaaccaaatccttccttattgactcagcgtcacctagctagcatcctctagctaggaggttgatactgaatcttgctctgtctcccaagctagagcacagtggcaccatcttggctcatgcaatctccacttaccagaatcaaactatctttccacctcagcctctctagtagctggaccacaggcacaaaccaccatacactactaggtttttaacttttttatagagatgaagttcactatattgcccaggctggttttgaactcctgggctcaagcgattctcctgcgtgtgcctccaaaagtgctaggattacaagcatgaaccaccatgcccaacccttactacaacaatttacagcactttataaaagtttggatgggtgaactgtcagatacatgtgcaaaattcctcaactttttcttttcttcacgtctgcaatgtttttcatcagcatcctgtcactttttgctaccactgctggccagctggaaaagaacagacaaccatagaatcattccccgcacccaattttctttctctctcttttttttttttttttttgagatggagtctcgctctgttgcccggctggagtgcagtggcgctatctcggctcactgcaacctccacctcctgggttcaaggattctcctgcctcaccctcccaagtaactgggattacaggtacgtgccaccacacctggtaaattgtgtatttttagtagagacgggatttcaccccattggccaggctggtctcgaatcctgacctcaggtgatctgcctgcctcggcctcccgaagttgtgggattacaggcgtggccactacccccggctccacattttcatatagacccatggaaatggtttctctatcagaccagtacaaattgcagacaagtctggcaatggaaaaaatatatattggcaacttctagtttttcaaactggagtaatagctgcagtggcgccatctcgggccactgcaacctccacagtcccaggttcccaagtagctgggattacaggcacttgccaccacgcccagctaattttttaatttttactagagatgaggtttcgccatgttgaccaggctggtctcaaattcctgattcaagtgatctacccacctcagtctcccaaagtgctgagactacaggcatgagccactgacctggcctcacacattctatttcaaaggctgatctgagtttactcctacctcagttctctggcactggagggcttgccataataacaagacttcaaggctgccttgattcagaactgacttttgaaagacactgtctcaaaaaaaaaaaaaaaagaatttttaatggtgatgtagagaacatttcatgatgtggtaagagaatcacaatatacttaagaaaagagaaaaggtattttaacagttgtaataacataaatcatttttctaaataagaaagtgcataatttgtatactagaaaaactatctggaggccgggcacagtggctcatgcctgtattctcagcactttggagactcataatgagactttgtctctaaattaaaaaaggaaaagaaaggaaaggaagaaaaaagaaagagaaaaactatctggaaggatattttctcaaaatgttaacaatagctatattggagagtagaatgttatttttattttttttattattatactttaagttctagggtacagtgcacaatgtgcaggtttgatacataggtatacatgtgccatgttggtttgctgcaccataaactcatcatttacattaggtatttctcctaatgctatcccttccctaacccccaacccccgacatgccccagtgtgtgatgttcccctccctgtatccaagtgatctcattgttaattcccacctatgagtgagaacatgtggtgtttggttttctgtccttgtgatagtttgtgagaatgatggtttccagcttcatccatgtccctgcaaaggacatgaactcatccttcttatggctgcatagtattccatggtgtatatgtgccacattttcttaatccagtctatcttgatggacatttgggtgggttccaagtctttgctattgtgaatagtgccacaataaactacgtgtgcatatgtctttacagtaacatgatttataatcctttgggtatatacccagtatgggattgctgagtcaaatgatatttctagttctagatccttgaagaatcaccacactacttccacaatggttgaactaatttacactcccaccaacagtgtaaaagcgttcctattctccacattctctccagcttttattttcttattctagctcctctttcttttttttcgagtgaaatcttgctcttgtcccccaagctagagtgcaacggcatgatcttggctcactatacctctgcctcctgggttcaagcaattctcctgcctcagcctcccaagtagctgggactaaggtgcctgccaccacgcctggctaatttttgtatttttagtagagacggggtttcacctgttggccaggctgttctcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtagtatggtgcactgagtgaggacaggaggttgggacatttcccagaggcttgggttcaaaccactgaggtattgagaaagataaagtaacttttacatgaaagataaaaaacaagatctttcctcaaaagacctacctggagcccatacttgccctcaggcaacccataggcttgcacaacagtgtctatttttttttttttgagacagagtttcacttttgtcgcccaggctgggtggaatagtgtaatctcggcctactgcaacctccgcctccccgcctccccagttcaaggattttcctgcctcagcctcccaagtaactgggattacaggcatgcactaccatgcctgcttatttcttatttttaattgagatggggtttcaccatgttggccaggctggtttcgaatcctgacctcaggtgatccccctgcctcggcctcccaaagtgctaggattacaggcgtggccaccacgcctggccagtgtctatttccttaagaaaaaaatatgtgtttttttccttagaaaaaaaattataaaaatcgaaacagcatacaaaatccaaagaaaatatccaataggctgaatataattcatttccgcttgtccctgcccccaggaatgtctttagcaccccgtccctgcatacattctttgttgggtatagcatgcattgttagaagcagtttatcatgaatttcgttcatagtcatagtggcagctgttgtgtattgactaggccttgtgtgaaatgctttttctcatgatctcctgtaattctctagagggttattgtccccattatacatttggggaaaacagctaggaagtagcatggctgggattcaaaccctgtgtgggtcgggtacagcggctcaacctgtaatcccagcactttgggaggccaagacgggagaatcatttgagctcaggagttaagactcgcctggggaacatactgagaccttgtctctgctaaaaataaaaattagccggtgtggtggtgtgcgcctgtagtcccagctactcaggaaactgaagcaggaggatcacttagtctgggaggtcaagggtgcagtgagctatgacttgccactgcatgccagcctgggcactgagcgagaccctgtctcaaaaaataaaaataaagaataagtaaataaaaataaaacaacaaaacttcctcatctgtctgaagtcatagcctgggctcccaattcttttccactgtcctgtctgcccagtgcccacgatcagaactttcttgacttgaggtctcagaatccctaaataacaatgtggagtagcttgtggttggttcacttctacaggatccagaattctcctggcctctgaagtgtacacaaagtaacgccacatattccagtctcatcagtctgaagtggg

SEQ ID NO: 5088 - DNA, 42518 bp, Homo sapiens
  misc_feature (15807)..(15965): n is a, c, g, or t
acctttttcctctcaaacaatttgttttttttacattgcattctgagtactgaagagcacttgaaatgtatggaagtggtttctatgctatttgataatcagtaatgttcagctgtcagatagtactttactggttgcagacccatctctcttttatattaaagcactagtgcagttataattgtgcctacttttaaaatctttcagtaaaaaagtacataatgaatacagaaatctaactgacagggatacagtaataatgaaatgctactatcacttattttaatatacaataaaagcaggcaaataccattgctttttgagtgcctttttaactttatactaatgacttaaagagctttaaaagaaagaaattggctgggcatggtggctcacacctgtaatcccagcacttgggaggccgaggtgggcggatcacctgaggtcaggagttcgagaccagcctggccaagtggtgaaaccctgtctctactaaaaatacaaaatttagccgggcatggtggcgcactctgtaatccaactacttgggaggctgaggcaggagaattgcttgaatctgggaggcagagttgcagtgagccgagatcgcaccactgcactccagcctgggcgacaagagtgagactcctccccgcccaaaaaaaaaaaaaaaagaaattactctccataacagtctatgttatcaccacatatataaaaacatgatttagatttccatttcaaagttacattacccgattacttccaataggtgctaagcaaaaacccccaatgtattattgaaccatggacttgcacctcatgttaatgtgaatatttatttccatgtccctcttaactggttttttcttgtcttccctctagtgtattgttatttcagatatgtgatatctgttttcatactcttgcctttccatcatgaagcttagttatgaacagagattcctttgtagagctcataggcagtacagagaggtaagtctgcctcagagggccttgtatcttggtgtagtttttaaatagtgcatagtgtatagtgtaagtgtacattttgttttgcacatagtttgttgccccgaatgggttttttaccaagccttttttctttcatgtatttacagtccggagcacaagattctcttctttcaaatacaatgtattcgctttactttacaacactaaatctgggctttgaatttccagtgcattggactgattgattgttgggagttagaggctgttccaaccatccttagtttgggagagtggctccttctcttgttttctaagcgtacagtcaacgggtgccatttgtggtatttaacatgttaggatgttgttccaaatgctgagttgttttatttctagatgtaattagttcactttatgtaatatcttctctcagactgactttaaaaacaaagttttatcattttcattgtatttgtatttatacagagtgttttagctttgatattctttgtattttcattcatttgttacatgagctttacagtaacatctgtataaatggtttttaaaaattaactatgtatgtgcccatgccgaagtgagcaataaaatcaatgctgtttgcactgtcacagcatcaacgtttttaaagaatattggtttgtaatgaatcgttttgaaaacatttatggttggctctatggagggtgacaacatggtcacaaaatgaaaagttcaagaacacatgccatcctgagttgatgcctctgtcatgttcagagctcagctttctgtctcctcgcagagcagggaaggtgcccgttttctccggccgtgtgactgctcagttggtagtacctgttgggggtaccgcataggtggatttctgagggggtcaggggctagtggggaagagcatcttggtcctgtcaccagtctgcaaccatctttgcttaatacatctccgctctgtagggcaggcctatgacaggggctcatatttgccagccctacttggtatgtcgagcagtaaaattctcaaaatgaaaaggagaaatcaattgtatttttttagaagctgtggattttaaggtttataattcactactgtattaatgatagtggactaaatccagctaactctatggatagaaaaggaatgaatatggtctgtgtaagtctacacagcaagggtacaacagaagggaacacctgggaaatgtgtaagtagtagcagtgtattaaagttaaagggtgagcatgcttttgtttatatgctttaatattcttttgaatatttttgttttgtttgtccctcattgctgtgtttactggttttatctaaaatttataaagttttagtacataaagatttttggccgggtgcagtggctcgcgcctgtaatcccagcactctgggaggctggatgggcggatcacgaggtcaggagttcaagactagcctggccaacatggtgaaacccctctctttactaaaaatacaaaaattagccaggtgtggtagtggacgcctgtaatcccagtacttgggaggctgaggcaggagaatcagttgaacccaggaggcagaggttgcagtgagcaaaatcacgccactgcattccgacctggacaacagagcaagactctgtctcaggaaaaaaaaaaaaaaaattaggccaggtgctgtggcttgcgcttgtaatcccagcactttgggagccaaagcaggtgaatctcttgagcctagcttgagaccagcctaggcaacatggcgaaacccatctctacaaacaatatgaaaactagctgggcgcagtggcacgtggctgatagtccagctactggaggtggggctgagatggggggattgtttgagccctgggaggccgaggctgagtgagccatgattgagccactgtactccaacctgggcaacagactgagaccttccttgctcaaaaacaattttttgttttttagtattataatagtctacaaattatccaagtttgattgactaatgatcagaagtttaacctgaagtttgtcccttcattgtaatgaaggttaacatgttacccactgcattgatttgtacttcatataccaaatgcttactatatatatatattatatatatatatatacacacaataagatatatgcaacagaacaagagcctagtaacagataaaggaggtaatcacgcaggagaagtgttactttacattcctatgttaacattcgtacaaactagacagaccagattttaaattttacttaaaaggtatctgccctaaatgtgactgtctgctgctcattcaacaaatatttactatgctcctgctacatgccaggctctgtactgctgatagccatatagctttgcatggtggttagaaagtgaacttccaaagtcatgcttcagtctgtgtctcactgtgggccaagttcaaacttaagtgctcaaagctcaatttatgtaagcaaagtcagtcatgatgggagcacatgagtaaatacccacctcagcaaggccctgaacccagacttgaatgtgtgtttgtggtctcactgtgttgtccaggctggagtgcagtagcatttcacaggcgcagtcatggtgcactgtagcctgaaactcctgggctcacgttgatccatgccagcctcccaagtggctgggactacaggtgagcaccaccacgctgtggtgcagtcgtgggattggcaagggaacctaagatgtttctcctccccacttaagtattcttaatgctttttttttggtaggagtcttgctccattgcccaggctagagtgcagtggtacaatctcactcactgcaacctccacctcccaggttcaagcgattctcatgcctcagcctcccaagtactgggattacagggtatgcgccaccatgcccggctaatttttatatttttagtagagatgggtttcactaatgttggccaggcagggcttttcattaattttaaatattgtctggttatcccttatgatagatgaggcatttagttctaataccaagcacctcactctgtaacacccccacaggactttccaaatgcatgactgtgatgaatctttcctgggctgctccacgctgatggcttgatgcacacaatccacagcacttgaatcgcactgtcctctgcttgctaagctatctggtgaagtgatctttatttgcttttgatttttcaaaaatatgttgtctcctatttttgacctttgctgagcaatcctattccttccctgaccaattctctcataaattctttctctgttgtttattcctggttactttttagcttggtaaagagcaccagttcccaccaatcacagaactagcaacttcagtcttcctaaaatattttacatttaaaaaaaaatcataataaagcatcgttaggcttgtgttaacagatctaatggtattatataatctaccactcaagagtacatctgccatgcttccggatcttttctgtatcatatttatattgcatcatatgtataaacccactcataccatgtttttttctataaaactgcgtattttgtagtctaaaactttttactcagtattttatggctatctagatctactttatcttctgcttaacattttttagaactatgttccagctcttgcgtatctagcctcatcttgtgcatttcctgtcctttccattcactgtgcttgctgaattgtcacaacacatcacaggggtctgtatgtcatttactgtgctcagacacacccagtccatcaagcctttccccgctggaagctcccgcctgcctggtggccccccttctgccagtttccattccaagagctcagcacttggaaccacagcagttgatccagtgtcttctctctaggtcagttttcactgcttcaggcctcctggcctctcatcatacataactcatccgcacagcactctctatgctctaatggaagcctctctctgccactccctggctccaagtccccatatcctcaactgctctgaagcttcctctagcttaaaagaagtgtagcttcccttttcattgatgacgccgcccccaagtgggttttttttcctcgtattcctccatccagatatgaggctggtgcactcttgcccacttgaaacccatcatcatgcctccttccccctcaagtcactaatgcgtctttgaatgacagcctggctttccaccctttatctatctactcttctcactgctatctatctatctatctatcttctgccaaccaacagaaaccataatcattttttattatttttttgagaaagagtctcacttttgttgcccaggctggagtgcagggtgcaatctcagctcactgcaacctccacctcccaagttcaagcgattctcatgcctcgctgagtgccaccatgcctagctaatttttgtatttttagtacagacagggtttcaccactctgtactaaaccagggaaaccaggtttggccaagctggtttcgaactcctgacctcagtgatccacccgcctcagcctcccaaagtgctgggattataggcatgagcctctgcaccaactgccgtaatgcatagtctctcatcgtccagccatgttatgaagtctacacatacatgtattgtcaaggttctccgaggcccacctctgataaccacccacctttcttctctcatgatcagaaataatatagtatttttttgtcctcaagtgctaattcttaattaattatttttttgacttaaagcaacaaacttcaggagctggctgctcacacaaggcttgttacttgcttagcacaaatacgactaatgattattttccccttttcaggtgtcaggtcataaattcaaagcaataagcttttagaaaacaatttttatttaaaaaatcataaaaagtactggaatgaaatacaggtaaagcatttgaaaattatttttctggcttagactgtttactggctcgattcagctctgtcctggtaaaggcctccagaaccttcacctactattatcaagtctggcctcaagggagggacttttactgtactgaaaggaagccagctgaagccgagatctgaagcgctcgcttccagttcccggaagaaaacatcatcatcattctgtgttatcatgtcctgcagctgtgaatttccttctccatcttagatctcagctccctcttcaccttatgtaatgtctgaaaaagaaggcatgtcatcccgctgttcacagcatttatccaggccctcatctattgttcccctccatcttccagctaatcaaactcctccaaaattttcaataatctagcaacagcagctttacagagacctaactaaagttaaaatcataggataaaaatgtcttgggtcatagatggttgccttattagtcttctctccattccctttacaggtataatacatttggttttctactcctaaaaatgtaaattagtcatgtgtcacttaatgatggagatatgttccaagaaatgctcattaaatgattttgttgttgtgcaaaatgtcagtgtacttacacaaacctagagagtcagtccactgcacaccggggctatatgatacagcctattgctccaaccaccaatgtacgggtcccttgctgaaagaaacattgccatgcagtgcatgacttggcttctatcttaattatacctgggcctgagatttctctctggctttaagttcttgatgttcctgtgatatggctttgccagcaatgaaaactgtttataggaagaaaaaaaacaaatattatatttaatgtttgagtccaaatgtaacatttcttaatgttcacaggcttaaaatcattttaatggaaataggaaatatactgtactatggtcaggtattatttgatcttaaatttcaatcttgaaatggggcctctaatctgtagagtgcaaacttcagttaacacaaggtttattgtcaacagactaagaagttttgccacaagggcaagtggtcaggactaagcacaacagcgtaagcaagtgccagagcccacctggtccttatagtagttctccatggagtccagttcatcctggtggcgtctctttgttcatctcgcttttctttggcatagtttcttaggtctcgtaatctttgcttttgatgtttaaaccttcttcaaacagtttcttaaatatctgtcagttatttaatcgtaaaaatgtcattgaggaatatcattttggccaactagaggtatatactgattgtatttcccaaggtttttttttttaaatactagttttattcagatgttttgacataccataaaatgtacctctttttctgagacaggttattgctctgtcacccaggctggagtgtagtggggcagtcacactcactgcagccttgacctcccaggctcaagcaattctcccaccttggctacccaaatactgggactataggcatgtgccaccacgcctggctaaatttttaattttttggagagatgcgtctcactatgttgcccaggctggtcccaagcaatccttgcacctcagcttcccaaaggctgggattacaggcgtgagccactgagtccagccttacccttttaaaataaataattcgtatgttttattatactcagttgtgcaaccatcaccactacagaacatttttaccacccaaaaagaaaccgtatactgactagtgctcattccccctgtcccatccttagcagtcaccgtctgtactttctgtctccatggatttgcatattctggacacttcctaaaaatggaatctgtaattcgtggcctttcgtatttggtttctttcactccgcatgttttcaaggttcatcatactgcagtatgtatgaatacttcattcctttttattgccaagtaacatcctactgtagaatgaatgcacactctttatccattcattaactgatggacactttgggttgtttcccctttaggctattataagtaatgctatgaacatttgtgttttttgtgtgattatatagctagagtgaaattgctgggtcatagggtaactctatatgaccttttggtaaccttctgaggactgctagattgttttccaaagcagctgcaccattttacagccccaagttctccacatcctgccaacactcgtcctctaactgtggttctgagtcgtatttccctaatgacgaaggtgtcattatcttttcatgtatcacagaggttctttacaaccttcagaaaagcagtgtcaagcgccatgtacatagggtaagaacgccaagagcagaaacatgccacacctacacatgtacacactgaggagggggagtgatcatttggggaggccaccggaaaacacactgctcaaagggttggatatgcgcacttgtcctcccttcatcagtgtaaattctggatagaaaaactggtttgacggcgacgcattcatgagctacagacaagttacttacgctctcctcaaagccttccctagaaatatgtccaagtctttagtaaactataattactaaaatattttacagatgaaattattgctagcttgggatctcaaaaggttaatcatttcacagcctgattaggatgacatgcaaatgtcatccttgtggaaaacccctcacagcacagctggacactagtcctgatttttgtggaatgcaaggtcatgttatcacactaaatttgtctctcacatgttcccaaacctcaaagtagttttactggagaagtacctgttatgtgtaggaggcagggaggaagtaagactcacattaagatgagggacacggagactgagaatggacgggaatgcacaatggagtaagaaatgaagtgtggccaagcagaactcagggccagcactataggacttcagtttagattttgattcaaatttggacaagagtcacgaacaaagaaggtggtcctgaaagataacaaagttaccttcttaacagggctggacagaaaagtcagacttaccatttcttcccgggtcctcatctcatcatttttgcacacaactgaactctataatcatcataatattttcgagcacgaacatttgctgtcgattttcttttatctttgattgggtcaacctttgcctacgaatgcagtcttgaagtcttgctaagaaagggaaaggggagggaagagaagggtaaggacaagaggaatcagattccagcgttctcatctgcctcactccccatcacgatgtcttcaggcagtatgtccgtgtggggggccagtggccccagaagcccttcagcctttggcagctttatcacctcaactgaagagcagctccaataacaccccactgcagcagagggcagcagtgatcctgggcaccctgtggaactgagggctcactccccatgccaccaggaagctgctaacaaggctggcccgatgccacctcacaaggagtaggaaaatggcacacccagactttcaagcagagcctgagtgccaggagcatttaggcaaaaactaaggaaattagacagtatctgacaaaggagtgaaataaaatggggtcatgtacataaagcctcttatgtaggtgtttcagatactagtgtttttccctccacaggaaagtaccatctgcagttcctgagatgtcttcctggaactgttcagtttacagttctcatggcttatctctactccacactcaggcaaagatttttaaatctctcctttggcagattgtttctgacctccatcctctcccttcgtaattctctaagcacaattccagtcaaaattataacggaggctgataaatcctggagctctctacttgggacctgagaagatgggagagggcaaacagcactaagttcagctgcttggcacctagatgggtccatggagccacagacagaactggattaaaatctcagctgtgtcccttgcttatcagtgagacccaggcaagttacttagtatctcaaagcttcagggttttcatttcatagaaaacatctctaatcattactatgaagactaactgaaactgtgtatataaagtacctagctcttcctcctgccattttgggtttgtgtgttttgttgttgttgagacagggtctcactctggcacccaggctgagtgcagtggcaagatcatagctcactgcagcctcgccctcccacgttcaagtgatcccccacttcagcctcccaagtagctgggaccacaggcaaatgccaccatgccaggctcatttttccacacccatatatatatttttaatgacagggtcccactatgttgctgaggctggctcaagtgatcctctcacctcagcctcccaaagtgctgggattacaggcatgggctatcattttggttaaagacctaggcaacacttccacatgcaggtgttaagaggttaagggtcttgcaactgttgcccagctagcacagataaagggaatgaatataacaaattcagaattatatacccaacttgctcttgacataccagtctcttgttatgttcatattctttcttgacaaggtagtaaggaggtcatgccttcttagggcttcttctatcttgaagggggacatgaagtaagtaggttaataatgctgttcactaaattcttaaggataagctcttctcatttaaattctatgcttaagactgacagtaacttacttcatcttggagtttcttctttgatcgatttttctacatgcttctttcttaagctgttcaacctgtgcaatttgctgtttccacattttgctagtgttgggccagaaacataaagaaacggaaactgctccagcataaggggcaggagacgtgttcacttactttcactgcaaggtaaaataagatgttcttaatctgagacgtggacagaactgtcatccaacatccctggtagatcaaagcttatgtaagtgatgtggttttgatctgaaaagaacaattctaaatgtacttataataatttgcattactcctctgattggagtagccaactactggtaaggataaaaataagctcaatagttctggattgatgccatgctggtctgggaagtccatcctaattgctcagccgcttcagtgcctgtgggtagattctctacgtcggtaaaacaagactcctcaaccttcccggtaggcaagtgcttagaagaaaaagtttctgtctaaaggatagagtaggagggccagcagtctttgggtgtaacaggaagcctggcattctcatgactttgtttcttgtaacaagactctacactcattggcactgtcaatatataggggtggacaggccatctgcttgccttggagcatccctttcattctaccaacctcccagaatagacaaaaaggcagtcaaagtgagtaagcacacgagtgaggctaacgctggagcagcagtggcagtcctggcattccttgggtgccaatatataggcctccctgaagtacttccttatgaagagttttagccctctacggaaaaccagccacatggcagtgattgggaaaaaaaaaaactttcttcggctaactggtggatgttagctttcagtgctgtgtccttggaatgttgccatgctttcaaaggttgccagttttccataaagtacaattctgtggttcttacttggaatgctttatttggctttgggaggccacctcttagactctgcgttgtggtttttctagagtaatcttccagggctgactacattctggagttcctttacgaacagcttctcctctgtatatttttccttagaagcagatataaaacagaataaaaataaaaggtctaacagttctttcaacatcatcttaaatattacatactgacaaaaacagctaacggtagttttttagttttttgctaacagtaagccaaaccaccttacttcaaatttgtaaaatctggttaatattcatttctctaagttaaatgcaccttttggcctctggcatcccttggaatttgaaaaagcactgatctttttcaagtttcagtcaccatagtcccacaccctaaatacaaccactattaatctttttttaaccattaatgtttcaatgtacttctctttttccatgtagatttaaaaaattctaggcaactatgcagtatgcttagttgtaaccatactgtactttatatcctgttttgttctgaatattttagcataagcattttccccatgatttcacttagtttctgtaaccattctttgaaaggcaatgaaaacttctgttttgggtttcttacaaccaggtctatagccaactagatgttctgtcttctcttactcttctttaattttgtcagcctagagtagtttttaagccctggtgaactgctaagtcaaataaacccttaaaaactgatgggaagttttaagtagcggaaaacactacttttctttggaaccatgtctcgtcatattttagcaacctgaatgccttataataagcaagtcctgtatcatgacatgaaatcctgccttttcctaaagagctcatgattaggccctgttggccccttcttcttttaaaaagatcatctttgtacttcccactcatctgtcaaatggcatttattacagtggagacttttacccactgtttcctcctccttctcatgtttcttagaggtccaatattctcttgaactttatgtcttcttagttccctttcaaatgctcagtaaacgcctaaaggggaaaaggtcatatattacagttattaaaaacatacacaacggcagcaccatggcttagctggttaaagcacctgtctagtaaacaggagatcctgagtttaattccaatggtgcctcaaccgagcatccaagctcttagccgcgtgcggtgaggatgagcaggtggatcacctgaggtcaggagttcaagaccagcctgaccaacatggagaaacccctctctgctaaaaatacaaaattagctgggcgtggtggcacatgcctgtaatcccagctatcgggaggctgaggcaggagaatcgcttgaacccgggaaacggaggttgaggtaagccagattatgccattgcactccagcctgggcggcaagagtgaatctccaccttgagaaaaaaaaaaaaaaatacaaaagaggaaaaaaattcacctaggatacctgccacccctaaaatataagctcattcactttttaaaaaaattcctttcagactctatatcacaaatgtatggtttcttgttttgttttttgagacagtcgcactctcgcccaggctggaggcagtggcacaaaccagctcactgcaacctccacttcccgagttcaagtgattctcctgcctcagcctcctgatagctgggactacaggtgtgcactgccatgcctggctaatttttgtatttttagtagagtggggtttcaacatgttggccaggctggtctcgaactcccgacctcaggtgatccaccttctcaccctcccaaagtgcagggccactgcacctgcctcacaaatctctacattactttacatatataattgggacataaaatgaaattttacatcatgcgttttttctgttctcaagttttgcaatcattttgatactctcctgagtggaagttacatgctgagttacaaatgagttaagatgtctgaattggttttagtttttcaccattataaatcctaccgcattataaaactactactgcaaataagtgttctaaatccatgctacatttcaaaatccacattccacagtgaaagtcttcctaggtaatcataccaatctccctgttgttgaatcccaaccacctcctccattcctgtcttgggtacttgatctcatcttctctgtaactcaagtggcctttcacgttaatccacctcaaattcccttcttctctgaagctcactctgaaaataacaactcacactgtctcctctttcttaatctactggaacaccaagctatgtccagccaggttattttttttagagtttcatgagtataattttatgctaacaaagacataagctatgtcacatagctctcttcatccactccgctcaagaatattaaatgtattttaagcctaaatcaacagcatgttcaggtagcatctggctgaggggaaatggtactggctgctgcttaatggtagtcaagagatgggaagaacctgtgcttggaattggcggacatctgtttctcttggcttgcgctgccttttctctccaagtggaactgtttgtgtttgttaactggagatggagagagcgaatgggatcttagggtggctttctacgcatggaaagtcctgcaacagagaaaagacatataacattagtcctgatagccagaatgttatgctggaaaccaaagttggttttcactaaatccaaagagatgatgagtgaatgtgctaaagggactctctcctgtaactaacttgaattggtatggtaaaccaagtaaacagacaaatgcatacaaatgtgtactgtctcaaatacttagcttctacatcaactttggatattcaacatgtggaatgcctcctatgcacaaaggactatggagagtgtcttggtgatagggggagatgcaaagagagaaaaggtaaattatctgagccacgcatctctatccttttacctatctgggtcctgagaaggtgggatgtaagcatacatatctatcttttatatatgcttataggcaaagttaatgtgttaagcattgtctaagtggtctcaattttccctacttagcaatctagccctcctaattgcacactgccaaagagatctaataaaccattccttctacaaacctttttatcccattgtctataggtgtgtctggggatctgctagttggaagagggtgactccagtgggaaaagcacttcaacatagccttaagaccaaggaagctatttggtacctttataaataaattttccgagcttattatttttttcacatgcttttaattaagtctttcacatttcaaattctaagatgtatttttaaaaactgacttgcataatctatttaaatgatagctgctcatgatgtatttttctctagaaactgaagacgcacttgaaatatattttaatttataacctgttttcacaataggataccatgtgtatgtacataaaaagggaaggaagaggttcctggatgagggtgcctagaaattagctgagtccttttaaagggaaggagaggaaataatcaagagaaggaaagagcattcttgaaggagtaaaaaacaactgaaaagttaaggaagttggatcagaaaaagactatttctgaagaaacaatggatgaccaaagtgataaaactaaatgtaaaatatgcaggattttagttggtggaagacaggataattggattgaacaatggcatatcaaacagtagaagtatctgcaaagacacggcaaaccagaaactgtgatacgagtataaagcagtgcaatcactttggtgggcaagttggcagtggtgaagaaagtaggccttatgatccagcaatcctactagatggagatatcacagaaactcttacacatttctaggctgttcattgcagaatttttatagtaatgaaaactggaaacaacatgtccagaataggggaaatagatagtgctacacgcgtgtgtgtgtggtatctgcagacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacattaagtggacactgcaagaactcagtcatgtccagcagtaggggaaatggatactgctatacatataccacacaaaagtgacacactgtaagaactcagttacactgcagttaaaatgaatgagctgatctgtaaggatcaacataaatagatttctaagacaatgtcagaaaaaaacgcaagttcagaataatatatacagtatgtaaatttttaaacaacataaaacaatactatgtttagaaagtaatgcatgagctcttaaagtataaaaacaaggatcagaagaaaagatgccaacttaagacagtggttgcactgagggtggggaaaagagatctgtggggagagcagagggggttctactgttttatttcttaaacacaaaggggctaaagcaaatataattgttaacacttgcacttctagatggggaagatccaggtgtttgatattacttttgatccttttatatatttccaactatttaaaattagaatataagttattaagaacagatggaactgcctaagtagttccatggatgtcccccttctcagtctctctggggtaagtacctggccttgacttctttggccatactccacgatgccatcactgtgctgagacagtgtctcctcagttccatcctctacccctcatttccagtattttcttctttatggtcagtcttttctttaatccgatcacccagacactttttaacatctattgagaaaattcttttcaacatctttcactgatttcagcagaagtaaattcgtaggagtaggcagacctttaaaaaagcttcctttgacagtcactaataacagttttcagacgcttatgcatgtttaattatttacttttattttgagacaggatctcacctgtcacccaggctggagtgcagtggtgctagctgggctcactgtaacctctgcctactggttccagtgatcctcccatctcaaccacttgagtagctgggattacaggcatatgccacaagcctggctaatcttttattttttgtagagatggggttttgccatgttgcccaggctgtctcaaactcctgggcttaagtgatccacctgcctcagcctctcaaagtgttggaattcagttgtgagccaccacacctggcatacatgtttagttttaaaaaggtgtatatcagtgtatggatcactaagtttcaataaactttagaaaaagtcacgtagggatttaaaacattcttcaatgataccttaaaactgtaatattgtattttgtgagaatcagtgatccatccaatttataccagatctgtctttagcggcaaaggggaactataaagacatatctaaagaaaaaggcttaacataatcgtttatgttaaatgatttagttttcatcagaattcaataaaatttgataaatctgcaccaaatttagttagatcatgaaacgctgagagatcacttcctgttctcctgcttgacttacggaacattttcacagtaactattaataagacacaactaattttctatacctcactttcaattgagagattacttaaatgctcacttaacccatgggaatctcaaatagatgaaaaaacaagacttgcccaatctagttcagaaagccgctgagagagtttttcgatacatcatgtaattcttgttctgttaatctctttcttggcctctgggggaaaggtgattgcaggatgaggctgtagctctgttttcatttctgtaataaaagtgaccatttgacagaaaatagctaggtgtctattatttagtttaaaataactgtaatacgtactttaacaaatcttcattctggtcttcacagctaaatttggagatcatgcccctgcattttcaaattccttgtaaacagactgtaaacactgaagtctgcagtaatgttacctttttcctttgggaggctccttgtcctaggcccttggacctgagctggatatacttcccatttgctgcctttaggcacttggaaattaagaaaagtccatcatctagatcctattaaaaacagaaaaaaagttgattgaaaaagctacaaataagaaacatgaactttctgggagtgaggaagggaggaactgtgcacaaagctacgtgccttcaatctccgtgttttgaagtgcatttgtcaaaagaccctatgacacccagtgcaccaaaggactggagcaatgtctagaaacttgtgctcagagaacaatgtggctcaggatgccattcaaataaaaacacaggccaggtgttctctaaatatgaaattcagggattaccactatacctgagcaacaaaaaaattatcactagtacaaagtattcaatggctatcttttgtatcaatgtcaataaaggctgtccaaaattgaaacagttaaaacaagacaacacctctcaaaatatgaatataaacccttaacattttaaatttcctttttttttgagacagttttcctctgttgcctaggctggagtgcaatggcttgatccgcctcccaggtcaagcgattctcctgcctcagcctccctagtagctgggattacaggtatatgccacaaccctggctaatttttttgtgtatttttagtaaagacggtgtttcgcatgttggccaggctgtctcgaactcctgacctcgagtgatccacccgcctcagcctctcaaagtgctgggattcaggcatgagctaccgtgtccggctaaatttatttcttggtcttagagataatcttttaaaaatacttcttgtgatgaagaaacatttaatgtttgtttgtttttttgttttttgagaggggtcttactgtcacccaggctggagtgcagtggtgcagtcttgggtcactgcaacctcacctcctgggttcaagcaattctcctgactcagcctccagagtagctgggattacaggacctgccaccgcgcctggctaatttttgtattttcagtagagacagggtttcaccatctggccaggctggtcttgaactcctgacctcgtgatccacccacctcagcctctcaaagtgtgggattacaggtgtgagccaccgcacccggccatttatttaatgtttaatgatatcttaatttcacttcattatctttttctattaaagtaaaattaaataccctttagtaggctggtatggtgattcatgcctataatctcagcaatctgggaagcagaggcaggcaggtgaggcaggagtttgagaccagcctggccaacatggcaaaaccccgtctctactaaaaatattttaaaaaaaatcagccaggtgtggtggcacgtgtgcctgtagtcccagctacttgggaggcgaggcaggagaatcacttgcctgggaggtggaggttgcagtgggtgcagactgcaccacacactccagcctgggcgacacagcgacactctgtctcaaaaaaaaataaaacaaacaacttttactaaatagcaactaaaatataatcatattttaataaaacttttaaaataaagtattctagctcaatgaattatttgaaaataaacactcccctttaactgccacccaggtcaaaaacagagtattaccaactcagaaatatctctaaaacccccactatgattcccccaaaataaacattatcttatgactccattttaacacctctttttatctaatccctctcctgtttgatgcacagaatgttgagaatgtggtcacctattgttaataatgcttatttcatctctgacttttaatgcattgcttgaatgtttaaataatgaaaatgtatcactgtttatatatctccctgtgtacatacctgcctgttgtttttcttattttatttttttctttttgagacaggtcttgctctgctgcccaggctggaatgcagtggtgtggtcacagctcactgaagctcctggctcaagtgatcctcctgcctcagcctactaagtagctaagatcacaggcatgcaccacactccaggctaattttctatttttagcagagacaaggtctcactatgtttcccagggtgtctcaaactctggcactcacatgagcctcccaaagtgctgggattatgggtgtgagccccgaacccagtcctgttctttttagaaagataaggacaggatgactatataaaaaaggtttttcttttttttttttgagatgaagtcttactctgtcacccaggctggagcgcagtgggtgatcttggctcactgcaattgaaccaaatagatcaatatgttaacagtggttcatggggataatgggaatatgcatggatggttattttcttttccactctgtgttttctaaatttaaattattaaattacggacacaatatggactctgaagccagaatgtccaagttcaaatctgactctgtaattgctgtgtaaccttgccctctctacatcagcttcccaacaataaataatatagtagctactccagagttgttatgggcagtaaattattcaatacccctaaagtatcagaactgcgcctggcacaacataaacattcactatgtgttggctcttattatttcccttatatgcattcgtttttctcctatcttcctagaacaagaatgtgcaggtgtatacagagcaaattttaaggagtacgatgctttgactagtgcaatatgcttgacaattctagcagactctttaaatataggggcttccttgacaaagaataaagacttcaccaatacacatacacaacacggccttctaatcaattaccaacacacacacagacatacatacaagtgtacttctaccaactgaaagtaagcttttccacttaccccagaaaattccgtatgctctccagtagaattacggctggggagcagtgacttgaatgcaagtattcttttcctatggggcagggtgctgaggctctgaagggtggtagggtggatgtaaaggaatagctgctcggataggctcccctgcttcctagcatttggaatcccactcacagaaagggtttccgctagtaagacaaattaagtggatattacgatgcaattctaagaaataaaccattttatatacatacatacataccttataaacatgttcacatacattagaaatattttttaaacttaagacaaagcacataaaaaataattaaaccagggatatagcctcagcacacagggatctaattaaattaggatgtaatttttttttttaatttttaaaaaaagtagagatgaggtctcgctatgttgcccaggctgtctccaactcctgggctcaagtgatcctcctgcctcggcctcccaaagtgctgggattaaagtgtgaactaccatgactggccccggatgtaattttaatgttattatcataaaactgtccctgaaagttactttaaaaactggaagcaacttaaatggcttgaagaatgttatgtttgtgaattatggttcgtccacgttacaaaaccagttaggcagtaatatttttatgtattctaccatatgaaaattccagagatgataataagaaacaagaatgatttttccaggccggtgcgggagctcacgcttgtaatctcagcaatttgggaggctgaggcaggcggatcacgagtcatgagttcgagaccagcctggccaacatggtgaaaccccatctctactaaaaataattagctgggcgtggtagcaagcgcctataatcccagctacttgggaggctgaggcaggaaatcgcttgaacccaggaggcggaggttgcagtgagccgagatcatgccactgcactccgcctgggcaacagagctagactctgtctcgaaacaataaaaaaagaatgtttttccagtactatactttgttatttaccaataatatgaagaccaccaatagatgtactaatgtgtcaagactctgtcccattaaaaaaaaaaggtaagtggtgagaatttagataataaaatagtgatgcaaaaatatgcaaccaaagaccatgttaagcagaattcagataccataattaatagaaacatttacaagtaagatcatgtaagaccaaaaaggatctcatatacagcaataaaagaaaaaggctaatggcaacaacaattgccccaagaatgatcatcagcagtaaagaactaaatccattacaactcactgtcttcaacaaaggatgtcctactcttggacaaaacactagggggtacaacatatcttcatgtgatttagaacttggtgaggctaaggcttttttagacagatttcattaggacattgagcacctaggaaagaaaatattaaaggtaaaatttttaactacaaaatagtttgctgaacattatactaaaagccaagagttttgtactcaggaaacaaatttaaataatgttgaacgaaataatgttggtccaactgctcaaaataccaattattattttctttttcagacagcatttccctcttgtcgccaggctgcagtgcaatggcgtgatctcgtgcactgcaacctccaccttccaggttcaagcaattctcctgcctcagcctccagagtactgggactacaggcacccgccaccatgcctggctaattttttgtattgtgacagggtttactatgttggccaggctggtctcgaactcctacctcaggtgatccgcccacctcagcctccaaagtactgggattacaggcgtgagccactgtgacgggccataatatcaattattttaattgctatcagaaagtaagatgccattttgtaatccagaatcatttatacaatttaaagcaaagtttcatacaatgtttcattatttagctttagaaaaatagatgccagagttacgaaatgctggctgttttatggacatgtcttggtatgaatagacaccagagttagggtcttgctagtaccagaaacatggactcatggtccaggccaagcgcagtggctcatacctgtaactcagtactttgggaggccaaggcaggcagatcacttgaggttattagttcaagaccagttagccaatatggcgaaaccccatctctactaaaaatacaaaaatcagctgggcatgtgcacatacttgtaatcccagccgcttgagaggctgaggcagaggttgcagtgagccgagatgcgccaccgcactccaccctgggtgacagagcaagacctagtgtcaaaaaaaaaaaaaaaaagactatggtccatatattgaagcttaaattagatgcctgtgaatgtatatgacagtatctgacactttaaatctcaatatgaaaggaagctgccataagcccttttatcacatcaacccaaacaccttggccaggcatctctctgaatcttttttcctttgccttaattgcatactcttaaacacaattcccctctctacttataatgttaaaataagtaattcattttacataacatcttttttacatagcacttgacatcacagaacccgtttctgcaatcaccatccctccattcccaatcaatccatctgattctcctacttcaagaaacatttttgtagtatccaacttgactctggtccttccgtttctgtgcctatcccaatggcaagcatagctttttggttactggagggtgagtttgccaggaaccaaaagtaagggagaacattccaagacttgtggccatatactggtttagtaatttatgaagccacggtggacaggatggagtaggatgattgaggagggcaaggttggaggctcaaaattggggcttgaaagatatccgggtctactatgtcaagcaataggctgttggaaatctggcctgaagcctagaagaaaaattgctactgcataacgaacttattggttcaaacaatgaaaaaagtgagtcaaccaccagttcaggaaactacattaaagaataccctgaaagcgtgaccagactataagctgcatccataattctcttcccggttataaggaaccgcaaattacctaataaccttgcatacacttatttgccttggactttctgcccatatgcctgcgacttcagataagtgttcatatttaatgggtagtgggatatttggaatttcaaatcccatgtccagttagcactctattcttctcaattttaaacactcctcataccatttacatttttatagttgtatgttgaataataactgatacttcaggtttaacactcaccattacttcttagagaaaaggtgtgtgctgtgtctccaagtctaatgatttcacagtggattctgcttcatctccatcccaagaggggcccaacatctcagaagacaaggagacctggaaaagttccctccttcactcagggcccagcctgaccagagggcccttcccctgggacctggagagctgctgggtgcagaaaaaggaaaagactctcccttttgctgcttagctgtcttgctgcttatgttttgttttcactgatatatgaatggtagaaatagctgtatataagtgtcaacgattaaatgtataggagaacagcaaatactggtgactctagggtgtggggtgaagggggtgggatgctaactttgcattaaatatccttcaattgtttcacttttgcgttattttgttactttaaaattcttatggaaagaagttcatcaggccgggcatggtagctacacctgtaatcctagcactttgggaggcagacataggtggattgcctgaggtcagggttgcgaccagcctggccaacatagtgaaaccccatctctactaaaaatacaaaaaattagtggacgtggtggcaggcgcctgtaatcccagctactttggaggctgaggcgggagaactcttgaacctgggaggcagaggttgcagtgagccgagattgcaccactgcactccagcctggcaacaagagcaaaactctgtctcaaaaaaaaaaaaatttcatcttatgatggtctccctgagacacattttttacaatgtactatacctaaaaaagaaggcattgcctgtgctcttgaaccatgaagacatagcattatgctcaacctctagttagcaagaagtgcaatcaaaccgtcatgacaatacatttttgtctatgaaagaagcacaagtttaaaaactgtgaaaatgacaatgatactggctcatgaaggtcctgtaacccagcattgctatactgttggtaaatgtcagtcatggcctttttggaaaacagtctggcaacttttattattagccttaaaacatttcactgtcttactctgaatctagcctcaagatatgaggaaaaaaagaataaacattaagttcacgtttttgataatatttaaaaaaactctctactttagaggaatggcttagtaattttgaagcatccacatgaatgatgttatacagtgattacaaattattataaagaatttaacacttgaggctgggcgcaggggctcacgcctgtaatcccaccactttgggaggctgaggcggcggatcacttgaggtcaggagttcaagaccagccttgccaacacggtgaaaactcactttactaaagatacaaaaattagccagccgtggcggcgtgcacctgtagtcccagctaccaggaggctgaggcacaagaatcactcgaaaccgggaggcagaggttgcagtaagctgaattgtgccactgcacactccagcctgtgtgacacagcaagactgtgtctcaaaaaaaaattaaacaacttgagaacacttaatgttaagtttaaaaatgcaggaaacgagcctggtgagtgggtcatgcctataatcccagcactctgggaggctgcagcaggaggatcgcttgaggcaggaattcaagaccagcctggtcaatatagcaagatgccatctctgttaaaaaaaaaaaaaaaaaaaaaattagccaggtgtggtggcgcacacctgtggtcccagctacttgggctaagctcaggagttcaaggctacagtgaactctgatcacgccactgtactccaccatgaggtcagagcaagaccctgtctctttattaaaaaagcaggggtgaggggcaggcaacgaaatatatagacatatgactaaatccaaaaaagaaaaaaatagtaaaaaggactaaaaaattaacaaaatgttaacagcagttatttagttcggaatagattttttttcctgctttttctatttgcaagttttttgcaaagatgatgacgtactttgatgattaagagaaaaacagggacaggcgcggtggctcatgcctgtaatcccagcactttgggaggccaaggcaggtggatcactgagatcaggagttcgaggccagcctgaccaacatggtgaaaccccatctctactaaaatataaaaattagccgggcatggtggcgcgtgcctgtaatcccagctactcaggaggctaggcaggagaatcccttgaacctgggaagcagagtttgcagtgagtcgagatcatgccacacactccagcctgggcaacagaatgagactccgtctcaaaaaagaaaaaaaaagaaaatataaaaatgagtagatagttgatactgagatttaggtattatatgtaactcaaggttctaaaactccctcaggaaagtttaaaatatgagaagttagtagaagtttcacattagcttttttggtgccatcttggtatattacgtgtgattttaattcttagtccaaaaagcgtaactgttttcatcaaattcagagacactaagtgctacctcccaaaagaaactcttttccatgtgatttagattctttagtactttctggctcttccaaacgttctcctcgatcagattcttaaaatactgttcagtttcacctgttcagaacagataaaaacaataccaaaaaacccctagtgaatactactttttctatgtaagaggcagggaaaggtaaggacagtgaggcacccctacttgccatggtaaacagggttctagtgaaagtgcaatcagaaagaaccaaatcacctgaatgagcatgtattattcgagtaacaaagaaacaagaatattgctttaaaaacagggtcacagttgtatgagcaatgttttattttttaagtcagtggcaggtccattcaatattttttacctctccatctgtaaaggatgtctgaggtatatcaaggtgacagaaaacgtgattgttcaacataatgcaagctccaagataatcatgccttaggctgagtcaggctgtatcagggttggatgaaatttttcttaagaccatcagtctttttccaccccaccatacttgaagaatcatactttcaccagtagctataactcactagggaaataatttcaaaatacatgtaggtgaacctcccatgattcagatttacccctttggatattctcatgcccatgtctagagattcccattcaaacacccaccttcatttttttctacttccatattcaccaagcaacatttcaaaacatcaattaacatttattatgcatttactctgagctaggctgtgtgcccaactgtttcacacatctacttacttaactttcacaacaaccatgaaagaatttcagatgagaaaacagcttagagagctgccatcatatagtgagaggaagaacccagcactgaacccatggtcttcttcgaacccctccttcttcagtggtaaatgataatgctagctcaggtcccaggttgaactgccctgcacagctgatatgattagtgataataaagatttgtttcccattactgttaatggcattttgaagaacctgatcagctctaggaaatattgccaggtaagtatatattagactgcaaagatgagaagcagactgtaagaaaatgctgtccagctaaggtactgtcatataggaagcctatctgagcaacttccccagtagctcaccacatactgccgatctcccctgggatatccttcagtctttcaccaccaccagactcacataaaagtatctctcagttgcctcccctctcttcatccccactgccatatcattagccaggcactaccatccctccccttcctggagcaagcactaaactgtaaaaaactgctgctctctttacatttcaaattaatctcaattctttacttagaggttgttttctacctcttaaccctgttactaaaaagactagaaaggtcacagcatacaaatacctactggtagccttgaattaggtgagtcccacctgtcaatacttcccctagttctaattccccctttatgcttttattgtatgtagttatggctgtctccctactcaagtacaggtttgagagtatcaacatgacaagcagcttggaatcctcccagagtaccagacgcctataaaacactcaatttttgaaacaaagaaatgtccagtgtggcagactttcaattttccctcccagtttttaaacagtttagtaacaatgattaaaggtaggaaactactctaactaaagactttaagattaatttcaaatgtgactatcacaggtctcactataaaaaagtgagaatggaggatgagcctaccccaattttttgtcttaatttgtattcgaattttgtaaattgtggttgctgctgaaagtttatttttgataacttttcaacataagaacaggaatatattattccattcgtgaccaacagcattatttacttaatctcaaattattaagacgttaagttctttcactttttgcaatgacaaatatctgaaatatttaggctgtcacaaattaagtgcaggctaaagacacaaatgcaccaattcttcctgttgatgcctcagtaacatcaaatatttaccataaatagcagttctgacacacgaaattttggagaaagaaattttatgaatcataggacaataaataatttagccagaaatttatctttctagtataaattagttttaagtaatttatgagcaacatccaagttgataaagaacatgatgacagtctaagacagttccaaccagctggaacaataagaatttgaaatttacaactacggttatcaggtatactgtttagtgaatctgcttcctatgaagaaaaatacacaaaaagataaaaggcaaaagggacaatcataaaaggtaaaccaaaccaaatttccattcttaaacttacttttctcatgagatgttcactgatgcgttctgtaagatactccaacaaaccatcaaatatttccaggagattctaatagattctttatctcctttcactatattttctcctggagacagaatatagagctattaaaaatttaaccatgaaatctgaaagcttcataatcttgaaacttggatataacattgtaaaatgctatttaagaatacaggcgatacataccaacttacagctccttggagattaaaaaaaaaaagaatacaggtgaaacaattataaatattaagaacaacaatttcctgctgccgattatatttgaagaaaaaaagggggaagctttaaatatggcgtctaataattcactggatattccttccttttttggagaagcaaaataattggacttaagaaaacatgtctagtaaatttataccaaaatatattgcagctaaacagaactttaccagattggtgggaaaaagtgcaggagagaacactttcagattgtggtatcctattctaaatggtggtttgttcagaagatatagcagcagagtaacatcaaaacaacaaaaaaaaacaataaacttgttgggatacttcatcagaaattcctgaattctccaccataaccccccatatttgttaactcctcattttgatagatcataccatttttctgattaaaatcctttccctggctccctttctgaaatataaccctgcatataaaacctttttaaatctcactccatcttcagcgtctccagctacatctctaccatatccacttcatattcataacttacactcatagatcatagcacagtccctagcaagtacctactccgtaacagatttttaatataaatgattaggttgaaatgttgaatagaatgggttggcaaaaagcatggaaacttgacatatttaatgtcacctgaaatggactccaatcaacctcaggtatagatagtacttaacccttgtgacactctgattgtcctttgggagacatgcctggcattctcatgagttcacaccaatatgggaaaagcagtgtagaaatttgactttgggagaatctagccattcgtaacctcagccatgatgcaaaacaaacctaaaccagaatttgacgttttatactactactagtaacgacaacgtttgagttttttcgtttaaaacatgaaccagaaatcttggttttggacgtgtttttccggcttaaaaatacctaagtatatccaagagcatcctcaaaacttttcagtttctaggatggggagtatactgacaacctagcactaagactgccagccagaatgcagtgcttcatgctgcaggagaaactgttttacaattttcatagggtgggtgtaatctgtcaaagacagctctgcattaaagagttttacaaacatgatgtttataaccctgctatagtatgtttaacaagcacaaataccagaacttgtcctactgggtgataaagcaattacaaattgcaaaaaaaagagggaaactatgggagtagccctcaattatctccgaactgatttacccattcactcacctagaactgcattaaaaaacttaagaagaagagtattttattctcttcgcaaaaatttgttcttgtcagtatcaaattaagagattaaatcaggacttatcctgattaacatttatctccttttacaactatcaaagaataaataacagtataaatcctctttttgtgattatagtttcacattgtcaatattccctctattctaagcttgaaataacttactggaataatcattcatttctaaacataaatgaaatacacaaatacagtgatttataaatatatttggtatgcttagttttagaatacagtatagtatacttattttggagatttaattacagaaaaaaacttctgaatagataacatggttcaaaattagcaagtgcaaaaagtatacactgaaagttcttgtccctttgtcctgcaaccctgaggtccctttgttggaagcaatcagtattacgagtttcttgtatatgcttctagagagttcttcgattgcaaacaactgcaaatacttctgcacacctttgtttttacaaacactagcatacactctgcacattaccattataattgtactacatttttctcgcatcacatatgctagagatgttcccaacacggaacattgtgcacaaagagcatattcagtcatcttttacagccacaagcagtccactgtatgcagctatcatgatttatctaaccaatccctactaatggacattaggtgtttctaatttttagctatcacaaacaagtagcattagtatgctttaaaataaaaaatacggccaggtgttgcgagaagtcagggaccccaaacagagggaccggctgaagccaggcagaagaacgtggattgtgaagatttcatggacatttattagttccccaaattaatattttataacttcttatgcctgtctttactgcaatctctgaacatgaattgtaaagatttatggacacttatcacttccccaatcaatacccttgtgatttcctaggcctgtcttcacttaatctcttaatcctgtcatcttgtaaaccgaggaggatgtatgtagcctcaggaccactgataattgcgttaactgcacaaaattgtagagcatgtgtgtttgaacaatatgaaatcgggcaccttgaaaaaaagaacaggataacagcaattgttcagggaataagacagataacttaaactctgtccgttggtgagccgggcggaacagagccatatttcttttctttcaaaacaaatgggagaaatatcgctgaattctttttctcagcaaggaacatccctgggaaagagatacacgcctgggggcaggtctacagacggtcccccgggcgtggccatcttttatggtcgtagactgtagggctgaaatagacctcagtctcccatatcgctcccaggcttattaggagaagaaattcccgcctaataaattttggtcagacaggttgctctcaaaaccctgtctccgataagatgttatcaatgacaatggtgcccaaaacttcattagcaattttaatttcacccagtcaggtggtcctgtgatctcgccctgcctccatttgccttgtgatattctattacctgtgaagtacttgatgtctgtgacccacaacctattcgtatactccctccccttttgaaatccctaataaaaacttgctggtttttgcagcttgtggggcatcacggaacctacagactgtgatgtctcccccagacgcccagctttaaaatttctctcttttgtactctgtcccttatttctcaaacctgccgatgcttagataaaatagaaaagaacctacgtgactatcggggaggttccccgaaggccaggcacagtggtccaggcctgtaatcccagcaatttcacgagtgagccaggtggatcagctgagcccaggagttccagaccagcctgggcaaatggcgaaaccttgtctttacaaaaaatagaaaaaattagccaggcatggtggtgcacacctgtagcccggctacccgggaggctgaggtgagaggatcacctgagcttgggaggttgaggctgcagtagctgtgattgcaccactgcactccagcctgggcaacagagactctgaatcaaaaaataaaataaataaaacaacataacataaaaacaaaaaacacacctcaaattaccagctaggaatttacgtttcagacccagatcaattgcaaaatcaatgttcagctctcctggaaaagtttcatgtatggacctgacctctatcagttgattgtcttagctcaatcttacaatttggtcactccataagctcactcatttggttaagtaaacaatgtctacagttctaacaattattttactaaaatgcataattatgtgatagttatacatataccaacctgttatgtgagacaagtgacctgcaagtagtccaaggccagtgaatcaattactgcttgtacattgtgtgcatcacttcttgactcctaggaataactatgaggtctggggggggaaaaaatcacataattttgatccatgagaggccaagttttcatctcattgtctctgactaggctactgaatatgctcactgctataaaggctctgcccaaacagaacatgctgtaaagtacagataaagttaataaacctgaactctacacagcagaatctttactggttgagtatttattgattgaaccgatttacaatattagactggttgaatacggttgaatatttattacaccatatatatatatatagaatatagatatacatgaatatgctttacaagaagcaccatgttaaggaagataaagtggtcctaaattcaaagacagctaatagtctaataagggagccaagacatgatactttaaccctaactatgggctactttctacgaagaaaaaaaaaacacagcaggcattcaaggagcgttttatatatacacatatgtatgtttatttattatttattgagacagggtctcgctctatccccaggctggaatgcagtggcgtgatcttggctcactacaacctccactttcccggctcagcaattctcttgcctcagcctcccaagtagctgggtttataggcgtgcaccactatgctggctaatttttgtatttttagcagagatggcattttgccatattggccaggctggtatgaactcctggcctcaggtgatccacctgcctcaagtgatgagcctcccaaggtaatgggttagaggtgtgagccaccgcgcctggcccttatatgtccttttgaatagccaactagaatattggtataaagatttaaaaggtcagcacaggctggacgtggtggctcatgcctgtaacctatcactttgggaggtagacgggaggatcacttaagctgagttggtaccaccctggtttgaacatagtgagatggtgagcaagatgaaaggacatatgcgcttattaactgtcttgtaaatgaggttcatcatctacaagcatcaattcttatccctagcactggttaagtaacaaatccaataaattcccaagctccactcaattttacaacctttgaaggtacatttacagaaagatgcaactttcacaaggcagtagccatgattaggttaagccgtgattatcaggagcctcaaactgatctgctcaaggccgttattatgagtgggttccacagggtattccttaagaatacaatattataattatacaatatgtgatattaaatacaatttaatatacaatatttttttaatattgtatattaatatagaatttaatatgcaatattaaaaaaagaaacaagcaagagaaaatgaaattttataaatatcaaagaatctaactaaaggactaaaaacttttggctaagatataggcaaaattactcctgcttttagtattcttacctggtaccttttctcccaaatagactgataaagagcaataaaaacattagcatcacagtcttgaagttcatgtatttcagatgtatatgacacttaaaaagaaggttattggcaatggttacccactctgttgggaaaagggggaaagatcagtcttaaaaaccaccagaaaaaaatcacacagacatttaaaaatccaacaacctcccccccaacaaaaacagacactgaactttgcagaagataaggaattgattgttagagaatttcaaagaccctttaggcatggtttttaaaaagatgtatttaattcttgggatgatttccagagtgctgtaatttctacatagtcaaaactatactgcaaattcattgatactgttgcagcctaaaatcttaagttacttatataagccttacatgggtgttttagttaaaacatatttacaagtaaacaggaatattatgtcataaacaacagtttaatgaaatccgaggttaccagaaactcattaatggaggctgcttcgcacttgcaatagtattggcttgtgtttacccaattatcttgtgcaagtcagggtttctctggtgccggaaaaagtgggattaaacttaggctgttaagaactggtataataacaacatcaacggtaatgcatttgtagtttttcttttttattatatcgatctatatgaaagaaaatatgggaagtacatgaagccagaattatcaatactgttgacgtttcctgcgtaccacattctcctctcccctagatatgctgggatttgcaaagtttaacggtttctgtaccaaaagtaacttagcttaaaatacttttccttgaaatgcctgggaattggtaggaaagcactttcaatcggtattagaaacaaactctccactatgttctggacacgtaacgttctggaaacgaatgagagtgtattttccatgacataatccccctccccacgcccatttctcacagctggccaaaccatgacaactggttttacgcagtccttgtgaaaaggatgaaagcgtcctagacaaccaaattaattcgctcttcaaagcggtgctagacaaagcccatgactctagagggcactgaagagaaaaaagcacaacattctacaggggcatattctactattctgcaggggcataataaatcttaagaatgctgtcctttaaagaccaatacaaaagcaggtacgacctcagggcccatagtgcaagggcggaggcacacggacagcggctagacgccccacagaaagacaagtccggggacgacccttctgacgctctttttacagccaggacccaagtgtcctaccggcctcgccccagtgcctctctcttcccacagcatactgctgttccacggcctcgaagcgaagaggtggtgaagctgagagacctatccagggaacccgccagcgcgacgcggcgtctgaaggtcacgagccccgccgacagccagacccagtccgggctagcccgaggcctccctggaggtggacggtttcagtccacactactgggaccccagggagacactcaccagcatccgagcctgccatgtttcagaggcaggcgccgccggactccgacgcggccgggaaggcgacggtgtcctggaaggaccgatccacgagacccgacactggggcgcggacgcacgaaccaaagcgcggggaaggaggcgtgaaagaggacggacgttaaaagagcttctcgccgctgattggtcatcagaggagcacttcctttccaggacgtgaaacgggggcggtttgggaagtttagagaccattctccgccgaccaaaaccgtcaaaggattatcagacacgcgggtcggacggtccacatcagccggcagcccgggcggtcccggggtgcgagcagcgcacttccggtgagctatttcgttttgtatccctccgccgcgtcaacgggaaagtagtgcggaccgctctctcggtggtccggggtggtacagccacgtacaacgccaggccccgccttccccctcttttggttacagacgtgagggctctttggagagtaaacatctccgagtggcgagggtgggcggggctgggcttgggaaagggcggggtggctgcttgaggtgtggaaagaccagaagaaggtgaggtcaagagagtgcagaatgaggcatccaatggtgggtgggccctgacctgagagagtggcgcggggaggggtgaaagcgcggcgtcctggaacgccagcgggcgttgcggcctatgcgcgaggggcggggcgattaggtcataagcggctcccagcgttccctgcggcgtaggaggcggtccagactacaaaagcggctgccgaaagcggccggcacctcattcatttctaccggtctctagtagtgcagcttcggctggttcatcggtgtccttcctccgctgccgcccccgcaaggcttcgccgtcatcgaggccattccagcgacttgtcgcacgcttttctatatacttcgttccccgccaaccgcaaccattgagccatgtcgggttattcgagtgaccgagaccgcggccgggaccgagggtgagtttgggaccgagctgtcaggcctggcgggtggggggatgggagggcgggtcagggtggcggccggcggggctttgcggcttggacttggcctttccgggctatcttgggacttcctttcccgaagcttgcgccattttgatattcacgtcacagtgattggaagagatttgacggtgtagtgtctcaagcttgctttttgtgtggggattggggagctgtcggggcggctgccatttggtagcgttgagggagttgagagggagcgtattgtgcggatgaaagcgggacgcttcgaggcagagaaggaacatctgttaggtgcggcgtttcgggaggtgtttttggggtggccgggcattcgtgggagcgaggggaccacttccaaagccctggtgctgttggggtaggagggcggccggatcagccatgtggctgagtcgcgagtacaaaatgccggcctcggacatggcggcggcgctttgttaccccgcccggcggaggagctcaaaatggcagcgtcgagaaaatgtggcgcaggagaaatgcgagacaaagggggaagcgccgccccagcgggaacgccgcccggccgactcgcccgggccgggactcctcccccggtagtcgccggctcctccttttcttttttcctgcgtatataattttgattcgttgatccggagctctaccgcggcgttcccccagctgggtttgtagcagaagtgtttctgagaaaacccttgttctgttatcgctgactgtactgtttaggtcttaccactaaagctgtttggttccaaaacggccatatgagtaacatcgtcgtgatgctttcggttcatgtagccttgttattgctgatagtgaattgctaggctggtggggaagattcagtaaccacaagaagtggtgtgtgccagaatcccaaattctggcatgtgggtgacaagttccgacatgataaatccccggcttccgacatgataaatcccaggctgtttacatgaccaagtaatgtgtacttgggactacgggaaatgttaactgtggctgttgagagagagagagttttcacgaaggacagtgctaggtttacctctcgaagtctgttttcagtggtttttagctgtgccaatggatgacaaatctatacagaaacctgggtatagccatttgaaaatgtgaaaacgttttttttcattccaggtttggtgcacctcgatttggaggaagtagggcagggccttatctggaaagaagtttggaaaccctggggagaaattagttaaaaagaagtggaatctgatgagctgcctaaatttgagaagaatttttatcaagagcaccctgatttggctaggcgacagcagtgagtaaattcatgtggcttcatcaggctgtaactcgatcgtggattctagtaatgaaattctgacaggtgttttgcaaataactcaattttggtagagttacatgttctgcttcataattgggaaaggtgtgactcacttttggatataggtggctttgggatttttactaaattaggttgagtataacaataaattttttttttcataatagggtgttcataggtggtccagattaaaatgaaggctactttaaactagttactaaattatgaagttaggggcttacaattacgtatttagctaggggtggtgtcatgaattttaagactgttataatttgttttcagcaagaggtggaaacatacagaagaagcaaggaaattacagttagaggtcacaactgccgaagccagttctaaatttttatgaagccaatttccctggtaagtgctacttttcagtctacctacccgtgtttttgtttccacctaccccctctttttcttggcatcactaattttactaaatatctgttactaattatagcaaatgtcatggatgttattgcaagacagaatttactgaacccactgctattcaagctcagggatggccagttgctctaagtggattggatatgttggagtggcacagactggatctgggaaaacattgtctgtaagtttgggagaactcttagttgatctgatatatgcaagaaaatgtaatggtaatttaaaaacgagtattttaatgtatttctgtttgtccccactttcaccctaaatagtatttgcttcctgccattgtccacataatcatcagccattcctagagagaggcgatgggcctattgtaagtatatatttttactttattagaagcataatgtgtagattttagactacatagctaaagatgtaatcatttgtggggttttatatagaggttagctcatcctattcagctggagctgttttgggtattggacaaacatgaagaaaggatctgctagtataataagttagcagtttaaaactagtatccaggttgtgctgaaagctgtttctctttccttagtgtttggtgctggcaccaactcgggaactggccaacaggtgcagcaagtagctgctgaatattgtagagcatgtcgcttgaagtctactttatctacggtggtgctcctaagggaccacaaatacgtgatttggagagaggtatgtaataaaagggttttatttgtcattggtgctaaatatcctaggtattgtagttacacttacgttttaattaaaggtgtggaaatctgtattgcaacacctggaagactgattgactttttaggtgtggaaaaaccaatctgagaagaacaacctaccttgtccttgatgaagcagatagaagcttgatatgggctttgaaccccaaataaggaagattgtggatcaaataagagtaagtgcctttgaaatatgtgatcaaactgaattgtgttttcactcttaagagtctgatactaattttccccccaaaatccattagcctgataggcaaactctaatgtggagtgcgacttggccaaagaagtaagacagcttgctgaagatttcctgaaagactatattcatataaacattgggcacttgaactgagtgcaaaccacaacattcttcagattgtggatgtgtgtcatgacgtgaaaaggatgaaaagtaagttttattaactctgttatatttgcttcctaacaactttgcgtaaaattgagggatcattgtttggtgagttgttttaggttatttcagttggtgtgattcatttagttagcctactaatcctgaaaatttcttgaatccttcaaataatggctgtcacatttatagctttcctatagaaggaattcatgtgtcccctggttgacttaaggaccaaggtcgaactgctcgataagtggattagcaggcgtttcctctttgacttccagccatgtaaatgaacttaatgttttgctgaccataaatgtgtggccctagcaatggtcttttaaaactcggatttttcctttctctctcctattattagacttattcgtctaatggaagagatcatgatgagaaggagaataaaaccattgtttttgtggaaaccaaaagaagatgtgatgagcttacagaaaaatgaggagagatgggtatgtgtgagctcctccattgaagcagattgattaaacagcttaggaaagggcaaacttggatcacgagcagtggatttttttcatatctgatagtaatttaactttttcatttctggcgaaattaaagagatctgtgaccaaaagtggtcaagcctggagtctgaggttttcaatgtgagtttaataacacaacttgtcttttaacttaggtgcctgccatgggtatccatggtgacaagagtcaacaagagcgtgactgggttctaaatggaaatatttcaaatgaagtatttttcccccttacttaacctagctagaattctgctcagaaattgatcatgtatatgccttcctttgtagaattcaaacatggaaaagctcctattctgttgctacagatgtggcctccagagggctaggttagtacaaactcgcattcatggcttggttcccagaagatctccatttaacttttttaaagaaagtttattgctttctttaacctgcttttttctaagttttttttcacataaaggtgctgtctttgtggcaaggcctaggcatgaaatcggaggactcgagggggatggaggactagtgatcggctggctgcttccagtcgattgagaggtgaaaaagctgaacgtgtgccagtaatcttcaaaaggcagaacatatcacctcgccccgtaaactgttctctccgagggaaaaaatggaagttatcctcacagttcactgcctggtatttcttctgtcccatgctttgcatgactgccatggtacagccttgtttcaaactttcactgtgatctgtgggtctttgagtttcagtgagtttgctgaaatgtcgaagaagtattccaaacttcaatgttcaatgaaatttttgttcaagtttgaaatggagagagcagcttaaaaggtactaagccttttacaaattggtgagtactggcacatgagatctagagcaggacaacttctcacacatagtaagtgggaaaagaaagtgctttgaaagttcctccctcacctcacagtagtcgtcatgtcgagacctgccagagagagacacattctcaagtgaatcctggttcttggaagcgcttgcctagacgagacacagtgcataaaaacaacttttgggggacagtatgttttcttgcagctgcggttgtaaggtcttggcaagacaagcagtgtggccagaatttgaacttctgatgaatgtgtaatgcaaaggaccttgtacatttttttgtttcaaggtctcaaaatgagcacatgaagaggttgctgtgaaactttaagtggccctactgcgcagaagattcagatgtcacttgatgatctgtaagggaacttgctgatttgggaatgtgcttagggacacacattccttttgacagggtctgtcactgggtgggtgatgaattatacagatgacagtgcttttttttcttttttcaacctcaatggtattcctacaggaaatggataaccatttaactgtattttttgcagcccgtaccttcttgggaatac

SEQ ID NO: 5089 - DNA, 13961 bp, Homo sapiens
ctcatctacttctttctttggaaagtgctacaagatggagctgccagggcctcctagggagggaaaggttgcggatgacttagtggaaaagggaggtgttcatacaaaaggtgcagctggacaatctctttgacttgggtcctttgtccttatggggacagggacccttacatggagtgcaccctcatggcctgcatctctggccccattcggccatctgggctaggagaccaccaccacatgcacgctccctttaagcaaatgattcttctgccttttagagtgacgttcttgggctggcgttgaccttaggagtaacaacactcttggggtcaacagctttcaaactctatgctgtggctccaggattccaagttggttcttaaggagcagccccagtctctctccatccatcctgtaagaaccctccacagccccagccccaccttgatctttttctgtttttatattggtttctgcataaagatttgtttgaagatcaagttctgctattgaaagttgggcactctgccctgtacagttgattctgggactttagatagttaaagttgtgtttaaatgttgacaagaagctacttgatgttaaacatgcattcagttgcatataaattgtcacttactctctctgaagtccaaggacagaggggatgcagttgttgtattctgttactgttatctaagatgccaggagggcagggcatgtgaggtagaaggcataggtgtcagagactagtgggtgtgttcctacttaaattttttaacatagcacagattgcagggatattttatgtaaaacatccagctattcttgaaaaacagggttgatataatggcagcttgtgctgttatgtaagaaaagcgagcttaatggatcttcagacttgctcagtttatcttgccgataggagcaattctgacctacttggggatgaaagctggttttcacagcactcctttccccctgtggacactgtgctggatgggacgcatgccaggctgagcaaagctgagaccgcctcggctcgttgcctcagcacagcctatacctagagcctgcctggctgtctgtcggggagacctggcatggaggtccatggatcgggtaagagacagggtgaccactttgctatgtgagccaggagtgttattagagcatgtccagagagggagccaaggtcaaggcctgtcgagggtggacacccagtgacagttgctctgagctgggagcccagatttaaatccctagggcccgagagactgatgcgaagtgcagggaagccattgaccccaggagctgggaaaacaggtttctgtggacaggaggagggcgtccccacaaatgtcctgtgtgcgctccgcctgcacctgcctgttgtggatgtggggggaccccctcagttgatagggcctaggtggagggtacaactgctcccaggaagttttcttccacatagaagagccagagatgtgtttagtgtttctttataagtgcatagtgatgatttcttaacaagaaaatacaccctttgacatagtagtctttcagacttcactatggaaagttgaattaattaggattcatggtgttgacagtctatgggaaattatactatgaaaattcaatagtattttttttgtcagtgtgaatgtgagctaatttatgacctgggatatattctcactgaaattagccaaacggttagagcaatagcaagatttggtgttgattgattgtgggaattctgccaaatctcaacagccgtcctttggtggcagcagtagccatacattgcccctgaactcgtagcgtgagtctgggatgctgctgggcccctgactaggatgaggcagaaggaaaagcggcggggagccaccgagtgatgggcactatgggtgctttcctgagggtgggaagaggctgcgaggaaccatctttctcgtagtattgggagttcattctttattcctgtacatgtaatatattgtctcttgttaatcataaatcggaggattccaataggtcacctggggagtgaaggcagaggtcaccttctgggaagctcatgaaagaaaaccagaggccacgtgtgcttgtcaggcaggtctgtaggatccaggatgcagtctccatctcctccctgcctctctgagcatcggcagtgtggatgctgcagatacagagctgaattggatggcacagctccgtgcagaggccaggacaggctggaatggctaatggttgttgttgtcagagctcacccttgctgagtgctgctcacggctgcacaaccttccgagcatgcagcttgcattaacatatctaatctttaccacactgagggtcagagggctagttggtgaagccaagagtgggggcttggtcgccggctgtgaatctcttctgctgatgtgctgagctcagttcaggcagggactggattgacagaggcaggagacgagagcaccatgagtgtgtccaaagcagggtgcctggtgcaggagccaggatgcagagagggtagagagcagactgggagtgagttcactggctgtggcgtcacttgacctgtacaagcaggcgaggttgtctgttgggagtggacaacagtctggggagtggaggtgttgagagctggacagcttggaggagcttcccctggcaacaggtggttgttgggtgagcagtgtggtgtcccagtgatgtgtggacgccacactgttacggcctctgtgatttcagaggcatgcacatagcaggggcatggacgtgggccacaggcgagggagacagcaggccttgtgggtctagatggctaggagaggaagcaccatggatctgtgttgccctcgatgtcttaaatttggtgctgagttaaacatacattggctgtgactccactgtgctgagggaagggctggatacatgcaggaagagcaggagccagggagctgtagcggctgctagagaaaggagagtcctggccaccatcctgaagagctcaaggctttcaaagtttggtggaagttgagggtatgtcatgagaaatctaaagtcaaaccaaagaaagttatctaaagtccaaagagtcaaggccagggcctcaataaatgttgatggtttcccaggagaagccacagaaatgccggtgatgagagtgtttgaactggaccaagggaggcatggacgtttgggggatgggctgggaagtgaggggcaatggcagccgcagggctggagaacgctgtagccaggggtaccagtttccagagagaaatgagttttggtgaaagtgttctgaagtggagtgcaggaggcacaggctgccccttcccggcctctagcacacagctgcccctccagagaccccctgggacgggcctgtctgcccatgtgggtggggggggcctgacattggagcagggatcacacaggctcagtgtggtggacaggtagggatgtagctcaggaggatgagtccttggaaagaaagttgggagaggagcaaacggtggagacagggggggagaatgggtggtcacgggctggagggacctgcatttgttgaaagttggtggtgcatgttttcaaatcagaactttctaccagaagctatctgaatttagatgtcactttcattgtctctccttatgaggaggaacttcacaggaggccctgcgtgtcactttctgacctgcgtccaggtaatggcctcctcagaagccacaccctgatctgtctaggtggacagctttctttggcctggaaccctgcactagagggtgcagcatgtgatcacagtgtcggtttcattccgtgaccagtgcacagaagagagtgtcttctctctccttgaatgttgtgtgccccaggctccttgcagaaatcccctgtctacctggggtcagagcctgcctctgtccccagacgcttttataaaacctgagtgcatgtgcgagcctcgggctggttgccgttgctttctaaatatgccttgttaccatgtggtttctagcctgagaatgttcttactttttatttgttgagatcagttcatagcacataaatttaccattctaatcattttaaagtatacgatgcattgatttttgtacgttcacaaggttgtggaactgtcgccattatctaattccagaacatcttcatcacccaaaagaagccctgtactcattagcggtcactcccagttcctcctttcctcagcccctgcaaccacgaagctactttccttctctctgtttcccattccggacatctcactcactgggtcgtgcaatgagtggccttctgtgattcgcttctttcactcagcctgtgttccagctgattcctgttacgctccatcctttcatggctgtggtgtgccactgtgtggacacaccacatctgcctattcatttgttagctggtgtgcatttgggctcgtaacactttttgtctagtagaataacgttgcctgtgaacattcttgtctgtgttttggccctaggatattcttataccctaatctttcccactactttttgaaatttccacatcttttctcatccttctaattggttcccattctggaattttcttctgcctttagggagtcccaaataggagtggcactaaacatctgccaacctcctgtcccgcttgctattttcagagatattcgggaaactcaacaagtctttcttcattagctgcacagtggtcccttgaacgataattgaactgtgtgagtccacttaatgcagatttttttcagccaacacacagattgaaaatacggtgtatttaggatgagaaactgtgtatatggagagtccacttttcctatactcaggttcctcgaggtcgactgcaggattgagtatgtacagatttagtatactcacagggggtggtgggggactggggggtgctgggtcttggaaccaatcccccgcacatactaagggtggactggccagcctcctgcacagaatacaacccttcagggtgaaaaggcttgggggctttcaaaacactctgagccacagaactccttctggccaaacatcagcaaagcttcaaaagaccacgttgtttcaagaaaggttaatctaacagcctgcacaggctccatataatcaagacccattagcagggaacctgtagaaaagagagcgttctgagcctgcctgctcagtggctgccagctacgtaaacaagatctgaagacagtgggtgcctgttgccatatattcacaaaggcttatggcagcccgtttacaaagctgcatccacatgaagaaaatttgccctcagccaccgaaaaacaaaacaacaaaaaccccaacccacccaaatcaagcccaacccagaacaacatgaaaggaaacactccttttgaacataaactaatcctgctgcctctttccattagaaatggataaaggtaccttggccgttgctttcttgcacagttttgtgatgcagtggtctgattttaagatttgtatcctgtaggaggctggaccccctagccatatctagacatacagttagctacagtttggaaagaccccggtgctcggagagactcggacattcattgcgttgtattcactacttctaatctcttttcgtttgattgtattctttaaagcaaagtattttgtgataaattagtcactgcctttattgcagtgatacatcatttgcagaatggtaacaataatttcggttctcttgataggaaggtgggttagcaataccctttaaagaataccaaatttgatagaactttttgcacaataagtgcattatgttcatcataaaagagattgtttctcccaagggtgcgctgagttttaccttaacctcctgtagcgacatatgccaatgtggccatctcgggtgatttaaaagatttgttaccctctgcgtcacttatagcccaggtatgtcctgtctcccctggatggctgattggtgatttttaaaaggtttccattgtgctgtgggaacctgaaggcatcagaacgggcttttgcttgtttgctgttcatattctgttcatttaaagagtaaaagtgtgtggttggtattgtggcccatgttgagcaaagcaaagagtaagccactgtctgaagcccacctacgttgaatgtaatgaggctgagtgaaaaggatctgctacactgaacacagaacgtggaggtctgggctaaccacacaaaattgctgtgtgcagtgaacattcacgctgtactcttagccacatcccgcacaaaagacagaagacagctcccaggagatggagcatgtgtggcaaagattttccgcctggttactttgaaaaagcaaaaggaggctgaaactgtgctttgtaagctgcatgggttggtgctggctcctgacgtcagttcagaacactcaggagtgaaggcagaaacctggtgagggactcccaggagggcttctttctccacctttcagcctctggagttcaaatttcactcaacctgagtgcaccaaccccaccctcttatttacattgccctggcctttttggcggaatcaaagtccctacataccaaggagatcttttaccttctacactagtgggaggccaggtgcctgggagggaggtggacgcccccgccctcctctggcatgccactgtcctgctgtgaaagcctgtgtcaaggaaactgggctcagaggtgcagactgagagagccgctgggctgttttgaaggaaggtaagcaggagcatttgtgtgtgtgtgtgtgtgcgcgcgcgtgcatatgtgtatgtgtgtctgtgccgtgtggtgagtgtgtgtgtgcatgtgtgtggcttctgtaatgctacaaagacctgaaacgagctgtgtgcctgctgagatttaccaacttgccaagacttccagaggaaaagagctggactagccaggaggagagggcgttatggagtggaataatcagcagaacggatgctttaacgggcaagaaggaatgtcgctcaggacttgtccaggaatgcctttattggtttgcaagctgaggagtcttaacttactgacttctttttggggaagagtcagtgatggtctgacatgcttttgcaagctctctggccgcctctgtggccagccggcgtgggtggcctcagataaggccacaggacctcctcttttcctctgggcttgggcccctgtgttttcagttaggagtgcccaaagggaactgagctgcccagtcaggggcctgagataggcgcctgctgaatgctgagcctcaccggcgtgctggtgtgagaggtctgcccggggagccgccctggcctgccctgctgtcgtgcggctgtgggggcaccttggcggcgtctgtgacacgcctgccacagccccactcgggcacagtgctcctttatcgccacattccagagcctcacccaggagaccgcgggagcgctggaatctggcccagctcctgagtcgctcctgctctgcagtgggatgccttcccttcccaagaggcagtgtgtggctgggcaggcgtttctgtgtggaaggttctgctctggttcttgctttgttaattttttttctgctctatatttctctaagaatttacagtctgcctcatttttgaaagcgtgagcaagcagctcagctttacttcagagggagggattttccagcgccctccgcagtctcagcaaggtgtcctggtgctgccgctgcagcctctttcctgctgggcacctccctcctggcagctcagagggtgatttgggtttgggggcttgggaaggagttaactctcaggtgagactgatgcaccaagggagcaatgccttagaatggagttattctgcctaaggaggaaagagttgtccctacagagtagagtttattaccgtcttttattttttgtaaaaacaaaataaaaaaagaggaaaagggcacatttcatcgcgtcttgaaatatatcaaaatcataggtatctgatttagtagattaaaagcagtgttctcaaagacccaagtgtagtcctcatttttagctcttgaattttctgtggaatagaaaatgatttaataaaaactccaaaaatcattattagcaaagagtcagaattctattgtaataaaattaaagcagaccttgtttgagtgagggttatacatgctctaattataaatgtccacatggaaaaaacgagagtgatttttgcattgctatgggtaagataatacaacgccccttgagaaggaacctcttggctcagatatcgctcctgactgggaaggtctttcggtgtctgcagcccctaccaggcctccagggatcaggtcccttgggacactgcccgggctacccgtacctcccctcctcgcaaatgtgagaatgcccttgcttcattgttaaccccattcaaccctgccttgtgctctgggccacagcctagttttagccctcctggcttggtgatggactcttccatgcgccggagcctgaaatccaggcagtccttagcacctgtcctcaccagcactgaaacccccactggctgttccacattgtgcagcacagacccatcaactgaatggtctgctggaaaactcacaagtccagcgccggtgccatggtcatgtgtcagttgacctagcaaatccaggagaaatgttctctcactgctgaggggaggcatgtgatgcagtgatgggaaccctgggtgtgcatgacacaatctgccagaaaacccttgccctccccccatgaaacttggacatgcttcggtcccttgcaatccccctaaccttgtggttaagcagaggagaatccataccccttctgggtttggtttgagcctaatgagacaatagtacgaagtgcttggaagacagtggttgcccagttagcttattactgctgcttttgccacattgctgtcagtcaccgaggaaacaaacaaagtatgggatgggaaaactgttttacagtggtaagatcctgagctgggcagcttggccataaagtcgcactgggtggatggttagcaagttggtgcctgggacaatttcagtcatatcaaaaaatgacttagggaacttctgaatagtttttttaaacccatctttcaccatagctttatattagagaacagttcctcagtgtaatctcgagacgggaggtcagtggacctgcgttctgtgtactcactgattagatgttcatgagcactcctctgtccctcagctctgcacccagagggtccacacatgaatcacttgtgagtctgggaattcttcacttgaccagagagggggaaagcacagaaaggagggtttgcccaagcctgctgtgtgccatgccttttgtgttgaatcccagtggtcctgggagctgatatcagaaacacccccttctccaggttgcttctctgcagacaaggacagtgaggcacagaaaggcgagtgattcatctgaagtcacacagctatgatcaagccaggactcaagcctggattatgcagaacctctagaaggggagggaaggtgtgcacatgaatcactccaatggaaatgtcaaagacgctttatgtgacaatgaggcgcaaagggactatgatcgttatcccaaggagagaggtttccattgtctcatggaatttaggaagaggagggaaggcctttgaagagggggaggaggcatgggggagaaggagaaggagggaggggaggagggagaagaagaggaaagggaggagagaaggaggaggaaagggaggagggggaaaaagaggaagagggaaggaagggaggagacaagaggagccacctcaggttggggtctagtctgctgtgagtctcatttttgtcttgattcacaacggttgttttaactgagatgcaatttacatgcagtaaaatttgctctgtttagatatagtagtctgagtttgacaaacattatgccatgacactcccaccactatcaagacgaaatatttctattgcccaaaccatccctcacaccctttgcagccccactcttctcctggcccgaccacacccatttgtgtccagacacagtgtctccaccccagaatgtcacctatgtgagtcgtacagtcgagccctttgagtctggcagtgttcactcggcatagtccttgagaccctccaggagactgcctgcagatgagcactcgtttttgaaaccgaagcctctctgtcttagcattttccctgggctgtggttgtcagagcccaccatgggcacttgcagctgcagacacattccaataagcctccacttattgggactgtttggatatggtgaattgattcagctggcggccccaagtgagtcatttgagggtgacctagggacaggatggttcctggctgtgtctgagaagctacctgttccctgtggtggtccaggcacaggcaggacctctggcatatccatgctcctgaccccgatggggctgctggtaccatgggtgtgtgggagaactgaagactccagctaggaacagcacccgatccactaactgtgaggatagaaatgcactagctttaagaaaggaacaaaaactgtgaccatcactgcagcggctgtgacaccacaagggtctgttcctgaaatgaataattttaggagttagggaggaaagcacaaagcacttaatagtctctgaagaggagtgaggtgtatatgagtttgtgtgtgtgtgtgtgtgtgtgtgtgtgtcttgatctagtagttgatctgtgaaatataaaaagtgattgactaggattagaattttatctttttttgagtggagggaggttggtttaaatttcagatattctattcagtaggcttgtaaaaaaaatgttaatgttagtgcaggctctctcagcctctgatttctcatctgtaaaatggacttccctttcctgcttcacaggattgctttgggaattgagtaggatccctggggcctaacagtgtctgggcgcatgggaggagcttgcacggtggccttgtctttaggaggtcagctgagttgtagagaggggtgtttccagaattctctctgtttgtcaggtgatgaagatgccaattcctgagcctcacctggctcacctgagggtggctgcttcagcatcagtggatgcctttcttctccacactgctccgtctttcccttgcctctgttgatctgtctattcggatgccgtgaaatggcccaccaccctttccatctcttgtttctctctctgttccccaagggggcttgtccatttccagcacatcatcaggactgggctgaatattgcttttaagtccccgtttatgactagcatcatagcaagtgcttagtcaattctaaccaactttcatggagaagaattttctagttttcctttgaaactaaaaaattgcagggaggatactgttagttcttttgaaatgaaaaagtactttttaagcacacctgtcacaaaaatagaacatgagattcttagcatcaatacctagaaaaggaaaggttccacgtcgcttcataaatctatcagatttgtccttcctttgcttcaaccaacttctgttggaagcagggccagtggacagttcagtggattacacatcagtgatgatatttttggttgctgagtgattgatgatggagggtgctgaagtgtgagatcagctgtcctttggctatctgattgttagcatgccggggagcacagttgggcattgcctaatctgtttcaaccgggatggaagggatgttttcatatatttttttggtcttctccattttttgggtacttttgaaatactttctgagtgcctcttaaccctcttacctccttgtgggaaagccactttcagtagcagggttgggttggaaagagaaggatcccctgcagggaaggtgggtgaggagtctgttgctgcaagtcctccaaggagacaagaatgtatgctctgtattttcttcctttggtccttttccaggcgataaacctcactggtatgtcatgcagtgaaagtcattcagggtgtatttatgtttgttggatttttaactaagatctggccaccaggaaatcgttgccagaagtggacagcctcccttgggaggggaggtccttgatgctggttggctgggtctggtggcacgcaagggaaaggggacaccgaatgggatgatttaccctggactgagatgtggaaaggtctcctcctgcatccgcagctgaagagctatggcatccctgcaagttacttcctcccacctaagattaggttctgaatttgcagaatgagggttgattcagacttccccatgctcccttgagatggaagcaaaatgttaaaatatgttatttaatgatataaaaagatggaaggagcgacgagtggcaggaccccaccttttagaactctgtccttaccccaccacctcctcacagagtgtcagccctaatagcacatcaggtgccagagacagagtggagacttaaagccctgcgcctccctcatctggtgggggctcctcaccctgcctgctcctaggagctcatcagggcacaggaaccccacccacaacccatgtccaggaaccacaaatgggagtttagttggctatgcatttctgtggtctttctacatcacttttccaaaccagaaccatattatcagtagcatttctcatcagttaaggagggtattctttaatgatggatcagcgcctttgggggctgcaaaagcagggtgcgggctcctgtttggtttctcattggcgagactggcagtcagccatgcaggaccctgcttccacacctctgttaggtgtcttttctagtcatgattctctttttattgccttatcctgcagcttttgcattgagtcttagaaagcatagcaatggcagaaagtgtttaatgaggctctttcctatgtgcccagtgtagaggtagcagtttcataggtgagaagatagcgatacagaggtcagaagacagatatttacccagccctgccacttggagctgtgtgggttgagcaacgaaacgccagcctcacaggtggcaggaggataaaggagactggaaatggcaatagcatggtgccatttgcttgcagctgctgtttgccagggctctgtctcattaatcttgtgcccctggttccaagcacactgtggccagataatgttcaaatgttccctggatctctgcccatgcttcctgcttcatgggcaaatgggctaacctttaggtcatgacttttgtttttttggaatttagaacccttagattgggtgacttcagttatttttccagttgtgttcatttcagttggagaccagccaggtcagtagtgatggctgccctgctcccgcctctcacggatgctggacctggctgtgctgcctgggaagaggcccagagagtggggacacctgggttgcagtggccaagcgctgcacggctcttctaccttcagatccttgtgggctgtgtgtgtgtttgttttggttggtgattgttcttcgtttgcttgttttgcctgctaaggcagctgagctttcaaaatagctccccacattttgtcatgtgtgaaaaagctcaaacttttagcctgtcactaatattcaccgggtgtcagaggctgttcactaatgctagaaatgcaagggagagcaaaaaaagcaaactccctgccctcagtgagcctgagttccagtgggtaaaggtgcagttcttcgaatgcaagtatgtactgtggacaaaaactcagtgaggaaagggtggtagggcagcaccgttgaggaggtgagggagctgagatgcagagaaagacaaaagccaaggccacagggcagtgcatgcctgcagtggactgctaggaacagggcaggc

SEQ ID NO: 5090 - DNA, 14233 bp, Homo sapiens
tatctgcatgtacatattcacacagaagaagtcagggctttgcctttaaatataaaaagtgacatgataacaatattaatgtgagccttctagatttttatttcagcagtccccaggggggtcaacttcacattagcccacaaggagcacagagataacacagtgctgacttagtggtgctttcatcagacagtgtggtgagccagtgcccttgccaggaggccccacccactctgaaagtcaagtggagttgtgagactcctccaagggcacagtaataacagaggtagctcgccatacagaatgtgtcccctgatctttatgatttccttccatttcacagtcacattctatggtcactcttactgttacccccattttacaggcaaggaaattgacacgaagaagttgagagctagtaagtggcaaagtcagagtttcagctccatcagccgactccacagccatgggcgattatacagggctgatgtttcactttgtcttgtctaacctagaagtgacctaatgtcaaactaaaaagcacatggaaagtctcacagtcatggaataaccatgtaatttgtacatttggtaacccctatgaacctccacctccttatctaaaaatgcagactatagtacctgccatcacagccactgtgcagttttgaagtagtaggctttaggcatctgcagtaatgcttaactcgtatcatttaggcctagatactgatgtgcatataaatgacagtatttgctttaaaatacattagggagaggcttcacttcccggagggtgaattagacatacttttctctatttctctgctaagtacaacttaaaaccttggacagtaagtataagacaaatataagaaagctctgaagatggggagaaataggccagctagccatggacttcagggccaagggacccggtaggcttatttataatatctatgggccaggaaacaatcttcagaggactaaaagtaactgaacctgcagaacatgttctccaaccacaatggactcactagaaatcagtaacagaagggcaacggaacaccttcaacacttggaaactgaacagcacacttataaataatctatgggtcaaaaagaggtctcgagggaaatccaaaaacatactgaactgaatgaaaatgaggataaaatacaaaaattgtgagacatggctttatccactgctttaatacagccgcactgagaggaaatttgggcaagaagaaaattctgaaatgaatagtttatgctcttacctccataacctagaaaaggagaacaaactagacccaaggcaagcagaaggaaggagataataaaaatctaagcaaaatttaaaaagatacagagaagtaatagagaaaataaatgaaagaagtggttctttgaaagatcaataaaattgacaaacctctagcaagactaacaaaaaaatggaggacatagatactattgttaggaaggaaacaggcaccatcactaaagaccctgcagacaccaaaagaatatgaaggaatacacaaactactctacatgcatagtttttaaaacttaggttaaatagacagttccttaatgagcatgaactgtcacaactcacccaataggaaatagactacttgaatccctgtaactataaggaaattgacctagtaatttataatctcccaaaaaagaaatcttcggtttcactggataattctaccaaacatgtaaagaagaattaacactgattctacgcaaaccttccagaaaacagaagaggggggatcatgtcctaattcattttgtgaagctagtataccctgataccaaaaccaggcaaaaagaacagaaaaagaaaactacagaccaatatccccgcagattcagatacaaaactccttaacaaaacataaacaaatagaacacagcaatataaaaaagattgacacactgtagccaaatgggacatattctgagatgcaaggctggtttagatttgaaaattcattcatgtaatacactatactaacaggctaaagaaaaagctcacgacatatcagtcaatccaaaaaaagaataaaaagagtttggcaaaattcacatcattcatgatcaaaacttccagcaaaatagaagacaggtactccttcaaccttacaaaaagcatctaaaagccccacagctgacagcactctttttcaacatagttctggaagttctacagagacatatacaagaaaaggaaattaagacaacagatgagaggaaagaaataaaactgtcccttttgctggtgacatgatcatctacgtagaaagccccagggaatcttgagtctgctgctgacagattgtccaaacagaaaatcccagggaagaggcggagcttgcagtgagctgagattgcacactgcactccagcctgggcgacagtgtgagactctgtctcaaaaaaaaaaaaaagaaaaaaagaaaatcccagggaacaacaaaacaacaacaaaaagtgaaactgttagaacaaatcagccactttgcaggattctagttcgacacacaaaaactagttctatttcagtacgctacaatgcacctgtagaagctgaaattaaaaatataagtcacagcccggcggagtagctcagcctgtaatcccagcactttgggaggcaggggtgggcagatcacgaggtcaagagatcggaccatcctggccaacatggtgaaactctgtctgtactcaaaatacaaaaattagttggcgtggcagtgcgtgcctgtaatcccggctattcaggaggctgaggcaggagaatcacttaacccaggaggtggaggttacagtgagctgtgattgcaccactgcattccagcctggcgcgagctagactccgtctcaaaaaaaaaaaaaaaaaaaaaaaaaaatatatatatatataatatatatgtatatgcacacacacatatattcgtatgtatatatatacacacatatacaatatgtatacatatatttatgaaaaggacatagaggtggcatatgatcgcatatgtataatatatatatatatatatatatatgccacttataatagctcaaaaaaattaaatggttaatgtaaacctagcaaaccatgcacaagacttctgtgctgaaaactgcacaatgctgatgaggaaaccacagaatatttcaataagtggggagacatactgttttcatggatggaaaaccaacctagtagagctgtcacttctttccagattgacagacagttttaccacaattcctacaaaatctcagcaagatttttttgtagatatagacaacataattctaaaatttatgtggaaggctaaggaaccagaatagccaaaacaactttgagaaagaattaagtggaaggaatgggttacctaatttcaagacttattgtatagctacagtcatcaagactgtggtgtggatgaggaacagacacttaggttcatgaaacagagtagagaacccagaaacaggcctacacagtatgcccagctgatttttttgacaaaggtacagaagcaagtcggggaaggtcagcctttaacaaatgatgcgggggcacctgggcacccacaggcaaaacaatgaacagccaccaaagctcacactttatacaaaaattaacttaaaatggatgatggacttaaatgtaaaatgtaaacatagtattttttaaaatgggagaaaatctttgggatcactaggcaaagagttatgagttaggacaaaagcatgaaccataaaaggaaaagttgacaaattagactttataaaaattaacatttttgctatggaaagaacctgtgaagaggataaaaaagacaaactgcagagtagagaaaaggtttgcaaaccacatgtccaaaaaaaggaatatcatctagaatgtatataattctcaatactcagcagtaaagaacaaacaattcacttagaaaatgagccaaactattataaaaagtcgaaaaacaacagatgctggcaaagctgcagagaaaaagaacatgtatacacgttggagggaatgtgaattagttaagccactgtggaaagtagtttaaagatttctcaaaaactgaaaacagaactgccatttgacccagcagtcccattaccggatatacacccaaaaaaaaaaaatcattctaccaaaaagacgcatgcacttgtatgtttatcacagcacaattccaatagcaaagacatggactcaacctaggtgcccatcaacagtgaattggataaagaaatgtgggacatatacaccatcgaagtactccgcagacgtaaaaaaagaaccaaatcatgtctttgcaacaacatggatgcagctgtaggccattgtcctaagcaaattcagtatcccctaatttaaaataaaagttgaaattaaaaagaaaagccactgactaaattaaataaatggattttattcagtaggaaaaaaaattagaaaatggttcaaagaaaaaaagagacatgtcacgaagaggacgtagaggtggcttatgagcacgtgaaaagatgctcaacatcattagccatagcaaaatataaatttaaatcacacctatcagaatggctaaaataaaaaatagtgacaaatccaatactggtgagcatgtggaaaaactagaccccttatacgttgctggagggattgtaaaatggtacagctgctgtggaaaacaattttggcaatttcttaaaaatgaaaaacctcatctgccatgtgactcagtgattgcattcctgggcatttatcccaaagaaatagactttgttcacataaaacctgtacaggaactctttttactttaatagccccaaactgtagatgccttcaacaggccagtggttaaacaaattgtagtacctcaataccatggaacacttctcgcaataaaaataagtgaattattcatacacacaacaacccggatgggtctctagaacataggttgagtgagaaaagtcaaaacctgaagtctgtatagtgtatgattccatatatgtccactttttacatggcaaaattgtagacacagagaagagattcatgtctgctaatggttggaggggcaagagtagaaggggaatggagtagccaaaaaggcaacaggagattggcagaaagtggtggagtaagaggtcgggaaggtggagccaggccaggagccgttctctgtagttccagaaggtggtggtgtggcatccacatgcaatgtgaggtcattactgaacctcaggatgggaggtgactgctcagatttgcattttcacacatcactgtggctgctgcatgaagaacaggtgggatggacagtgggctggaacagaccaaatggtttcagaagagataggaggaaatagaacatttgtgtaggattcaggtggtgcaatcagctgaccttaacacagtggaattgggcctgactgctctttctaattgtattgcttttgtcattattgtttaaattaggttctggttcttgttaattagtatgcagttagtataacactatctccataaaattcctctgcagatgcattactaaaacataacttgatacctccttagtcagcataagccccatgtgttaagttttttccagacaaccaccaggataggtgtccaagagaaatagcccagttagttaaaggcttaaggacagattttattcaggattattgcaacaggagaaagtgctgggctcagccccaatgcagcaaagacagctggagatttatgaccgaggaatagagcaaaaggatctggtggatgaaagtcattaagaagggacatcaagggtaggggggttcttgctaaactggcctaacacgtttctgctacagacaggccagggacttagacacaaatggcgagggatgaggagcttgagacgtgtcaagggggattagatatcaagtgtgggggatgaaaagcaggattcttgctggactgagcttgccacggttggacgtggaaggccaatgttgaggcctagtggagaagagggttggaggagcctggctaaggtttggtcaaggagagtctgtcacaagatagacccatctgatccaggctaacgcaatagggtgaccaaatgcagcccgcacgcttctctgtgtttctctcaggtcctttgggcacttagtttataattttttattttctattttttatttttatgggtcatagtataggtgtgtatggagtacatgagatgttttgatacaggcatgcaatgtgtaaaatcacatcatggaaaacagggtattatgggcacttagtttagccataaggcttccgtgcaagtggcctgggagccagctggggccagcttctgccacaggcatccttcacccaccctctcacaaacaagcgattcttcaataaacaataaacagaatacacaaaaagcaaaccaaacatctctagatttattaatagatgggtgaattaaaggagtcttttccaaataatgtgacaacagaagccaagggggatgaatgcccaaagctggggcttgccagaacctgctggtaccagagctgattgctgaagtgtgaggaattttgtgagccagctgacagcacattggcagctgggatctgccagggcgggattgtttacaccacaggatttagcaaacgttatgaatcaaccctccatcggccccaagcttccctgacacaccaaacagtagaaattcactgcctttttttttttttttttaactctgcttggtgttagctaactagtcatgaagaatagaggctgaaggaccaaagagatctttctgcattttgacattcaaatatttggaaagattttccgcattcgcatttggattctagtcccattgccaggctcaagtaagctctgtgataacaacactcagtgttggaaactgctgtccgaagcatctctcagcagatagggaggcctaaaaggacacggagagtggtgtctggtgggtcctctcctgacatttcttctctctctggtcaaatgctggagcacacatatagtggctctgagacttcctatctgggtgagctcaggcagttctagggactctctgagccctagtttcatgtcctgtacaacagtagtcattcctactgcacatggttctgagaagattggaccagaacatgtagctctggctcctggcccagacctgatcaacactcgcaaatagtggacactgatgctgttaggagaacagagcatccatatgaagggcggttcctgagctggggagaccagtgacaactgtaagtctgggttcagagcatgagtcgggggacgagaaggcccctgggcatctggccctgggtggctgagccctgggaatcctgcttttcccaagatgtgcttgtgcccagtgtgctcatgttttaaatgccagcacctactccaggaaaatatgggtatttcaatatctgctcacattatgcatatttaaatatgaatttaaatactgttaattctcctagggatgtgttgtcatttaaaagaggttgtgattagcatgaaggactgggacaggagcaggagatggcagagcagctgtaggcactgatgtaatgcctccagctttatgggacgggcccaaccaggcttcacccatttggggccctcaagcgggagcgtcagtggcagcctcgccatcgtccgtctgttgaatgtattgccacatggccacattatgccccaggagcatgtgttggaggacagtatccttaggcttctcagaaattccacatgggagcctcaaatgacatgcttttcttgaaaacaaaaatatttgtaaaaatgtaacaatgggagtcgtttaattcaagtctcccctataagcaaaaatagataaaattatgaaatgtaagatgtaaattatttgtttcttagctgatccttaatcttgatgatattttcaaaacaaatgaataataaagactgagaaaaggtttcctttaaaaagtcgtggttctcgccaggcgcagtggctcatgcctgaatcccagcaccttaggaggccaaggcaggcggatcatgaggtcaagagatagagaccacctggccaacatggtgaaaccctgtctctactaaaaatgcaagaattagctgggcatggggcgcatgcctgtagttccagctactcgggaggctgaggcaggatttaaatactgtttgacccaggaggcggaggttgcatgagccgagatcgcaccactgtactgcagcctgacaacgagtgagactctgtcaaaaaaaaaaaaaaaaaaaagagtcgtggttctgatacatctcacttccaaactatttcataattttttaaaaatataaacacataacataaaagcatctattgaaggtgaacattgcaccagcattcagtagatttacggagtcatgagaccatcgcccctggtagttccagagcatccttatcctataacagctttacaagtggtattcagagggggttggggactttaggcttcagtgaaaaagattagcagttaatgttagtttacttcaagaggagcctttatatattttgcaacttctattttgtgttcagttcttctggagagtagggtgtagcattttaggggcctggcttccaagcatgcagcctcttctctgctgtcgattggaggtttgtgaagggctgggaggattgcctccatccaagtgccagtgcatgagactgatcaggagggtagcatgtgaagtggtcctcattggctcacaagaggggacacaggggtttggttggtctgtgcggacttcctggatttggtaggtttcaaagggtcatgatgtttgccacagggagaagaaaagggcagtaccagtggcactggtccttaccctctgtagctctatgatcttgaaagtttgcataacctctggaagcatcatttaaatctaagcaaaataagaatgtgtgtgcctgcatggtattgggggcagtcttaaaaatgaagatttcagcctatgaatatgctagtgtacaaaaatttgtcttaaaatttagttttttaattcagaatgcactttcttattgaaatatttcagagccccagggactgatagagagacacagcgtgagaagaggacaagaggaagacgagacagagagattattttgacacaatgctttatttttattgaaaaagctgtcatccttaaaaattgacagatacaatgcttttaccaatcttcttctttctttcctgtactcgactccttttctgttgaatttttatgagctctgaatgagaatgtttataatagggacaaaggcagtactgaatgtgaatatgtgtgacatttatagaggcccttgtttactttggattttctaagcctcaaaagcacatgcattcctatatggatttctccatgggtttatattcaggtacgaggcatatgtaagtgtgcataggaatagacatgcctggatacatgcctgtgatgtacttgcattccaattagtgccaaagaatgcacactggtgcatggtgaccccaaaaaactggtgggattagcaaacatcgcagcctcctccaacccctgccccagatgaacaacatgaaaaagaaagttgactgcttctaaattatatttaaaagtaaacatcagtgctgggttcgtggaggcagcctaaagtgctggcctgtgaatgtgcctttaggggtcttttgagatgagaacatgattcatttgagggtgatgaagctaaaaaaaaaaaaggtgttggctttctgtgctgacacccatccgcggagcaggccagcttggaagtgtccccatgtcagcctgcagacttctctacctgctgaatgttctcgtttgctcactttgggtttagaggaatctgcttttctaaatttattatcagctcattccattaccccctcctctcctggtggactgttcttgaccctcagcatgagaagttattctgaagtgctgctaacaggatttgatgctggccctggggcttggtgacaatgtggctctggtcctgcccgtctgtagctctgtgatcttgaacagtttgcataacctcgaaagcatcttttaaatctaagtaaaataagaatatgtgtgccatgcatggtgttggggaagtctcttaaaaatgaaaatttcagcctgtgaatacggtagtgtaacaaaaatttgtctaaaatttcattttttaaattcaaaatgcacttccttattcaagcattttctgagccccttgtctatgagaattgtgctccatcccgggattgaggaagggaggcggtcctggccctgggcagctctcgggctggggtcccttctgaagcagcctgtggctggtgtggaatccggaaccacagctcgggcctgagcctgggcttgtctcctcctcgctgctttgaacaggaaaaggagttcagcccagcaggatgcctcttagaactgggaatggcttggaagaaaatgcttatgagccccagcatataaaatgtgcaaggatgtttccctgctggaagcatttacctggtatccttgcatttttactttcctccgaaggccctcaccttgtaatccacctccccacagttcctcccctctagacagcagcctgcctcacagtggtgtcccaagagcactgggcgtcaagagtaaaatgcctgggcattttctctgaagcacctgttaccactgtcccttcaggctgtgatcctggccaaaatgcacccattctttttgacacacttgggagggtctgggattgtgagactgcagaagggtcagatgtcttgagtcactgagagggctgaagaaggaatatgtagtctgttcttgacatttgttactggcccgggcctgccccatcagagcctttgagggcattaccaggtgccccccagattagtgtacctcctcaacagataggcattggccaggctgtcctactaggccaggaaccaccttgttgtctgtttaaattctatcacattttagtgacacacatattagacatgttatatggtacatatgtgtgttatgtgtgcaggtatttatggctctgcctaattgaggcatttgccactttctgagcacttcttacaggccatgcacttatatatgcacaatgtagagaaagagcaaatgaacaagtttacaaaaaatcctgaaagccaggcaagtgagattccatcatttggaatgaaagtaaacttttctgatgcttcagggccaaccaagtgtgcatgggcgtcagaggtcaggtctccatgtgtcacctggcagagggatggtgtgagcagctactggaatttgatttttccagaggagcatgagattgggttactgtgaagtcccagtgtcctgaggttgtggagggtttgtgttttgtgtttgtttttaattccttctccgcaatgcccagtgagcactccacttgagtctcaagaaccccagagtagagctcgccctggggtgctggcagcacgtaattctcaggaacaaacaagtacattcgaataaagctgaggatctcagtctcagtgcctggtccctcggaggcattctagtatccctcttagttttgttttattggggcaagcctgttgctgaaaacagaacctgtgggtcaccctgactatccttcccaggccttcgaaactgccttgcatgtagtagagagactcacagtttgcaggagtggcaccgtctttgaggagctttcacataaagcatctgaagttcctttgctaagtcatgtgcccagtcctcaaaggacctgcagatcacctgatcgctgggagtagggctggtccagggttcctcttattgtgtgacacataaggttcgcccgagtccggtgggacagagatgtgggaggtgatgggatgcagccctgtaggacccgtgaggctggtggacaggcagtgcgggctggtgggagggtgttaaggagaattccatccagctgatcaggtcgtgtctcaggaaggacgtgccccctatggaggctcgagacctttaaacttgctcatcccttcccgtgtgtcttctctgggcgccccagctcctccttctccttggtttaatgccccttttctcacctccctctggcaaccaagtctgcttgttcttcctccgaaagggaaactcctgttgccccttctctccctctgttcctcctctccctcttgcttcaccttccctccgtccttttgtttctgctgcctcgctctcacctgcatttgaggatgtgacttcccagtgggacctgggttgggatttggtgtcaccctccctccctcagctcaggacatttccagagcagagtcttcatcacactcctggcatctaacacagagaaggactggataaaagtttgttttgttttctgatgggtaagtggaaggagagagacagtctctcgctccagggagctgagtgcatcatgcctgcaaagggcctgagcccgcagagtgggagctcgtgagaccagcacctgtgtttctgagaggagacctggcattgccggctggtggggtggctgtcctcttccaggtgtctgatttgcacccctgcttgattttgctaaggtgcagtgggggtcctggctgtagcagagtcaacatgtggacagtccaggtcctgtcctccccggggattctgggtgtttgggtggggggagcagactgtccgggaagaatttttaaatgttttttcccagtggacttgctgccacctggagcccacctttgaaatcactttagtccctggcactgcgctgaggagaaagaagcaagagaggaaagataaacagatctccagaagatgcttaaatcgtagattcacactcaggattgtcccagtcatggctgtgacacgggcacagaagcagcatccctgcctcctcctccctgctgcccatccctgtgggtttgctccgagtcactgagcccaagttccacggagggaatgggacccacccttgggagtgccatcctggtcacagtcaccctcctgggcctggctgccccatgctggtgccgccccgtgccgccttcctctctgcttgggggtgacaggcacgggaaaggccagtccatccgcttccgctgagcctgctctgtccgtggtaggcatttccgacagcatcatttgcaggagctgctgctctgcaacacataaacaaccaggaggaaatgcctactcagacctttgggaggaaggtcccagggatcttcctggcccatgtcggagcggtggccctgagggtcccaggcaagccgtgtccctcttggggtagggcattgactgcccactcttcacaggttgatgagtgtgccagggtcgtgcaggggctggaccggccatggctcggctcaggctgggcagcaagctgtgctggaagcacaggcgtgcacaggggctgaagaaaggaggcagcccaggaggaacggggacctgctcttccagggagagctttctagggaaggggtgacacaccagcatttgaagagggagtgggattttgccagacacaagagacagagaagccaggagtgagtgtctgttctgtgcttccccttgtgaaaaccctgagtaatgtccgtgtctctaaggcccagacacatgacaggcccctatgttctgccatgtggactgggtatagtcagatttcgggtcacgggaacagagcactttgacttgactgagggagatggtgtccaaatgctgaaaaaaatgtggggtcacttgaaaagggctttgtagaatgtataggagttttcagcagttggcttaggagtttggccttttagatgagagaagcatatgagcaaagaaatggaagaaaggggacacagtgcgtagaggctgccaacagcctacagtaggtgccagccggcagaacaggctgagggatccagaatcaggctctaggacagggtttgggcaggatgtttagcccattggggcccggaagaaaacctgcagggtttgagcagtgcagtgacagggtggatttgcattggaaggtcccctgggctgccttgaggagtgaaaggcttccagcctggtggcaggccagatgagaggcagatggccccatccagaggaaagggacatgggtgtaggctccgccggggtgggggg

SEQ ID NO: 5091 - DNA, 100000 bp, Homo sapiens
gtcagtcaggtagctgcaaagggctttacgtttccagtggactgctgccaagtggacataaacatttgaatagacattcccttctccaattcataattgtttttatttattaattattttattttatttgaggcggaatctcactctgttcaggctggagtgcagtggtgagatctcgctcaatacaacttctgcccctgggttcaagcaattctcatgcctcagtctcctgagtactgggattacaggtgttcaccaccaggcccagttaatttttgtgtttgtagtagagacaggtttcaccatgttggccagactggtctcgaactcctgacctcaagtgatcctcctgcccagcctcccaaagtgctgggactacaggcatgagccactgcgcccggcccacaaagcaaaccacagagccctaagccaatgatctagctgctttggtctatatttctgtgagtaccccaaggcaccagaccctgtgggaccagcggtcactctcaggccagggcgcctctcaaggctgttgcactcactcccctctccagccaatctccaaggcccgcccaggctgacggcacctccaaacagccgtggtttgccaagttctccttatgcctcaggcactgtgctaagagcttcagagggcaatctcgcccagttctcataaagtccatgtggctttagttttaataccctcatttacaggttagaaaactgaggcttgcagaggtgtttgtgatgcagctccaggattcttataaaatctacctgaatttaaaggatccaagtttagccattccaccatctggccccctccgcatgtttctccagcctaagctcttggcagcctcctgtgggctctctctcaccacctgttttgtcccctctggccatctccttgcattgcctggcacaggctcaagcactgccccctccaccgacaccaagctcttacagggcttcccgctttgcacctgcagcctgcccctcctcccccacatggctccaggaaggtctgcctggcagactcctgattctcaggcagcccctgcaagagccctccccaggctccctctcctgttcccttatagctattgggagacatctgtcatatgtcatcagagtatcactgctttccaagaaaggccttcctactgggcaaagaatgggcgatttctaccaagctgagtgatccccatcattggagtcagtcaagcatgtgttaggggtgtgaaggggccattgactgaaggttcttgcagtcggaaaaatctggaatctcagatccaccagagtaaccaatgttgacttcattcaggctctgtttttttactgcagtgatcctagagcagagggccatggggctggcacagggcacgaagtccctgtaggtatgttaagaagaaggcatgggccgggcgcggtggctcatgcctgtaatcccagcactttgggaggccgaggtggcagatcacctaaagttgggaattcaagaccagtctgaccaacatggagaaaccccgtcctactgaaaatacaaaaattagccgggcgtggtggcacatgcctgtaatcctagctactaggaggatgaggcaggagaattgcttgaacctgggaggcggagattgtggtgagccaagttgcgccattgcactccagcctgggcaacaagagcaaaactctgtctacaaaaaaaaaaaaaaaaagaagaagaagaagaagaaaaagaaactgaatctgcatccatgcagtgggcatcacaaagtgggctcccagggtccatgtttgtagaagttggtgtgcaggtgcagtttttgaaacaaggtgctgtattagggttctccagagaaacagatccaatagggcatatgcagattatagaagaaatttaattaattaattaattcatttatttttgagacagagtctcactcttcgcccaggctggagtgcagtggcgcattctcggctcactgcaagctccacctcccgggtcacgccattctcttgcctcagcctcccgagtagctgggactacaggcgcctgccaccagcctggctaattttttttttgttttgtattttttagtagagacagggttttaccgtgttgccaggatggtctcgatctcctgacctcgtgatctgcccgcctcggcctcccaaattgcgggattacaggcgtgagccactgcacctggcctagaagaaatttattataggaattggccacacaattatggctcacacaactatgtctgcaaactgaagacccaggaaagttggtgggtaattgccagtctgagtccaaaggcctgaaaaccaggagcactgatatttgagggcaaagaaaatgaatgttccagctcaagaaggaagaggaagaactcaccctttttctgccttttgttctacttgggcccttgaaggactggatggtgcccacccacactggtgaggatggattgctttactcagtctacccattcaaacgctaagctcttccagaaacacgctacccacaccccagaaatcacattttaccagctatctgggcaacccttagcccaatcaagttgacatcgacatgagccatcacaaacaccaaggttatgtaaattccgaaaaggttctgagacacggaaagctcaggtgcctctagccaggcctggcaactgtaaagcccactttgttgagctgtagtgaggattcgtgtgtttgggaagagaaaaaggaagagaggaaagggccaggtgttctataagagtctcaagggacttagtatctttttttttttttttttgagacagagtcttgctcgtcacccagactgcagtgcagtggtgcgatctcagctcactgcaacctccgcctcctggttcaagcgattctcctgtctcagcctcctgagtagctgaaactacaggtgcgtgccaccctcccagctaatttttgtatttttagtagagacggggtttcaccatattggccaggatgtctcgatctcttgaccttgtgatctgccctcctcggcctcccaaagtgctgggattatagtgtgagccactgcgcccggccgagactcagtatcttaaggcaaaacacaggcatttgccatgttccaactccacagttctctgaatgcgctgtagagctttgtaactccatcctgtgaatgtttcctgctgtctctttcagttggtctttgggaaatattttcagtgacagaaagtagaaataaggaaaaatatccaagtccttgctcatatacctcccttgatctagggatacaattcagatttttgcggtggcaaagacaatcttcattgcaatgacaagcttccaacacatttctaaaactcctacaggggaggagcaagaatgagtctgcaaagaagggctcagggaggaggagattggcgggagtttcttgcccagactcccctgccctctgcttggcatactaggaggagaggccactcttggcatattgctgctttttttttttttcagctaaatgttggagactttgttttcaaagttgagttttttttggatggctaaggatggaaaaaatgcacattcccttttcagatactggttcatgccctgtttttgtttaatttcttggaaacttgaagttgcacctgcgaagtggggaggccctgggctggggaagcgaagctctggaaggggcccaggtccgattggggatccagagaggcttcccttcatgtgcctctagacgaggtgtggggaacccgggaacagccatcccagccaacacagagtgcgtggggatactggagcccggtttttcttccctttcttgggacactgccagggaatataaccacagacactgcacgaatgagcacccaatcacagtttttctagaaacaaaggtgtggttggggcatcccattccattgctaccccaaaagggcagtgtggccggtggggccatctggcttgggtgtgggtagcagtttggagagatttagaagaggctccctgacaaagggtcagagaaccccagcactgcactgagttttcctgctgtgagctctcagacaaacaacagtgtcacctcctgtaaatgggtgccctaacactgcagaagctcaaattcatgttgtcattcagccaacatggtttttggcattatgatggtttcgtgatgcacagaatagcacgtaattggctctgggtgtgaagatcaccacggtcttaatgaagagagggttgagcaaagtgatgatttagtccaattgcacagagtggatggtgtgggcggcagctgggaagaagttaagagtagcctcaaggccagatagtcctgatccctcccacttcttcgcctgaccaggtgggtgaccttgaacaagttgcctagaatgtcagatcctgtttcttatcaggacaaaggagatcgtaacagtaccagcctcacccccattcctaacccagctgctgtgacctcctccccaccttcccctatggcatcttccctggcaccccttgactcatccattgactcttgacctggtgtctcctagagtgtaggaaaaatgcctgcctcatctctagggctggggcatggtgctcatgaagcctttgcctgggaataaatacccagatcagtctgggatgagaaatgacactaccttccagagcacagcaggggttgttcaagtcttccagaaaacagctcttgtttctcctcatgtggtgggagtggagtcagagcgtggctcaggccccacatctcagctgtttggatctggggactcgaagtttctggtggttacttctgaaagtcttttcaggataattattcttgctcggtttctctgccatctctgacaggctgttttccctgcttccccgctgccctgaaggggccagaggaacagggcaggaccccagggctgcggatgggttggcagctctgttcccgaatccaaagcagttcttggtgactgtcctccaagacttgccctgaccctgctccgggtgggattctgagaccgcctgctccacgtggcagatgaaatctaggctcttctgtgagaggctggcggggaggatgttttcctggaaaggaccacaggacaaaccctgatgaaatttctcttgtgacctccctggaggaagagcacttctgatttctgcaaacttttccattcccccgatctcacaaatggggaaactgaggctaagcgactgagttcagggcatctgaatctcagggatggacagtcaggatggacaacctataggcctttcctcctctgaaatctctctgctcgggatcgtttttctggtttcccctggcttgcctaaattctgctcattgtcccggcgcattttaagaagtcatgtgacttctaaagacttccctgacctcctccctcattagctgggtatttcaggggcttctacggcaccctaggctttccggagcggctgtgccctttatgtatgcgcgactcccactaggctatgagctacaggagggagggtaggtcttgtcccggagagcaccttaatcacaggcgctgaatgaaagaatgaactggttgtgcaggaacaggatccgaacccgcctccccaggtactctaacaccggcccggcggaacctgcaagccccagaccacttggagcctgggctgctcaatgggtctgataattccaggtcctctctgcgccagcgaagggaggtcccagggcgcacctcggcagggcgggggaccccggtgaagggcgctggaggcgcgctgcattgttagggtgatgaggccaggtgacccgccaggctcggggcggggcgcgggggccggccgtggcgattgcccgcgccgcctcgagggggccctgccgcggggccggcagccagccaggaggacgggcccgcccgcgcgctactcggagcccagcctcgttcggccatcgccctgccggaccgcgcctcaggctcccccaggtactggggccggggaaggggaaacgcggccacgcgccgcggtcctctttgtttcgggcccggcgcgggctttcgcgcccgggcgcaggaacgaggcttggggagcacagagatctggagctggggcgcggggactggttcggggagcgcggagacagagttcggggagcgcggggtacgggagctcagggcgcgggatggggtcacgggagaacccaggttagggagcgcggggacccggttgggggcgcacggcaaggggtttggtgcgcgcgggtacggggtttgcggcgcgtggggggcgggggctcggcggagtcccaggacaggggctggggcgcgggccagcttcgccggagtccggggacggggggctgactggctgggtttggggactggctggggcgcaggaccactcgagtgggacccgtgcgcccgggcgccctggactgagggcagagaccggagcagctatgtcgcagtcgctgtcggaccgagcggactttgctccctaggactccgtctcgagactccaggtggagagcgcagcaggggcttcaatgggcaggctcaagacccttctcctactttttctaggcaagctctccatgcgtctctttccctttccctttggtgggtgggaggcagggggtctttacgcgcttccttttttccctgaaggacgggacctcggggtggggggatattctggggtggggggtgctgtccaggctgggggccagctgtgtggcatgtgcctcctggcacgcgggagctgtcgctgacagcaggaggagggagggtcccggacggcccaggggtctcagtgtcggtgctgtgcagcgcctgacatgtgagtcccgggtcctttgcttggagtgatttgagtgtctgtggcgggaaggattcaggcgttcctcaggcattctccagacagtgtcagcagatgacccgaactccagctggttgaaaaactcaaagcgccatcagggtgtggggccagcagagagcactactgagggggtcacaaccccctgggaagcccccaggcttccttggggcgcattcacacactttgatctccgggttggctttccccccatttttttcactatttgaatgcatgatcatggaggactcgaaaatatactgaaaagtatgaatgcagaactcattgtattaatattgcatggcccttcgaactaaccaaccctttgacattttagattttcttgaggctttggtctgtgcatattaatttttaaattgctttcatgctttcccttttgaatgaggtttacttgttctggtgattctgttcttctctctttggggcctgtgaggttatatttgcaaatcaatcaacaagtattaagaaggcttttctgtgctgaggccttgagggccagggagggggtggggagtcgctgcagctgagggtggaggggcaaggccattacacagagatggaggtgcactgggtcctggtggggggtggtagcacagggggtggggggtgtgtacacagggaattgacaggaggaactggcagcagcccgactcctgaccttaggaatagtaatggtgaccccgaagacaaagtaacaggcatccgattgagtgtttgcctgtgctaaatgctttgcatgcattcatttcatttcacccaaatacattccttggagggagttgggattatgattaccccattttacagacgagtaaactgagcaaaggaaggctaagtaacttggccgagatgaaatgaaacatggtggtagtgcagcctggattctgggacaggactctagggtcccagacccctgttcctggctgctgctgcgcgtcgtcgactgaattctaatgcatgtccagacagcgattcctcagctgaggctgccatagcttcagcagctcagctgaattatgtctttaaaaaactaccaagatagaaaaactagtagcccagggcactacttattcctgaatgcaaattgattttttttttttttaacaaagtgtctcttggcacctaatgttttgaaagtgagctgtttgcaaatgtgactctggaaataaagggcggagagggggtgtcaaagtatgctcttccactgcaggaggtgttgctgaaggggatagcgagacctgaggaggaggcagtatggcaagaacagtgagtggaagggctgacctaccattggcagtcgcagcttatatctgcttaggactctacacaaggacccattttacagatgagtaaataccaagtaaattcttaaagtctgggaacagttagggatctgaatgagcccagttcctgactctgtgtgccccattcctttcttaagatcagcctgttgtaaaccacccctgttcggggaagcctcttgttccctccctgtgtccctgtgtatgaacttgagagggggaggaacttccaccttcctgagggcagaaagcattgtttagatccctgccacttactaggaagccaagacatttgctgagtgcctcagcagcacgcttagaattgaggcttcgaggcttcctcacgcggcccccatagatttcccagggaggggcctcctgtcttgcgggttgatctggtgggttgccccatgcagcaggagctatcatgggaagggtgggtctgggcgtctgaagctctccagaggtcagctgaccctgggaccccgggtccttcctgtaggaccccagaaatcactggggatcagctaacccctgcaagctgtgcctggaatgacctagagccagtcctgtctacctagatcctctgctgctatccttgttgatctagaatgagggatgctggttagttggttaattagtaggtggttgattaacttagttactctcttcctcacagcaagagtattaaaaaccatccaacatggaacacagttctttctttctgcccccacagtgaagggcgtgttgcgtggcttatcttcacagggatcatggctcacagttgtgtcgtttccacgctgcctcactgctcctaaacgctgagacaagaaaaatcgctgccaccaaaatgctgctgagcaggactaaattctctagattgagggcgttttgaatcttagagtatgttgaatccggatgcaggcccgtgtcctccgtggggcttttcgagtgcagctcgggcaggaacagtggtttccttgatgtctatccgttctcgtaaaagcagaaaactagactctccaagtttcgtgagctttctgtttgtactcttgactcaggaatgtgtttggtacacatccatcactgcaatgtgggatgtagtgctgagccagggtccctcgggtgtctccattgtctgcatggcggcatctcctgtcctgctcagtgtctccaggagcaccgtggccctctagacacacctctaaccaccgcccccccccaacccccgccccatgcacctggcgcagctctacctggtatccctcacctgttgcctcctaccctcgtgggagttgcctctgcgaaacaggagggaggaggccagtgaaaatgagggtgactgaggtgggggccatcaacttggggatgaagcactgcacacaatttagggtccctcggaatgcccactgtgtcagggaaggggaggattctcacatgcttctttttatttttttatttttattttttgagatggagtcttgctggagtccaggctggagtccagtcgggccatctcagctcatgcaatctctgcctcctgggttcaagcaattctgcctcagcctcccaagtagctgggatacaggcgcataccaccatgcccagctaatttttgtatttttagtagagatggggtttcacttgttggctaggctggtctcgaactcctgacctcaggtgatccacctgcctcggcctccaaagcgtggggttacaggcgtgagccactgtgcccggccgatttttttttttttttagaggcagtagtctactactcttttgtctcctgggcaaaatgaatgaaagattatactgaagattctatgtctgtgatctagaaaattccctctggcagagggaggtgctcccagagctaggaagtgctcctcagagccacccctcaggggagagacctctctgtccctgtctccacccagcgctgggcaggaagccctgggagccctctgcaaacagcccgccagctctcagcctaaaacgcggctaacaagacccccttccttttactactcaagtatccaaggtggcttgggcatttctgtccctagtctgatcgttgctgaaccgtgcatgtatgccatcctgatggtctccttttctggaagagagcgctgagacttagcgagctcaagtaacttgtgtgtgttgtgaggtactgagccttggatctgaatcccggtccgtcagcaatgcttggagttcttgccaagataggggtttgtgcagtccccacccacagcccagcccctggagtggccaggccaaggctcagagctgcggcgtgcctgctgtctacctcaaccagtgcgccagccccagctgcttcctcgaccccaaggctgggcctttctttactcttccttcctccctcagctctaattatggttcagttagattgtctgcccttcctcttcctcttctcttttggggaaagataatagcacttaaacgccctttgcaggcctggctttgtttctaagatatcagaagaatctttaggaatctttttccagctgcccaagcgagcggcaacctgtcggcacccaggaaggatgaatacgggtgcctgctgacgattacaagtgccactcctagccaggccatgcccctggggacaccggggaccctccaggtggactaaagtgtgtcacctcctttcattgtgtcttggcagccacagtgtgcgtggcacctcttgtgtgtagagtttatgaaactgctcctgaaaagtagagaccaattcttgatgctttgaatacactggaatacactcgtggcgatactgaaagaaagaaagtcctcggaagtgtctggccaaggccgttcactgccgtctgcagttgcttttctttttacaggaggcccgggctctgctccaggccctgggattatttctcgctggaggattcaggaatctgcgtctccccatcaccctggaacacagctgcagtgtgtaacatttcactcacttggagccaccaataaaaggcacaggcccacatctggctgtgcagggcaggcgggcaggagagtgggcctggggcacactgggccattagcaggggcatctgcgtcctggcctgtgcacattcctcccggagcgccgggctggctctgcaaacaaaggggcctggtcctggcattcttctccacctttaatccatcacctttcttagaggtgtccctgggcgcctacccctttcatcactggccattgggaggtagatcaaaggtacgcacaggaggcagtgacataggccaggctctggcatccacaaacctggggcagaactgtcctttgtcctgagaggtcctggggttattgtgactgtgttgtcatttgtcacctgcagcctggggttgtcgttcctccacaggtttgctcctccactgttccggagctcaggggtgggagccacgtggggttttgtttcctccttttgggctccagcccagtgtactttggtcctgctgaatttccatggccccaggggcctgaaaagcaccttgggtccttctggagaaccacttcctcattcttggaggtgctaatctgatccactgggaggagctgtgtgctaagtggttgacacaggggaggccagcgtgatagagatgagtttttctcaaagatcaaggacaggtgtttccagtttgtctcctctggaaagacctgcagagccgggtgacagggctggaggaaagggggcctgtgtccatgtcttgggtaggtgctaagggagacagagggctctacgtgggtgaagaatgcatttctctcttgtcctgcacgcaggagggaggccattttttatctgtattactcggagagtagcagaagactctcaagtaatgagcatattttgctgctttttttttttttttttttttttgaggcagagtctcactctgtcacccaggctgagtgtagtggtacaatctcagcttactgcaagatctgcctcccgggttcacgccattccctgcctcagcctcccaagtagctgggactacaggcgcctgccactacgcctggctgccggctaattttttgtatttttagtagagacggggtttcaccatgttagccagaatggtctgatctcctgacctcatgatccgccctcctcggcctcccaaagtgctgggattacaggcggagccaccgcgcccggccgtatctttgcttcttaatttgctttttgactatttttctacaaatagttttcttgtaatatgtgctcattgtagacttggaaaagatagagaaatgctaagaaaaaggaaaaaattccttctaatatcacctccacagaggttcatattttagccttctgtgtgccatatgttttctgtgcttttttaatttaccaagctgagatcataccatatgtatattttgtatcctgcattttaaagtcaatgtggcagtataagcatttcccaatccagaatagctctgcataaatatgactgctgatgacagtatagtactccagtatgtggatgtacctgatatttggacttcactatttgttcattgatcatttacatcctgtgttatgcttgcactaggtctttgggcagatcgtagctagtcatgctcttgaaaggatttctagcagactcttggcatcaaagaatacaaacatctttttttttaagctttggtaaaacatgcataacatgactttgtcgttttaatcatgtttaactgcggcagttaggcgacattaagaaccttcacgtgtgcaaccatcaccaccctccagctccagaactctttccattttgcagaactgaaactcgtgtcccttaagcactaactccccatgttcccctccccccagtccctggcaaccaccatctactttctgtccctgtgaaacggactacatcgggtgcctcatacaagtggaatcatacgtatttgtattttttgtgatttgtttatttcacttagaatactgtactcaaggtttcatcatgttgtagcatgtgtcacgatttctctctttttaaggctgaataataccgtgtgtgtggggtgtgtgtgtgtgtgtgtgtgtgtgtctgtatgaatagcacattttgtttatccatcatctgttgatacacttcagttacttctacccttcggctgttgtgaataatgctgctatgacatgggtgtataagtccctgctttccattttttttttggtgaacacaagctttttggactccttagtatatatggtcaaattgcagttgagacatagggtgctggctggattctcaggtgtccacccgctgtccttaaacatggctaggttatcacccccagggtaaaaaccaggctgcaggaaaaggaagagggagacttcttaccaagctattttgacagattgtgtaaacttgtgattaatgggatgagaaagcaggaagaatgtctttcatttaaaaaaaaaagagcctcggggttgcttggttttattttcaattaaaagggtctgattttgtttctggagaatggtttaatttggataaatggttcagtctgggaaccacatgccagagcctatgatctatgagtcaattactcagggtttcctcggctgcttttctgagggaacggtccagaactgggctcgcctggtttggctctgttaaaacgtcgatgcaggccctgggcagttggagtgaggcggttctgtgatcagtccttgaagtgcagccataatgccctccccataatgccttccccaactgaggtggttaatttttaccctctaagaatgtgttcacaattccaaatcaggaatgtcaacacaggctgtcgttttcccctccttggaacatgttgaaccagaattactggcatcttttccacgtgggcatttgcagaattggtgggatttgggggctcaaggaggaggcagactcatccgatgtttctcctctggattacttgaggtccctggccgggcaggcctgcaggcccagagaggggtggtgggttgctctatctggagtcaactggtgtttctttccaagaggatgctgggtgggggaggtgagggactaaatcctgggcgactttgcagaaggacccgtcgcgatggagggcagcgtgggcagaggccctgggcagggccacctgctgtgttctggagtagcaaagggatttgcagaaggcaaagaagaatacaaagacacaaggtagggtgtttcaccctttcggaaactgtggcaaagccctggacaactttccatggcgcttgtagatttgagaccaatgcccagcgacctagcgggctggtgggaggcagcgtggagggcggcagggtgtccccagggtggaggtggagagagtctgcacagaaatttccaagagcacagcccataagggaagaataggctgctcgtgaggtgggtgaaggcattgccctgctggcttgtatcagggcgttggctcctggtcctcaacaaagggcatattagcataatgaatagttaagttacttggttgggcttcagccttggggccgtggtctctttccgagggaaggactggtgggtgggccccacctctggagtccagcctgcattgggaccacgtggtttgagaaatgttttcccaagcctgggccacacggacccttgatttctggggcagccctggtggcaactccccacatatccctgtgaggccttctcattttccactggcaaggattcaggtgtaaccagattattctgatgaaaaatttgaggagacaggtaacccgcaacacacagagttgctatgttttgctcttttttttttttttgaacggagtctcgttctgtcgcccaggcacgatctcagctcactgcaacctccccatcccggttcaaataattcttctgcctcagcctccatagctgggactacagacgtgtgccaccacccccgctaatttttgtatttttagtagagacagtgtttcaccatgttggccaggctggttcgaactcctgacctcaggcgatctgcccgcctcggcctcccaaagtgctgggattacagccttagccactgcacccgatcatgtgttgctctttaactccccacccccacctccattaataggaataatccaaaacataggtcatcgagagcatactgtgcttttaaggcattttgttattattagtagagattttgcgacaactggaatggtgtttattcactttttaaaggctactcttctcacaggataacagaacacacgatcattcattttcctcttcccacgaaggtgttgcagcagtgggcgtgagaagcatagtgtgtgtgtgactaccgcgcgaatggttctccaaacctggatcccgacctaggcgttgccgttgccggtctctgggtgtcaccctcccattatgactgtagtgacttctcagaacgccctggagggatggccttactccaaatggtccctggctgccgggctatttgtgagtaaaagatgtttgtcagtgctgcttcttttagaacatgccattccacatcagctcagcttgtcgggtgtctggttgtctgtgcggagcccatggggagtctctgcagcctcacacctagcagtgaggtggcccctctgcgtggtcatgccctgcgggttgcattcctctccctgatggctggctgccaggacctgtgggccctggcggtgagagggtgggaggtgctgtggctcctgccaggctagctcttcacagactgggttagttcttccaagcatagttccctgggacaccacgcacggggcaagcacagctgtgtggccagcggcatgtgacagggctagacacgcactgggccgcttaatgccgaccttggcctgtgagtctgtgacaggactcttggtgagcggccagctgggggctgttggtgctgagttcagctttgtagccaaaaggttccagctgatttccagacagacccggcttccgttttcaatgccaagatgagcgggcgaatgagtgggagcggacagaggcttttggccgactgtgatcgctattgtctggatccccttgaccctctggaggtactgcctctcctttcatttgtacacaccggtttttctgacggtttcgcctcttgtcagctctgtgagccgggacaccagcttttccgtttcccatacgccagatggctttgagcaaacaagaggaaggccccagcgtgggtgcagcctgtggctgcttgtcctgcctgtttaccctgggggtgaagcggaaagggagcaggctttgcaggaacccggtggcaccccttctcgtccctgccacttgttctctttgtggccctgggatggtccccaacttctctgaagtggtgctgaaaactgtgttgatagcacggacctcactgagctgttagagtagctgtcgacactgtgtacccgaggttctttccagtggaaaccaggttagccttcgttccttttctttcatctgtggttggtcacccttttgagagctctgaccccaaaagaagttttttcagattggcccaagttcctccacgttgggccccccaagacagactgactgagaaggagtggagctgtgggcctcctgattccttcccaggctatgtcccttccagagtggtccggtgggacgctgactaccagaggcctggccctctgttctgaggcccagttagccatggcttcatctgctcacattctgtgggattgggttgtgtaattttcgttgtatctctctgtcccattaaatctgaattcctccaaggacaagaaggctgctgctgcttaaaaaaaaaaagaagaaaaaaaatgataagagctttagaaggagcttagagttagctacgtgtacttgccaagtgtgacatcactcagagcctccattccatcctctggacagccaggggctggcctcccaaccggtgctcactgggcacacttcactatgggaggggatagttacacatctagatgaaaaattctagaagtgattgcttacgaggagagagggaaatgccggcacattttcccaggctttgttcatgtttttattagggccacaactttcattcttggagttttgctttgtaaattatcctttaacttgcagaagagaaccatttacaactcatcttacagacttgagaatctagccactgatatttccttggaaaatagccacattgcaagttgttgtgttattgaaagttgatgcaaatgtccccaggagtccatgcaggtttcctgagaagagttgcacctacggagctgtgcttcagcacaaaagaatattctttctggacagagtgtgttgtggggtttgtttccttcaatctgtactgccaaatggcaagaatcatttcctttttcttcctcggaaaatggattccatcttgatgcagagccaccagcactgtgtaatcccttgtgtaatgtttatttatttatttttctttttattgagacggagtctcgctcttgtcgcccaggctggagtgcaatggagtgacttggctcactgcaacctccgcctcctaggttcaagtgattctcctgcctcagcctcccagtagttgggattataggcgcctgccaccacgcctggctaattttttatatttttagtaaggtggggtttcaccatgttggccaggctggtctggaactcttgacctcaggtgatccgctgccttggcctaccaaagtgctgggattacaggcgtgagccaccacgcccgacctatttttttattgagacagagtcttgttctgtcacccaggctggagtgcagtggcaccatctcgctcactgcatcctccacctaccaggttcaagtgattctcctgcctcagcctcccaagtgctgggattacagatgaccatcaccacgcccagctaatttttgtatttttagtagagacaggtttccccatgttggccaagctggtctcgaactcatgatctcaggtgatccacccacttggcctcccaaagtgttaggattacagacgtgagccaccacgccccgtccctgtgtaaatgtatgtatgtgtgtttgtgatagaatctcactctgttgcccaggctggagtgcagtgcgccatcttggctcactggaacctccacctccctggttcgagcaattctcctgcctcagctctcgagtagctgggattacaggcgcccatcaccacacctggctaattttttaaattttagtagagacggggtttcatcatgttggccaggccggtctggaactcctgaccccaggtatccaccctcctcggcctcccaaagtgctcggattacaggcgtgagccactgcgcctggcccttgtgtaatatttaaatgcaggttttgttcttataaagatgttgggcatccagcagcttgtcctgggaaaatgtctcctctcccgctttttgctttgtgctgagacccccagatctgttcacaaatactgcatcggggactgagtgcacgtaagacactagccaaattttggaggatgtttgggttcatataatacataggcttcgtgcctgaagcacatcaattctcagatggcaactgctcagatccctgcctggaggaggagtgggtgtggtgatggcagccacgctgtaatactgtgggctttgttcacagccacagtgaggaggagatagtgtgtcccggtacaagtatcgctctatcagcagatccatctgtccttcctcaaagaggctgcggcccacttcaggccattgtgtcaaacagttggcatttggccttggccctgggtaaaacacatggcagggtacacgtgggtgccactcacgactcccccacatctgccggggtttccataacgcactgttcgtttgcagctgcacgaatgcgatatggcacagcagccgctcatagacctcaggcttgttccatgcatagaagatgcacaccgcagagtggaggccgcaggcagggaagtaactggcataattattgactgtgtgtgaggccctgtgcggggagattcacttgttccttcctttattcttcattcactcactcattcctttcatgcagctcatgttcagtgagtgcctgctgtgtctagatacatttaaccctcactaactctgtagaaactgaggctcagaaggtgaatgcaggggaggtagcttgcccaccatctcagcttggacatggcagggcaaggggcttccgatcacgctctcagacccagagtctgcttgtctccattctgcctgctccggagcccccagttcttcagctgcatctcgaaggtgaaggaagacgatcccgtggcctgctcaggactatgtgcctgtgctgtggcctggctcgcctctccctaccctctcctgcaggccccagggtcctctggagccaaggcttagtgttttgaatcactggcctttcctttgagaaaaatggggctccctgtgcaacttttcaagagcttgatggcagggcagcctctcagagggtcttgggggagctcccaagtggagttttgccggggtgcctgtgggtacagacagcaaagtggaggcagcttagaaacagcatgtcacattgggctggagaatcagccggatgcccgagcctcttgttttaggggggactggcagaataagtcatgttaggcccagcttgttccttattactgatcgatgttaccacgagggatgtaccacagtttactcaaccactcaccagttgcaggacttccagttcatgacatgatatatcttttcagttatttagattatctttcatttctttcattggcatctgtgagtttggcatacaggtcctgtgtgtgtcttcagatttacacccaagtgtctcacttcttttttttttttttttttttgagaccgagtctcgctctgttgcccaggctggagtgcagtgcatgatctctgctcactggaagctccgtctcccagcttcactccattcgtctgcctcagctcccaagtagctgagactacagatgccccctgccatgcccgactaattttttgtattttagtagagacggggtttcaccgtgttagccaggatggtctcgatttcctgacctcgtgaccatctgcctcggccttccaaaatgctgggattacaggtgtgagccactgtgcctggcccacgtcttaaagtgattgtgaatggccttgtatttttaattctgtgtctgtgtattcatactagtacatagaaatgcaattgacttttgtatgtttaccttgtatcctgtgagtttgcaagttttgttttgtatattcctgggcatttcccatgtagataatcatgacatctgaaaaagggacaatgttatttcttcctggactttgccttgtagattgttgcacagtatgaattttacggttcttctctcctcattagattcaggataagcagtttttaaaaaatgattacatagtgtgaggtacctctacttgcttgcctcacattaagagatggaatgtcttttttttttttttttttttttgagatggagtccggctttgtagcccaggctggagtgtagtggtgccatttggctcactgcaacctccctccctgtttcaggtgattctcctgcctcagtagctgggatataggcacacacccaccacgtccagctgattttctgtattgttagtagagacggggttcaccatgttggccaggctggtctcgaactcctgcactcaggtgatccacctgcctgggttccctaagtgctgggattacaggcatgagttaccgtgcccggccatgagatggaatgtcttttgtcctgctgttggcccgctaagtcagatcacttggttgagacccgattcccttctacctttgatactgcctcctaacaactttcagccattttaacatacaaggatggcctttgctgaatcagttattcccttaggagttatgcagtggtagttcttaactgtttttaagcacttagaaacactattgtcttgcacataatcagactgttacttagcaatcccttttgcttgggagcaagctcttcagagtaaaagggagagtagagggggagaaaatcgtatttactgtgtgattccataggcagtttgcaaatctgacaaaacaaacatgtgtgccttttctcaaacctgactctgtaagagcaccctgagtacctttgggcagcacgctattgtaactgcagtggaacgtgaatgtggctgccatcactgccaaatgatagatgcctgcccaggctcacctaccaccgggcagctgcttgggtggctctgttgaggagtccatgtttttggacgagtgctatctaagtcagcagttctcacagtgaggtcctgacaccagcattagcatcccctggaaactgtaggaatgccagttctgggttccaccccagacagacctcctgcgtcagacactttgggttcggctcggcagggtttagaaccactcatctggattaatcttttttccaatatgtagtacaatctgaaaccccagtgaagctgttaattgagatgtctttaaagttccatgtggctttgagtaatccacgcatatcatgccatcagactgtggctggttgctcttccaaagcctcccacgcccgtgtgaggaataagctgcatttacagttctcatacttaggagaactccttttagtccctgaacccccaatgtgaatttttgcctaagattaagaaatccagcagagtgcgaaatggaaagcgaggttggtgttaactagtgtaaatttgtgcgtattttcagcatttgtttaatttaactttgtcccccacctactggcttattaccttaagaaataaaaaactggccaaggtagtgactcatgcctatctataatcccagtaatttgggaggctgaggcgggctgatcaccgaggtcaggagttcgagacaagcctggccagcatggtgaaaccccgtctctactaaaatacaaaaaatcagctgggcatatggtgtgcgcctgtagttccagctactcgggaagctaggcaggagaatcgcttgaacctgggaggtggaggttgcagttagctgaaattgcaccatgcactccagcctgggcgaaagagtgagcctctgtctccaaaaaaaaaggccgggcgcgtggctcatgcctgtaatcccagcactttgggaggctgaggcaggtggatcacgaggtcagagatcgagaccatcctggctaacagtgaaaccccgtctctactaaaaatacaaaaaatagccgggcttggtggtgggcgcctgtagtcccagctactcaggaggctgaggcaggagatggtgtgaacccaggaggcggagcttgcagtgagctgagatcgcgccactgcactccagttgggtgacagagtgagactctgtctcaaaaaaaaaaaaatagaaataaaaaaatcaactttctggaggccagtgtctttatagcctgctctactggttaaggattttgattcttcacatagagatgcagactgagcttcttttgtgtgcaagacagtctgcttttcttacaacgagagttcctatgaactcaggagcaagtaggtagccacgtgtgaatgtggaccaagctgtgaaaggggacatgtctgcagaggaaaagaaggtgctgtggaaactgagagctgaatgaggaagggtcggggaggcagccaagagcttagtgatattaatcagtcaggttgtccagggaagagaaccaacagggcatgttcatatatatatgcgtatacatgtatatacgcatatatataatgaataaattttagccgttcttgaggttgcagtctttttttgtttttttttgtttttttttttttgagacggagtcttgctctgttgcccaggctggagtgcgatggcacaatgttgctcactgcaacttctgcgtcctgggttcaagctattctcctgcctcagcctcccgagtactgggattacaggtgtgtgccaccaggcctggcaaatttttgtatttttagtagagatggatttcaccatgttggtcaggctggtcttgaactcctggcctcctgatctgcctgcctcgcctcccaaagtgctgggattacaggcatgagtcaccacgcccagcaaggttgcagtctgagtctgaaggcagcttggagcagaattcggaatctgtcttttctcttaagggcttcaatgattggattagccccactgacattatggagagtcatttgctttattcaaagtccactgtttaaatggttttttttttttttttttttgagacagagtctcgctctgtcacccaggctcagtgcagtggtgtgatctcggctcactgcaagctccacctcccgggctcacgccattccctgcttcagcctcctgagcagctgggactataggagcctgccaccatgccagctaatttttttgtatttttagtagagacggggtttcactgtgttagccaggaaggtcttgatctctgacctcgtgatctgcccatcttggcctcccaaagtgctgggattacaggcgtgagccacgcgcccggccttaaatgttaatcatatgtaaaaaataccctcatgcaacatctagactaagtttgactaaacaattggataccatggcctagccaagaggatgcataaaattaatgacactgcaaggaattgggattgtgactgtgactgtggtctggggcagtgggaagatttatctggttggcaagtgggtgtgggaaaagccaccaacagtgtcctccctgctcagtggcctaacccagggctgtcatgagataatacactgttcatcactaggcttgtggaacacaaagggagccactttctggagaagcggggcagagcttctgtaagtcgactttgatgacaccctggggtgagattggatctccccaggataggattggtgtcctccagagggaatgagcatcctgcttcagaggttgggcactcagtcttgctagtgagtcctgccccatggttgactagctcggacccaggaggtcatcactgggtcctgaagcttttctaccaaaactggtgaaaaggcctcttcaagggcacctttcagagtgagcacccaggagacgttcgtgaaagtgtgagctgcctcagcttaggaactgttcttatgtatttatctcaccgtccagatggtagggctgtggatttagatctttgtcgttggcctaggtttgagagtccttgaaggggggctccaggcaggagggttctgtgtttctggcaggtgcccatgcagctcctggctgtgaccactccatctgcccactcactctggatgatccttgtgtgcccaggcagagggcctggcccggggatgcccaggagttttgcctagcttcgctgttagggacataaacaagaacgggcatagctaaagaaggtatggccagagaaggctgggcccggagctgggggtggggctgtgtcttggctcccaacgttgttgttgttgaattatccccaggcactcatggagttgtcctgaaacccatcttccgttgccttgatttatccatgctgttcttacccatgtcatcttcagagagaaaagtctttttccatgcacagccaagagactgactttacttgttttgtacgtagttaagaattccaccaaaagaattccactgccataccagcatctccaaggatgtcccataaacttggttgcagagtttgtgaaatgttgcactccagtagaaggcagcagactaggcctggtgcggtggctcatgctgtaatcccagcactttgggagaccaaggcggcagatcacctgaggtcaggagtttgaaccagcctgacccatatgatgaaacctcatctctactaaaatacaaaaattagccgagttggtggtgggcacctgtaatcccagctacttgggaggctgcgacaggagaatcgcttgacccgggaggcggaggttgcagtgagccgagatagcgccattgcactccagactgggcaaaagagtgaaactccatatgggaaaaaaaaaaaaaaaggcagcagacgagactgaagggttgacctttcaagtgtttatccacctttgaccaaataaatctaattccatctctttgagttacttaagataactatcaatgataaagattttttttgcagaactctgttgaggaaaaatagctggcttttccatttccagaatgatctccgggtcagagacatacactgggtcagtccgggaggggaggccactcctcccctggatggtcagggtgcacagggaatttttgccatcatactgcaatggagaaatgtttacctatcaaactgtattgcaactgtgcttcaattacttccaccttgggctgttagtaaggattgacctattcaggttaccagtagactaagtggctgaccagctatctactgtgaagcagactaaataacttagtggtttaaaggaaaacaaattcttcttgaggtctagtgggctagctgcgtgggagctgtgctcagcaggtcttcacagcctgcctttctgtctgcatagtcctgcttcttagcaggtttatctcaggtcacccaagggcaaggcagaagctgcaggcaacacctcaggttctattccattggccaaagcaagaccagctggatgccagggttaggaaatagattccaccttttgacgagtcttgggagagaaatattgggccatgtttttcattctaaaatgttgcttgactcttccatttacttattcagcaaatttattttaaaaattggccccttgctgatacctgcaacccacctaaggaatgacacagcctacacttctgaggtgactgcatgatttggctatgagcttcctagtagccattgtgatgaggaaacaatggttttgaattgttttttggtatctaagcgatttaaaaaaaagagttaagaaaacagataatgaacagaaacaagttattctggaaagtagagaagtttctgaggctgaacctgaggtgggtggtcccatagggtccctgcatagtcctcagcataccctgcacccacccattagagaagtggaacacaacagtctctaacactcccagtggtggccaaaggcagtgtataagattcaggcccctaagaataaggtgccagggatttgagcatcctgtgctccatgttccaactctgagacacaaggacaaagcactagaatattgcactcgagctacagaagaataacctaggtgtgtgggactacagaggcatgagcatctgtcctagcttaccctctgaagttgcccaaccagcgtcgcaccacgtcctatccctattaccctagacaaagaggtgaccacctgtgcctcagtttacttctggtgttacagtgatattttcatgaagtcacacctgaaaaccctggggtgagcagtcactgtgacctgacatcagaggccaggggtctggcagttgtgttggggacacccatggcctgcctgatgtgggggtcacacaaggtcacacagggttgcttgggattacagcctgtttctagatggatctggtggcgcctgggttcctcactgaggacttgaggctccaggctccaggacattcccaagtcccccagccaggacctcagaaaggacactgtctgggtgggtttgagaggagcaagttaggggtgctgagaggtggggctgctgttgccctggaaagggggtcatttgtaggctgatgtctgtgctgggatcccagttcgagggttgcagagcagccagcgggaccacaggcagagtcggccaaggactggttgcccctgacagcagcgagaggtggacaagggagtctggagagaatgccaccgggtgagaagttaggtttagggcttggttgggcagatttatggaagacatgaaaacaccaggttttggacagagtgatatctaattggtttgtgctgctacaacctgataccttagattgggcaattgatagacgacaggatttatttctcacagttctggaggctggaagtccaagatcaaggccctcggtgtctggtggggcctgtttcctggttcatagatggtgacttctatgtgccctcacatggtagaggggtagggagctccctggggtcattattatgaggccctaagcccatcctgaggctccagcctctgacctaaccaccttcctgaggccccagctcctcataccatcaccttggggttcaggtctcaacataggaattgggggtaggggggcgggtcacagacattctgaccatggcaatgatcagaaaagcccagtttgaggtgggctgcaaagggagacccgcggccggctcttgcagtctgcgggggtggagcaggtggtgtagacccagcttcctaccttggggccccagtggccctagcagcatcgtgaatcccttcatgctaggtgtagtgtgtgtggattgttctcagggttttagcttcatcagatcatcagggctgctcgaccgccgaatgtgaaggccagggtttcctttcctatgctacagcagctctctctgcgtgtcctggtccccaggctgcccattgccctgagaagatgcatggtggagcttgggcctggaatgagggggagtggaaggaggtgagtgcaggatggacaagggccccagggagactggggccataggatgctgtgaactttgatggaggctcagagatgtagagcaggagggctggcctctcgtaagattggctcctgtggctcttgtttagccccttccagcccccatccctgcctcttgttctccattctctgcatagtcctgggggcgtaaagatgatgtgacgaggctgaggcaccgccctgcaccagaaagttcttggaactgccaagggcacattcctaagatgcaatgttgtgaagccacctctgctgtcccttggagattctcccgctcccattattaaaaatctgaacatgtgtcttgatgtctgtttatttattttttattttttgtgagatggagttttgctttgttgcccaggtgtgagtgcagtggcgtgacttggctcactgcaacctccacctctcaggttcaagcagttcttctgcctcagcctcccagtagctgagactacaggcgcgcgtcaccatgcctggctaatttctgtatttttagtaggatggagtttcaccatattggccagactggtctcaaattcctgatctcatgatccgcccccttggcctcccaaagtgatgggattacaggtgtgaaccaccacgacctgcctgtctgttatttaaatatgcattaaacatggggttggaagagtgacatgggaggtctatatacacggcgttgcgagatttgcttctgccttccagtgctttcccttgggctccctctggggagattcggctctgggagatttgcggccagttttgccattaccaggtgagtggaagggctcgaggggtcatgcaaagcttcctcctgctcatggccttggacataaccaaggagggcttggactggaccctgagcagggttttcctgcaggtgtacacagaggaatgtcccatagggtggcttgtgggagagtgggaccctggggaggcagagctgggaccctctgctgaggggggccccagcagtgggccttgtcctctcctcatgcgtgggaaacctgcccagggaggctgtggttatttgtcccagtttttccatcgacgaaacaggagtcggtggaaatttgcaagtaggtgatggagaggtgggcctgaaccccaagtccttagaatgaaaacctgggcctttcttggtccctcaggtgtgctccactgcagggtggggaggtgctggggtcggcctctttgaagttgggctatggacacaaaggggttggggttggtggaggcacccactcttgcatggaggagggtgtggaccctctgccaagtgtcaagttagcctgaaatgaggcacagactgggagctttgcttttgccctggggtaagaataaaagaagaaaacaatgcaggccgaggaagcattcctaggagtggcgcagcctctttgatcctcctcggcaccggcttgctgtagcttgctcttatcaggaggcaaataccctgtttccttttatgttgggaacctacaagaggctctgatgctagaatcggctccctcattcttgcctgcaggaagcagtgtcctgtatacaggcgtcagcacccacagggggtggacagtggagggccagcctgggcctgcctcgtgtgctcaggcctccttggtggggtgggagtggtgcagaagttctcgtcatttgtcatttgccagagggacgatgggcagcagcagagatgtcccgaggcctgctcaccgcaggccttctacgcagccctctggaaaagggccatccttccagtttggagacttcctctggagaattccatgacacacattcttgaacgtggatgtaatccagtaaggcgtggttcatggcatgtggtgtggaataattcattgttgacagtttgctctaggaatggcgtggcctccctacctcctcccactacatgctagtggccccccagtggtggtgatggttaaaatgtcctcacatttccaaatgtccccagcgcctccattattagtaggcagagaagtcagtcggcacttaaaaaaacaaactaggatgaaaaatccagagagtattctgccagttgccacgtcatattcccataaaaccttcagttatttacccaatgggtgctttacctggttgttacttaagatagatttctgtatgtgttgcaaggaaaggattgcagaaatggacaggaccatttttttcgttccacattgtgactcttcctttcctgttttgaaagattaaaagatagcaccccctagatgggtgagggttgggttaaatagtagtgtgggacagaaaggtccatttgtgagctcgctgcaggcaggtttgatggtcctggtggaatagccttggcggctgctggttttcaaagcctctgacaaagctgtgcatatcacccgtgatgcaccctgaggaaagacgaaaagtcagcctctcccttacgtaggacgcttgtaaacttcccagacgcactgttggtcttaaggattgttctgaccctggacatttgcaggacttgtcaaggtggatctgagcctcctcatgtgctccaggcagagatcaggattcggatgcatcacaactggtggaagatggggactaggcaccctgcacaccctgcacaggtcaggttctgttgtccccgcccccgctgctcctggttatcgtctgtggggggcatggcttggtggcagggacggaggacagagggctgggagtagggcctcttggctgcaacctgcccttctgcccagcacgttgcattgagaatcgccaggtgccattccttccttgcatgccatgctcactgtaccaagacttgtggagttttgccatttgggtttatgggaggttgcattcccctcagcccagccatgagagcgggcagcgtctggcctggggcccgcactttgcagcccctgaagatctcagctttatgcctctgctttgcttccctcagcttgggaagcttcactcgcccctgcccccagaggtgactcagatgtacccactgaccggaggaacttgttgggaggaagtcacaattatgggttagggaaagaaaagtcaaacaaccaacaaaataataatcatgctcgcctgtggattggcctaagggatgtggggccctctgtcgtcctcggttccctacctcagagcttcagatgccagactcaggccggaggctcctagggccccaggacaggcagaacacccacattcatggggtgcagagttgtccccagatggcctggagagacccctgctcagggggtcttggcccttaggtgtctcaggatgaggactctaaataatctatctgggaacctccttagagtagctgactgttttactaaaggtaattttttaaaaatcacgttttgattttaaagtgtctccaggatctctgcagtttactagaacctcttactgcccaattgtcaacagggttattctacaaaagaggcatgtgggttcaaggagaatctgaacatgggattcacacactgaactccaactggttcctccgcctttgtgtgtgtttatatgcgtatgtgtgtatgtaagtgcacgttcctaaattatatgtacacaagtgtatgtgtgtccacatgaacacacacatgtataccgtgcatgcagcatgcacacctacatgtatgtgtctatgtgcatgtaatgtgcatgtgtgtattatgtggtgcaggcttactttggagatactgcagtttggtgccaactggaccattgcaataaaataatattgagataaagtaagttgcacacatcttttagtttcccagtgcatataaaagttgttatactaagctgtagttatattaagtgtgaaaatggcagtatgtctagaaaaacaatgacatgtcaatttaaaaatgcgttattgctaaagaatggtaacaatcatctgagccttcacaagttaaaatctttttgctgatggaaagtcttgcctacaagttcatggctttggacggtcagtagctactgaaggttggggtggctgtggcaattccttaaaataagacgatgataagtttgccacgtcagttgactccttcatgaaagacttctctgtagcatgtgatggtgtttatagcattttatccacggtagaacttttttcaaaattggaattagtcctttcaaaccctttgctgctttattacatttacacaattacatttgtgtaactttctttttttttttttttgagacaaagtcttgctcttgtccctcaggctggagtgtgttggcatgatttcagctcacgcaacctccgcctcctgggttgaagcgattctcctgcctcagcctcccaagtagctgggttacaggcgcctgccaccacacccggctagttttggtatttttagtagagacagggtttaccgtgttggccaggctagtctggaactcctgacctcaggtgatccacccgcctcagcccccaaagtgctgggattacaggcttgagccaccacgcccgaccacatttgtgtaatttttaaatattttgttgttatttcaataatatgtacagcatcttctttatcaagggtagattcattcttttttttttgagacagagtctcgctctgttgccaggctggagtgcagtggcgcatctcggctcactgcaacctctgcctcccgggttcaagcgatcctcctgcctccgcctctgagtagctgggattacaggcgcacactaccatgcccagctaatttttgtatttttagtggacggggtttcaccatgttggccaggatggtctccatctcttgaccttgtgatccaccgcctcagcctcccaaaatgctgggattacaggtgtgaaccaccgtgctcggcccgattcatcttaagaaaccactttctttgcttatgcataagaagcaacttctcatccattaaagatgatcatgcgattgcagcaattcagtcacatcttcaggctccacgtctagttctagtgccttgctgttcccagcacatttgcagctcctttcttcactgaagtcttgaaccctcaagacattcataagggttgaaatcaacttcttccaaactcctgttaatattgacaatttgactcctctcatgaatcacaaatgttcttaaaggcatctggactgttgaatcttttccagattgttttttttttttgagatggagtcttcctctgtcacccagactggagtgcagtggcgcatctcagctcactgcaacctctgcctcctgggttcaagtaattctcctgtctcggcctccgagtagctgggattacaggcacccgccaccatgcctggctaatttttgtatttttagtaagacagggtttcaccatgttggcaggtaggtcttgaactcctgacctcaggtgatctaccgtcttggcctcccaaagtgctgggattacaggtgtgagccactgtacctggcccaaaagtatttcttaaaaagtaagacttgagggccaggcacagtggctcacgcttgtaatcccacactttgggaggccgaggtgggcggatcacctgaggtcaggcgttcgagaccagcctggcaacatggtgaaaccccgtctctactaaaaatacaaaaattagacaggcttggtggcagctcctgtaatcccagctactcgggaggctgaggcaggaaaatcgcttgaacctcgaggtgaggttgcagtgagccggaggctgcagttagccgagattgcaccattgcactccagcctggcaaaaagagccagacttcatctcaaaaaaaaaaaagtaagagttgaaagtcaaaattctccttgatccatgggccatagaatggatgttgtgttagtaggcatgaaaacaacattctttctttgtacatctctgtcagagttgctgcatgaccacctgcattgtcaacaggtagtatattttgaaacgaatctctttttttctgagcagtagtgtctccacagtgagctcaacataagtctcaacagtgagcttaaaatagtcaataaaccatgttgtatgcagaagttctgtatccaggctttactgttctatttatagagcacagggaggatagattttgcataattcttaggactctggaatcttcagaatggtaaatgagcatttgcttcaacttccaggcattagtgccttagcccctcacaagacagttagcctgtgcttcgaagctttgaagcttgacattgattctcctctctggctatgaaagtcctaggtggcatcttctaatagaaggctgattttgttgcattgaaatctgttgtttagtgtagccaccttcatcaatggtcttagctagatcttcgaataacttgcggcagcttctacattagtacttgctgcttcaccttactctgctatgtttggagacggcttgtttacctaaacctcttgagccaacctctgctagcttcaaacttttccctgccgcttcctcaccttgctgagtctgcatagaattgaagagagttagggccttgcttggattaggctttggcttaagggaatgtggtggctggtttgatcttctaatccagaccatcaaactttctttgtaacagcaaaaaggctgttttgctttcttatcattggtgtgtttatggagcagcacttttaatttccttcaagaacttttcatttgcatttgcaccttggctaatgtttggcatgagaggcctggcttttagcctgtctgagcacatgccttccccactaagcgactcatttctagcttttaagagatgtgactcttcctttcacttcaacactactggttataattggcctgatttcagtgttgttgtgtctcagggaatatggaggtccgaggagagggaagagcagtccagagcatcagaacacacagaacgtttatccattgagttcgcagtcttaatggatttggttcatggcaccccaaaacaattacaatagtaacatcaaagagcacagatacaaataaccatgaaagatataataataatgaaaaagtttgaaatatggtgagagcttcaaaatgtgacacagggaccagaagtgagctcatgcttttgggaaaatggcactgacgtgggttgccacaaacctttagtttgttaaaaaaaactgagtatctgcaaagttcaataaagaaagcacaataaaacgaggtctgtctgcctgtgtgtgtcttgttgatttctgcaacggagcagagagtgattttttgttgttatttttcttcttgtttctccaggcaaattgtttctcccttcactcatgtgccaagctctagacggcttcctggcttggcaagattactgttaacgatccctaagcattccttttatttgttaaatccctgttattctgttagaatctatcttgcgccaaaatagcctcaggagaaaaataatgaaaaaaaaagaaatgaattaggtgtgccagagaatgtgatgggcgtggggaggtttatgcagataaatatggtgggtaagaatgccgcccttttcaatgtctgtttaaatgtttccattttccttgtaaaagcactccaacacaagaatgcatttgcagagaggccaaggatcgctcccggtggacacacggttttgtagcctcccttccaccccacccctgccccgctccagctgtgccttagcagacgtcattccctgttatttagtctctgcaagtgcaagaatttagggtgataacagccatacttccattccatgaatttcacacttcttactctctacttatctaacacacatgtgcacagtgtgaaccttggtctgcgacttaactttgcctgtgtggggtgttgtttctctcctgtctgtggacacttactgagtgagattcacaggtgtggaaagagcagggtctgcagtgcgaatgttttcgtagttctcatgtagactgtccaatgacttttcaaagtgctccccaaggcatgaattattccactgggggctccttgcctgtagttttgaaccctgacccagccaaaggctcccctgctcctggtggcttgctggaactctagctccttccctttggcctgaggtggccacacccagggctccagccaatgacgttttgtgccctcacccacctcctccgtggtctccccatttgcttaaggaaacactggagtgagacagaaccatccagtccatggctgtgccccactgggcctccaccttcagacgtgcccagggtctagccacctgcttttgctcagttcccgagtccagcggcaggaagtgacaccaggccagccttctgcccgggagctcaggtgctagagcttgtctgccctctgtgagcagggagcccaccttgcccatttgagaaagaagcaggggcactccgaggagatgcttctgaaggaaccgggtgttttaggaagatcttcctggcgcttcccacaggtctggtgaatctattcacccaggctcccaagaggctgagcccctccttgccctttttctgagtgagctctgttccttggctgggtgcagacttgggagatgtgctcagtcactccacagcaaaattcttctctttggggtggcatgactcctcaggagtggggtaagactgtttaggaatgaccaaacttaggtctgttttgttttgtaactttgttaatatcccatgggcgttttccatataagtaatatggatgtgattattatttttagtgacttcatagtattcgaatcccattctatgttgtaccataaaatgaccagagcccagttgctggctattaaaactgcttccagccttttttttgtgcataattctgtaccctgcccttccacgtagatctttccaggcatggtcattgcctagaacacattccttgaaggagaattgaccattgtgatatgtgtttgaaatgagaacatgagattttgttcgcatgtgccttgcccattgagaccctgctgcaaatgtgtctttgtgctctatctcctggtcctagctgtcttgctgtgggacaactagggacagcatcttgcttactgaggttgggaaggtgaaggtcagagggacagcaagccaaggttaccgccttacaggacgatcctgtggtctggctgctcacccatttgttctacgcgtttatcttttgcaaagggcttgcagttcaccaagccctctccatacatcaaggcttcctgtggacattgctggccatggaccatggggccgtgtttctattcccatttcccttcttccttccttcattaattcagcaacaggcatggaccccttctcgcgtctgggccttggataggtgaagggcagggtgagggtgagggcttccctgtgatgtaagaacttttgtggggccctgaggcctggggccagaagacctgcccgatccaccctgagaaggcctcgcaggggagacctcagtgttgcatttggggaccatgtttagctgagtggggatgggtgggagggatggaagaggggagaggagaccaaggcagggtctggcacccctgtcaagagccaaacgaagtaactaggttgtggggatggggtggggggcggggacgtgggtagagttgatactgcagtgttctggtcagagcatgaaaaacctgaatgggccagtaggcggtctgtgtgccagggcccatcaggagtatcattcattcattcacaaatccttagctgtgttctaggcagggggatccctctgaaccggatggacagatggacagagtttatgccctcttagaggtgagtttttcatacccgatgactgtaagaccaaggtgatggacttttccctagggcctcatgcaggagaggcataaactgagcagggatctgggggagtgagcccgtttgtaaggacagcaagtgccaatgtcctgaggcagcacctggctgaggggttggagagcaggccagagacaggcaggggctagatcacattggtctgtgggctcatgagagaacttttttttttgagatggagtttccctctgttgccgggctggagtgcagtggctgatctcagctcactgcaacctccgcctcctgggttcaagtgattctcctgcctcagcccccgagtagctgggattacaggcacccgccaccacacatggctaagtttttttggtattttagtagagacagggtttcaccatgttggccaggatggtctcaatctcctgacctcgtgcctgcccactttggcctcccaaagtgctgggattacaggtgtgaaccaccgcgcctggcaaaagaactttcatttatttattttttaagggtgtagattctaaaagctggagagggtttgtgctacattgtcatgtcctgattcctgtcttaagaagctccatttggttggcctgtgatgcacagagatggtcagttcagtggtgggtggaccaggatggtgggagtggagaccgggaactgggcctttttggggctttattttgcagggcttgctgacagattggctgtgtgcttaagagaaagagaaggagccccaaggttgagacttgactgtgtggggaagtggtgctattgtgcagaccgagcagcagggaggacatgttggggagaaaactgggagttcttatttgggggttgaagtgagcggtgcttcggggatggcccagtgaaggtgggagcaggtggtgctcggactcagcaggtcaggggagaagaagcttggagtggtcaggaccatcagccggcagacggtggtgggaagggtgacagccggcctgggggtgcattcacagggaggacctgcaggtcgagcccaggcaccctgaaacttagaagtacccaaggggataaaaccctccaaaggaggcaaggcaggaccagtgaggtagggcacggggtcacagcgaccagggaagaaaatgcatcagagatggtgtgttcaaatgcggctgggattggaataaaatgagggacaggtgtcccttatgggtctgacaggctatggctaggtggtgacttatggaaagttgcagtgagatgggttgacatggattctggagcccatgaaccttggggtaaggggcagtgactatagtcagcctttaggaaggcttcctataaggggaacagcagagagacaggccaggtatgggaaggctgggtggcattcaaggagggttgtgttttcaaagatgggatgtgttacagcaggctgtatgccatgggaaagttggcacaggcaagaaaaacgtgaaggttaggagctggagggacggggtggtggtgactcacccctataatcccagcactttgggaggccaaggagggtggatcacctgagtcaggagttcgaggccagcctgaccaacatggtgaaacctcaacactactaaaaatacaaattagccgggtgtggtggtgcatgcctgtagtccgagctacttgggagactgacacagagaaacgtctgcacctgggaggcagaggttgcagtgaactgagatcgcgccactgcacccagcctgggcgacagagtgagactccgtcaggagttggagaatgagagccagggtggcggggacaatgctggagcccgctgtgcatgtgcatctgggtttggcacctggcagcgatgacatgagctggtgaactgcagtggtctccattttcttctgggctgaggtttgttgggagctttagctcctgtgcgtgttgctgcacagagcagctatgcactgatgagaaaggactgtgaggggtggatggcggcgtagacgtggggccatgctgagggctcctggaagtctgtgacttggcttgctgtccctcagaccttcatcttccctacctcatgcagggaagatgcacaattggacctggccatctgatggaactataggattgtccccagtaccttgtgctggtgactacagtggacacctagaggtctgggaggagcagctcccggaaccccattgataaaagtgtctcgtgtccagtgtgtgccgctgccccctgcaatttcagcaatttcagcaatttcagcagagcatgcctccaaatctaatgtccccagggctccactgagtgctggttactccttcacgcccacccacacttgccttccactccccgacacaggccccttatctctcttaattcttagccagttgaagtcaacacaattcttcgctttgccctccgccccactcccaccctttgctctgagcctctgcttacctgttttggtcaaggcccagtctacactggagcccgacacacacgcctccctccctcctcaccctggagggtccaccgcctccttggctttatcttctctctgtccctcctaggctataaactcgggaatgaatgaatggacagatgaaccctgccagtatattgtaaaccatctaatcagaaactcaaagggcagcagataggaggccacagctcagggtttccaaaggcccagcccagggcgtgactgaggggtgtggtagtcaagggggtgaccttaaacctggcgtctgtctttgtcattttagtcattccatccgcagcgcctgttgagcacagcgtgtcttaccaggcgggtgctgagcgcacacactgagagaccgtggtcttggcacacggtagtttatagtatgagtggggtatgccgcaagcccatgtctgttccctgctagcctggtggacagtgatggctgtcactgcagacatgggatgagaagcttcagtggtgaggtgggattgaactgcctttttctttgcttgaataacatttaaaaacttttttttttaaataaggagataagaggattgtgagtactatgctgtaagtatactttagtgatatttaaaaaaattaaagagcaatacatcgaaccttttaggaagctgaaaacagatgtgtagaaattgccacagctcccagcctcagcacctcaccgtcctgggccacctggggaggggttttcctcaggctctattcagtggatgtgcacagggctgggacgcaggaagactgtaaggaaggagctctcctcggtgacggcaggtcctgggagctcagtccagctccggaacagcagtgctgctgtgcgggactgtgtgtgaggccagggggtgccggacgtggacgccacgtgagacaagtggctcagtaagatggttaaggtctgagcctcagcgcctcattagaagcttttgaggtcggttgcaattgatcatccgctttagcagatgaagaaactgtggcccagaataattaataataaaccccaggcagtgagtagaggagtggggtcggggtccgccgcagctctctggaccacctcagtcaggcctcctgggggaggctccaggctacaggagagcagggcacctgcctctatccccaatctcatggctctctgtgcttcttaacccaactacaaatcagagctcctgggaagactggaagaaatatcactgcctagggttcccccaagactgtggagtcccctgactgtggtgtagtggtaggggtggagtttgtgtgatgtcggtatgtttttaaccagctcctgcaggggattgaggagcagtgttggctgagaactgctcaggctgcccccaggtgggatcccctagggctcattacccacagttccagatgtggtccagtggtcattttctgatctaagtcaggcaatttggggcattttcggtcaggaagaaactggggaggtgtgaaaggacgggggtcgattaggaggtttccgaaaggacagtggtaactgagatggctatctgtgggtgacccgcctcccatgccccagccttcccatgggagccccccaagggaggggagaccaggctgggtcctcttgtgtcagcaccctgtttaaggatctggtgcaggttttgaagctgagcaggttgttaaactcctagagccttgggcgccttgtccacatcaaacagtaacagagatttctatgggagggggtgtagaaagccctcccctttcgtgaccagtggcatgcactaccatctagctcttcctcgtgttctagaagagaccagtctggccaatatggtgaaaccctgtctctactaaaaatacaaaattagctgggcatggtggtgcatgcctgtagtctcagctacttgggaggctgaggcggagaatcgcttgaacctgggaggtggacgttgcagtgagccgagattgtgccacactgactccaggcgacagagcgagactccgtctcaaaaaaaaaaaaaaaaaaatgccctcttagcatctcaatgtattatcacggaagagtttaaaaggccaggcacaacaccaacaactgttcctttttctttacccccctggaggaagtgaacatacctctctccgtttttagtgttcgggtgctcaaagtggcagagtaagtcctaacatcgtggatctccaggcttttcgtacaacaactctgcagggttcttctgcttggagtcaacttgatggtgaagaaatgcttggcaagggtggaaaagtaaatcatgatgtcctcagcacagggcacctattaactagacagtttccttgttctcattttcggttagaataggtggggcagctcatttgacaggaggaaactggcttttggaagtgctgggatgcctactgatccgtgcctgggtcctgggacacccattggtagcgtaggtctgtaagctggacctggggacttgggcttgtggttatttagctctgcgacctcggcagttctggaagctatcacagttggaggctggaagtccaagatcaaggctctggcagttgtctggtgagggctggctcctggttcatccaaggcaccttctatctgtgtcctcccaggcagaatgggtgaagggtcttgtggggtccctttcttaaaggcattaaccccattcatcagagtctcccctcatgacctaagcacctcccaaaggcctcacctcctaatatcgtcactcgtgggtgaggatttcaacatatggattttggaggcacacagagagcccgtagctgtggggtccgttttaccatgagaaaggtgtgctccgtgcttgtgagaggtggagacaggtggcccttgtttatcttttgggctgggcacccccacccccgacccatggataggtgaaggaagaagatgctcctcttggcaccagcctctgactcttcctgctcctctgaagggagggaaggggcgagatcctaccagggacttagctggagggggctggggagagccaccttaatttaaactttcttttgctctcctgtgcacagtctgtaatgaaacagctctgttttgagcagagagagggaagaagcacccactggaggggaattttgtaaggaaagcattttttatttacttccaaagtcagggggaaggaactctgtgacgagtcagagcagagggaaacaaatgctggttccccagggcgggcaaaaacaccatgcaaaggatgtcagaagtcaccatctgtttgtcagagaagccctgaagtgtggcagtcgcagaatgacatttcattgacagcctgcacaccccagggactcccatgggtggggacaggctgcgtgcccgggaactttgtagccaatggagacgtttggttaacctggtggaataaatacactctcctctgtggccagtggactctcattcatacgttatctactgagtgtctgtgtgattttcatgagaaacagtgttgtgtaaaggacaagcagtactgctttcaagtcctgcttccacccgagtgggtaactccagctttggaccatctgagggtcaggcacttcacaaatggcatctttgatcattaataccactctgggagttggctccttgtctcctaggatgtcgctgggtcactaagagcctgggcgaaagccccctcacccagggactggaagtcagctccccacctctccagtctttcaggtgccccatgcacatatctgagcccctgggacttgacgtaccgaaagtcctctgctggtcttccccctccagcatggcctggggaacaggtgtgaagatgtttgctggataggtgagatgcaagtgtgcctgaacattcctgaatgtcccagagggtgagtgccctgggaggcacactgttacactgtcccttctgatttcggatggagcacaagctggctgcacagggaaagagacaaaagggaggattttccaaagtctgtgtttggacagggcccaggtacaagacctgcccctagagacagtgtctgggctcctgctgcccagtgaccagtgttcccacctttggacaaggagagagggccaggctcatttctgcagatgagagctggcaacaacttgctgatgtcagaaattccttaaactgaaggagtctttttcaatatcagaggcaaagtgcctttttttttttttttttgacagtcttgcatgttccccgtggttggagtgcaatggcgtgatctcggctcactgcaacctctgcctcctgattcacatgattctcctgcctcagcctcccaagtagctgggattacaggcgcccaccacacacctggctaattttttgtatctttagtagagacgggttttcactatgttggccagatcgttttgaactcctgacctcgtgatctgccctcctcagcctcccaaagtgttgggattcaggttgagccaccgtgctcggccgtaaagtgcttttaaatgtgctttaggtggcacatgaaactccctcacactcggacaccctcaagccatggagcagtgggactggccatgtcagtttcgtgtcgacgggcatgtagtgggtagaggagagctaggagtcatctgcccagagtactggtggccccaatttcagagcactgaggctaggaatcgggaatcagggctggatcctgcaggacagtggctctgtgagcacacgtcagagggactaaggatttggactctccacccccacttgggttgtctggccaaggtgtggtgaggatttggtttagatgatgcctctctgcaaaacacccagtggtaatgcatattctcatctctgaatcacaggtggcgctgaccatggctgtcccatccaaggtcatggtcaccttgaccccttgattaggtggagactgaagctttcctgttgttgacttactcttttcccttttatagtaaataaaggaaagtatttagagactagtattctctctaaagatcaaccagtgacagcctattagattctgtctctccactgcacaaactcccgagtctcccatcccacgacgcatggaagctgagacctttacgcttcctaatacctgctcccaggactcccattgcctctctgagactgtctctgtggtcatttgctttttttttttgagatggagtctcgctctgttgcccacactggagtgcagtggcacaatttcggccactgcaagctccgtctctcaggatcatgccattcttctgcctcagcctcccgggtagcgggactacaggtgcctgccaccatgcccagctaatttttttgtatttttagtagagacaggtttcaccgtgttagccaggatggtctccatctcctgaccttgtgatccgctcgcctcgcctcacaaagtgctgggattacaggcgtgagtcactgcgcccggcctcggtcatttgctctatcagtagggactcaaagagtcttggatttgtattgtattcaatgggtcataatccatattatcactattttgatctccaagttgtttacagtttgcctggtgggagcctcttcagctggcccctgtgtctttttgttaaaaaacccattgttctgtgagcactgtcttacttttggccaaaaagaagagatttcaggctcattggggggtgactgttggtattggagcctcccaccctccaaggacagatctgggagtatctctgtgtgtgtgtgcatgtgtgtgtgtgcatggttcgtatacacacattcacatctactttgatttctagatgtatctacgtctctagatggaaactctgagtcacaccaatatctgattcctgtctcccaacacagggcttactatatgtcccccattctagactagcaagctcctcccgaaggtgcctcccatttttcttctcacgatccttatgctcaatcatcctgtgcatgaccaatctcccgtcacctctccactgctatgccgtcctctcccctgtacatttatctgtgtttctagggctgttgcccgaggctgaggtctcttacctagagtttccatgtccactcctgctttctcccgagtgtcctcccaggactgcaggggtcctccaggatgaacatacacctgtgatgctttttcctttttgccagttagagcccctgtgacgttggagtccagcccagctcggtactggggcctccttccttgtgactgcttgtgcaatcctgctcaccaccctgtacttgcttcttgagccctgtctaccctcagtgtccaacacagctgtgcattagccacccagcctttggccagttcaccaaaaatacggcgcttaccacccttgcctctcctcacctcttttcctgtctggaaagtgtctgcttctgcttcagtcacaggccattcatggagttcttcccatgatctgtggactccgtgccccctcctaacctgcgtgtagatcgtccctctgggaggggcggggtgagccagccgctgtatttcctctgcatcgagcacacacgttgctcacgtatctgtgggtgaatgcatgatcgtgtgagggaatgactcataggagcagcctccagtttccagtgacaaaacgggcacgagtggcccctcagcctcccccagggaaccttgtacttggtgttaaagtctgactcatggaggggctcatgtcctagttccagctgggtttccaacccaggttgagatgtagcctctcttcctgatggctggttgctgatgtctgccttagccgtctggaattcatcctccctgggaagaacctcattttgtcctgggaagaacctcattttgttcctgggaagaaccttgttttgttcctgggaagaacccattttgttcctgggaagaacctcgttttgttcctgggaagaaccttgttttgttcctggaaccaagtgcagtcagaagctagggtgagacaacctggcgagtaaaaagcacagaggatgtggcaaagcacgaagaaaattggaagctgggcagcagcacagagctcactgtggcttaagatggagtgaggccagtctgccacccaagttttgaggtgagggtctgtgcctggagggtctgtgccctggcttctgagtcccttcgcatccccagaccctcagctacagcttactttgggaggactcagaagggtgtggtctgagacaggcagtgaacaccggtgttgatgtggtgaaatacagcaaaggagaatgttttcattcctgcaccagtgtttattgctcctgcttgggctgtgtgtggaaaatcccagacaaggttaggacttcctattggaggtacaagacttataccacactagagggtcagggccccaaccatccttgagtggctcagccatggaggatgataaccagtctgggaggtcagatggggggcggatcttcaactgagcccaggacagcggtttcagccagaaaggagaatgggaaactgccttgggagaagccccaagtgagcccaagggcgagagcagaaggaccctggagtgtaagagcctagattgcaagactggcaggaggaggtcaagtcgggggcagggagaggggctggagaggcggcctgctgatgaatgcggattcgccttcgattgagcactgtttcctgccagtgaaaaatcagtttgttgtcctcactggggaggttatcacacgcacgatatttgttactagtaacgaagtgtgggagttttctgaatggctactttttaaataagtaagagcagattcagggtatccctgcaataaaaagccaccttcaaccattgccttccactctggcttgcataggcagtgggctggcctgtgctcctggccgttgttctgggtggaccccagagagtgtgaatcctggtactcaggttggaggagttttatcctgctggggctatctgttcattgctgaattcagatttctttggccggttcctgtgggcaccatgtaagggcggtggtagatccagctgacctctgggcgtgtttgccctgggtaaaccatgacgcagcatatcctgttcttagctgtttgtaggcactgctatgtacctggtattgtgtcagtgtgaagcaatctggaatgaatacgatacagatgtgttctcagggaaaaatgtttgaaagactaaagtttggatatgctataggaaaaaaatgatgaatgtatacagaaaaatgaatgaggaatgaatatagaaaaaggtgaataatggtgtcatttgaaggacagggggaaatgagatgcctgcttgtctgccaggtgatgatttagtgaggaattggaacccagaatggtgtgtctaggaggaggttttttcctttgtagttaaaagttgaagagcagctttgctcttctactcagaaacagaaagatggatatttagtgccagaacttgagaggttaacgtcagccagttgattgatggctggaatttgcacatatgtcagccataaaggccacgacttagcccacccagctgctccccacatccaaggcatgtggagttgcaagtggagctgtagatctgaagttagatgttggagccataaaggctgagctctgggacactgctcctaggctgggcctggagtgaagccagtggtaggagtacagggttagctggcctgagactagaaggccccctatcctgctcgaggcaggggtctcttccgctgcccaccgtagaccacaggcagtggcttcatcttgaactgttcttttagttttagacttgccacaaagcttcttgcagacagccaagatccactgcccgggaaggctggtgaagtccgacaggcattgaaaggagggatctgcctgtggatcttgccgcctctcctcctggcgtttctaagtgaccctttcttcaggatcctggcttgtccatctctcccatcaccctgtcatcttcacctcctgaacttcgggtttctaatttccttctaaaacgcagacccataaaggaagacgggacttcagatgtgctgtgaattgtcctgatttgccagagcaggatggcggggggtggggggggtgcggtgagggagggataggctgggagataggaggtgcagcccagcccccaggtgtgcaaggccccgggcggtcctgtgctttgatatttgttgaaatccttacctggttaggcgtgtccctctctgcaaggccaggctcctagttttttgtagaagaagcaaattagaaaaaaagcctttctgcctcggtgtttacctgctttccactcaaatgccctgtttgctagtgtagattatcagggtagtgtagattactgctcattacagtgcagagttgactggataatattcaagatttagaaattccgaaagccagagcttgcccgttttgattcttttaagcacctcgccagcgttctcggagaggtttgaaatcctagtaaagtgaaccctgcgccaagcgcggcgcgtcggtaattccaatcagatggcggctgcaagatctgctccccccgcctggaaggcgtttcctcacccactttcccagtgtttggcggctcagctgtgcctccgcgctcgctcggagctgcggttggggcgggcgggggagggagggctaattgtgtcagatggagggacgccgtgcgggaccgtgcgctcgcgcctggcttttgttcccgggtctgacttctgacgggcaggagtggccgtggaggctgcggcgcgcggctgggacctggccggcggccacggagagcccttggcccctcccgtgttggccatttcctgggacttgtgtcgcaggggactcgggaggcatcctccccccagatagccgctggggaggggtcagcggccccctcgcccggccgagcccggctccccgcgggcggcaggggcagccatgaggctgcgcgcctgacccctgggccaccgggagggttcgcgcgcggaacccggtcgcgccggcgccggcccaggtgagtgcggcccggagctggtgtgcatggccaggggcgcgaggcacgggcgcctcagggctgcacgcacgtgggctgcgccgggtgtgcactggtgcccgtggacgctgtgctgtgtgtacccgcttgtgctcatgtgtatgcgtgtgcccttgtcagtgcgcgtatgtcaggtgtgtgcaccccgtctgcacgtccacgcgtgtgtgcttgtgagcgcgcgtctgtgtgtcaggcatgtgtacgctggtccgtgcctgagtcctcgtgggtgcgtgtgtacccttgtgttgcacgcgcaggacaaggagcgagagggccagtggagctttgcctagtgggggcgtctttggtaagcgtggaagagggttcaggcttagctctttctaactcaactgcctcttgaaaagcttcttgggttcatttccctgcaatggaattgggatactggccattgcgcagacctgcatccctcgcgtgtttcttgcaaaggtaaagggcattttagctctgcaatgaagtgggggtgcgctgggatgtaggaatccttacaggttccctggggaccgcatgggttccagcggtgtctgtggtccacaggacggcctttcacggtgtttgaattaaacagagcggtgctggttgcaccccgctaggttcagcctccctttccctaagttattgctgaattaaacagagcggtgtggttggctccccgctaggttcagcctccctttccctaagttattgcatttgtttttctaagcttttgtaaggttctgtggggtgaaaaactgtcaaaatttcagctggttaacttgagtgtactgcgttcccttttaaagtttagtggtcaaacgctgctgcctggaagtgtgggacaatatgtgttggatgtggagggtgtccctcttgccccagataccggccccctgtgggcgggaaatatccccgaggcccggaagtgttcctggctgtttaacatcagagtaaagttggctgggaatgtgtttttgatcagtgtctgcctctccagaatgcctctgaaggtttcccagtgcctgaatgcctacctaaatcctcttactatggtggagctgaatatttcctgaaaggaaacatagctgggattgtgctgatgcagctttgcacttttgcgtgtgtaaccattttgccgggcgacctttagccgggagaacctatccgagagatccctgcggttttgcatttcggcaagtggagcattcatgtggagcacctccctgttcaattttgcagagatttttctttctcaaagagacctcacaatcaagaccagcactaattactgtgtccccctcagggagtccttgtgaaccagcagcctgctctctacccttccaacattttgttcctaacaattaagtgcaattagattcctgaactgagcctgctaaatgcttcagcattgctgcctcctctccccctttggagaaatgaaagcacagtatcaggtgaaaacaagggcagtctaatcccgtctggtctcattcacaatagagatgttatgtacagatgaagcgtgagcagatgttattacactatcctaatgaactcctcagagatccagcaattcaaatggctgagccctcgcaacagtgcttatgcttttccctctttaagttttctagctgtggaccagtgggcaagaaagctgcaggaaaacaggcctctttctccctggttggaataaaggtatttgtgaggaatgaaaggtcacagtatcttccttggcccacagactgtggctaattcatttggtcaacaaatattaattgagggtccaggtccactgtctgccaggcgctgggcagggccctaagaggacaaaggggaaagagcctgtgtcctgcatctaggaaattgcaatatagcacaggagagaaggcatataaacaaataacgcaatacgagtgaaaagtacgtaccagctgctgcattgcaatagagagatgtgtttgttggtgtttgaatgctactcttgtctgagcgtgagactggggcttgaggcatatgaggcctagtctcatatgcctcatccattggctgtgtggtgctgcatctcggttttgcatctcacctcacggtttgtagactagtggtgattacggtaatgacacagaagcacttagctagtgttccaactgcataattagcagcatcattatccttcttttgcagagcactgaacacacaaccgtgttatcagaaaggatgcaatctctttgaaaaaaccagataccgacataggaacaactcataataacagtaccttaaatgtatatagatacttacagtatagtcggttatatacagtgtggttctgtcttggccgcaaattagaatcacgggatggagctggggtggggggtttgaaacattccagtgttctgattcaacctccaggtaatctgatttaattggtctggggtggacctgggtcagctgttttaaaaactgccccagtgattcctatgaactgacagatgatacacgtttggtcatttacaatagctgttaagagacaggagggggaggatatcttttctatttagagaggttgtgacttgtcctgggccacagagcttgtagtgtaggtatcagaacttatggaaggcttctgcttggttcaggactctttcccctactttatttattttttcttttttttagatggagtctcactctgtcaacccaggctggagtgccgtgccatgatctcggcctactcagcctctgactcctgggttcaagggattctcctccctcagcctcctgagtagctgggatacgggtgcccgccaccacgcccagctaatttttatatttttagtagagacggggtttcccatgttggccaggctggtcttgaactcctgagctcaggtgatcaacccgcctcggcgtccaaaatgctgggattacaggcatgagccaccgcgcttggccatgaagttctttattagtgattgtattagtccattttcatgctgctgatgaagacatacccaagactgggcaattttacaggaaaaaggatttaatggactcacagttccacgtgctggggaggcctcacaatcattcgaaaggtgaaaggcacatctcacatggcagcaggcaaagagagagagcttgtgcagggaactcccccttataaaaccatcagatctcatgataattattcattatcacgagaacacacaggaaagacctgccgccatgattcagttacctcccactgggtccctctcacaacactgggaattcaagatgagatttgggcggggacacagtcaagccatatcagtgattaaatgttaggactgttaggtgttcttgatgaatcaatccttttattattatgagaggactttcttatccttggtaatgttctttgatctgtagcctactttgtctgatatagccactccaactccctttgattaacatcagcaaggtacctcttttttctagcctttgtctttaaaaaaaaaaaaaagggccaggtgcggtggctcacacctgtaatcccagcgctttgggaggccaaggcgatggatcacgaggtcaggagttcgagaccagcctgaccaacatggtgaaaccctgtcttactaaaaatacaaaaattagccaggcatggtggcgggtgcctgtaatcccagctacttagaggctgaggcagagaattgcttgaactcgggaggcagaagttgcagtgagccaagatgcgccactgtactccagtgtgggcgacagagcgagactctgtctcaaaaaaaaaaaaaaaaaatatatatatatatatatatatatatatataaaatctgacaacttttgttgacttaaattgagatacttagactatttacataaatatgattattaatatggcaaggtttgaatcgtcatactgctacttgttttctatttctcctacctattgtttgttctgcctttgttttattccttttgccatttagattaattgaataatttttattatttcattttatctctcttgttgcttattacctataattcatgattttagtggttgctctagggtttatactatacctcttaacatcacaggctaccttcaagtgatattatatccacttcatgaatactatgagagcctataatagtcttatgggatctttggggtgtccaatttctggctggaaacctctgtggccgtggcacctttgcctgagttcttgtcctgtgtccaggaagaatgagataggcagacgggaagggtgaagaagatgaagataagctttattaagtgttaaacagctcagaggagacccaagtgtcctctctgtaggcaggtcatcccgacctctgctgctctcagcagagaggaggcctggagagggtagttcctctctgcagctggaagtcccaacatctctgcaggtctctgaagtctcggcagagagggtagctcctctgtgcagctggtctcttgtggtctctccattctcttgtcctctctcttgctctggctgaacatggaaaagcccttggaggggaggaagtgcctgtgattggtccatgggcggccatgggctggctggaagaggcaccatgagtccccactccatctgtgggactggcagcccgtccccagcctacaggccctccctggcctgaaggtggggcttactgaggacccacccccttctgcccaggactttgcctaccgctgccattcaaggcccggtacttgtccccaatcccgctctgagatgagaggtggggggccgggagaggagacaggcaggcagccagaatagacactcctgagccagcagggatggtgggcgggggggggcttccatgcgcccgagggtgcaggccgcagagatgcctgggtgctgtgcctgggagggtggctgagctgcctgcactcagggagctcctgcttttccccagctcccgcctgtgtggtggagtggaggcccaggtctgcagccgtggatggtggctgcagctgcaccccggtgggcagatcctcctgctcctggccccactcaagagcgcagggaggcttggatctacagctgcagtttgggagctgcagtggcacccagggagttcccaccccaactcagaaggggtggagctcccaccgctccatggagagtgcagccccagcctcacctccctgctgcagccagcgtgatggtagcaccgctgtcatcaatagtatatttccttttcttctttcctgaactttgtgctattttttcgaaaatttacttttacatatgtcacatgtcacattacactattgtttaaacagttaatttcttttggtgagctttaaataataagaaaaactcataaatttacctgtgtaattagcattctggtgctcttcatctgttggtgtaaagccataattccatctgccatgtcctttttgccaagcactgtctttaatatgtcataggtgtcagctggtgatgattttttttgggctttattgtatatctttttttgcatattttaagaagtttttggttcacttttattttgaagagcatttttattgggtacaggattctagattgacaagttttctttcagtattttgttttatttattttgtttatttttttaacttttagattcagggtacatgtgcaggtttattatatagtaaattgtgtgttgtgggggtttggtgtacagattatttcctcctccaggtaataagcgagtactcgataggtagtttttcaatcttcaccctccttccaccctccaccctcaagtagccctggtgtctgttcccttctttgtgtccatctttcagtatttcctattatactgctgtttctcacttatattttttaaaacaatgagaaacctgttatcctattggttggttccctgatgtaatgtgtcttttggccccgtggttgtttttaagatctttctctttgttactgggttaagcaatttgattattgtatgccttggggtagttcctgtcacatttcttgtgctagaatatatatatatatatatattttttttttttttttgagatggagtttcactcttgttgccaggctggagtgcaatggcgcgatctcggctcactgcaacctccacctcctgggttcaaggatttcctgccttagcctcccgagtagctgggattacaggcaccaccaccatgcccggcaattttttgtatttttagtagacacggggtttcaccgtgttggccaggctggtctggaatcctgacctcaggtgatccacccgcctctgcctcccaaagtgctcggattacaggtgtggccaccgagcctggccaagaaatttcttgagtttcttggatctgtgggtttatagttttctcctggtttgaaaaagtttcagccattattttttcaaatatccccccttccctgccctctccgtcagtctccattacacatatgttatgttggttaaagttctcccacagcttactgtgcttgtttatttgtttatttaggttgtctcatctctgtgtgctttgcgttgggaggttgtactgtgatgtcttcaagttcattcacctgtgcttctgcaggatctaatctgccagtatcgcatccagtgtatcttgcactgtattcttacattttcctcaatgaatgtttgatttgatctttttatgtttttcagatctctacttaactttctagcatatagaatagttattatgtggacatttgggttatataaagctgttatgacctttctttctcttgtggacataggctttatttctctttagtgtaaataagaatggaattgctgagtcataggttaggtgtatgtttagtttataagaaattgtcaaaccattttctaaagtagttgtaccatttattccacattcaaataccatttcatcttttcaaataaatttaattattccagtgggtgagtaatggcctcctgaatccatatggatattaagtactgatagaatacacggtcacatatcagcaaatagaatgattagtgcttgactctaaaagcaaattgaattcttataaggttatcatatagctgaagccttggctctacaaacatgaataggtagctgagtggttagtttttccaagtgctaatcttgtaattgtgtttgaggaagaaccacatgtgtatcacaggctggactgtctcttctttgcaggagagctcagagaggctcaagagcttaatggtgattctggaacacctttgaaccggaaagccagttgacttcctcataacataattatgctgtttagctaattactttttccaaagaaaaagggttgagagtctagaagtgtatgtggattactttgtcacagaagtaggtgctctacggctgaagtctggaagggagtgcattttcacataatgatgttggttgatgtaagtttctaggcaccccatgtggtgattgatgagttgggtgagagtgaacgtccgtctaggctctggaattgggaatgctaacatggtatccgtgggtcgtcttgggaattttagcatcacaagatggtttcttgttctctgtttgcttggtaaaattcctgtttttgctctttacaatccactagatttattatttcccttaaatgaaaaggaaaaagaaacaaactatgagatgaacgttgacaatttcttcctttactttttcagccggaagaattaacctcgagtctgcacgctttaagaacaaggcctttaaaaaatccaaagtgtgtggagtttgcaaacaaattattgaggtcaaggtatttcatgccgaggtaagtctgtgtttatgattctctcactgattaatccgagcaaaacaaacaagaaacaaaacgaaaactttttttcaggagtttccgaaagttaaacatggaattccccttcttagtttatatgtcccccaaccccctacccccttacttagcagggccaaccgtatttacatagataagtgctcatgaggacatttttacagaaagagcagagttcccgatgggagaggaggcagcaatttgtaaattaatcatttattctcaggtctgctcgaagtgtcagtaactcaggttgtttagtttgactttcagatctgttactcaagtttgcgatgaaatgtttctatctttagatttcgggttcattttggtatggcccctttcagatccttcactaaactaagccaccagcttgggtaccagatatttagacgtcaagtaatgaatggacttgccaattcttttgtgactgcacattaataaatctagtaagagaggtgtgactgtaagaatgtgggagtggtggggggcaggggctgcttggcggaccagtggggtacaccacacaagggagtcactaggaggaccaggtccttggagagtgcgggggctgctctttggcatcattcatctgcggggttggggatttcctctagaaaatgtgcagagtctcagcctgtgggctttgtgctgttaggacctccccctcagtgcctccttccctgcagacccccagcagatggtcctgatggccactttagagtagggtgcctgtgatggaacgatgcacgcagtcaaaccttatgggttgaggatgtgaccaggggcctctaaggggctcttgggattcttttacagttcaaggcctgagtgtgggtgagaagactggggtgcccctcctctgattcggccccttggagaatcagtgctgaagaatgtgttggatgagtggtgggtaccggccaccctggtcgctaagtaaagccagagaccagggagccacctgtgtaattcatctagatctgcatccaaggcagagacacgggctgtagtgtactctgagccaactgataggacatcctgtgattcaaaactttttttttttttttggagacagggtctcgctctgtcatccaggtaggagtgcagtgggatgatagggctcactgcagccttgacctcctggcccaagccatcctcccacctcagccactccatagctggactataggcatgcgccacatgcctagctaattttcttacttttttagagacatctcattatgttgtccaggctgctcttaaactcttggcctcaagtgattctcctgccttgcctcccaaagtgctgggattacaggtttgagccattgttttaagcccgtacttgcaaaggcactgcactaggtgatatcttggtcatctgtgaatgctgtggcctgtcactggccatcccctgcatagcttgtccagttcaggagggccatgtcagccaaatgtggtggccctttggtttggggcctgcaggtgtaaggtgatgagaaattgcactgatgctctcggacaggcgtctccatcaagcttgctctaaaatgtctgtgggcaaatacagcagcccctctgtgtcccaataccctacagggtccagtaggggctttgtgcctttccaggaacatggcaaaaatagaacccaaggagtctccccatctttgaatgtcattctcatagaaatgctcatattttatttttttatttattaatttatttttgagatagagtcttgctctgtcacccaggctgcagtgcatggcgcgatctcggctcactgcaagctctgcctcccaggttcacgccattctcctgcctagcctccccagcagctgggactacaggcgcccgccaccatgcccggctaatttttttttttgtatttttaatagagatggggtttcaccatgttagccaggatggtctccatctcctgacttgtgatccgcctgcctcggcctcccaaagtgctgggattacaggcgtgagccaccagcccggccagaaatgctcatattttaaaattttggtctctaactttgactcccaagtgtaaaagaaggaaaaggaaagtcgtggttgaattggaaccatgaaaccagcagcacagagacctgggaatcagagctgtcagggcctggtgttgatccgagagccctggtcctgtgccagggagccattgggcgatactgggagagctgtcatgagcagcatggcatcagcagggacactgggcttgttctcggcttcctcaccctgtgatgacgtcccgggcaaagttgcacagccgaggttccccatgaactgacttctgcctgtcagatgctatgtggggacaggtctgatttagagcaaaggtggaggtcagacagagctgggtcctggcccagcccctgacaggggcaaagctcctcactctgggtctaggacttagggtaagggctgttccaagggcagaagtcaggctaaagtgcacagccagcgttgtggtacttaggtttgttgctggtgttaggattgctctgagggaacccactgtgggtagctccacatggctgatgccgcatgtgtgtttggttagcctcgcaccacacatccttgagctgtaatccagtgggggagctccttagacacagaggcctttgcacaacttaccacagtggcttgggctgcactaggttggttatactgcttgaggagtaattttccttctttgtataaaagagaactgagtttactgaagagtcatctcagacatccttttaatacttcagtattctgttcctgccatttaagtagtattgactattttcagagtaaaggaaccaacgaaagagaagagcttggagaaagcacggcctccagctgtgaaacgcgcaacacgtcttggacggcggggagcctgtcttctttctttatctggaggatcattgtcttgggccttccctgggttgggacttgtgtctcttcctctgtcctgcagttgcacacactcagagggccagggaaggaccccagattgatcctctgattccaaatgaactctgttttgtggtatttaaatatgtggcgtgtgaaatattacggaggggtgaggaggcctgccagagtggtgttatgtgcctgagtgtgtgggtgcacatatgcatggctatgtgtgcagtgcatgcatgcagattgagttcatgcatatgaggacaagcagtgcacacacctgtgattgcatgtgtgtgctgcgtgcatgcgtctgagtgaatgcatttgcttgagcgcacagatattccacattgtgaggaacatgtgagagcatccctcctgttcagaccactttgtagagttcagctgctctatgcgtccattatcttatcttgagggagatagaaacagagaaaatgtgcatgcacacaggagagcttttgttcttgaaagagaagagagggaataaatagtgccctatctggacaagatgtcaacaggcttatcttgctgtgtgtcacctggttgttaaggaagatgcagtaaggcatgcgtctccagataatggtttaaatttcacacgcttctggcaacatccaggcactcacgagacaaagcccagtgtggtggccccgtggcccatctactggtttctgttggtaatgatgcttcccgcctcctcttggaactctctggagttctgcttcggtgggaggcagcgagacacctaagcgtcacctccgaggattcaaggcccactttggcctggaggaccccacacgtacccaaatggacaagcaacggggctgccagctctgtcctcgtgcagcattatctcctgtcctgttggctaatgctcctctactccagggaacccagtgtagcactggtttttctcactggtgaatagatttttggtcagtggaggtaacaagggaaaaaacagccatgtaccttttttcatccttgaagaaaatcactcatggacagctatgatgttaggtgacttcacccctctcctcacgctggtttatccctttcttctttacctcctcctcccctacagcttactttccaccgcaggatgcatggctgctcccattgccttttttttttttttttttttttttttttgagacggagctcgctctgtcgcccaggccggactgcggactgcagtggcgcgatctcggctcactgcagttccgcctcccgggttcacgccattctcctgcctcagcctcccgagtagctgggactaaggcgcccgccaccgcgcccggctaattttttgtatttttagtagagacggggtttcacttgttagccaggatggtctcgatctcctgacctcatgatccacccgcctcggcctcccaagtgctgggattacaggcgtgagccaccgcgcccggcctcccattgccttttttaagctgttcctttccaggggcagccaggatgcaggcattatggacacacaggcacctgctcctgtgtgtccctgttcgtggctctgggcgcctcagctaggatgggatgtcttgtctagaggcgtagaaagagatcaggatgtggggtcaagttctggctgtgccactcacaccctgggcagtttggacagtaggcttttatgaagcccattttctcaaccctaaaatgggcatgaaaatgagatccagtggtgcagagctgggactcagggaggggtgtacgtgaaagggcctggtctgcaggccagtgaggcaggacgggaccaccgcctccccaggggacggctgcttcgtgctggaggcagtgctgcactgcaccctggatgtgccgcctctcagagggcgctggttcagcttcccccaaagagttgccctgagcttgctggctgtgaatcctgggggtggtgtggtgagttggttcacctttccagcctgggtgcctgcagtgcatgcatgtgtgttcttgtgtgtctgtgctgaattcctccctcactccttgctctcctcttagcagtcccatatggtgaagctcttcgccttgagccctctggcctggtgggcttcagtagggtctgtccccatggtccctgggtctttctttgtggtgggtggtggcaagcacacagctgctttttgcagagagaactggcagagctgaggatgtggtaggcttgggaagctgcatgtcctgttgagttcatggcaggaggtcattatcaggagaaggaaccaggaactggcccagatgaaggaaaacctttgccttctggagaaggagggccaccgcccttcagggagcacttgcaggctccatccccgaggagggaccccactcaaggcacttggtggaggcattgggaggaaacagcagccatgggcaccgttggagcagaggcattctgactcaagggacgggcccacctctggtttctggcgctgttgactttacatgtggtgagtgttgtgcccttgggcatatgtgcactgagatcttgaggacttctgttgagaagtgtctgtcttcttctttctgtggcatagttttttggaactgcctcacgtgtgcctgtgttatggtcagaatgtttgtgtctccccaaaattcttatgttgacattctaacccccatgggatggtggcattaggagatggggccttggggaggtgatatgttttgtgagtgggcctcatgggtgggattagggcccttatgaaagggaccctagaaagctccctcacaccttggctatgtgaggatgcagtaaggaggcaccatctatgaaccaggaagtgggtcttcccagacaccacatctgtggtgccttgaccttggacttgcagcctccagagctgtgagaaatagcaactgtttataagccacctagtttagggtaatttttaaacagtagcccaaactggagagacatcatgtttttatgcacatagctctaggaattatgttaataaacaatagaaacttttttttttttgagatggagtctcgctctgtcacccaggctggagtgcattggcgcgattcagctcacagcaagctctgcctcccaggttcacgccattctcccgcctcagcctcccggtagctgggactacaggcgcccgccaccacacccggctaattttttgtatttttagtagaacggggtttcaccatgttagccaggatggtctcgatctcctgacctcatgatccgcctctttggcctctcaaagtgctgggattacaggcgtgagccaccgtgcccggcctagaaacctttataaaaaacatacaggattccatgtttcagaagtcttttagacatgattgttttcttagctttttcagttatgttaagttaatgtgtgtgctagagaccaggaggtgttcagggtgctcccaagcctgaggtgccatggtctgttgaggccaaggggccctgtggacaggagggtcatggtgtaggctgaggcggctgagataagcccccatcatcagagcaggagtactgggggtcggaagttacgtggaggctgtgaggctggcctgggggtgtgggtgggatggactacagtgcagaggcttgcggctcagaggtgggcagatctgaaatgccttagggagacacacagggaatgtcacccgtcgagagccctaggcctgcaaaggctgctgatgcacagaggcttagttttctaacttaatgcaagcaacaaatctatgatcctgcttgcctgtgagaaggcggggatatggtgtccccacttttggggggcgggcatcccatccctgctgatacctgggaccagatccactgaatgggagagcccctggccaggctttggcccccagccctgcctgctgctcacccttgctggccttcttcctggaggctgggccccggtctccatcgccgtgcagacctccattcctccttcctaacccagcttccctgggtctggccctttgtctgcccaggctgggtgcccttgagatccagtctcctgtttgcctctccgctcctctcctgtttgtactcagagacggctctgggaaactgtaaaccatccagcgggaagaacctgtgcctgcatcctcatggggccctttgaggctgtgcctgccttatttggtctctcctgactcccccaggtgctttgaaggccggctgcacagggctcatttttgacctcttgctggactgtgctgctctgcctgctaccctcatcctttaggtttcagctcaagcaccaggtcctcaggaaggtgcctccctgcctgccgctgtgtcccctagcatctgcccttttccctccagaactatccatggccagtgacagccagccatccggatgttcactggggcagtgattctctgccctcagctggagcccaggggcatgaggggctggctctgtgttgttcaccagatgcctgtgcacagggcagacacctcgtcccaaagtggagtgctgtcttgtcttgcagggtgaaccctcaccagcacacttttacgagcaggtgcggcagctggtgcattgcgatgcccacggtgaccaaggcttcgaagggctggagtctagtgggctggagtagtgagcaggaacaggatcccgtgtgaggagtgctttatagaggtatttgcagcctccttgggagcacagaggagggacaggcaattctgggaggtggtggggcagggagtgtgggcattgtcaggacgatggaggaactgctgtgttctgatcattgtttatgaatctatctgctcccctgggccgactgcccctactatgatgcgatgcactgcgtttcttgggtatcctgagtctcagcaaagggcctagagcccagtaggtgcacagggaagtaagttgcatgacaatccagatgaatttgtgcagataaacacctggctcattgatccgtcttctctggcaaatccatgtgaaatggctccagatgttatttccaaagttctttccagacaattggaggtggtgagtcccccaaccctgagggcaagcccagccccaccctggggttacttctaccggggaactgagctcagccctcccatcagacttgccccatccagagaggtgcaacacgacagaatctcccagaagctcccaaaggggaaggaggcacccaggccaaatttatctgaataatttctggtcggtggtggttatccgatgggaagcagcacttccctgcctcaaattctgctcctctgttgcaatacaaagcctttctcagccgcctccacacggactttatcgtggattttgtctgaaatccttcctgttttctaactctgtggctgggaagaaggcctgacccctcccagatgtttctcaacggtctgggttgtcaggatttgaggtttctgcatgcagggacgtctgggttgtgttagttgattgtgctggtggattttgatttttaaaactcacgagtagtgtagccaagctcataaatccaagtatttgttttgcagtaactgtgatctggattttatgttaagttgtggggttgttttctgttggtttattcagatggatgtaatgctacctctgggtgttcaaggtctgcctaggtgtggcaggggggcaaggccaagtggcaacttcgattccacatcctcgaagccagggaagaggcagtgctgtgcttcacggagcccacgtggtatcagcaaccctgggacactggcaggcctgaagtgttaagaaatgtgaggagcggccggcatggtggctgaagcctgtaatcccagcactttgggaggctgaggcaggcggatcacgggtcaggagatcgagaccatcctggataacatggtgaaaccccgtctctactaaaaaaacacaaaaaattagcaggtgtggtggcgggcgcctgtagtcccagctactcgggagactgggcaggagaatgacatgaacccgggaggcggagcttgcagtgagccgagattgtgccacgcactccagcctgggcaacagagcgagactccgtctcaaaaaaaaaaaaaaaaaaaaaaaaagaaatgtgaggagctctgttccagaggatggagtcgaagcctggcctctgcatgaccagccagacggcccctaacctagggtgagcatggacaggcaggatcccctatcaccctccccctccagccagctcactgtggctagcatgggtctaggaggtgcctactgtgttaggtctggccacccacacacaggtggacatctgccaccgggctgctgggctagtgagggacaagaagtcctggacagtcacacccatgtgtgtgggggactggggttcttgggagggtgctctggtttacatggtgatgagtggccccaccgctggggtctgctcacacactgagtgaggtggggacttgtttccttccaaatgtgtatttgaaggagacaattactaagagggtttcctagttagacttaagatgtttttgagggattggtaccatcttctttctttcctttcattctcaatattgtataatatgatccctttgaatatctgatggagatgcagagacattctccttgcacccgtgccttgtgttggggggggatatcttaaatggggggcaggttgacaacaaggaaagagacaacaaggttcgtcctatacatagattatgtaagtaatgttagggatgggagtggcgccctgagacgaagcagcaggcggggcctcagtgggtctcactgactctgggcttattctctggactgtgaagtgggcagtgaggcctggctggccctactcacaggctgtttgaggaacatgtgagtcaagggacgtaaaaggactctgtcagctcctgagtgcttcatcaaattagtcagtgccgcagctgattcagtgtcctatttgtgaagattaagtccacctcgatgatttctgagaggctcaaaggttaaacctgtgatctccagagccaggctgatgtgagttagaccttagctccactgcctctctgtgcttcagtttcccggtctgccacatgaggacaaaactgatactcatcaaggggttgtgtgaggatcagattcatgtctgagcacgtgaaccagcccatacgataagaatcccttgagggggataatgatttatttatttatttacttattttttatattctttcttgtagagatgggggtcttactgttgcccaggctgttttccaactctaacctcaaataagcctgccaactttgcctcccaaagtgctgggaattcaggcgtcggctctgtgcctggccccagtgattatttttcgagaaaagaaaatcattacgtggaaagaaaagagaaagagtaaaactgaatatctggggatgaaaacttcaagagttttaggggctgtttcttgaagtgtgttgcagtgttcttgggcagatctggcgtggggaggtgaggatctgtgggagagtgagaacagcaaatagataagagcatggagatggccgccctatgacatcggcgagggaccttgcggcgacatccaatcctacctgtgccacacgggcgcacagagagggctgtctgtctcgaatgggagcatcttgagccttatccccattcctgagtttgtgttcaacaggggtggtctggagggtttaacttcccttttgggaggcacctggctgaggaaatggtgcttgggaggcaggctgggtgcagccaagagccttgggctctctgcaaccccagtcaacctgcacaaaggcctgtgcaaatactggagtttgtgagagtgactatcttggttgactgattctgattgattgattattgttgactgattcttgattgattgattattgattggttgatgcctcaacaattaattttatagtgccttttgggtggtggcctccctcaggctgtgtgacccactccctgtcaccttctcacccatttgctgctatttttcttcttgtctcttcagacttttttgacccccgatacagaaatgactgtggaaccctccctccgcctttaggctcccgctgcccttcctggagttactttcctgtacctcaggtcatcctgattgaatccacggttcctgtgattttcctttcctcttgcactgcagtgtacattcatgaatgttttttgtgttcccaatgtatccaggtccagatcagtttctgccctgttgtaggtgtccaggacatatttataggctacaaaatgtttcagctgtgggtattaatgaatactggtggaattaaggagggaataaaggtagaagtatttagtttggtgagtattaacttgtggttagctttgtatctttacaaactctggtttgttggaggtggtgaaggtccctgcgggtgagctcttccccttccctttcccacgagacttatctgaggcttgccctgtgggtggctttcgggggtaaagattggtaatgaacctttcctctaggtttcttttgtcaagcgtggggctgcaggacgctgtggctggtagcctggtaagatgagtgtgatttgaagcggggcttgtggagaccatccaggaaaacagcacgcagggtttctattgcaaggttgggcgttcttgtcttcagtcaacattggccagcctccgtaggaccatagaattggcacaccccatgacactgtgaaggaaaaagagcctgtgtaagacaccaggctgaattgggatacaacacatgagctagatttttgtttgtttgtttttgagcggagttttgctcttgttgcccaggctggagtgcagtgctgtggtcttggctcactgcacctccgcctcctgggttcaagtgattctcctgcctcagcttcccgagtagctgggattaaggcgcccaccaccacgcctggctaatttttgtagttttagtagagttggggtttcacctgttggccaggctggtctcgaactcctgacctcagatgatccacccacctcggcctcccaagtgctgggattatagccgtgagccactgctcctgacccacaagagctagatttttattgtgtgtgtttgtgtatcttcacaggaaatcattttagccattgctcttgtcagcgtagaggaggaggacggacctggcccatctccttacgtgctgccgcatgtgtagatggggcatagcagggtagggggtgctgcttactgagttggagctgggagccgggcacagtcactgtggtgtagaacggggtagaggcaggatgtggggatgctgcagctcattgagttgagatgggtcctgatagtcactgcaggtgtagacaaggcagaggcaggatgggaggatgctgctcacgagttgagatggggtcctggcagtcactgcaagtttagatgggacagaggcaggatgtgggactctgctcactgagttgagatggggtcctggcagtcactgcaagtgtagatgggagctggcagagtcagggatgggctgctccacaggaagctgtggccctggacagttgcacccatttctgttcctcagtgccgtgatctttacaatttgtacattagagtagttaatctctagattttctctttctcaatagactatatagagaccactccccaaatagacaatttcataggttctctactaataattcacatatgtcatatacatttgcattttgatccctttgtgtactgctacctggaaacaacaaggtattccctttacatagattatgtaagtcatcatgcatccagtgatgtgacgttttggtagaggtgttctttctttggcttatttctggggaagcagcgagcgtggtggaggtgaggtggatggtggagacagcctgccagcattcctgctctgccttttctgcttagagtcattgtgaggaatagcagggtaaatacacatgaaacacaaagaacctgaggagctccagaaagtgttcaatggtgtcagtaatgacgatggtgataatgatattttagtgatggtgatgagggtggcaatggtatgccgataatgatgttgtaattgatggtgtgatggtaacgatgatggtgatggtgggtggtggcgtgattgatgatgatggtatattatgatgatggtgttgatggggatggtgatgatgatggtatgatgttggtgaagatggtgaggtcaagatgatcatgatggtgatggtgagtggtgatggtgtaattgatggagatgatgtggtgatggtgtggttgatggtgaccatggcactggtgattatgttgacatgatgatgggatggtgacgatgttgatgaatggtgacaatgatggtgatgatgatgttgatgacagcatgatagtgctgtgactggtgatggtgatagtgatagtgtagttgatggtgatagtaacatggcaatggtaacgattgtgatgatgatgctgatcgtgatgatactgatggtgatgataatggagaagggttaggggcatattctgtgatgcaggccagtatttctaccgttcctttttggctcattcttggactttcaggtccctgactttcacattttaacctcctagttaaatgaaatttcatatgtggttaagtagaaagaaaacatttcatcttttaaaaactgttatgttacatgtaagggccctgttatctctactcttggaactttaagtaagggaaagaaaagataaaatgacattgagcaatggggttaagtgtccagttgtggtttttcttacactcctcaaaccttgctggtgtgctcataccatcagttaggactctgaggcaacccgttctcactacattcactgagttcccttgggtggcctaacatggtccagttgccatcgatatcccaaaatggtgtatttcacagaggacagaggaaggtgctgttatgggtgagtctcggcattctggaatgagtagattcggccccaaaagttacaagttttgtgggacttggtccctggaagaaggtaatccagggaggatccagggtcagaccacgtgtaaatgctccccatttgagagatggtttctgggatctaatagtggaatcagcgagactatcatggaatgagacaggatggcacagaaaaagaagtgctgcaacaagagagacagctgtagggaaggcctaaaggagatgagagttggaaaggaagcaaggagaaaggagaaaagaagcaaggagaaagctgagaaaggagaccaggggaaagtgggatgaagggagttttgtaagaaagatttggtaatgggttgttccacgcgttaacccaacattattaagcacctgctaggagagaaagatgagagttttgtgtcctgtcttgagtccatcggagtcagcaatacactaagtgattacagataaaggtttggagatagagggcaggtcggtaggtgtgtgttttttgctttgggccaggtgcagtattaggactccagagaacatggtagttatttaaaactaacaaggcaacaatggggtcatggggttgagcagtaatgtgggcattgggcaggccttgtctggcggtcccccgctgtgggttaatcagtcccccctgccttgtggagcctgttactgggacacagagaggctggcaaacttgacagttgatgtaggagaagcagagggtgactcacaggcttgtttataacttggtcaatatgtttcgagtttgtataaaagattctgacaaccctgtaagacagtggcctggattcccaaggctggtgggacgttgtgaagaatagcagttccaagacaacatataaaaatgttgggcgtttgcaagcagacagctctgggctgtaactgctgcagcgggagccaggattcttaaacatgagtctggaacctcgtctgacaagggaactgatgtgtggtttgcagactgtcagctgtggagccgaggttcaggcaaagccatgagaaggggcctgccacacaccagctcagacgccggagggtaactgggctggagaaggttcaggctcctcacaggaaaacgcttttggtggagcctacttgctggaatgtcactgaccctctcacttgagatttttcagcttttcagtttttgcaagttgaggatgaaaagtgatgtctcctttttattatgtttttcattcatctggtgattacatgagttgaacatctaaaaagatacaaaaaagctgcctgcagcatttctgtttacttagcaaagagcctttcaaatcctttgttcattgcttatttaaaaattagattattttagggcgtggtaggtggcttatgcttgtaatcccagcattttgggacgccgaggcgggagaatcgatcgaaccgggagttcaagaccagcctgggcaacaaaacaagaccccatttctacaaaaaatttaaaattggcctgcacagtggcacgcgccaatggtcccagctaccctagaggctgaggcagaggattgcttcagcctgtaaatttgaggctgcagtgagctatgatcatgccactgcacccagcctgggtgacagtgagacctcatctctaaaaagaaaaaaataaataacattttgaaattaataaatttaaaaatcatttttttaaatttctgagacttcactatattatgaatataaatcttatctgtgatattaggcagaacttttgccaatttctaatgacatttgtcctcgaaaaggtcagtttcttatctttccactttgtacattgcaaacattccagtcagttgctgtctaagtttgtttgtggcctgtttgtcacgcaaaagttgtaatgtttggtttgttcagtctactcatcttttcatttagttcatactcttgttccttgttgtagaatgtctgccctttccaaagtcacaaagatgttctctgatattttattctaataattcatttcagcttttccattccgaatcagttctatgattgatgcatctgaaattcatggtatttctgttattattagatgatgtttttcatggagtaaccagttttcccagttttgttgtctggctcctcctttcgtctgagttgtgaggtctctctccagtgtcattttctctcctatagatgaggccaccgccatgtctgtcggtcacaaagtttatttcatacaacacagagtgctgtatatctgttagcttgccttttgtaagaactctcacatgtgaaatagtttgagatcataatttttcaatagcacctaatattttgtttgtatatatatgtaattttatctttttattgcttaggtaaactatcttttcatggcagagaggaatcttggctatcaccctgttctactcctaattacagaagggaaatgtgtgccagaggggacatgactggcacggatccttggagaggggctggagtgacatgtgagttcagactcctgaggtccctggacacctgctcctggtcctggtgtgtagctatggtagatgtttgctttagtgggctcatgcatgtggagccccagttcttgcaccaggccagaagagcctttgcacaccagctcactgggtgttccagtccagctctgggaggtgggcctgcccatctagagctgggctggcagctggtgtcactgcttaacctgctctgtcgcccaggcaggcagcttccgctctgtgctgcagtttgctgttcgtgcaacggagtgagaatgtgctttctccctggtccccatgggaacaggtggaacaaggcgtctaaagtacatggagcttgtggaaggcaccgtggcagccaataacggggctgcatggaaggagcctctcccagccagagggcatgtgtcttctgcagggggaggtgcagcggccggcaggctccgggcagtgtgccgggccccggttctgcaacccaagttctccaggttcttcttgtgggtccagctccgtgctagagggggaggttccagaagctgaggcattttcccttgcttcgtttacaggagtgggaagccttcgccagaagcccctgggagaattcacttacctttctgttggtcaaagttgggtcttaccccattctgagagcctcaggcaaggagaatgaacggggttgccctcgtgctgcggtctcgggcacccactgctagggtcctagaagaccctaaagggctcctgtcagtgtggttgtattcatcacgatttaccctattagaaatgggaaactgatgagtatttaaaatatttagtcagttaaaagcaatggtaatgaaccaattacatgttaaaatgaacataagcttaataaaaataactatgtttcaaaacaacaaaatgagaggaggtgcatttttttttgtgattctttatgcagccttaatcaagaggctggttacccttgcatgcagtcttctgcaatgtttggttgaagcgtcaaagacaatctagccccataaacatatctacttggaaaaggaggcatttaataggcttttccggccattgtagctatttcattttgattctacaccagaactcaagtgcagttgcttaaagttcagtttcactgtggaatctgaaattgtgtcagtagagtttttccacgctgttttattaaaatccactggcctgtcttgcacaccaagtgcatcttttacccgggtggaacaccacgcactggacatttggaaattattggtccactgacaatttcgcagaactctaaatgttgacatatttgttatacaatctcaggaaaatccccacatttgttaataatttgttgattttaacagaaatgtcctaggagttgttaggccctggtgatgggtacaagtctttttttttttttttttttaaagacagtcttactctgtcacccagggcacgatctcggccactgcaacctctgcctcctgggttcaggagattcttgtgcctcagcctcccaagtagcgggattacagacatgcatcatcatgcccagctaatttcttgtatttttagtagagatgggtttcactatgttggccaggctagtctcaaactcctgacctcaagtgatctgcccgcctagcctcccaaagtgttgagattacaggcgtgagccaccgcacctggcctgggtactagtttttaaaattctaattttcacttgaaatctcaaattttgacattggtttatgatgacagctcacttcatttttgagaaaatgacaagcactcgagtctgaataactgcattttgtctgtaggagttctttcaaataaaaatgacatcccctgagaaggtggctagtttagctgccagtcacacaactgctattccaaaaaggaggcgggtctgcctggctgagggtcaaagtgaaccatacgttttgtcttctgggcctgtgtgcttcagagatggattttggtgcgaagttcttttctgttttggagcctcccttctggccagcaccttcacagccccgaatccctaagtggtatcaggtaatgaggtctccatagcttgtgggcctgctggctatgggcttctgaaagcagcctggaacaggtcaagattgggacacagttgtccagcacgtgaatcctcagtctcatcccaaaccccagtctcacattagtaaaacaggcgaagataggtagcttctttccagggtgtgtggaaatttggcaatacgcatgcagttcaaacttttaggtgctgagtgtattagctgctgttactcgtgttagtgctgctattgtgagaccctggtcatgcacaacagagacgctgtccttgaggagcttgcagcccatcgggagagatggacacagggagatcatcatgatatgaaagccatgatgacctgccatgatggttcagtggcacagaagggtgtcaactcaggaacgaggcagctgagccgggcccaggaggtgggtgcaggatggcgtgaatgaggaggtgaggtggtatgggcagggttagggcaggcaggggtagggcaggcagggggctgtctcctgtgggggcaggataggaagctgggcctgggcactgtttgattcatattttgtaatatgtcagaaggcagggagagtatggctggatgcaaacactgaatttgatgcacagacgggctggagtccaccttcatggaccatggctgcccccttggctgagtcacccttacagtttctccccgagggtgcttacgaggagcaagtgcagtaacatacgggaaagtatcttgtacactgcctggtcggtgctgaccagagctgggccacggatagattgacggtggacttgctactctgaggatatccatgctgctgacaatcgagtgtgaagtcctagtccaaacatttgtaaaactttgaggtcacttgtctacataccagaaacaatggccctgcctctcaggattgtagtcttggctctgggcagtttatatgatttcactatgataattgaatttaatgattttgccctacagtgcgatggctgtctggtggccgagtaggccacccaccatgaatgtatcataccactgccaccttgcactgaccagggccatttttttgtgttgagttggcgtgttgcatgacaaatgatcccaaagttagtaccttaacatagcagtaagcatctgttatctcccactgtgtcagtgatcggaatttgggacacaggtgactgggcagttctggctcagggtctctggagaggctgcacatctgaaggcttggttggggttggagaccagcttccgaggtggcacacttctgtggctggaagctggggccagctgtttgtgggaagcctcagttcctctccatgggggcctctccacgggctgcttgagtgtcctcacaacatggcatctggctgtcctcagaatgagtgatcctgagaccaggacagaagtcacgatgtcttttagccacaaaagtcacacaccatctcctctgcaggttgcactgtcacacagcccagctgattcactgtgggagggggctatacaccagcagggggccaagagacgaggtcacccaggccatctggaaggctaaccgctgcatgatgtcgggtcctgtgacatgctgctagacgtgtgtgggcagaattctttgcctgactctcactcaccagaggccagaggcctgcccaccgcccttctccttatctcagtcctttgtgctggccttgctggggatggtttctgtctggacttttaatcttgtgtggaagccccttgtttcccaaggcaagtctctcttgatttgaaaatcactgatcacctttgtgtgttttgcccatcagaagtgtaggataaatacatgtctttgtgaataatcttacaaacctcaaggtatagaatgacattcagcaattcaaaaatatagatcatacaaagataacaacctagctgtaactactggattctaataattgccaggcagtgggcaagtgaccttatctgtttcatcctcattcaacccacacaaacctttttgactttgacacatcatagaaaacagagtgcaggagggggagtgagcattgattaaattcacggggtgttgacacgcagagctgggatgtggggcccctctccctacttctgaggccttggtcttcaggtcccacacacttctgcatgtggacattgctttctatttcaaagcagggtcccttgaaggattccatttgacccatgatagctccgtgggaggaacagagacccagcttgaggggcagagcctggataggaggctttggtcactgttccccaaccaggtctctttccctcctcccacagctgtccctgtgggctggcaaacgtgggggaaggggggcatgtacccgacgttcccttggagctggcacaggaggctgtgttgggattattagggttgttgcttcatttctctctccctgtcctgcaaggcctgcctgcagcatgcccgtggtctcgtggggaggtttatgcctcatgatcacagctgcagcctctgggcagaagggcctgtaaatccgcattggttccagctccgcattgcattgttagggcctccgaagggacacaggatcgctccgttcacacaatggcccctctggaaggattctcctataggaatttagacatgatttattctgacagtcagttctcaggttggccggaagtggaagcacttccgaaatccagagcacgactttctcacaaatttaaaggctcccatccggtctttcatggacactttaaatttgattcttaaggggcatcttccagtttctcttcttttttcagggatcagctataatttcgggcacacacgaatgcattctgctgctgaaattcactattcttctttagggatccagttggctggacgtacataccccttgaaaaaccaatctgctcatgaccccttgaaaaaccaattgctcatgaccgtgctcccaagacattcctacctgagccacctgagctgttgctaacagcaacagttgtaactctgctcttgcacaccatgtcctcactgccttctgtccacactgcctgtgtcatatgtaaaaatctctctcgtgccagagagaggccacctatgggatcttcaagcagagactctgaaggattgagagggtttgaagatgtaagaattcttgctagagagactgttgacacacattctttctcttttttttttttccagcctgcaagtattcctgccacaagaatgtgaagccaaggtaagcattccgttgctttcccatgggactttttatagctgacttgccttcattgaatgatatgtgtgggggggcctctttggactgcagccacggaaagaaaacctttaggaaagccagggctgggatacggtgtatacttttcatctcaaggataaaccaaaagctttgaaatccacggttttgattatggaaaataattcttaagaatttgatttcagatagaattcaatagttgtcccctggccacatcaacagctccttctcagtggcacatggtcctggtttctcactgccttgtcatactgcctctcggtggagagagggcaggagcagggaggccagggcattcccctggcctggagacttttctgcctcattttggagatagttgtgcataacggattggggttttcagctgccacggaaacctgggaaccctggagtaaggtttagtgagttcactgaggtttgtgagtctctagagaggttcaattgcccgatggcctctatgaccaaggaggcctggctatgtcctgttgggcttagggttttggtgagtggggaagtgaggtggctggaagtgccgtgtgggaagtgacagacaccccaaggaagaagcacatggttttctacttgtcttggtgctcgcaccttcagatctcctggggatggtggctgtacttacggaatcccaggtatgatttgggtctgcagtcggggtgtcagcagtgttttgccccatctactgtttgccctgcctatgggggctctgtaggtgccctgacaggttgtccccatggctgtaggtccgggaagaggagttttagagtcttgggattttgctactgttacagacctcatgggtcagcgttttgatcatttccagccctgccttcggctccgagtggaaggctatgctggaagctgattcatgttaccatgaactcactgcatgtgggtctgttttccatgtgaggactagggcggtggtttccccgaccctcccgatctcaggcatacacaaacacacacatgagtaaatacaccatgtgcatgcacataaatacacatgcatgcacataaatacacatgcacacaaacacattgtgctcacacgcatacatgcatatgtgtgcacagaaatacacacacacacacacacaccaaagttggaagaactagactagtatagctctatttcttttctcccaagagactttttaagtcttcattatggagaatgccgagcacgtgcaggagcagagaggatggcacagggcctgctgcccccttcctgaaccccagaccagcagcccctgtgacctggccacacctccttgcggctgcctccttcagatgtcatgtggggtgcacttctcgggcctcctgggggctgtgtgagcgcttctcctcttgctttccaccctgctctggagagggcttccccttttccagaggatgggcatttcttgttcacacactcctaggcgtagctgatttctgaccgtggtttatttgggttttttgtccacagataggctcctttcctggggtgctgtgcaccttcagtggtgtggagcagtgcttctgaatgcagtggtgagtgggaagattgtacctttgggggagcatttcaacttggagagcttccccctcccctaggaggactgggatgtgttgtccctcacccctgtttatggtgcctttgtccgcattgcttgcaccttgggtcggctgcggagtaggaggaggggtgggctgcttgtcctgactctgttgtgggcccagccacctctgagccacagccgcagagtgagcctgctgttgttccttccatttcttaaatgaagcctgtcgccggctgcttaagggttgaattctttggttcaaagtgtattccaaaatccttaactatcactgaatatggaattctaacggcagcaattggcagtttgctgagggatggataagctcttattcctatcagatccagtgtggggaaatatatccgtgttcattttttttataatacagctttgaaccacagggagaaagcccctggcaataacaaagcaccttctcattccaaaaatataatgccgtcgttgtggggatatgagggccataactccccagctgctcctgcagggtatgtggctaagggagcgctcggtcttccaggaactgaatatggctgtggcttctcccacattattgcactcggctttgagtccttcattactgtgtttacatatattgcccagtgggctccttagacgctgcaccagattgctcaggcaagtatgaagccttggttcagctcataggctttggtctggcatcaacccaagactgggtggtagcgtgtgctgtgttaaaccccctcgatggtgttcccctctggtgggagcacttgcgcctgtgtctacaggctccacacatgccctggagcatgtggctgggtgtggtggtgctgttgatctgctgctgtcagtgacattgtcacaggctcctcccatccggccctcagagccccttctgtggcactgacaatgtggagaaaccatcctgcagaaatgggaccgagacagcagctggggacctgcctcaggcagggaggcagagccatcgttgggacatttgagaagcgccaaaagactgctatcactctcttcttgagccattggacagtatgtccctcaggccaggccatgcagctcagtggatggatggaggcagagacctggacttggatccagtggggctttttgtctcctgaagcctttctagtcccccttgctatggtcttgatgttttgtctcccccagattcctgtgttgaaacctgacccccaaggtgatggtagctggaaatgaggcctttggggagatgattaggtcgcgagggtggagtgtctataaatgagattagtgctttataaaagggaccccagagagatcccttacctcttctgccatgagcatacatggcaaaaggcaccctctatgaaccctgaaaagggcccacaccagacactgaatctgctggtgcctgatcttgtacttcccaaccctagaaccttgggaagtatatttctgttgtttataagcccccaatattttgttatagcagcccacatggacttagataggccctgagcctcactttctcctgcataaaaaaagtgaataataggtttctgtaataaacagaaaaataactttctcttgctgttggttatgttaatacttacttaagtttcagggaagtcacataatgtatgtacaacacttgaaagtttgggatttcaactgttttgcttcctggaatgcagtgcttattcatgtagccacatgagctgtgtgggcatcatgacttgcttttttcctggctgtcacttgacttatggcaagagtgaaaaaagaagtaggagaaatgaagcagttgtaggaaagcagatgttgggaggggagaagggggaggaaagggtggcaggtggtgcccccctgaaggaaatgaagggggcttaggcaagcagatggaggcatgggaatcctatccttgaaacctgcagcctggcatctggtgagatgcctcttccgcctctgcccacttgcagacacatttgctccttagagttgcctttgtgtagggtattgagtatcatcttgaatcatcagaggtgaaatggacctgcagatatttttttgtaaacttaagaccccacgtagggaccatacgcaggagttagtgaggggaaatgcgcaggagtaatgttggggagatgccctgcacagggtcccgatgcgcagctcccccttaatccaggaaaaacacagaacctcctaccacctgggctccaatgctctcagacccccggctcatcctcagcctttgcagcctggctgcgaaggtccagcttgctgtttctctctctcatgtgcctcggtttgcacccttcttggatataaaatacaggagtgctggtgttgcctcttgctgagtctgtagaaggagagtgcagcaagaggagagaggtcccaggctctgtccagctcttggctcctgcaggtggcctcagcatcttcttccactgtcccggtgctacgtctggcacttgccaagccaggagcctttccccgctctccagctcgctgcttgagggagagagaatttgtgataggcttgctgctctttttaagctgagactacaggaggtcctggggaagtcacggaaccccctgctgccctcatcgcctgctgccctgggggcctttgctgggctctcccacagggatccccatgtcctggctgcggctgatgcaggagctttttcacttccaccagacagcccagggcaaagacttggtcctctgccatggaaaacacgggacctagagtttatggctcttcagaaactgtccctagacattcatcctgggcgtcaacagacgctcagtggcctaacgataagtttcaaccattaacttctgtctggcagttaactttcatcttcagatcactcctttctctgcatgctaagagccgcagctgccgtgcagtgggatacgggcctgctgggtcccgggattgacctctccagccccctctccccattgtctgatgaaaaacctcgagaccccaggaggtgaaacaacttacctattgtcacctagcttctgggcccagaattcatgggcgttgatttcaaagttctgatttttgctgttccatgtgttctttttggtgctttgccatcttcagtatcagaaatggagctgaggtttgtgtgggtgactttagcccaccttgctcgtatgccacagaacctactatgcctcttgtgaactccagctccagggccaacttctctaaaacacggttgagcgtctctcccgcttggcttggggctcactcctcttgggctgcatctctatttcctctcatgaaatgatgcctgagaattctctgactcccgcatggctcaggcctcttcttcccgtgaaggctctgctcatacatccgtggcatcttgtccgagactcccagtcctcccacagacagtgagcaggggcagtatctctccccaattcccatagctctttgcaaccctgcagggcctcggctgtcgcagctgtgcgtttctgttttggaccttctcacccgtgcacaaggaggaggctgtgggagctgctgctttgctgaccctgagctctcggttactgcattctttgacctgtctcatcttccatgtccagaccttaccctgtctagggccccagagcctccactctcagcatcccaccagccagctccgctctgctcagggcaggggcctgtctttcctgccagccacaggccacggaggctgcagactctcgtccccaccttcagcagggttggtgctccctggctgttggtggaggatggaatctggtgaagctcattgccacagcttttaaggttggggttcagctttgacctccccaaaaggtgtaagtagtggcctttcttcatatggtcttcactagaatgaatgatctgaatttgctagtaacaaggcctaataaattctttctttctctcttctttctccctccctccctccctccctccctccctcccttccttcctctcttcctcccttttttccttcctcccttcctctcttcctccctttctcctcttctccctttctccctttctcctttctctctttctgtttgtctttcttccctccgtcacccgggctggaatgcagtggtggatctttcacagcaacgtccacctcttgggttcaagggattcttctgcctcagcctcccagtagctggggttataggcgtgtgccaacacgcctggctatttttttttaatttttattttagtagaggcggggtttcaccatattggccaggctggtctcaaactcctaacctcaaggatccacccaccttggcctcccagagtgctgggattctagtgtgagccattgagcccagcaggaccaatacgtttttcataaccaaaaggaaaatccctggccctgcgtgtaaaagctttttgttgtttgtgagttcatctctttcctgcccctatttgtaccctttacaatagcttaggaagatggttactccctctgaactcagcttcttcatttgagcataggatttttagggtgtcatgagatacatctctccatgtccagcctgtgcagaaggaatgccactcagtcagcctgttgagggatctgcaggaccctgccgagtgctttagatatgctctgtcatttactcgcacacttctgtctgaggaggcttgttctgctccctcttacaggtgacagggctgggaccagcagttgcatctcttgctaaggcctgcgatggtcctgccccagctcacgcggccagcagggctctgcctctctctgccgtctcagtaaatgtttacacgggcatcccttctcctcccccccacttcttgctctaagggcagaggcagttaatttttaagccagccagttcagcagaatttcctgagggtagctctcggccgtgcacagagctggacccagatgcagcatgctgtcacagggagcttctgtctgcagccccacaggacgaaatgagagtctgattctgccagatgttgcaggtctccacctatgtttgccaagtgtgtgtgtgtgtgcgtgtgtgtgtgtgtttaatgtttgacagcttttaaaatggtttttaaaattagaagatgttatttttagagcagttcagatttgccgcaaaattgaggggaaagaaccgagggctcacacacacgtgcttacattacacacgcatgcatattcacgcacagagacacacactctcctgccgtcagcatcgccgaccagaacagcacatttgttagaattgatgagccagtattgatgagtccacagtctacgtagggctcactctgggtgttgtacattccatgggtttggacaggtgcatgataagtgactccaccatgacagtaccgtatggagtagtttcgctgccctagaaatcctctgtgccgcgttctctctcctgcaccccggcagccgctgaccttttcactgtcttcatagtgttgcctttccagaatgccatagggttggaatcatacatgtgtagccttttcagatgggcttccttccttgataatatgcatttaaatttcttccctgtcatttcttggcttgatagctcatttctttcagctgaataacactctgtcatctggatgtgccacagtttaccctccattcacctaccaaggtgggtactgattggtggcttccatgtctttcttttttgctagttgtcactactgcagaagaaccatgaagcatccttaaattctgctctttttgaggacacttttattcctttcctgtaagatcccttttctggtaggctgtcctcaccaatcatttttgactcattttaatagaaagtcactttacacattaacaccttactagaggcatgtttatacctgtgtctcttttctactgggaactattactcctgactcccagagtctgggaagtggccccactgtgtgaacccatcagccaaggccaccatgtgggctctaggctcactctcaaagtcagcaagccacattggcttttcatgtcagcacaattatactttgtacaaaagaattaaggtttctaaatcctagtaatctgagcctcaatcagaggcattcattgtggacttctaggcctttcttggactgaaggtggccagcaggaccaagccactgtcaactaaggaagtgcgtcagctgggcgacacagctgccagcagctcggggccttgccctgtggggctctgctccttgcaccgtctcggctctgcggggctttatggtgaccctgctggcattccacaggctgggaagtcactgagttcccactttacaccagaggaaacaggtctttgaaactggtggtgacctttggccgggctgagggaccatgttggctgtctggttatgagtgaagttctcgccctgtgatggcaggtttgtttttagtgcggcataagtgtaagctatatttgtgtaggaagtcctagccctgccccaaaagaggccaaaagagaattatgatcttttgaaacaagatatttgttttaaataaataataaattttaaaatgtatcctgtgttttctctgaatcatcagttttcattccacattgtgtttaacagatgaaacaacacatacctggaatgaatctgcacctatttgccacatcattttactacgtggccagtaacctaattagcagctctgcagccagcatctgtatctgtgtcctggcaggaggctagaaggtgcagccggagggagaatgtgggtccctgcatcctgcacgtggccaggccaggcctgtctgccttgactctcggcatctgtgaaatgagggtaactttccatgcactgtggttacatgggagggtaggaggctgttggcaagggcaccccgtgcctgcaagttgttttattgattaaactagggctttcgaggtgccctggaaatcttcttctgaaccccactctgtgtcttttgaccagttctaacctgagaaagaagctctccctgcagaacctccatacttgagaaataatttgggcaagcgtgctgttggttaaggttcactccccacctccacctgcgggatgttgttgggtgtctgtttaccaggggtgtcacggaggagagaaggggccagtgacctcatgcagccaggctctgatgacagagtgggacacccagagaagaagaggccccgaattcaaaacagatgccactttcatggtgacagtaatgaatgtttgagtgactgccctactgggtcagatagaccagggtggggagcccggtcctggagggagccccatatagctcgggggcaggggacagagcagcaaggccaggcatccatgggcacacgtcgctccagtgtaacaaaaacaaaagaaaagagcacgcggtgaacatttcctgctccgtgtgtgtgtgtgtgttgtgtgtgtgtgtgtgtgtgtgtgttccatacgtgaaactctgtactaggcgaatacttttttctcttgcctggcctctttgggagaacagaagtacaaaatggaaatttgcatgtgtgctctcagaagcagcttctgaaactttgaggactcataaaagagaagaatgaataacagcctgggtctggatcctgactctgctttgtcttacccatgtgaccttgggcttcagtttctcctctataaaacaggaattaacccctactaagaggactgcggagaactgaattcaacactccccaagcacagggcctggtggcttctgcaggagtgctcttttccccttttaatacctaatctgcatcattgtattaggaatcactgtagatgtctacagtgtcagttgctggaaatactctttctgcagttgtggtactgacgctagtagatttatttcatgaaatgttgcctacgctagcataaatcactatgcattttatttattaactgttaaatgacaagaaagtatattattttctaaattttcttctgagaatggggtctgctcttttaagcaaacaaattccattagtgggcttaattagtgcctcagacttagcctgaggcccacctgaaagtggttccatatgctaatggcagagccgtgggcttaatattttctgacactggaatccaagtgcctcttgccgatgctgccttggttctggcgagctctgtgacctttcccctgactggctgcccttcttctactccccccagcctcctgcatttgcacaggctcaccctgccttggctcaccccacagggacttccgtagtcctggcccacatcgctgcagccagggtatctgggcctagggcagagtgggtgctgcaggtgtccctgcctgcttggtcttggacttctgatgtgatttcccacaacccctgacgagcaggtacagatgcatccccagccctccgcctctctcacctgtgcctgggttctgtactgcgtgtgcgtggactctcccactcagactctgtttgcgttggccaccatgcttttactcccgcttctcttgaaacacgttctggccggtggtgtgcagatgagggttttaccctgctgggggtgcagcgggctgattggcagcctctgctgattcccctggtgaaaaacctcacctccccccgcctgcttccaagctaccagcctgacattaatcagcttgaaacatcctgaaaatgccatttggctccagcacctcctgcccatcagctctggtcacaggggaacgtccctccttccacacatgtggccccaggtgctctttctgctgactctggctgccatcgcaggagcccttggcccctttctagaagaccccaaactctgtattcccctgtgtgagctacatcctgttcagtgatgtccttttttgacgtgcttatcttactaccccttttttcagacaccattcagtttttgaactgctcagagtctataatgtatgcttcctcccattatcctgcacccctcctccaggctcactggggtcctctcctctcctcaatccagggcctcttcaccctgggcttctgggctgggtggcatcggggcctctccccagccctgtggcaccgtgtgctcttctggatcacagctcttcctctctgaccctgcctctggctctgtccaggttagaaatcacttgtcataatgtgtgtggtttcgtccactgctctcctgagtggtctgtccttacccttccctctgccgagatggaggaggaaggtgtgctgcagttggggagctgcagaacggccgttctctttcaatgtttagacaccatatgcagtgcatctttttaaaatttctactacagcattcttccacatggatgccacccaccctggcatctagcaatgtcatctctgcagaagctatctccgggactttctggcagtcctgggccctggctctggctgggagactgcattctgctctgagtgtaggttcccagtgggatcttgttcctgaggcctctctatggcccgttcagctcaggtcttccagagcctgagttcaggctgggagaggtgttggaagcccgcccctgttggacataaccatccctgtcaggctaggagagacctctgcaggcctcgtcctcagggcggggtcgtggccctgtgcccaccatacttccagacaccccactctgtctcgtgcagcccctccccagacgctgccctctcatgttgtcagcgtgtgtgtccatgagtctcagccccctagccacaggacaggcacttagttgatgtgcggcactgaagcctgtgctctctggcgactgcccagtgttgctgtgcatgcgccttcatgcctctcattgagacatggcttcacgttccatgggagaagaacgtttcttttttttttttttttttttgagacggagtctggctctgtcgccaggctggggtgcagtggcgcaatctcggctcactgcaagctccgcctcccgggttcacctattctcctgcctcagcctcccgagtagctgggactacaggcgccggggagaagaacgttctaatcaaaccgctggctttatttttgtggggctacttctgaagggtaggtttcctatgaagcccccatttcttctttttttcagccacatttttatcagcggggccaaaacccatacgaagcattcaaatccccacctccagattttgaattgtaaaataaaacttgtttcacctgggtttccccttccccccttttgtaaagcagttaattttaggcagggattcaggaagtcctactcccattttctgtcaagcacagaaatagctcgcggggcgccctctctccgcctccgggagcagctggcggagttcatttttgtgtgtttctaggcatttcaactcctgccttttgcgcactgtgtgtgtgtctgtgcaccctcaactccaaattaccctggaactttccgaacccgcaggcttcctttctgttcttaataaagcggtgtgcaaggatctgagctgttaacctcccttatcactggaaactgccccctgttcagaaggtctttagaataacaaactcacaatgtgtctttcaggggaggtggagtggatagaatggctgaatggttgcaatactgtgatggagaaattctgctttcagaatctttatctaaaacctttcgctttttcagaggtttctttcttctaaaaagcatttggaggggagtcgattgaacctcaggaggttggttagaaagcttgcactgcccagcaagagctggagtggcccaaccttgaacaatgggtggggtcagtaggagtagacttgtgggcattttaaaggtagacctgttaggattggcatacccacccggtgggcagaggcacggcttgtgagtaatccttaggttttgaatttgagacactgggcagagaggatgccactggcaggattttgtgaacaggggtggaagtttagctttagacctgcaggaacagtttaggtttcatggaatatgtttatgtggacattagagttaaatggaatgccattataagattttgtgaacaggggtggcagtttagcttcagaccagcaggaactagtttgggttcatgaaatatgcttatgtggacattagagttggccagttggccatttgcagctcaatgctaattttaaaagatttgataagttgtgagctcttagggtttctcatgttttcttttctttcagcttttttttttttttgagagggagtctcgctctgttgcccaggctggagtgcagtgcgcgatctcggctcattgcaagctccgcctcctgggttcatgccattctcctgcctcacctcccaagtagctgggactacaggcgcccgccaccatgcccggctattttttttttttttttgtatttttagtagagacagggtttcagcgtgttagccaggatggtctcgatctccgacctcgtgatccacccgccttggcctcccaaagtgctgggattacaggtgtgagccacgcgcccggcctcttgtcagccttctttagagcaaaggacagttggtaaaacccaaactgtcatcatgtgattgttaaacactcttgccaaaatgtatttcagggaaaatttctctggtcctacctttgtggaatttaccattttcttccctgaataactgttgtatgtttatacctttcttccattttaaactgaatttcgaaggcaactgctaattctttctcatctccgagtgcccgaagtgtgatatttgatatgccattctgcaatgaatgaatgaatgagaggttgagacactgacccaaagtctggcgaagtgaccagctcacttatttgtgctattccttttctttaggatgaccactgaacattgactgtcagagctctgcgcttcactctggagggtggttttatcgagatctgggcatcccctccctaggggtgaccacttcctctgccttgtcattagcaaaggtcagtggaagccagggcttgatatgaagagcctgctattgatttcatatggaaacccagatgccacagacccccaagaagcaggagctgggggtggcattagctgatgtcatcgccgaggctctgctccctgtgagctcagtgccgtcctgatgaatgggccttggctctcacagcagtgggagctcctcctgctccagagctccatgtccggaaccccgcctttctcagcataggctggcgtggttgaaaatacaaacacctgcttgcctgctccctggtggatgtggggccacccctcattttaaaagcctcggaaaactgtgctttgttttagtgttactgcctccttgaccttttcctttaaaataagaagaggatattacaaaatcacaggagcagagggtcatacatttctgtgctcttctcttgaagcagaaataaaagcacatcttatttgtgtgtctcctaagaaggggccttgccactgggccttgaggcacaggcacctgcccagtaggaggtgggcggtggttttccaggcagagggagcagcctgggctgaggctcacaggtgggaggtagggtaggcaagggagttgagcctggactatgttggctgcaggtgaggacagaggataagaagaatcaggtgtggggagctgacagtgccaggccctggagtctaccgtacggcaggcagggcgcctgccgatatgcggctgtgtcctccatgaaggcctgcgcaccaggcacatgggctccaacccagccttcctgctgctggccaaacagagagctgtggtgaggggctgcccccactgggggtggccagagccatgacagaaagccagtgtagggtggacatgagatgatgactcccgtcattcgtgagtgggattaggagtcactggcacacagttggaaagggagccatttctgtgccaatagttaaggtccccactcagtaggcccctacagcttcttcagagtcaggtatttaacttgtattttaaacatgaataaatcaaagcaaaatcaaaaagcgttccttcatttgttagactaccagttgagtgttttagaatgttcatggtgtcaggcatggcatctggaccctccttccaggagcctgtaggatcgctctcaggaactggctgtgattgatggggccatgccacatcaacatacacccggggccatctctgtaggacatgactctcgggtttcaccgtccactcaggcctatggtcttgggcagtggttcctccctgccttccttcaggtgaacaggacgggcgagggacatgtctgttttgcccctggttaagtattatcatgaatcagtctcattgtgcagcctcatcatcagaaaattgtccaggaaatgcctagtctgaaaaatatggagttctgtttcaggagagaggcaaagtctgtatggccgactgagatggccttcggtaactatgcgctgtctttgaaaggccgtggggtcccctttcaccctcactccaatctgacagtgtatattgatatagtcccactgtcaagactttcctatgagcttgaggttcacatccaccccgcgggtcgtattatccctatgtcacagatgaggaggaaaattgagttcacagaggacagtctcgtaaattcatcagagccagctgggagaagcagagggcttgccctaatttcagtctctgatgcaaagacagagctttttcggttctgtccagtcactctggggcttgaaacagtatattatggtttaaaatacatatttgtttaaaaccgaagcttacattcaagaacaccacatacgtgcatgttcagcctgatgcattttttggtgaatcgcagcgtagatggacgagaggctgccctctgcctctctgcccactggctagtgtcctgggtcatgtctgcccgcctcgtgctgagccacagccgcgctctgtcggcctcttgcccccaccatcggcggctgaaatctcctcactgtgacagctcatggcctcattgctgctgttggctttttcaagtgctgattttgagccctttcctctacttcccgacacagagcactgaaggatggcattctggtgcccaacacactgtctgggcatgctggggctgtgcgcattgctgggcacactatttctgttctctgttgttcctaacaaatcccctgtacactcagtggctgaaaccaacaagctgtgatggattcgtgactggctgggcagtgcttgcttcatgtggtgctgacagggggactgggtggccagaaggtacaaacgccctcatgcccatttccaacgattggcactgggcacctcggtgcccccttgtggtgtctccatgcggctgttcaggcttcccttcattatgggggctgggcccaagaatggatgctccaggcgaaggcggcaactgcagctgtctaaggccaggcttcggagttctgccaattccaccactcacagcaggccacagggcaaacccaggacgagcccagactcaagaggacagggacagactctacctcttgatgggggaatggcagagttcctttacagaagaccctggtgatgccaccgtctttgaaaacacaacctactaaacttattcaggcaatagcatgcaggatgttattgtagaggtaatcatcagtctcttctgatgaattaaaatgtaaattactcaaaatgtcagtgtcagtactttattactttattattaattataggtggccggtgagaatttaggctgatcagatgtagctggtgaggaatgcatgagttgggacctggattttccttgtgaaatggatccagtaatgtggatgcagttaaatcttggtccttggcattataatgctctataaaaagacggttcatcaactcaatactaccttttaatctttctgcaattaggttggattatgatttatgagtttttcttcttgctttttttgcaagccattagcattttatcaatcccagatgtcctctttctctttttgaaaagataaggcgtaggactgtggtaagtgttggcttcaggggtctgtagaccctgattctgcctctgtgggcctcggctgcaccatgagatgctggcctccctgctcagccctggtcttgtaagacagactcactgcaggaaggcgtttgggccccgagcgatcctgtgctgtgccctttgctgggacttgtgtatacagcatgcaagtgacctgaaagtgcttttcagccacttcgagaatcccctggacattgttccaacaataggttacatttgatttctgatctgagacaaataatggtgacataatggatagaggatactatgctttgctttaaatctattatattccctaccagtggtaacttgtttgcctgaggccagcgaggcctggccctgccttgtgggccatgggcctcaactgggtaaaggtagccaatgttaaaagctacacagcctaagtaaagaatgaaaaagaaggttccagtaggttcagctaagcccactgggataggggcactactcttttgtctaaaaattattagattccatagagttggattgaaggggaaactgaggcccctagaggtgaggagagccgagaccaagccaagaccaaggacgggaaagcttgagcctttcttttttcattttactgtgccacagacatgatcttcactagtgcttgttaactgtaaggaaaaatataatgacctgattctgggaattttccttctcttttcttccgctcctgtcccggttctcagcccgcaggctgagaaggtttaattgcgtctgccggcgggtgttttctcatggggattagagcaggctaaattgggctttgacgcttagtgggtaacagagcttcctgaggaatgtgaacctaattagggattccagggtcaagcctgacaaggagacacagaagcaaagttagggtgagctcttgaaggaagcagagaaagttaataaagctcgaatgtcctcattttgtactgccattctttgtatagatctgctgttgtttgcaggctgtgttgaaaatctgaccctgggcctctcttcaaccctctacctagccccctgtccccagcaccattggaaaagcagccttgaatgatgagtaaggccaccttcggcatgtcaggagccccggcctcacctgggggacccagctcctgttggtgtgcccagaacgttctgtgtcgactgacgtctccacccgtcctgtcagacctttgattgttagtgctggggggttgcattttgttccccaaatttaaatgttgaagtccaaatccccaggaccccagaatatggcaggatttgagataaggtctttaaagaggtaattaggttgaaatagggtcattaggatgggcctaatcagtatgactggtgtccttagaaagactgggacacagacacacacaaggaatggccacggaggacacggggagaaggtggccatctgcaggcccgggagagaggcctcaggaggaaccccctgcccacatcttcatctcagcctcctagcctccaggactatgggaggataaacggcgtggtgtcagctgcccattctgtggtatgttgttacaacagccgccccttacccgagctagactgttgcttatttaagcagataaacacttgggtcagtgtcagcactgggaatgagggactttccttctgtgattattctccttaccctgcccttgtaataaatgataataatggtatataaacacatgaacaatgcatcctttttcaatcttaactaatgggtgaattaaagatttgctattttattgatcagtaacatacaatgtaagaagtcaaagctgtggtataatagagtggcccttcgtaaaagctccaccctccttgcaaccaggctgctactccgtgtagagatatagaagagtcccaacccccaattatatcgtaaggtcctggtggtcagcaaatatttgggtccgtatctgtttttccctggctagttcagggcctcagaggtaggttacctctgactgttttatgacttaggaaagaaagtactgccatcttggcgccatcacgaagtttctttaaaagaattgtttttgtaaagataaaataaaagtaaacttcatttctgagtctttgcaactttcttagagttaaaactattatgattaaagtaattttatgtatgatagaacttgtgcataggtgatgtctctgtacttggcttaactcagtgaattgctttctcccttgtctgcaaggttggcaaggtcagtggctggcccgtttgtctctactcagtttctacttgttttgcacctgatgctgtcccacggatttgcattcggtgttgtgtggtgtgtgtgcatttgtggaacgccgtttcattgctgtgggttggtattgttgagctgattctcccctccagaatcctgacatgacaaggtttgcccaggcctgcttgataccagagtagagtagagacttcacctgtgggcaaatgacctggagaacaagcaggaagaaacgattagaggagccaagcctccaggctttcctgtagctgccgggtgtgtaaaagcatgcttgacacttgagggtgctcgcttcagttcttttttttttttcttttgagacggagtcttgctctgtcgcccaggctggagtgcagtggcagatcccagctcactgcaacctcccaggttcaagcaattctcctgtctcagcctcctgagagctgggattacaggcacgtgccgccacgccctgctaagttttgtatttttagtagagaggggttttgccatgttgaccaggttggtctcgagctcctgacctcaggtgatccgcccactgggcctcccaaagtgctgggattataggtttgagctactgtgcccggcctctcttcatccttacttcatgtttctgtgaggttctaggaagctgattcacgtgacccaccatgactgaatttttgatgatttggaaaagatagaattgaaatttacatttattctctttatacagatatgcatgtttatacagaatatgtagtgcatcagctatacccacacggctttagagaactgatggaaaaatgtcactttctatatggctgtttacaaagtgaaatttaataagaaacacaataaaagctgagtttggagttttattgtgttcatcaaaaggaaaacaatgtcggtcagcacgaggagaactgagttgtcctttatttctcccaggacttggatctcccagaagtagcagagagggattggttcaggtttgaagagttgatctcactccttactgaggaagatctcacccgaggccctgtgtctgttagcactgggggtaatggtggccgggccagtgcaccttgatgaaagcactttctaaggcagaatgtacttgttagctgaagtgctttcattc

SEQ ID NO: 5092 - DNA, 21605 bp, Homo sapiens
gcacatatacaccatggaatactatgcagccataaaaaagcatgagttcatgtcctttggatgaagctggaaaccatcattctgagcaaactgtcgaaggacagaaaaccaaacaccgatgttctcactcataggtgggaattgaacaatgagaacacttggacacagggtggggaaatcacacactggggcctgtcgtggggttgggggagggatagcattaggcgaaatacctatgtaaatgatgagttaatgggtgcagcacaccaacatgacacatgtatacatatgtaataacctgcacattgtgcacatgtaccttagaacttaaagtataataaaaataaataaataagcttaaaaaaaaggtacacccactttggagaaatgtttgacagtttcttacaaaattaacaccatataatccagtaatcctactcctggatatttacccaagagaaattaagatacagtccacaaaaagatatactagaatgtttacaggagtttattcatagtagtaaaaaaactgaaacagcccaaagttcatcaacagataaaaggataaactgtgattttaaaaaaaataatggccgggcgcagtggttcatgcctgtaatcccagcactttaggaggccgaggtgaacgatcacctgaggtcgggagttcgagaccagcctgaccaacatggagaaacctcatctctataaaaatacaaaattagccgggcatggtggtgcatgcctgtaatcccagctgcttgggagctaaggcaggagaatcgcttgaacccgggaggcggaggttgtggtgcgccgagattgtccattgcactccagcctgggcaacaagaatgaaactgtgtctcaaaaaacaaaacaaacaacaaaaatagtcaactctgattggtccaggtcatgctgttgagtcaggccatttcatagtggtttgagaagcctttgaattggatgaaggtgggaggggtgtcagtggaagggccccgaggatgtcctaggggctgtgggcatggcaggtattctgcagcttgtcttgtttaagaccaaagcaagccattcttcacaaagattgtcatgattctggtttgaatgatcactaatttattttttttgagagagggtctcactctgtcacccaggctggagtgcagtggcgcgatctggctcactgcaacctccacctcctgggttcacgccattctcctgcctcagcctcccgagagctgggattacaggtgcccaccaccacgactggctaatttttgtatttttagtggagagggatttcaccatgttggccaggccggtcttgaacttctggcctcaagcgatctgcccgctcggcctcccaaagtgctgggattacaggggtgagccactgcgcctggcctgaatgatactaatttaacattgctaaagtctgcatgatgaggctttcccgagtttacgcatgatttacatacctggtttccttttggatgtgtggtcgtctgcatcaaccaaggactgtcggagataagtgagaacatagagggtattttttttttttttttttttttttgagacagagtctcctctatcacccaggctggagtgcagtggcgcgatctcggctcattgtaagctccgcctccgggttcacgctattctcctgcctcagcctcccgagtagctgggactacaggtgcccgccccacgcccggctaagttgtttgtatttttagtagagacggggtttcaccgtgttagccagatggtctcgatctcctaacctcgtgatccaccagcctcagccttccaaagtgctgggatacaggcgtgagccaccgcgcccggacatagagggtatttttaaatgctttgaaattctaaagagaaaagggaaaaaaaaagtctcaataggaaaaatgtgacaaacggaatcccggcacctgttaatggttaattctcacaacagtgtctcagtgcatatccttggccagcagccacacctcggtcccctggagtggcagttccaagtcactggcatggccacaacagtttctgactcgagctaaggacagaactttgtttttgtccaaaattccctcattattatttttgtttgttttgttgttttttgagacggagtcttgctgtgtcgcccagcctggagtgcagtggcagatcttggctcactgcaacctccgcctcccgggttcaagcgatgctcctgcctcagcctctgagtagcttggattatcccaggcgctcaccaccacgcccgggtaatttttgtattttcacagagacagggatttcaccatgttggccagcctgttctccaactcctgacctcaggtaaccacccgcctcggcctcccagagtgctgggattacaggcatgagccaccgcccctggcccaaattccctcattaaacagtttctcttgcagaagcacaatgagtgaaattggcatgagccatttcactaaataaccacatcagtgaatttcctggtcctcactcaacaaacaaaacaactggtggttttccaggctggttcatttgagtctaccctcaaccagcacctgcccaacttctggcctagaagaggcacacgtggcagaaatacaagcagacggcagaataaatagctcaatgaaaagagtcaaactttgtaaaacatttgaagagattcattctgagtcaaatatagtgaccatggcctatgacccagccctcaggagacccagggaaaatgtgtgcaaggtggtggacacagctgggttttatacattgcagggagacatgagacagcaattaaatacatatagatatatattggggccagctgtggtggctcacatctgtaatcctagcactttgggaggtgaggccagtggatcacttgagctcaggagttcgagaccagcctgggcaacgtggcaaaccctgtctctactaaaaatacaaaacgtagccaggcatggtggcacacacctgcgggagtgggaggaccgctggagccgggaagttgaggctgcagtgagccgtgattgcaccactgcctccagcctgggtgacagagcgagaccctgtctcaaacacaaaacaaaacaaaacaaaaaaaacaaaacaaaaaaacaaaaccttggtttagaaaggtaggataacttgaagtgggaggctttcaggttataggtagattttaaaattttctgattcacaattggttaaaagagttatatcaatagaaaggaatgtctgggttatgataaggggttgtggagtatcccccccaaaaaaagcctccaagtagcaggcttcagagaatatattgtaaatatttctttcttttttcttttttttgagatggaatctcactctgtcgtccaggctggagtgcagtggcacaatctcggctcactacaacctccgcctcccaggttcaagcaattctcctgcctcagccttcctagtactgggattacaggtgtgtgccatcacgcctggctattttattttattattttattttatttattttattttattttaattttatttttgagacggagtctcggtctgtcacccaggctggagtgcagtggcgcgatctcggctcactgcaagctcggcctcccaggttcatgccattttctgcctcagcctcctgagtagcagctgggaccacaggtgcccgccaccacgcccagcaatttttttgtatgtttttagtggagacgggttttcaccgtgttagccaggatggtctcatctcctgacctcgtgatccgcccgcctcggcctcccaaagtgctgggattacaggcatagccaccgcgcccggccacgcctggctaatttttatatttttagtagagacaggtttcacatgttgtgccactgcatcccagcctcggcgacagagcaagactgtctcaaaacaaacaaaaataaagtgtgtattttttgacctaattaataaaagttcccatgtaataaaattttcaaaaacagtctttcaagtttttaaagatatatgtataaggaagttcatttcagtgatattgtaaaaggaaaacaatgaacaaaacagagtacatcaagaggcttgttgaataaatgatgtgcatctagagaagtcattaaaatgttgaagactttttttattttgctttatttttgtgagatagggtctcactctgtcgcccaggctggagtgcagtggcacaatcacggctcactcagcctcaaactcccaggctcaagtgatcctcctgcctcagccttggtagtagctgtgataccggcacatccctccataccgggctaatttttgtattttgttgtagagatggggtttaccatgttgtcccggctggtctcaaactcctggactcaagtgatcctcctgcctcagcccccaaagtgctaggattagaggcctcagcaaccgcacctggcctgacgacctatttttgtatgactattttataatggtaggatataatgcaatcttttggtgaataaacaacaaaatatctatactcatattatttttaaataggaaagatataccctaaatgattactgacgttttaacaaagtagtgggatagaaggggatttctacttctttgggtttttttctttgatttttacaatgaactcgtattatttcctagtaagaatgtaaatcaagagacaactttttattcatgggaggaattatcaatgtcaagagtcaaaacagataagaactgttaaatagtgcttatggctgggcgcggtggcttattgcctgtaatcccagcagtttgggaggctgaggcaggcaatcatgaggtcaggagttcgagaccagcctggccaacatggtgaaactctgtctctacaaaaatacaaaaattagctgggcgcggtgccgcctgcctgtaatcccagctactcgggagctgagacaggagaattgcttgaacccgggaggcagaggttgcagtgagctgagatcacccactgcactccagcctgggcgacagagcaagactccgtctcaaaaaaaaaaaaaaaaatagtgcttatcatattcagcaaaaagcaagcagcttgtggtcacagtaagagcagttttgtatgaataaatatggtttaaaattgtttttcaaaaaacaaacataaaaaaccaaaaccaaacatttctcaggaattttgtgaggacgaattttgtgtgtggagaaaacggacaaataatttccccatatatttaaatgctcaaaagttcactcaggtgctctcaccaggcaattacatgacaagtgatcacgtgcgaaaatacagagaatctggctcgttttaaagtgcaggagaaagcaaggccttactgtttctgaatttgctgtgtgtgtgtgtgtgtgtgtgtgtgtgtggtgtgtgtgtgtatgagaagatgggatctggctctgaagcgcagacaggagtgcagtggaagatcgtagctcaccgcggcctcaaactcctagattcaagaagtgatcggccgggcgtgtggttcacgcctgtaatcccagcactttgagaggccgaggtcaggagatcaagatcatgtggctaacacggtgaaatcccgtctctactaaaaatacaaaaaattagccgggcgtggggcgggcgcctgtagtcacagctactcgggaggctgaagcaggagaatggcgtgaacccggaggcgcagcttgcagtgagccgagatcacgccactgcactccagcctggtcaacacaagagactccgtctcaaaaaaaaaaaaaaaaaaaagtgatcctcccgccccagcctccgggtagctaggactacaagcatgcaccactgtgtctggcttttttctttttttcttttttttaagttttctgtaaagacggggtcttgctaccttgtccaggatggtctcaaactcctggctcaagcgatcttcctgctttggcctcccaaagtgctgggaatacaggcatgagccacccgacaggccatgttgctgaatttggaaagtggagcaaagaatcatgcaaaaaattaagaaaccaaaacgcaaccaaggcgaattcaattgcatttttttttcccagcgacactttctggacacgaacctctctcttcggcgaacctattccagggcgcccttcattttcatttcttgaacaacagccttgcaggccgagccgctgttcccgagaactcggcagccacagggagcagttgcatggacccaggagcgcgagaggccctgctctgccagcttcggccaatcagaggccgggagcggtgggcgtgacgtggggcggtgcgcggggctgggcggcggctgaggcgcgtgtctcgcgtggtcgctgggtctgcgtcttcccgagccagtgtgctgagctctccgcgtcgctctgtcgcccgcgcctggcctaccgcggcactcccggctgcacgctctgcttggcctcccatgccggtggacctcagcaagtggtccgggcccttgagcctgcaagaagtggacgagagccgcagcacccgctgcatgtcacctacgccggggcggcggtggacgagctgggcaaatgctgacgcccacccaggtacaccgggcggcgggcgtgcagcgagcggcacggcgcggagcctgtgccggcctcctgggtgggacccagcggagacagggccaggggcggtggggaggtcagcctgcgtgtgtcgaggcccccccaggccagaggtcccggggtccatgtcccatgctgggggccaccccgagcaccgggaacccggcctgtggcgtggccaggcaggttcggcctcggcagaaattcattcacttttcccgggcttcagacccaagagggacctaggttcggaacaggccggatccccctctccccccacaggccagggcgctggagagggacgtcgccgggaagagtaggctgtggctgcccggacgcccccagagcttcccctagggcctcagcattttagcctggttttggagggctgaagcctcacccgagagcctgtgacgcattatgtaactggcatgagcgcgccggccgatttctcctttgttaaatgggtcgagagcgtccagccggtacgtggagggcaacggtttagttttggtctttgacctcccacgcccacggctggggctgccgaagtgaagaaactagatttgcagacgccactgctagttggttatgaagctccgggcaacgcgtaaaataaactgccccgaccttacattgttttggatgttcacagaatttaattttttggatgtttaaatatgtagtgcccatctaacacagcctcccttttcctgctccctgccccctctcatcaccttggctttctccttttctttgcactttgaaacgtacagttaatgcagtttcacttcagcaggctccaggtaacctcctgatcaccaaatccagaaacgctgtgattcggacagacaatgtaagggtgtcgttgagaggggactcagtgccagggttggaatcccaccttatctgtttctcttaatagtgtgctgggatactagccccatggtgttgttgggactaaataatatacagcctgggcaacatagcaagaccccaactctacaaaaaaaaattggccggtgtgatggtgtgagcatgtagttcccagctgctcaggaggctgaggtgggaggatcgtcgattgagcgctggaggttgaggctacagtgagccttgatagcgtcactacactccggctgagtgacagaaggagacctggtctcaaataaaatacataacgtatataaaactccagtcctggctcttacagtcaatacagggtcattgattttattaaaaatctattctgttttgctttggagagtctgagatcaaagaaagagtattggtttcttcagcatttcttgtttttggacagagtctcactctgtcgcccaggctggagtgcagtggggtgatcttggccgcctgcgcctctgcctccccagctcaagtgatcctcccacctcagcctcccgagtagctgggattcagattcccgccaccatgcccagctaatttttgtagttttagtagaggcaggtttcacctgttggccaggctggtctcaaacccctgacctcaagtgatcctctctcctaggcctcccaagtgctgggattacaggcgtgagccaccacacccagccagtttcttcagcatttctgattttttactgcaaactggttccttcatacaggttaagaatagacccaccagcatttcgtggatggtcttgattcagggaagctctacaccttggtcctgacagacccggatgctcccacaggaaggatcccaaatacaggtgagaggtgagaaagacgagaagagcaggtcatgcaggatgagttatcgggtgtaagtcccttgctggacacagagaagtagacctggtttgggatcccccacccatgcttaagccagagagtgcctttcctgcccttttgcccccctacagcagtgtctgtaactcacagccgagagccatatccacctgtggcctgtttttatacagccccagagctaagaatggtttttacatttttatttagttatttattttttatttttttgagacaagtctcagtcacccaggctggagtgcagtggcatgatcttggctcactgcaacctccactcccaggttcaagtgattctcatgcctcagctaaccgagtagctggaattacaagcgccaccaccatgcctggctaatttttgtatttttagtagagacggggtttcaccttgtccagctgctctcgaactcctgacctcaggtgatctgcccgcctcagtctcccaaagtgctgggttacaggtgtgagccactatgcccggcctggttttcacatttttaaatgattggtgaaaattgaaagaagaatagtactttatgatgtggaaattacacaaaatttacctgtcagtgtcatcagttaacgttttattggagcaaagctatgtgtcatctgtggctgctttcatgctgcaaggccaagttgaatagttgcaacagagactgtggcccccaaagcttaacaaatttatctctggccttttagtggaaagtttgctgacctttgctctagaaaatgtcagagggtgggggggctgggtctgctcttctgcaaacacatgaggttcgtgctggcctctaagaaagtgagactgggccgggcgcggtggctcatgcctgtaattccagcactttgggaggccgagtcgggggatcacgaggtcaggagttcaagaccagtctggccaacatggtgaaaccccgtctcactaaaaatacgaaaattagccaggcatgatggcaggcgcctgtaatcccagctacttggagcctgaggcagagaattgcttgagcccaggaggaggagcttgcagtgagccgagatctgccactgcattccagcctgggtgacagagtgagactctgtctcaaaaaaaaaaaaaaagaaaggactgttgttcgtggctgtgttgtggcagccagcatgttcttgatgcccagttgtgactgtgcagtgaatgttccctgatctcctgtggtgctgacatcccgtgtttcttcatcagagaatggcatcatttcctggtggtcaacatgaagggcaatgacatcagcagtggcaagtcctctccgattatgtgggctcggggcctcccaagggcacaggttagtaaaggttgttttggtgggaggttggggagggagctcgggggcacattaggattgacccaatgcttttctttgagagcccttaaccctgctggaaatagcatctcagcttacctctagggcagctgcctcagggcacacattcagacctgcagcagtgtcaggtggctagagccttgggttctggacgacggaccctttgtgtagagctgtctctgcacccctagccctttagcaagcagggaagtggtgagagggaagcactgttgcagaaagcttagcatggccttttggggctgcagtgagtgaatacacagttaaactatctcaagcctttgcccggggtgatctttgagtttctttaaacatttcagaaatgatcatagtttccaaattaactatataaggttgctttctgtatttgttctgaaaaagtctagctgggtatattgaaaacagatttggaagacttcagtagaactatttgaaggcgcacacacacacacacacattgtattgtgtagtatcgtgttatagctattaatataaaatacatgtagatatttagagatagaaagagaaagcccaccgtattgaaacttccaggttgggtaagtgccacctaagctgatggtgagatatgcattcttattgcctggtgtcagttcaggatgtttccatttggtggaactgtcataatcctagctttttgtacagctttccagccaggagttaacatgaagaggtacaagaacatctctgacatggacagttggtcagggctcatggtttctctgtagacccggaagcttcagatgcctttaaaccctctcacgcagcatagtagatggtaaagggacagatttcccagggacctagtaagttctctagggcagtataaaattaggcaggttaattatgggaagcttacccatgagaataaggcaattctctcagtaagagctgtgttctcattttttttttttgagatggagtcttgctctgtctcccaggcggagtgcagtggcacgatctcgctcactgcaagctccacctccccggttcatgccattccctgcctcagcctcccgagtagctgggactacaggtgtccgccaccatgcctggctaatttatgcatttttagtagagacggggtttcaccgtgttagccaggatggtctcaatctccgaccttgtgatctacctgcctcggtctcccaaagtgttgggattacaggcgtgagccacgcgcccggcagagctgtgttctcatttttaaaaaagcctcagtaactcattttcttgttttttttccatattcttgtaatatggtataatttacatggtaacaaaatccacagatcggagggttcagtcagcaaatgtgatcaatgcatacacccatggaaggtagcagccattggaagacagatgacatttccatcgcccaacgacgttctcatgtgacctttttacttaaattccccagagctaaccatattctgactcctgtctccataaatcactttcactattctttttttttttctgagatggagtctcgctctgtctcccaggctggagtgcaatggcgtgatctcgctcactacaacctctacctcctgtgttcaaatgattcttctgcctcagcctcctgagtactgggatgacaggcgcccaccaccacgcccagctaatttttgtatttttagtagagtcaggtttcaccatgttggccaggctggtctcgaacttctgaccttgtgatccgcccgccttgcctcccaaagtgctgggattacaggcgtgagccactgtgtccagccactttcgctattttgtgttcatataatggtatcatggaccaggcacggtggctcacgcctataatcccagctgttgggaggtggaggcagttggatcacttgaagccaggaattcaagaccggcctggccacatggtacaactctgtctctaccaaaaatacaaaaattatccaggcatggtggcatactctgtagtcccagccacctgtggggctgaggtgggaggatggcttgaacccgggaggtgaggttgcagtgagctgagattgtgccattgcgctctagcctgggcgatagagcaagccttgcctccaaaaaaaaagtatcatgcaatgtgtattttaaaaaatttgggtgactggtctcttcattccagataatatctgtgagattggtccatagattgtatcaatagttaccccttttattgctcagtaatattcccgttggtgaacaggccagtttgtttagccattctctattatgggcatttgggatgtttccagtatttggatattatgaagaaatatccaaatattatcagtctttttgtttaaacttctgtgtattattctaggactatttagctttgaaaagaaattgggcacatgctacaccaggatgaaccctgaggaacattatgttagtgaaatgagccagcacacaaagacaaataccgtacaattctatgagatacctaaagtagccaagctcactgaacaaagtggagtggctgccatgcattctttttttttttttttttttaaattttttttttcttgagacagagtcttgctctgtcacccaggctggagtgcaatggtgtgatcgcggctcctgcaacctccacctcccaggtttaagcgattctcctgcctcagcctcccgagtagctgaatacaggtgtccaccatcacacccggctaattttttttacttttagtagagacagggttctccatgttgggcaggctggtcttgaactcctgagctcagatgatctgcccacctcagctcccaaagtgctgggattacaggcaagagccaccatgcctggcaaaatttaccatcttaccctttttttgaggctggagtgcagtggtgtgatctcagctcacttcagcctccacctccaggttcaagtgatcctcccacctcagcctcctgggtagctaggattacagacacgtgcaccatgtctggctaatttttatatttttagtagagacggggtttcaccatcttggccagctggtctcgaattcctgacctcaagtgatccacctgccttagcctctcaaagtgctggattacaggtgtgagccactgcgccccctccatcttaaccatttttaagtgtacactacatagcgttaactacattcactttttttttttttttttttttgagatagggtcttactctgcccctaggctggagcacagtggcacgttttcagctcactgcagggctcagctcacctccgggctcaagcaaccctcctacctcaggctcccgagaagctgggactacaggcacaggctcctaccacatccagcaaatttttgtatttctagtagagacggggtttcgccatattgccaagctggtctcaaattcctcctgggctcaggtgaccctcccaccttggcctcccaaagtctgggattataaatgtgagctaccatgcccgaccactacattcacattgttgtgaaacaatctctagatttttcatcttccccaacagaaaccctgtccccattgaccaacagctcccatttcccttcccctagccctggcagccaccattccactttctgttgcagtgtttgtctatttagatacctcgtggaattgtacagtatttgtcttgcgactggctaatttcactaatgaatgttctcaaggttctctggtgtagcatgtgtctgaatttctttttaaggctgaatagcctagagtaacacaggggagtaaagaaaaaataaaaggctggataatattctgttgtgttataaaccacattctgatcatcttttcatccatcagtggacagtcgggttgcttctgctcttggctattgtgaatactgctgcattgaacatgggtgtgcaaatatttaaacaacttttaaaaaataactttgtttctggccgggtgcagtggctcacagctgtaatcccagcacttgggagggcgagatgggtggatcacttgaggtcaggagttttgccaacatggtgaaacctgtctctactaaaaatacaaaaacaaaacaaaacaaaacataactgggcgtggtggcacgacctgtaatcctagctactcaggaggctgaggcaggagaattgcttgaacccaggaggcgaggttgtagtgagccgagatcatgccactgcactccacgcctaggcaacagagtgagatccgtctcaaaaaaaaaaaaaaaaacccactttttaaaaaaataagagctcatggtaccatttgcatccagtacatcattgaagcttgtagaaagctgcttagttaaagtgaggttggtcacttcgaagcagtcctccagttttctaagcaagtaagttttggaggtagaaagaaaagttctcctttatcctagaggctcgactgtggtatggtgggcccgggtcattgatttgcttgtccttaattggttgctcctacctgacagaagtgaaatgggtgttctgatggggggtgtgggtggtgacttgagaaggtccgggagcctgaagtgggatgaatgaagagcacagaggtcgttgggaggcgaggataagggggtgcagaggccagatcccacaggccaggagaggctgaactaagggcttgggcttgacaccagttacagcaggggcctaacacattctattaggtgatgcaaaagtaattgcggtttttgccattaatgtgttaattgccattaaatgttaattgcaccaaatacctgtctggaccctcggtgtcctccttgtaaatggtgtggtctgggtgctccatgttgaaacattcgataaaaatggatgatgtccccatctcaagtgctgggctgtggtacatcttccctctgcctctccccacaggcctccaccgctatgtctggctggtttacggcaggacaggccgctaaagtgtgacgagcccatcctcagcaaccgatctggagaccacctggcaaattcaaggtggcgtccttccgtaaaaagtatgagctcagggccccggtggctgcacgtgttaccaggccgagtgggatgactatgtgcccaaactgtacgagcagctgtctggaagtagggggttagcttggggacctgaactgtcctggaggccccaagccatgttccccgttcagtgttgcatgtataatagatttctcctcttcctgccccccttggcatgggtgagcctgaccagtcagatggtagttgagggtgacttttcctgctgcctggcctttataatttactcactcactctgatttatgttttgatcaaatttgaacttcattttggggggtattttgtactgtgatggggtcatcaaattattaatctgaaaatagcaacccagaatgtaaaaaaaaaaaactggggggaaaaagaccaggtctacagtgatagagcaaagcatcaaagaatcttaaggaaggtttaaaaaaaaaaaaaaaaaaaaagattggttgcctctgcctttgtgatctgagtccagaatggtacacaatgtgattttatggtgatgtcactcacctagacaaccagggctggcattgaggctaacctccaacacagtgcatctcagatgcctcagtaggcatcagatgtcactctggtccctttaaagagcaatcctggaagaagcaggagggagggtggctttctgttgttgggacatggcaatctagaccggcagcagcgctcgctgacagcttgggaggaacctgagatctgtgttttttaaattgatcgttcttcatgggggtaagaaaagctggtctgagttgctgaatgttgcattaattgtgctgtttgcttgtagttgaataaaaatagaaactgaatgaaggaactgagtccccggatgttttgttctattgggtataggtttcataagtggagaagtcaagtctcagggtgagtcgtctccgtgaccagcaagtaacagctgggacttgtctaggggccatatggagggtctgtgcctctacatgtgccattaacccacagcaggagcaacagttcagatttgaggtttctaaaaaaaaaatcataaaatgtgaggccgagtcttatgcccaaaaagcacctttgcttcaagtggtccttttgacccaagaaggatgttctaaagagatggctgaaaaccttcccccttggtgaagtctggcgcggacactgtaacaatgcctaaaagtagcctgcacttcccgttctgatgtgttatccacagaggctcagtaccaaagaggtcgcagggtaggagggtgagaaggtcacggtctcatgccatctgatgtaccgaaagaaagaaaggaggtgtttgaaggtgcaaatcactgtgatttggtctctgcgatgcaaagggggggtcctgaatcaggcctgacaggtgctaatgactagcccttccccatctttcactgcagtcttttttctctgaaaaaacttggaaatgttgccttgctggaagcacataaggtagatgtagttttctttttttctttttttaatttttttgagatggagtctcaccctgtcacccaggtggaacgcagtggaataatctcggctcaccgcaacctccacctcctgggtgggttcaaggattctcttgcctcagcctcctgagtagctgggattacaggcatgcaccactatgcccactaattttgtatttttagtagaaaaggggttttgccatgttggccaggcggctctcaaatcctgacctcctgaccactttggcctcccaaagtgctgggattacaggcatgagccacctgccaagcctggaagttttttttttttttttttttttttttactttagagttctaaaatcgtttttttacgtaataagattttgttgaacacaagttacaaagaaaacaactgtcagcgggcgccgtggctcacgcctgtaatcccagcactttgagaggccgaggtgggtggatgactgaggtcaggagttcaagaccagcctggccaacatggtaaaacaccatccctactaaaatacaaaaattagctggacatggtggcgggcgcttgtaatcccagctactagggaggctaggcaggagaatcgcttgagcctgggaggcgaggttgcagtgagctgtgatcgcgccatgcacttaagcctgggtgacaagagcgaaactctgtctcgaaaaaaaaaaaaactgtcctttgaccttggaaataaatgtaaagtctgggcatggagactcacacctgtaatcccagcatttgtgaggccaaggtggggcagatcaccagcctgggcaacatggcaaaacccctctcttctaaaaaaatgcaaaaattagcccgatgtgtggactcgttcctgtagtcccagctactgggaggctgaggtgggaggatcacttgaggtcaggaggtcaaggctgcagtaattccagtacttgggaggtggaggcagaagaactgcttaaacctgggaggtggaggatgcagtgagcaacatcacgccactgcactccaacctgggtgacagagcgacactccatctaaaaaaaaatagaaaaagaaaaacatattaatactaacacggaactaaagagaaaaaaaaatacataatatgagaaggcagtagtcatctaagaaagaagggtgatgccttcaactggtatgtgattgaacttccccaagggcggctaggaagggggtgacccccattctgaactcaactctggctcaaggtccagctgataaccaccgggcccactgggtcacaaattccagcttcctcatttaaaaaacatcagggttgcagggggttgtcagcctgccttatttacctcacagcgttgttgaggacaaaatcatcttttttgggattaagagttaatgtatgtaaatgactaaacttggctgattgtcatataagaacaaagtacaaaagtccagtttcctcaggtctgtttcctcacgcagcctccgcctcctgggttcaagcgattctcccgcctcagccttcctagtccccctgcttccttactgcctcctcaggcaggtactaggaggagtaggacaactctgtccatagcagtgtttgttaggagcagggacccacatccctgcttccgggtaactgccctgggacacatcttgacaaacttgcgcagtgggacttttttttgagaccgagtctcattctgttgctcagctggagtgcagtggtgccatcttggctcactgcagtctccgcctcccgggttcaagcgatctcctgcctcagcctcccgagtagctgggattataggcgcccaccaccacgcccggctatttttgtatttttagtagagacggggtttcaccatgttggccaggctgatctcaaactctgacctcagatgatccacccacctcgatctcccaaagtgctgggattacagctgtgagcaccgagaccttttctaaagatagcacctacaatctcagacatagggccctttcccaaatagctagacatttctcaccacagtgagaaatggatgaaagaggctacaggaagcttttcaccctactgaaggtggaatactcctttgggtatagatcagacaggtctcgattcagacccaccctgccactggagtgagcttatttcttcatttgtgaaagcctagtgttccatcatgggcaagcgtaagcacgccatcgacgttatctgtttctctaaccctttccagtattatttcagatgtacctaatatagaaactccaatgaacagaggtacttaggaaacacaattatcatgagtgtgatgttacagaaggttttgtagttgggattaacccatgttgataattatttagagtatacctttctgctttagcctatcagagtgaacatgactggtcacatttgtctccgtacatgaacatcctgtaggaaacaagagtgatctttaggtcatcatattcttttcttttaaacagagtttcactgttgttgcccaggctggagtgcagtggtgccatcttggctcactcaacctccgcctcccacgttcaagcgattctcctgcctcagcctcccgagtaggtgggatacaggtgcccgccaccacacccagctaatttttgtatttttagtagagatggggtttcccatgttggccaggctggtcttgaattcctgacctcaggtgatccacccacctcagcctccaaagtgctgggcccaccccacgtcatcatactctaaagagcaatttccaggagtgtcaagggagagaacacaagtcatgggttcttagtttctgtttctggttgggccagtaaagcccttcctcgtcccccttttccatttatcactagacacagaaaccaaaaaccatagcttcggctgccaaaagcctagaacaaaacaaaacagagtaacaacaaaataaggtgggttggaaagcctgattgatagaggcttaagcatttgggatcttactgagattgtcctgactcccaatcatatccctgaaattttatattttttactatctcattgttttacatgtaaaattatttaataaaagcagaatatgaggggagagggatctaatattacagtggggtcatttcaaattttggttatagtgccttctccacagcctgcttttctttaagggtgcccaatttctctctcagcaatgcatgcttctatgcacgactggcacgtggggggttttgtgtgtgtgtgtgtggtgtgtgtgcgcgcgtgcgcgcgcacatgccttctattctttaggacagaaaggtgcagtgaccacgtgcccacatcgaatggtgcaacactatcttcagccccatagaagaacttggagacagagctttacctgaaaggcttgaatggctcttcttggagcgaccgaggctatggaaacagtttcaggagggtggctgtccctctgagttgtgaactggtgaacctagaagggaacttcctgctacaataacacagcaaggcgatgtgatgaacacttttatttacaaatataataaaagctctgacagttatcatgctcttccttggaacctgaaaaatgttttgttttgttttaaagtgcatgcaaaagaagtaaagcctttttttttttcatcattttttattgtaagaaatacacagtttgaaagtgtgaataatgcaatatttatgaccaagaaatgggacttaggaggggaagggagataaagaaaaagatcaagatgatctgattgagagacagtgttgaactcaaatactgaactggaaaaggagggaggtggggaggaacaggaggaggaagtaaaaaaattgatcagagaaacagttaaaatacaatatgaaaataagtaatacctctccttaaattcttctatacacaaaatacacgatttgccaaagcccaatttgtgctactgggattctgtgactccttaagtgtattcacatcctctgcaacagcagaaaatgattatgatacaatcagaaatgctgaagacaagttaaactcttgccagcaggttcttaaaaatcacaagatctcttcacccacccaccccccgtccccaaaaaagtaataatatgtcaccactgatatgtacatcacattagtttctgtaaaatgtatcaaattttcaatctttaataaaactttgttttttttatcctgatgaataaataccaaaaaaataaaataaaataaaataatgcagcagctagttaagtgtaaggctgcggatattgtgtctctctcccccttggcatttattattattattttttgtttactttcacagattggtggtaatgagtgattgcttaaagcaatatacatccacttttttgttgttggtttattggttttgttaaaactgtctccaaagttttcactgaaacattttaatcacatcaatactgtgacgtgtactgtgaatagaagagacggccaggttttggccagactgaaagttgacacggggggaggaagggggcccctgatggagtaagaataaacaggcatagtccgacacgatgtcagtaagagtaagagagagagagagtgagagcaacgcccgttaaatggggaatgtggttttgcagggtctgaatttttttctgttttctttttttttttttttttgtaaatggcaaaaaatttaatctcatctgtagtcctccttaggaaaatctaatgtaccaaattcccaaatcccattctgaggctctccatgtcaaaagtttcaatctctcgctctgcctttccaataggttctttattctctcgctgcgttccttctgaagggcagccagctcccttcaatctgaaagaagcacgatgcagttcttaatggaaagcatctcctaacaggcaccacgtgcacgcgatacacccataggcacacatatgacatgcacacacacataggcacacaatgaagtgcgcgcgcgcgcacacacacacacacacacacacacacacaggaactacgggggaccgaggaaggctggctgagtcctgtgatcaatgcatctaaatcattatatttaaaattgctcacaagaatatcaatgtttggggtccacctggggctggcaatgccgttctagcagcccagcggctgggcggatctaggtcagtgtcctgtgttaggggatggctcatgagaagtaaaagacactcaagcacaattggattgtgctgctttcccacagagagccaaatgcctctgggtcattag

SEQ ID NO: 5093 - DNA, 12766 bp, Homo sapiens
tacttgggaggctaaggacggagaatcgctggaactcgagaggtggaggctatcgatagtattgggtttgcaatctgcggaggctttctaaaagcaaaagtgagaaacctctttctttctctttttttttttttttttttgagacggagttcactcttgttgcccaggctggagtgcatggcacgatcttggctcactgcaacctctacctcctgggttcaagcacttctcctgcccagcctcccgagtagctgggattacaggcatgcgccaccacacgcggctaattttgtattttagtagagacggggtttctccatgttggtcaggctggtctcaaactcctgacctcagtgatctgcccgcctcagcctcccaaagtgttgggattacaggtgtgagccaccgtgcccgcctctttctgtactcttatcctcgatttcttttttttctttgtatttttagtagggacgggtttcaccatgttggccagcctggtcttgatctcctgacctcgtgatccacccacctggcctcccaaagtcctgggattacaggcataagccactgcacctggcccttcttatcctgatttttaggtgcccaagactactgatttgtagtcaaggtcaaaactatcagggttcagaaccaatctccacacacacatgcaagcattcacactcctacaaattattgttatttaaagaatagtagatgctcattatgaaatataaatttcctataataaactagacataaccaattcaacatattagttcctttcattaaaaaaattaatgtgaaaatatatttatattatgtacttgcattactgagataatttagaatatgtgatgtctagaagtttaaaatttagaaactttatacttttatagttatatattataaatatcaatatatatgaacatattataaatatagtatactgtgtctatattatatagaatgcaattaaattagatataacatacttataatatatttatatattacatatgattatgtcttatattttatagttttacagttatatatttaatagtatgtaccttgcatttctggaataatttagaacaatgagaggtttagaagtttaaatttagaaaccatactatagttttctgcttgacattaaaaacaaacagattcagaaacataatcttatttcttattataaaatggaagattctacatgagtaaatgttataatgaacatagcctttatgtgccctactttttctttaatcaattttgatgaaagcatttctaaatttattacataattttctaatttttaaaagtaactgaatatgcatacataacctccttaaacaagcatatgaaatgtgaatatagaactttaaaactgaatagaatgaatatgtttctagcgcattaaatgttttaaattacatgtttaaaaactcagcatttttgtcacaaatatttttcccctattattctataacacaaaggcacctgagatggttgtttgctcctgacactaaacgctctggctgctctgcctttaaatgattagctctgccttctagctcccctgactttttcgtatggttaaattattcttgtgcctgtttgtatgcatgtatctaacagctcagttccttgagctctttctgattggtctatcaaaccagttgtagacagaaaccaggtagccatgcttttagcagtctatataatctaagaataaacaggtggccgggtgcagtggctcatgcctgtattccagcactttgggaggcagaggtgggcggatcacctgaggtcgggagttcgagaccgcctgaccaacatggagaaaccccgtctctactaaatacacaaaattagccgggtgtggactccggtggctgagacaggagaatcacttgaacccgggaggtggaggttgcagtcagcgagatcgcgccattgcactccagcctgggcaacaagagcaaaactctgtctcaaaaaaaaaaaaaagagaaaaacgagcttcaagtaacagtgtgaaggattttctgaagacttgaaaacatgagattttagcacttggattttgtaacatttattctgcctgcttgaaatccctttttgactccttcaagacagctgagattgccagagaactgatttctagacaatgagatatgctttgattaatttcttattttcagaatggaagcaatagctctacataaaagttccttgacagaaatatgtatgtttagtatactgtttgatagtctatttaagaacaaaattccattcctaattagagatcacatacaggaaaggagttggtacatggtaaacaataaatgctagttaattggagtttaagtaggaatgtgcaatttgaaaaagtagaaagcataacattttcacacctaaatgtgcctaatgtgccaacctaaaaccagaaatacaatcatataaaaatatactagggccgagcacaatggctcatgcctgtaatcccagcactttgggaggctgaggcaggtgatcacctgaggtcaggagttggagaccagcgtggccaacatggtgaaccctatctctataaaaatacaaaaaattagctgggtgtggtggcatgtgcctgtagtcccagctactcagaggctgaggttcaagaatcacttgaacccaggaggcagaggttgtagtcagctgagatccaccactgcactccagcctgggcaacaagagtgaatctgtctccaaacaaacaaacaaaaaacaaaatatatatatatatatgagtgtgtgtgtgtctgtgtgtgtgtgcatgtgtattatatttatatatatatatcacaataagatgacagagtggaacaaaagtctcttattttatcatatggtggcccctgtttggtaaaaatcacatagcaattaaaacatcaagaacaatccaaatatggggggaactggagtggaggatgagaaatgacaaagataaaaattctaggagagaatataaggctgtgccttttacttttacaaacaaataattataaaatgatgtcaactttcaccatctctttctgagtgtttatagaatggaatttctaataggctagatatcattaatcttacagaatatataccaagtgacacaccaaagtattaacaaatgttaaatactgaaacaaaagttaaatggaacagaaatgaaattagtaattttacagatcaaatagataaaaaaaaaaaagaaaaagaaaaaaatgtaatagtaaaagataatagaggtccttcgacttaccaagcagtgtgttctttcaagtaacagcctttgtactcaatagtattaggatgcttcaatgtcgtaaaaatttaacttccttaagaatatcttgccatttctattgaagtcagaaaagaacattttaatttaatttttgataggaaaatagtatttcctatcaagtatacgtatatacatttatattattgtaaatggacataaagtaaatgtttaataaatgaagaagctatttaacatgctatttctttctctctctctttttgtttttaattgagacagagtcttgctctatgcccaggctggactgcagtggcacgatctcggctcactgcaacctctgctgcccggttcaggttcaagtgattctcgtgcctcccaagtagctgggactacaggcgtgcaccaccagacaaactaatttttttgtatttttagtagagacgaggtttctccgtgttggccaggctggctcgaactcctgacctcaggtgatccgcccaccttggcctcccaaagtgctgggatcacggcgtgagacactgtgcccggcctaaacatgccatttctttagtttgaatacatgtaaaacaaatctatcaccaaatacattacaaaaaagccattacacatacccatgttctggtctcaaaatagtttttttccttttcaggcacccaggctagagtacagtgttgcagtcacagccactgaagcctccacatcccaggctcaagcaatcttcccacttgagcctcccgagtggcggactacaggcacacaccaccacacccagctagtttgtttgatgttttgtagaggtgggtctcaccatattgcccaggcttgtcttgagctcctgggctcaagcgatcctccagccttgcttcccaaagtgctgggattacaggcctaagccacctcatccagcctgcaaaatagttattgagctagaacattagcctttttaaaaataattatgaatgttcacacatttgtatgaaaacttcaggaacttttattatatgctccacaagaaggaaaaaaaaattgttctaaaaaaagtttaaagaattttgttaatttcttttttcttttttttttttttttttttgagacaggcctcgctctgtcacccaggctggagtgcagcggcgtgatctcggctcactgcaagctcgcctcccgggttcacgccattctcctgcctcagtctcctgagtagctgggactacaggccccgccaccacgcccggctaattttttgtatttttagtagagatggggtttcatcatgtagccaggatggtctcaatctcccgacctcgtgagccgcccacctcggcctcgcaaagtgtgggattacaggcgtgaaccaccgcgcccggccagaattttgttaatttcatactaactgtttatttcagtttaggtatacaactgtctctatctcacctcatgggtctgcttcccacataggacatcttcttaattgccaccacctcattggtgtgagcatttgtagcctgtgttagagggtagaagaaaaagaaaaagaattagtgatgtttcagccaatttaacttaaatattgactagagactatttatttatatatttatttattgacagtctcattctgtcgctcaggcggagtgcagctcactgcaacctctacctcttgggttcaagcgattctcctgtttcagcccccaagcagcagggattacaggcacgcaccaccatgccacgctaatgttttttgtattttagtagaaatggggttccaccatgttgaccaggctggtcttaaactcctgacttcaaatatccgcccgcctcggcctcccaaagtgctgagattacaggtgttttattttatttttgggaaagaatcgagctgtgttgctcatgctggagtgcactggggcacgatcttggctcacttagcctctgcctcccgggttcaagctattctcctgcttcagcctctcaagtaactgcggttataggcacccaccaccacacctggctaatttttatatttttagtagagatggggtttaccattttggccaggctggtctcaaactcctgacctcacgtgatctgcccgcctcagcccccaaagtgctgggattacagacgttagccaccgtgcctggcctcatattatatttaaataatatctccatactgcagtatcacagttcaaagatgcttcactttttgataggctaaaagacatctccactcccattttaatgtatagtttctctatattcttttctggatacatgtaagattgtaatataaaaaatgattagggtttaatatatcaaaccaaacaaaaaatgtcaattcccaaatgacccattctggcttcaccttgtaaactgtccatcaatggagaaccagtaaataaataaatatgatatgaccatataataaaataaccacttaaggaatgaggtaatcatgtgcaatgcaatatgaaaagatgttaaaaatgttttggtcaaaaacaagctataaagagaatccaatttttgcaaaatagtaataatgtgagtatacgtgtagaaaaaattataaagaattgcttcttttccgagaaaacaacaaatggcggatgacgccggtgcagcgggggggacggaggccctggtggccctgggatggggaaccgcggtggcttccgcggaggtttcggcgtggcatccggggccggggtcgcggccgtggacggggccggggccgaggccgcggagctgcggaggcaaggccgaggataaggagtggatgcccgtcaccaagttgggccgcttggtcaggacatgaagatcaagtccctggaggagatctatctcttctccctgcccattaaggaacagagatcattgatttcttcctgggggcctctctcaaggatgaggttttgaagattatgcagtgcagaagcagacccgtgccggccagcgcaccaggttcaaggcgtttgttgctatcgggactacaatggccacgtcggtctgggtgttaagtgctccaaggaggtggccaccgcctccgtggggccatcatcctggccaagctctccattgtccccgtgcgcagaggctactggggaacaagatcggcaagccccacactgtcccttgcaaggtgacaggccgctgcggctcttgctggtgcgcctcatccctgcacccaggggcactggcatcgtctccgcacctgtgcctagaagctgctcatgatggctggtatcgatgactgctacacctcagcccggggctgcactccaccctgggcaacttcgccaaggccacctttgatgccatttctaagacctacagctactgacccccgacctctggaaggagactgtatttaccaagtctccctatcaggaattcactaccacctcgttaagacccacaccagagtctccgtgcagcggactcaggctccagctgtgctacaacatagggtttttatacaagaaaaataaagtgaattaagcgtgaaaaaaaaatttaaaagaatttataccagaatatatatcagtgataatccctggagcagtgctatctgatgaactttctttgatgatgggacagttctatttctagattgtccaaaagagtaacatgtgaatgtggctagtgtgactgagaaaataaattttaaattttaatagttaacgtgcctactgctattgtattgaacagtacagcagaaagtaagattaatcctaagggggactttggtttcaggattacttatattttataataagactgtattacatatatacatgcctacatttatgatgtatatatgtgtattttttatctatagaggttgccttgtctcataattatgtctactgtcttctccatactccaaatgtaacagttcattgaaagtacatatgaaaaccattaatattcaagtaatagtcttttcctctcaacttactcaagatatacatatatatatatacacaacacacacatacatacgtacatacttttttctttttttaagacaggatcttgctctgtctccaggctggagtgcagtggtacaatctcagctcactgcaacctctgcctcccaggctcagtgatcttcccaccacagcctcttgagtagctgggattacaggcggccaccaccacgctggctaatttttatatatgtagtagagacagggtttcaccatattggccaggctggtctgaactcctggcctcaagtaatccgcccgcatcagcctcccaaagtactggaattatagggtgagctactgctcccagcctcaacttatttaaaatatttaaaactattagttttcttaaattttcataaaaataaatacaagacattaaaagattacctctgcatcagtgccataccctaatgtaagtaagctattttgcttctgtcacattattatcattgtggaccaataaagcatcgcagtggttctgaagtaaaagattggaattcattcactgataaagtcaggttaacattttagagaaaaattcataatcattttcttaaatacaactaatttaaaatgaacctcttagatacaatggtttctttatgatttttaaaaacggttaattcaaacaataaacaataattagtatgtacaaataatttgaccacagattcttatggaatgtcaaaatgaaaaaaaaaaaacccacaataacgtactacaggagttttttttaaaaaagcattaaggtaaaagtacctttatatattaatgagttatccactagacataattttccagtctgcagaactccacaaaacatattttagatattttattgatttagaaagtacagaatgacttttgttaaaaacaaaatctctaacactgttctggcttttaaactttaacactaaactgtgcttatatggcaatcaaaataaaagctgatgtaaattcagtattacaataaaggttaaagggactatatctgaaagtagatatttgaggcatcaatatatatagtgcagcttaaggagcctgagaaagatttagaaatattcaggcaatgagaaattttaacttcttgtgaggttttaaaaaataattaaccatactaaaaaatagaaaagcccacagaaataaaatcagatagtattattatttaattgctattaaggttatttataattaatgctatatttggacctaaaaacatgaaaaataaccacctaaaataaaaatatatttcttacatttataggataatcactgattagaacttaatgcttcactcacttacacatcctaatgtataggcagagacttgaaatttgaaaaacatttccatttgattattctatagatgtgaactttttagtgcaaatgttaattttgctatagatgtgatttttatactggctaaaagtcaaaacatgctagatagaaacttaaaaaaaaatcaatgtttagtacagaaaaaggagagtatcaatggggtctcagctttctagtgcatacagtactagaatgactacagcctctatcatttcaagttttattcttgaaacttacattcatgcttaaacttccaatagtctcaatggtctcagtaactattaccaagatcattgattcaagaaatattattaagaacttactattatgtgtttatatttttaaacattttacagctataccttttctattttatagacaaatataaaaaattatgttaatttaggaggcaggccaggcatggtgctcactcctgtaatcccagcactttgggaggccaacgtgggtggatcacctgaggtcagagtttgagaccagtctggccaacatggtgaaagcctgtctctactaaaaatatgaaaatagcagggcgtggtggcacacgtctgtaatcccagctacttgggaggctgaggcagaagactgcttgtacccaggaggcggaggttgcagtcagccaagattgcaccactgcactacagctaggtgacagagtgagattttgtctaaaaaaaaaaaaaaaaaaataggaggctgaggcggaggatcacttgagcccaggagtttggaaccagcctgggcaacatagcaaaaccctgttctacaaaaaaattaaaaccaaaattagctgggtgtggtggcacatgcttgtagtcgtactacctactcaggaggcagaggcagtaggattgcttgagtccaagggttcaaggttacatgagctatgatcacaccactgtactccagcttgggtgacagagtgagagaccctgtctcaaataaatgaataaataaaaattttaaaagtgaaaaagctttctttttgccctatttttgaaccccaactaaaaggtaattatatccagaaagatagaattaaactatttgctttagggggttatggataatatactgagttcaacaaaggtgatctagaaacctacaaactttagattgtgtttaggtgaatacaaaaatgaacatgcgcagtcctttttttgtttgttttccttagtacagtttcttactacctcatttgttaatgctgctaatttattctttatttttttaatttttttttagagatgggttcccactatgttgcccaggctggtctcgaactcctgggctaagtgattctcccacctcggcctcccaaagtgctgggattacatgtgtgagccaccacgccaaccaatgatgcaaatttcaaaattacttacgtaaatccaaacacacagaaatacttatcaagttaataatttctgttttctctgaacataacatatactctcagctgattgatttacaagagctgttccagcttacaattcacactaagtttattccctggcagcattcagtgtaaaagctgtgacctacagaggctaacagaattatagtgtttaggtataaaaatactagcgccagactctggtctttatggcttgccagcatgactatgacttatgaaaagtactaattgcagtaccaagttctcagagttcttcatcattcattcattcaacaaatacttattagctcccacaatttatcaggaattgggctaagtgctagggataagatagtgagttaatatgccagtacctatctctcctctaggaggatagacaataacaaaaataaaacaataaaagacaaatgtaaaactgcaattctgatatgtgccacaaagaagggtatttgttactttgagaaccacaacggtggatgtgacttagggaggtcaggaaagccttccctgaagaaatgaggtttagctgagagctaaatgatgaacaggagttaagaaggtgaaaatagaagggagaaatattcagagagaacagtttacgcaagattccaggaaggatgatcagaagaaaggaatcagagctcagcaatgagaatgagagagaagatagctcaagtagagatagggaccatgaaggacctttgggctggctatagtagggattttgatcttggcctaagaacgagggagagcccctaaagctttatagggaaaggggatgggatgagatttacatttcttttttcaagctcatcgaggttgcacaacagactgaagagaccaaagcaggcaatcatagttgtccaaataagagatagcgagtcttcctggtaataatggtacaagtaacaaaaggaaaaatctattagcacggagtagaagcaacttatataaatactactttggccaacaggaaaatccatttttaaggtactgccatgtgaccactacagataaaaggttaaagcttttcgtaagttctatagtacagtgtcattaattcccttttaatctgttttttagtgctttatgggtgtacataggcctgtacttttacatttatatacaggccctatagagttaatgattacgtttatcaatgccactctgctactgtatcatttctctagtctatcatcagcaacaaataatatatatttagtgcctactgtaatgagatcgtgccagcctttagagttgtaaacaaatattagaaatagtcctcaccttcaaaacgcacacactctagctaaatagacagggcttagcccaaaaagcaaataaaccactagtcttctgcagcctagtacaacgtaggtctcattttgccactattataaatggcttttataagtttcaaagcatgcttggtttattgtagtcattctgaaacattagcactttaagaaggtttggctgcttttttttttttttgagacagagtctcactctgtcccccaggctggaggcagtggcacaatctcagctcactgcaagctccacctcccgggttcacgccattctcctcctcagcctccccagtagctgggactacaggcgcccgccaccatgcctggctaatttttgtatttttagtagagatggggtttcaccatgttagccaggatggtctcgatctcctgactcgtgatccacccgcctcggcctcccaagtgctgggactacaggcatgagccactgcaccggccttggctgctttttaaatgagaagagtcaaatagagactgactcttgccaggagaattctgagaagatgaattagatttaaaataatagaagaaaagaaagcaaagatgacagagaatacatctgtaagcaaaacaaacaggtcacaaatgaatatatacagatgtttccattttaaaaagttcaaaactaagcaaaaccaatttacatttttaggagtacagattaagtggttataactataaagaaaagtaagaaaataatcaccataaaaatcagaatggtggatactttaaggggacggagagggttctgactgagggagacataaagaggggcttttgggatgctgcagtattgtatttcttgatctgggtggtgtttttacacagagatttaccttttaattcttctgaagttctatattaaaatagatatgtatattgtatatacttctttatgtatactttaataaaaacgctttgttaacaagaggacctgagactaaagaagacagaactttgggcctaaatgatattctgactacacactaacaagggagtgttaactaagaaattagcaccctttttcttttcttttttttttttttgagacagaatctcactctgtcccccaggctggagtgagtggcacaatcttggctcactgcaagctctgcctcccgagttcacgccattctcctgctcagcctcccgagtagctaagtagctaagtacaggcgtccaccaccatgtccggctaagttttctatttttcagtagagacggggtttctccgtgttagccaggatagtctcgaactctgacctcgtgatccgcctgcctcagcctcctaaagtgctgggattacaggcgtgagccatgcgcccagccgaaattagcac

SEQ ID NO: 5094 - DNA, 12724 bp, Homo sapiens
ttcttcctggtttagtcttgggagggtgtatgtgtcaaggaatttatccatttcttctaattttctagtttatttgtgtagaggtgtttatagtattctctgatggtggtttgtattttgtgggatcggtggtgatataccctttatcattttttattgcgtctatttgattcttcttcttttcttctttattagtcttgctagcagtctatcaattttgttgatctttttgaaaaccagcttctggattcattgattttttgaagggtttttttgtgtctctatttccttcagtctgctctgattttagttatttcttgccttctgctagcatttgaatgtgtttgctcttgctctctagttcttttaattgtgatgttagggtgtcaattttagatctttcctgctttctcactgggtgtttagtggtataaatttccctctacacactgctttgaatgtgtcccagagatctggtatgttgtgtctttgttctctttggtttcaaagaacatttttatttctgccttcttttgttatgaacccagtagtcattcaggagcagtttgttcagtttccatgtagttgagggttttgattgagtttcttaatcctgagttctagtttgattgcactgtggtctgagagaagtttgttataatttctgttcttttacatttgctgaggagtgctttacttccaactatgggtcaattttggaataggtgtggtgtggtgctgaaaagaatgtatattctgttgatttgggtggagagttctgtagatgtctattaggtccgcttggtgcagagctgagttcaattccggatatccttgttaactttctgtctcgttgatctgtctaatgttgatctgtctaatgttacagtggggtgttaaagtctcccattgttattgtgtgagagtctaagtctctttgtaggctctaaggacttgctttatgaacctgggtgttcctgtattgggtgcatatatgtttaggtagttagctcttcttgttgaattgatccctttaccattatgtaatggccttctttgtctttttgatctttgttggtttaaagcctgttttatcagagatgaggattgcaacccctgccttttttgttttccattttcttggtagatcttcctccatccctttattttgagcctatgttgtgtgtgcacatgagatgggtttcctgaatacagcacactgatgggtcttgactcttttctaatttgcccgtctgtgtctttttactggagcatttagcccatttacattaaggttatattgttatgtgtgaatttgatcctgtcattatgatgttagctggttattttgctcattgttgatgcagttttttcctagcctcaatggtctttacaatttggcatgtttttgcagtgctggtaccggttgtgcctttccatatttagtgcttccttcaggagctcttttaggtcagcctggtgatgacaaaatctctcagcatttgcttgtctgtaaagtattttatttctccttacttatgaagcttagtttggctggatatgaaattctgggttgaaaattctttcctttaagatgttgaatattggcccccactctcttctggcttgtagagtttctgctgagagatctgtgttattctgatgggcttccctttgtgggtaacccgacctttctctctggctgcccttacatttttcccttcatttcaactttggtgaatctgacaattatgtgccttgtagttgctctctcaaggagtatctttgtggcgttctctgtatttcctgaatttgaatgttgacctgcctgctagattggggaagttctcctggataatatcctgcagagtgttttccaacttggttcattctgcccgtcactttcaggtacaccaatcagatatagatttggtcttttcacatagtccatatttcttggaggctttgttcatttctttttattcttttttctctaaacttctcttttgcttcatttcattcatttgatcttccatcactgataccctttcttccagttgatcgatcagctactgagtcttgtgcattcgtcatgtagttctcatgccttggttttcagctccacaggtcctttaaggacttctctgtattggttattctagttagccattagtctaatttatttcaaggtttttaacttttttgccatgggttcgagcttcctcctttagctcggagtagttgatcgtctgaagccttcttctctcaaattgtcaaagtcattctctgtccagctttgtacgttgctggtgaggagctgcattcctttggaggaggagaggcactctgatttttagagttccagtttttctgctctgtttttccccatctttgtggttttatctacctttggtctttgtgatggtgacgtacagatgggtttttggtgtggatgtcctttctgtttgttagttttcctctaacaggaccctcagcttgcagcagatttttaaaagaacttccaggaccttgtctgttattgacgcctatgtcactacaggaatcagagcagggcattacattgatcctttaagaaattttgctaccctataccccttgaccctactctttttttttttttaatttttaaaggtattgttagaaatttcccaaggtttatttgaaatgacacaccactgaaaacataacttttaagatgatttgtggatacagtacacatcacctatcttactttaggacagtctgtgaagatatatttttcctgctgcagttcctttgtcaagtgactttagacagatacaggactgcaaggtgactcaggtcatgctggcataggagaagcaggtgctagtgtttcacttgaactagttttgggctggggtggaatgaaagctccctaggccatgaggacatctttgcaatgtggagagacccaaatcagtgggtgttgctctttgaatgttgaaggccttgtcagcatactggtcaccagtttcatcatcacttcatactgtttgtaccaaagcaccacagtttccttatgaaactagcttcaaggctggagatgtttttgaaagtattaatataaaatccaattcgtcttgacataataatggtaacttttcttgtaagtcaccattaaactcttcaaactttctctatgcttctgaaattctacttctgccttagacagaggctcctatccttcctcctgaagctctgttagcccgatggaggtgggcaggcactgtcatagtccgtcagcttcctgctgcacttggtgtgtgattcttcaagtcaggaaattggtccaggtagttttccggtgttagcaaggatgcaccatgagttttttgtggatatcctcccagagcacatcacctttctcaccaaccattttccaccttcctgcccagaccaatccagcgcacagacttcacacagtgactcagcttcgtcaggtctcttgaatgcctttgattgcttctaaacatcctcagagttctctcaggtctggtacctctgcttcttgtggcttgaagttctggacatattcttcaaactgtttgtcttttgtccagcagctttccctggcttctggaggacgttttcctgtgagtggctgagtctcttccagcattcttggcaaagatgccctcttgatgttggccagggctgcaggtccaggacctgggagagctgagcgctcagtgtggctggtggcgtggaggggcgggaggaagtggggaggatcagaggaggggtgaggtcttcgaccctactgttgatatgttgttcagggaccatcgggagccagagctctgctctgtttcacgggactccacaaagagaactgcaagtcccagtctttcactctcttggactttttatcttgtctcttcatcacatctcttcagtataaggaagaacagaagggaggagagaaactcagggttgtcagtcaaatgtgtccatttacagaatttataaatgtattgttatcctagttatctttatactagcctgctatggcaggtttcaggatcactgacctagagggtgagtcaagaaagattttctttgatgtggcttagatccccctgaattcatcccaaaagcccaagggaagaaagaacaggattaagtatacattgcccatatcttggaaacaatacagagagcagtaacagacagaagaactagcagacacacagaaagacatgggtcctttaaattttatttattcattttaatgaaaaattatattttgttaaaaatggtctatggagaagttctgtaatacagtagggaataagaactatgttatatttaccatcctcgagcaacagtcaagaagctacaaaagagaaaggcaaatttcacacacagccaagttgagtaaaaaaacaaaatcttttggtctaatcagataaagatcatttactagcctggaaactattgtgaggtattattttatttttgttttctctgtgttatttatacatcccaagaatcctaaaaatccccacctttctgtgatgaagagtaggtgggcagccatagatcactgagtgtcagtatacagaggccagagatgaggggcatccagctgactggtcactgggtggccccttgtgtagccaagcacatcataccctgtattttggtcaaaagaatatctttcttttaaaattaatttaaacttatcatttgagtcatggatactggctcttcacctggccataggaccacaaacccctcttctcatgcctagactctgaaaagaatcaaaagtatttggagccagaaaaggccatttatcttctagttatgagcattgcctccatcctctcccttcctccccactctccacatagaccaactgtttgtttttcaactctgctattttgcacatgccagacacccctatctagtttatctctgatgttcccctaaaccagacctctcataccactttatgaaaatgcatctcttgttcagtagtaactggaattaactatcaagacaatggtcatctgaattagaaattatactctgttttcaaattattatcaatattatttgataaatgttaaccaaagttttaactgacacatttctcatagagatactttccctagactcatcattttgaattgagggaaatggttaccctcattgaagaaagtaattgagggaaatggcttactctcattgaagaaagtctcattcttcacgtgcaattttctagaaacagcagccagctccatatatgcaagagaactggattatgtctgaagccaaaaatgccttattcctatgtataacaggactaatatatgcaggcctatggagagcaatgggcattgactgaaatgccggtgacccaaatcatagacccaagaatatatatataattggttcatatatatatattatttatataatatatataaacacacacagtacatacacacactattatatattaagtatatataatagtgtgtattatatatattaaaatatataatagtgtatgggtatgtatctgtgtgtgtatatgtatgtgtgtaagtatgtagtatgtgtatggtgccagccataagctaatcaaacaatgtgagttaaattacctgagaaacaatatcagttgagcactgagatatgtacttagtgttgtacatatatcttatacaaatagcaatagacaggcagggtaaaataatgttctaagtagcagagggattgactgatttccctgaaatgctcagggattgattagttctcattgaaatgactttccctagttacttatgcggcaacattgtcatcctgtccaggtcccctgaattattcctcagagaccagtgaaacaagtcatgctctagagtgaggcagagagaataaacgaagtatgccactctgaatctgcttattttaatgctatagataaatgggttcataaaaggtgggaaaaggaagtggatgtagctcttgtgatgtgaacgacatgaggaacatgctttccaaacctatgaataaatgtcagacaactacagtgacatagaagaccaggatgcagcagatatgagagacacatgtgttgagggcctggccctttctcctccagaaccaatgcccatgacagtcttgagaatcaaaatgtaggagaaaagatgatgagaaagtccaacaagaccattgcaaataaaactacaactggatagagaggttgaaggtgatgtcagcacaggctagcttgatgacatcttggtgtagacagaaagcagggagagtacatgggatcgacagtagggaaaccagtgtaggcgaacaactattggcatatggacagaccagcccttgtcaatacccgcacaccaatcttcattacctgggtgttggtcggatagaggtatatcttaaggggttgtggatggtaatgaaacagtcataagccatggcagcaagacacctgactccatgacagaaagagtatggataaaataggcctgagagaagcagctccatggccaatctccctgtgatctaaccacagaacacctagcactgtgggcattgtgtcaatgtcactccgaggtctgtagctgccaacatagctaagaaatagtacatgggctcaggaggttatgatcattcctgatgagaaagagaagagtgccactgccaagaagtatggagtgtaggctgccaataatgggatgaatatccagtgatgtgccttctccatgcctgggaagcagtaagctggaaggtggaagcagacttattgagccccattgccagctttgcaaagaggaaatatttactccaggtaaagcaatagtaatcagttgtataaaagttgctccttgagaatctacctgttcataagatgttcaccagtcctgactttcagtgacagcaaggatgataattagtcattcctgggagatcctaggtatgggaaaatagaatgtataaagaagatattattagggtttactctatgtaagattattggatactacgttggggatacagctattcatgcagataaacattgttgaattcattgtaaatcatataacccagaaaataaaaacaaaatgaaaaagaaatcactatatttgaatagtgctgtaatggcctgaaacttataggtcacttttcaggtgctcttcatcctgactggtggtattatagggtggatgtaaaggtttcccaggctattgagacctaaaagatcagtagaaaaatggttctaagcactattggaaaagcagatataagattatatggaaaaacaaatacacaagtaagaaatatatgagcaaatacaataaaatagaaatttcagagattgacttttcttcaatattcctggagggaaaattcaattgatgaagcccagagacttttgggtagttagaaaatgacgtaagagtgacttacctgtgtgtgtttccaagcacatagaactctatgttgcccagctttataaccctagttattgatacactgcttcaagaattcaaattttcataatataaattgaagaataaacagtaaaatgtggatttgatgtaagcttttgaaggcactaattgataatagcaccaaactactgttgcatatcacctactggtgatgcaaaaataaaaattggtaatttaggcaagatcaaggagaattttttttttaaactatggaatctgatgggatttgacaaaagtgagaaggctctgtgactcattagaattcaagatttcagctggtgcaggcagccaacctctgagaatacataaattgtgtgttggtggatgagccagagaaaataggcccaccttctcttatggttggtttggactatacatctcattactattgaaagagcatattgatgtaaatttatgcacgatttacaagacctctttctgtcatgaaaagaatgcatccaagattactggactttcattttcagaagaatttgttgaagttcagctctgctctttctaacaataatgatcttgggaaagtaatttaatcttgagatttgttacataacctgtaaagactactagtgatttctgtcttctcagtcattctcttgacacaagtaaggggaaatgttttgtaaagagtggataatttttttatttttgtgtttttgttatgtttcagagaagtacctcctttctctttctctagtgagtacatgtcaggattattcaccagaggtgtgtcaaatgatttcctttttttctgtggaagccttgggaacagatataagatatgatggggtttttaggagcctgtgtttgactttaaataaagatattaaactatagttttctaatcagcagataaaatgtgatatgtctgggtgggaaagggaaaggagaaaagattgtgagccaatgtgggaacttctgacatagctaaaagtaacgttgagcctggggcattgggctgagggaagtagaggggaaagcaactctgtcctcaaaaagtgagaaaaggaggtattatgctcaatctgcctgccagtgagaggttcagacaatactcagcttatgcaggattaaagagcagtatggcaaataaaaattgtacataggtatataacttattgttttattataggtatcattgttaaatgattaccataatcaaactaattaatatatctatcacctcacataatactttaatttttttggtagtaaaaatatgtgaggtctgctttcttagcaaattttaaataacctaaataaagctgggagggaaaagataatacagaacattaatctagttaattgtgtttattactactaaataaacatataattgataaattaaaaaaaaaacaggagtaggaatacagatagggaaaataaagctgagaaacaaatgtatggaacaaataattgttgaatttctacgtgtgtcaagtattggactggggcattatatacacctcattttttgggaagaatccttaaatagctgtttgtcttgtctgttttcatattgaaaactgagtgctttcacttgattcatcagttgcttttgtggtatatgagatgatctgtgagtttcagaggggataaaaatctaaacctttgcctcatccctgcagccattcaccctcttccagggtctctgtcatagaatagattgagtttttattaatgagaaactaattctcaaagtctcaaactctgccgcataaactgtggctctatgcagacacctcagcaggagcccattcagatgttaactttcatatattctccaccttccctttggcttttttccttcacttttcctgacactcttttctgtctcaagcactagtatctccatcctttttttacccccttacctttggctattatcctttctgtgatggtaatattgagtgcaaacttgattggattgaaggatgcaaagtattgttcctgggtgtgcttaagggtgttgccaaaggagattaacatttgagtcagtagactgggagaggcagacccaccaccctccgtctgggtgggtactatctaatcagctgccagggcggctagaagaaagcagcaaaagaagatggaagagtagtggatgcctgttacacaatataaacctttccaggtgcaaagtcacacaggctatgtgaatctgtacccctgatccagaggcacacataacccaagcccgtccaagcttaattttgaattggtttattagtcatatggtcagatagtgacttttttctagaaagtatttgaacctctgatgattacagaggtatacctcctcaagaatttggaaggttgattctatatttggcacttatctggacttctagggtaaaagacatggggttgggggagggggactctcagggttagaatggaagccagagagattaaagaatcagtcaggtggaggaaattactacaaccccataattcatgcctgagtcaacacccatgctctggtttgttcgagaattgtttgccttatgtgttccagaatctatccttcacttttttatatttgaagaggaactctcaaagaaaccaagttttagagatgtcagggagtctttaggacccatgcctactcatatatctactcttagcagacaacactattacttttctcttgctaagaaatcagcttcatctctctgttttttttttgccttggttcctgcaatgagatcttacagaggagattcataaataccctcactgacctgaaactttgttcccttccattcttcagttccatagtcatgttctcacatctttagccgtatgaaagatttgggcatcatcttttcagaatctgcacatgacctggctggtaggaacatttattttagaagctcctccccagagaccattcctgatttagtaattattgttcttccctccctccctcttctgctccctcctctcttccctctctccctactccttccttccatctttttctctattatttgtgccctcagccttgtgggtattgggcttgaacagcacaactcaagatctctgtctctgtcctggcttttactggaggttttcctctttggaggttgaatattttgtctacattgtggctttggctcttgctgtgctactttggaatattttatctcattgcatttcatagtccttactgtaaaacgcatataataattgccatccaaagtgatgtggtgtgcttggctgaagcaccatgtgatgagtatgcctgctgcatccctggaaaagagaaaacttctggtaggctaaactcaagaagggaatagttagtgataactgagaatgtgcgttcacgttgggtactagagaaggctgcctgaattttattatattgactcagtctatctagctctctgctttcaagctttctctgatctaaaccaagcaggaaatatagagaaattcaggttacataggccaagaagatatataggctttctcttgagataaactgggaagatttgactgttgaagtaaatgtagggaataaattacctcccagaggtgataccagatctgctggggctatgaagacaggctgtctgattccccacacataaaggtcctaccagtgcttgattcagccagtaacttatttgaaaaaagaaagattatttaaaagcttggggggacaattaagtgttccagctccctctaaggaggagttaatacagagtaaatatttcttaagaccaagttggctataaaagggagacatctgggaaggtgctatctttattaataaccacaggactgcttctcttcacagatgttgagaaggaacaacatgatctaagtctttaggtaagaacaagaaccctgctcttcctcaccatcaaacaagttatggtacctgggagtatggtgaatactcctagatatataaagagtgtactaggagactcctctataagctctccagagaaagtacggagaagaagtgaaggatctcaatagtccacagctttggatgtgtgcacagatttcgtctgaagttgatagaacttcaaaagcaattccaagtgctaccaaccaactacctaagacttctgtactcagtgatgtgaatatgattgaccctctcatatgtcttctttcctttctaaagatgaacaggaaggcacctcttattctactacattttactttttaaacaaagcagagaaaattatggctgtaaatgttagaagtttatctgattttctaggtgttccattatagaacttcttgcttctatcctcagtctttatgatctctttccttccctatattttttttcctcgcttttatctcttctctcattgtctttcttctcagaaaccaagagccacgactagctgagacacaagaattttcacaaaacaaagtagagtgattccatagatcactattatagctgcttaccaggtatgtctgcatggaattcttgggaatggagaaggaggaaactttaagttgcggttattattggcaaaatacaatcattgccttacagtttggttagctttccctgtagtgttcatcacttgtgctgcatattctctgataagaaggaatttttcacaaagttgagatacgtgaaagattaggttaaaggagattattgctgaaacgtcagagaagtaagagtgttgacgagaaatgaagtacatagaacacagaaggggaggagctaagctggattatctttgcgtcagtaactgaagaatatacatcactcattgtatgttcagtaggcactgaattctggtttagtctctcagtcctaggacagaatatggatgctgaaaaatgattctttcaaagtgctgagtgttgcctcacgcccagttgtctggcatctcttcactgaaactattacagttagatctctctctatgggtggaaggtaagaggatcgtttcctttggtggcatctttagggtagtgcctacactgacaaagtaactctgaaggggtatatttggatacgaccatctttttaacttagataaaaacaacttcaagaagttgttctggcatgtgacaagaaaaaaaagcaagggatgctttgctctaattcagctatatttactaatgactcttgatttcctcacaagtgaatatgttccccctcagacttccattttgagtaaatggcttcacca

SEQ ID NO: 5095 - DNA, 33774 bp, Homo sapiens
agcctgcctttgtagaagacagaatctcaggtgactttgatctccatggtatagtcctcgctttttctgtccttcatgactaggctcattggaggttccatctctggagcttctatcatgggggcctggcctttgggtggtttagtcctccagagatcgaggacactatgctctggccccccaaggtaccatcccagatgatgtggtcctctgagaggcccaactcttgtgtcctgctgttcggcagtcaggctctttgtggtctagttttctgggagacatctccttaatatttagtcctcatagagtgcagacagctgtgtcctggacttcctgggacaatggttcctaggtttaaacctctgggggtctggtcctccaggattttcatctgcagcaggcaggtccctccaaggtctgtcttccatcgtctggccctttggtgagcctgtcccccaaggcctggctgtttatggtatagacgacggtggtccagacttgctgtagcatggttctctgcacttagccccacaatgtttttttgtgtagtggccaaacttcctggggatctgtggggtgatttgaccctggacaggagtcatcctcctgttctagctctccagtggtcctgtctctgtaggactggtccccagtggtgcgcttggttgtgactggtccctctcacaggcctgttccccatgttctaggacacgcggggttcctctctgatcgggcccgcctctggggatctcagtgtttgtttaagagtaggtactgttgggggagagaacatacattgtaccaagcaggcctgcttgggcatggcggtcgtctctccctaacccccacccttgaccctaaatgttcagaaagagttccaggttatgttacctccttacggctattgatggcctgttgcagccacagcaattccatggccaagtgctgcggtggtactgaagctcttgaagctgaggttggctgtggggcagtctttgatctgggcttctgtgaaggagggaagaaaggaaggagaaaaccttgagggaccagaccctgggaatggcctagccttagactttggaaactccctcccctgcactgcccaaccatgtggtggcctatcccggcagagggaagacgggaaagggatgcagcttatctagcgcaagcctttcaccttcagatgggaggctgaggcacagtgagggtcaggggcttgccctgatctttgcagagggtacctggattctccatccttgtcgtgtctctggtcttctcttggctgggtttcctgtctgcttcatctgaagccaggagctgtgatctctgcagaggcttccttgatttgctgagcctctcctgacttcttcagcaccatctcctcccaggtggcctctccctcagactcttcactgggaagtggttccacagcccctgctctggatttgctaccctgtctcctgctttccaggctgatgggattttgccttctgagaaacaagagagatgtgagagccccagggctaaaccctccaagtatctgggcaccatgatctagcagacaagttggtgagggttaaggagtggggttgaggaggtgagtctactgcctcttccagtgagaaaagcttatcactgggaagggtgggtccaccctgcccaagtccctccttcccttctctcctaggtgtgttctacctctgggaggatcgcggcctgggaatgcggccctcggtccactgaagcgtgcccaggtcgccctcgaccctcgtacaatcgcctcatactcagctcgcaggctctggaactggcgtcggaccaagaagcccggacgcaggcctggtatggagaacgagaggaaagaagtcccttatcacggtaagaggggggcatctcggaggactgtcctgaagaggtcgtcccggcgaatgcaagaggggacctacggcggggaaaggataggtgggctgtgcgctagggctccggggggctcgagggacgatccagactggatgcccctcctcgccttaaggctcttcccgtttccctgatccggcgcgaggtgtggtgggagtggggacgcgcagggcagggagtccgtgggtcccagctttcctcagccggttggggacagccggtatctccagaggttggcgcgcagttaggggactgaacgtggtgcatctcgctgggaggtccaggtacgagaccccatgatttccctaaaggaaaaatcctggaaccccgcgcccgcccccgcacctgcaatgcagacaccttccgaaccagcagctctggtccatgggcgccaactgccaggcccgcccgcgcgcctgcgaagtacgtcattggtcggctcgctcctgagcatgcgcgggcgtgggctttgccccagccgttcccacggcaacctcctccgtccagggtagaggcgtcctggcgacaggcgtacctgcgtccccccagcccccgactcccctcccacagccgcaaggggcactccaatcccgcaggcggtacctccataaccgaggctgtctccgcggagaccgggaggaaaggcgcaaggaggggaagcaggacacggagccgctgctttctttctggtttaattccattcaacgcccccctcccccatagcacctggggggcgcagaacacccgcccgagtctgtaaaaagtcacagtttgaagagaatgagaggggcagttgggcctgcgtgggacgcctacgcagcggactgctcctcaggctcggcgttctcggccagtgcagcttctggctgtgcccgtcaaggatcgtggcgctttggaccagtccttcctcccccccggtctcccatcttgcacaggtttagttccctcacctgtgcaaagggccggggacggggtctcgggccgtctgtggactgaggttgcagtccccgcctgccctctctcacccccttctcttcatccagatcgtgcaggtcagacacactggggtgtgtgcgcgcgcactcgcgcgtttctgactgaggaccaggtgaggtggtagtgtaaattagtaaaaataattgttcaatctgaaaggataggaggacatcggacaagctttgctatgattgatgtcagctaaagtactacaaagattttgatcagtagtaaaacatcccctacaaccacttttcttctaattttgggaaattctaaattcctgtacctgggtttgggcagtctgtggctaaatctgacaggactgcagaggtggggaagttggttgtgtgtgaatactcctggagggctggagaggaggaaactgcctctcaggaacacacacacatagacgggttccttggaaaggatacatagaattactgagtcttccagctgccaacaaagagaaaaagggaggcttctgttaggaggggaaccaggccaatccccaatgctctgggggctatcttctggggaggttgaggggcccagagctcttggaccatgcactcccaccttttcacccagggcccaggaatggctttgggagtatgtaccttcccacccctcatgcccccaggaaccaaagcacccagacatgaacccacattgctaagcagtggtccaggttacggtcagccattgtcttcttctgctcctctggcagcccctcagtgacccatcctcttcctcttcatcgtcctcctcctccccacacacatccaggctgaagtgcagcgggctagcttctcctgcatctcccgaacgtgctccagctgctcaaaggagcattccttcctggaacgaagcccctgtctgaaccctgggaaagagtcctggaaccctggaaccctggaccatggtcccagccatgccccatggactgggccctacagccctatccacacacccgctaaaccagcccccaggactcaccgaaggcctgcagccggccagagtggaaatcattgagcggttcaggagtcccccctccatctcatagacatcagtcacctcggtcaggaaggagtgcgcaggggcgtgcctgcagagccgcttccacctccagccaggactgggcggcacttctcttgcctactctgggtggggtggacatgaccatgatcacagggtagggggcagtcaggcactcccgatcttttgtgccatctgcctatgcaccagtttatctgtctatctgcactaactctctgcccatctacttactagcataaatgggtaactttatggttccccttgggcactgggaggggtgaggaggcgtgaagaggtcaaaaagaagtcttttctgctaataacacagccaggcagtgcctgaaagggggtccctgggttcctgtctgagtgcctcactcatttgttttataccctgaatgagtcacttatcctccctagtcttcagcgtatatagagacagctactccctattgccaccagggctgtcttacctcctcccaaaatatctttctgcccctcttcttttttttgttttttgagacagagtctcgctctgttgcccaggctggagtgcagtggtgtgatccggctcactgcaacctcgcctcctgggttcaagtgattctcttgcctcagcctcccaagtgctggcattatgggcgcctgccactatgccctgctaattttttttacttttagtagagtggggtttcaccgtgttggccaggctggtcttgaactcctgacctcaggtcatctgccttcttggccttccacagtgctaggattacaggcctgagccactgcccctagccctcttcttttttttaattaaaaaaaaaattttttttttgtttgagacagagtctcactgtcacacagctggagtgcagtggcacaatctcggttcactgcaacctctgccttccaggttcaagtgttcttgtgcctcagcctcccaagttgctgggattataggcacccaccatcacgcctggcaacttttgtatttttaacagagatgaggtttcaccatgttgaccaagctggtctcaaactctgacctcaggtgatctgcctgcctcagcgtccccaagtgctgggattataggctgagcaccatgcccagccaaccctcttctatttaaaaactcttttaaacaaaaacaaaaatactagaaaacaaagccaaaccaataaaccaaaaaaactgtcttaaaatttccactgctctcggataaaattgaatgcccctgccagcctggccctcctgccttcccagttgcctttcctgtactctccccacagccttgagcttcatgccccttaggcaagtggtgtgcaaaaccaggggaaacacagtggtcttatctggagcaactggagaaagaatacattgtatttagtggggacaaacatggacacattataaggcagcatgcaaactcccaatcataaaaaaaattcaacaagaattcaaattgtgcccccaggtatttcctcaccatttcctgttccctgatactccaggcccccaaaccacctgtggttcctgaaacctttcaggtaatagctttcttccatatttaaccaggtaagcctctcagcgtggaacattcactttcttgcagagttgctcactccctccctgaggcgaatcctcacgctatgtgatcccagtgacccacctggcctttttgccacacattgagggtagggactgggtctgagtgagctctgagttctcaggggtctgctccagaaagcatcaattattgcttaggaactaaaggcggaggccccccttgccttcctctctacagtgaacccagagttggggtccctcctcctttccttcccttctgtacccacctcttgaacttgcccgctgcttgggggatggcagatgaggaagtcctagggccaaggagccgctgtggctgtaggcacagggaccctccgtagtgtgcctggggcctgggctggctgggccaggcagggctgggactccgtttcttctttttgtcatccattgggcgctggctgggcctcaggcctagggggaagcaaccccacaaagatagccaggggcaaagttagcccttcacccagaaatccctagagctgcaccaaggaagggccctgggaccttccagcttgtcacctcatctatacggtagggcagagccagatgccagtgtctgctgctgggatcgtggatgtacacttgaaggacctctaaggcccaacctaattccccttctgcctgaaaacctaggcccctcctgaaagggtggaccagtcacaactatcttggcgctactggggcttcctgtcacggtggctggggggcgggctggcagaggaaatgtagtgggagacaagacggaggtgagctgcagaagcccagccgaaattagggatgtcttaactaaaccctattctatttatcaggggcctaagcagatgctaacaaccctgtcagcatgggagggggacaaggtgcaggtaggggcgcctgggaaagccccaggtgtgggtaattgtaggagaagccgcagcatacagggcagggttcattgtgggtttccccacatagacaccggcatccctccacttccacccacccccaaccgaaaatattagggactcctataggtcccgcgggtgtgctttcagctgcttcatttttcccagtcggaaagtccctctgggcttcagctgcagccagggtggactgggtggttggccgctggctgcctgggcctcgacaaaggctgcgcctgtggctgggctgctccgaggtccccggtccagcagcgccccccagcctccggtcggctggggttccctcctctgggggtctcattccaggctgctgctaccggcctaacttcgaattctgggactgggggggttgggggggtgggtggcgcttaagcatttcactgacacatagctggctgccactgacggggtctgcgggtgtggggaggggagatagggcgcatcctctgcctctccgtgcagcagcttgacccaattagggacctgatagaagaacggagccggagcctgtgctccccaggagcggctggggcgaccggggatctatttcccaagccgggctccaaagccatgtgccaaactcatcgctcagctccgcagccgcgctcgaagacgagcgtcagacccgcgtcattccgcccccgccctcactccctcagggggctactgacctgaggtttggggtctcgagtgatgcttcggtgcaagttccctccgccctccgccctctcccccgggaacaccaccgggtgaaagctaagctggagggagttcatttgcatttaaagagaagtgaccttctccttagcgcggtggggtgagatgggaggagcatccccgcgtatgctaacagttcctctcactcgacctcacctccccgcctgaacctaggggaccctgttggttgtggatgtctattttaaaaagattttccctttcccggcagtttcagagagaagctacagttcttacaaaatggtggtggctttgtcagaaagggggtggggcgggggagaggagagacagatgagtgagtgagagagagagaatgtaagcacagaagaagcacaagcagcaacagcagcacatcaggaagacacttcgagcaaagacagccatcaatggagtgagtccagtgccctattagcactttacatacatttcatccccataacaacccttaaggaagataccagtgtcattcccattctactgaaagtaagcaacagtcttttgagggcaaaacccctctctctacaatgcagacagttttctctggtaagtggtgggggctgtattttgccgcagatgaagtgacaggatcctccccaccccccaggcctaggagacaggtgtggggagcaccaggtcataaggtagacacgcgattccctggcacctgactccagtcctcagggaaacctgagcacctgatggaggtgacccagtgtgactgctgctgcctgcagccagatcaatgggggcagctatttaaagcctggcagaggctcctggcgcaggtccccagaacagcatctgatacaacaggagagaggctatgtttggccaggcggctcagcaggctcaagtgagctggcccagggcagtgcacacagcacccagcccaccttccccatccccgggcaggagtggcttcctggggttgggcctcttggtgatgtggggagccatgggcactgctcctgagggcacctgctcagggcttcttcctgggacttccaacactcagaacactccacaagggtaaagagtaattccgaactttttcaataacaggggcccagactggggacaacagaaatccctctccttccccaccggagctgctagagagacagtggtaatgctgctgacagagggagcacccctgtggttcccatcctcagctgctcactggggggtcagaaacctcattattctcagagctgctttgcttggaatctccaagagtggggcggcaccccccccacaccctccagaggatctgcgactagaaataacatggccagatggaaaacatgtatcaggacccagctagaagggtcagaggctctgctgggactgtcacgtcattgtgggcacatctatttgtggaggcctggagggaagggcaggtgggttgtctctccatttcctgggcattcagcacatatcatcctttgtgcctgaccaacccaggacccagaagaacagggtgctgggtgaggccaccagcagcatgtctcccatataggagtcccatgctgaggtgggtaaatggggggtgtaaaaactgaacagagaatgtgctctccttaaggaatgatacaattagaggcccctgtgaattcccttgggcaggccagggctataggagcctaccccagctcagacccaaatagcagtgatgagtgtccacccctcttaacctgggcctcaaatgcctatgcctggctccatgccttttgccttactgctggagcctatcaatttcctattgaacaccttcagttgccccccctgccctctggatctagcccacattccttaacctggtacccgactctgggcccagcctcaccccctctcccagtcccatggacctgcttcccagctgtacatttaatcactaaatgacgttcatcttctacctgccctgtggttcagaaggccattccagtatcaccccctcaccttgctgaagggggcaggggcctcctctctgctctcagcaccatgacctgtctatagctaaaagtaccttttcccttcactagcctgtgagcccccaggtcaggaaaacttttttgtgtgtgtgtgatcctctctgaggcaagggtcttgccaactttgccagggctccactcaggcagctcaagtgaatatgccagcatcctgaggctgtggcgactgctaaagacactgtggaatatgtaagataccagggaaccaccatgggcgctctgcagcagactgaacaagtcagtgatgatggaaggggctgaatggatcagatccagaaacaaaggaataacaggtcaggagagaaacaagtaaggcaacagactctttatttaatgtggtttaaaataatcaaaatcaagtccctggctgttgtgaatacccaaaggagacaaaaaagctgccagtgagcttcaaacaagtctgagtggccgggctgggccataaggaaagcagttacagggacagaggcagctcccttcccccaggaagggcaagaggagcaggtgcctggctgtccctggggtaccacctctgtgctgtgcaaggcggaaaggctggggcagcagctggagaatcagctcagaggccttggccctcccccgtggacaccaggcagctccactggcctccgggtcagccctcgggccaccgtgatggggtggaggagggttaaataaccatctttacagaaataacagtctctacagaaagtgcctgagctcagcccatggtccgataacctcatggaaaacaaacaacaataaaaaaaaaaagtgctgctgacacctctcagaatctggtggacatgaagctctcagcggacaaggccctgaaaacaatttactattagcagagccatgcgctcttgagcttcacctctgtggtcccctggaggaaaagctagcaatctaagaaaccaacacagatcttggtcctaaactgaggtcacaagtgtgggacccacccaggtgaggaagacactggccttcactcatgataggcacctcccctgcatctggcccaggacctgggctactttggaaagcagaagcagacagctgtagtgattggttgatttggtcaatgaagagaagaaaaaggtagggaacctcattgcagactggcctgaaggtctagacatggatggagctgtgagcaaaggctgcaccttgctggggcccacattcctgacctgggaaacccagctggggccacctgctcactgtggcctctacaccaccacactgggatccagcagctccagtccctccacaggcattaagaggtagctaagtgtgagtcaggcaattatgtgggccactgtaggcctttcccctctcttcaagggggaggtgcatacctctgcctcttccctgcacctctctcgcctagcaaacactctgtgaggtggcagctcttgtaccagcttagcctggcacaggggctggggtagggaaaaggccctactgagcaggaagaggcaaggactactccagacagagggattcaaaggggaagaaaaaggtctgggaaacacttcacaggacagcagtatctcagccagagatggcagagatctcaacactacacagctgcttgagggcacctagatgtgaaggatacaccagagaatagcaggcaactcgatgcagatcagtggtacctgccctggggcaggagaaggagaaatggtgtgccattcattgccatctctggtctcagtcacacatgattcagtacttaacattctttgtgaaccaactatctgagagatttaaggtaagggctaaaagagtgggctaggtatggaagatgaagggactgcaggacaatgaactagcttcaaagaaaaacagcaagaagcaaagccctaaccatccttccatcttggtctgagtcattctgttgtcccagaaaactgcttggcacaaacactggctataccctggcaagtttgcaacagcagaacattcagcatatagaatggctctacacagtaatagtagttatgtactggagtgggggtagaacaggacacagaaacaactgtctgcagccttttatggatttctggggcccagtcaatagttcaatttcatttcttacctgttagacaaagctatgggctcccacacaggaagaagtagaatccccaaggacaggcagggaggtgccagaaatagaatcaggacaaatcttgaggattgcacatgtgggggtgggggcaggaagcagaaaacccatgaagccaaagaggcagctggacatgggacccagcaactgctgcatggagaagtgctgatgggaactggtggtggcctctcaggactgaaacccacaggtaagcttgtggaaagccatcagaagccctttcctttcttttaccacaaacaacctgatctcaccaaacagaaacctcagcatcaagatggcaaaggagccaagtggggtggtgaaggaggtgggacactgaggccaggcacccaggcaccactgctacagcatccctcttccttggaaggtcctcaatcaaacactgtcatgtgcaaaaaaaaaagaaaaagaaaaaaaaaaaaaaagaaaaagaaaaaagaaaaaaacaccttcagaaataatcctttgggtgatctcttgtcaatcatttgtgcggctagagaggcacctgtgaatgataaggctactgagaagcatcattggcctggtcctgcactaccaaagggcaggggaagcgatgcccaaggggctcctgaccagcacatcatcccagcaaaaacattctccaggtcccttgttccaggcaggaaatccccagctctgagcgccctccagggctctgcctagggacaccttttccaggtctagagaatcaaaggagcctccagagagctaggagggcctgagctgaccaagcaagccctgctcacaagacaaatgcagtcaagactgggtgtattacttgtcttgagctctgaagggcagggaggggtctgagcctcaaatcaacagagaaatgctcaagtcacttctgccaactcactgtgatggcagctacagatgacagccctctcaagactcttcagctcacagacaagccactgacttcatctgtacacacccccaccccaatgcaagcccactgtacacttacaggtataaatgcatttgcaaggccttgcaaatgccctatgtacgtaaaactgacccacaaaatccaaaattgcaagtgccagatgccagcaggtcagaacatcctggcttcagcaatgggctgctcagcatgggagccttttatgggccggcctggctgggctgccgctcccttcccagcatgacccaacaccaggctctctaggcccggcggaggtgggctcttgaggcccagtctggcctgatgcttctgtgctcggtgctcctggtagcaaggcgcttctgtgaccctgggggagctgggtgcttgagccccaggcccctctgcctcctctcagggccactgtcagtgagggagccctggccaccagcactcaggtcctgtacctcttgttcaggtcattgcgctctgtctgcagtgcccggcacagcttctccagccgttgatttttacctgcaggccctccagttctttatcccggactgttttctagggaaagaaatagaccttcagtgccgtgccccatcaacctcccacttaccatcaccacttggcggcaaacctttaacaaggctgagagcagaccgagtccaaagctggccccctctaggaaacagtcctgttgaagccatgactaggctgtcaggtggggcagcatggtgcagaaaaggggcacggctggagataacgtattcctccatttatctaccacgtgaccttggcaaaggacttgacttttagcctgtctcatctataaaacaggactactaataccatcctcagagctcaagagaaggtcaatgaacaacgtacctaaaaacattcagcagcaaaaaagacaaaaaaaacccaaaaacttcagcaaggtctggcttgcagttgctgctccatcgttagttcctttcttctacattacagctgtgaaatcacaaactacctgggctgctttacatgtaaaccaggcacatcactggccccgtttttttctgctcttttattcctttcttccatttgctcccttcactcccactggaacctaccactgggctcaccacctcccatggggagagaacagcattaactttggacttggcattgtgtgcaaatctcacctctacctcatgctagctgtgtcactgatgggtagaacatcaggaaagggcctgatatgcgctaagtgcacacccccaccctggctgcagatcacagacgcccacctcctcagccatctcaagcagggccttgttgctgctctcccaccgggaccggtcatggtggtttctttctccagcttcttgatcttcttagtcatctaggttatgtgacagaagaaggaaatggtcagagctggcctctccaaggtctgtgtctccaaggtggggactgcactgtgtctccaaggtggggaatgattgatcccaaggcgcaaggcattacaggatgcagtaatgccctctgtgccacctcaccaccaggaagtcagaggtgtccaccaccaataacaagaatggtaaggggccaggcatggtggctcacgcctataatcccagcactttgggaggccaggcgggcagatcacttgaggccaagagttcgagaccagcctggccaacatggtgaaacccgtctctactaaaaatacaaaaaaaaaagaaagaaaaaattagccaggcatggtggcaccgcctgtaattccagctagtcaggaggctgaggcaggagaatcacttgaacccggggggaaaggctgcaatgagctgagatcatgccactgcactccagcctgggcaataggtgagtcccatctcaaacaacaacaacaacaacaacaacaacaacaaaccccccaaaaaaaccaaaaaacagaaaagactgccccattccctgggacaacctggagtgtatacataccactgatatgcctcaagaggggaaaggctgtgaaccttcctaacagccctgcccttgagacaccccaatgggagcttcctgaaggcaggcccaacaattttgaatgaagcagcttatgccccagcaccatgcctggcctggaccacagttaccttttccatctcctgcttgaatgtggtgaatactcgctgcttttggaaagtgtgttctggaactcctcaaacttctctgtgtatagggcaagtgtggggagaaagcagcccacagataagactgggtttctctgggaggcactctggtcaaacactcagacccgtccttgactctctgaccagtaattctattgagatactatttttcctaaaacaaagcaaagctatatatttggaaggatataatccaaaatgctaagcctggaaagaggagacttagggtgacttttattttgcctttatgttgattttcaaactcttctgttccacctcctcaaaagcaatacatttctgagctacaaatgaagtcctctgagcccacctaacacctggtcaccaccacataggtactgtgcaggtccggagagaacaaaggctcaaccaagcgtcatagcagccaggacacagccagtcctagaatgagggtcccatttcactacccccagatggggcccagtgagggaaacttgaaggcacagggtcaggttatatgctctcacctgtgcttcaggtgggtctcttgctgcttcatcagctcacacatcctctgggactctactgccctttcaggagctatttccaagacagaaccccagatcctgtcagaagcccccaggggctagtttggtttttagccacaagcaccagacccactgaggcttcctgctctcagactggtaccaaggaatctgtgcctggtctggccagacttctcccatataacccggctatgagctgagcagagcccagcctgtctcctcccacacccccaccccaaccctggggcctgagcctcacaaatccttctcccgctggtgccgctcttctgcctcctttagcatctcctgggcctgctgggcttggcatccaccagctgctgttgtaggtccttgtgtttgaagactttgtcgatatgcgcaacaaagatggtgggagcagtcggcttgtcaggcgctccctttctcagggtagcccccagccacagaccagggcactttgcccagccccccatctcaatctgatatgatggactccatgtgtaccacacaacatgggccccaagtctctggaaggtcagctttccaacctcacgtgtttctctcccagtgagtcagaccttggtaagcacatggtttatggatggaatctgctccaagaaggcaagcaataaacacactcaaatctctgaccccaggattgatcacctatgggctggaagccctcacttctgtgtccctgattctcttgtaaatgggaagaatgggcaaaaaaatgcctctaagaacataacagcctagctcagttggcaaagacttgccatatctaggcaagactagacatgtgcatccccaaggaatggctgtcctgcctactagaggagcgctgcagcctgtgtcaggtgagagagaagggatggagagaaggtgaaggactcaggtgctacttcaaggtaaaatcaactggacttgctgaaataagggaaaataactccatttttttggatgggaagggaaggtgcctagcaggtaagtccagtttgggtatgatgagggtgcctgtgtctgttggggagggctgtaaatgcaaagcagcagggcctggtagtcctgcacctccttctccacggtagtactaagtccttttttgccttggcggggagagaaaacgggggtattcagattctgaagttcgtgtctcactgtagtggcccaggaagcctctatgtctcagcgctgagggatagaaccaaaccaactcccctcaaaccaaacaagcagctttgttcccagaggatgaagtatgcaaggaaaggggtgggtcaggggagcgccctctaggtcctgcacacacgatcatcacttggcctatgaacctaagagggcagatcttcccggtctcacccactgccacaccccagggctaggaaagggcctaatccagagcaggtcctctgccagccctgtaagggggctgcaggttcccttctcatgatgagaacgcgcccagaacagccaggtgactggcagggaagatccaagattcaagtgcctggggtggcagccaacgcagtgacaaagggagtgacatcctgctttttttttttttttttttgagatggagtctcggtatatcacccaggctagagtgcagtagcaaatcttggctcattgcaacctctgcctcctgggttcaagcaattctcctgcctcagcctctgagtagctgggactacagccgtgcaccaccacacctggctaattttttgtatttttatagagacagggtttcaccatgttggccaggctggtcttgaactcctgacctcaggtgatcgcccgctttggcctcccaaagtgttgggattacaggcatgagccaccacgcccagcctataaattctgccttttgagtggcaggagcagcaaggaatcagtggacacagtctctggatccatcactgatcacaggtacacccctcccctgcaattccaaattctacaaagttctgaaatggaaattgtcataagctggcagccagacttgacctgcatcattgtaagcccataattaggtgagtatttggaagttctactgcataaatacattaatgtgtctggcttccccaagccctgctgagggtgctatataacacacagtccatacatgtacctccattctaaaatgtgatagttctaattccaaaagatgcctggcccagtcatttgggacaaggcactgtggacctgggctgtgtggctgtaagtgagtctcttctccacacctgttttttatctatgaggaatacattactctcctcccaaggaggaggaggaggaagaaagggagaatgggatgaagcctgaaaggtactgtcccagtgcctagcacacactcaaaacctcacaatttctgggccatgactctgtccgtgatacccttacctcctcgcgcagctcatactgctcaatcagcttcttgagctctcagccagctccatgttctcttggcgcagcttggagttgcgctcattgtgctgttcctctgcagctgaatgtcattcagtgtcacctggaagtgcgaggtcacctccttgcgcttccctcctcctcccgggcccgctgcacaccttcttcctgggcaaagaagtcagcccgagagcatcatccactgctacctcacaagggtcccccagctagtccacagatggtctctgccaaagccctccctgctcccaaagcgtggagtagccagactccaggatgttgtgcaatgcgggtccaatgggcccctctgtatatcaggtgacatcaagtgagattctccccctagaaaaatcaggcacatggcaggcgcggtggctcacgcctgtaatcccagcactttgggaggctgagtgggcggatcacgaggtcaggagtttgagaccagcctggccaatatggtgaaaccccgttctactaaaatacaaaaattagccggcgtgatggtgtgcacctgtggtcccagctgcttggaggctgaggcagaggagtcatttgaacctgggaggcggaggttgtggtgagctatgacgcgccactgcactccagcctgggcgatgggccacagagcaagactccgtccccaaaaaaaaaaaaggaagaaaaaatgcaggcacacatgcacacatgtaagtgctaagtgccattcgaagcaagtcggatctcctaaggcctattcttccagatttcagattaatgtgcatttgtccctctgtacccccagagaccaagctgttaaaatttagtaacacccagggtttgcaaagtgtgcagaattaggcactcaacacttttgatggggaaggcacactgccccctcactggaggcaatccagcaaaatctattaaaatgaaaaatctgcatatactgtgacctagccatttaattccatgacttatcctacagataagttctatataactgaccagtgataaatataacagaattttcactatagttctatatgtaataatgaaaaattgtaaacaacccccaaaatgcttaactagggcactgatataatatatccatataatgagaagatagccctacacatactgtagggaaaaatgttatgtaaagtgaaaaaaaggcacaggatatgaaatggtacatgtatataatttcattctaaaaactacatgtaagattttacatataaaaaagaaagttaaaaggtgtatttaaacttggtgtaaccacagactgacctcaccatagaagcagcagaacatgggaggacccaggttcctgactgaccaacgtctgggacaagagctgcttgtcagagccaggctccgcttaccaggggactgtcatttcattgagaaatactaacgccagtgcattatggatctcttagtactttatccttcaccttatctaatacatgtcaaatgattacaagcagtacttcttaacgtaaggcattattgagaaagtgtatttctatgccacaagcctgcactactttttttttttttggacactgagtctcactctgttgcccaggctgtaatgcagtgatgcaattcggctcactgcaacctcagcctcccaggtgcaagcaattctcatgcctgagccacctggtagctgggattataggcatttgccagcacactcggctaatttttgtatttttagtagatggggtttcactgcgttgaccaggttggtctcaaactcctggcctcaagtgatccatcccctcagcctcccaaagtgttgggattacaggtgtgagccaccacacccagccttgctttttacactgatttcatgttgaaattgtaatgttttggatattgggttaagtatattactaaattaatttctgttttttagtggccagaagatttttaatcacttatgtgtgccactgcgctggccctagcctgcactactttttaagaggaaagcccatgaaagaaacattaagtggagtcaaggaaaccagagtcacctgttccagggggcccaggcctaccttgagggagcggtttgccgctgcagctcacggcataggctctcaagcttgctgcgggccaggacggccttgcttgctcaccgcgcaggtggtccttctcttgcaccagctggctctgctttttctgtaggagttcatctgcttctgtgaattccggtgctcctccagctggggacagggatagggagggcagtgagcatcttgtggggccttcctggtggggggatcactatgcaggtctagggtctcctagctgccctgacccttaccctctcaggccaggagcactctcatgggctgatgctgtgccgtgcttacacgctcctcccatgaactcacaataaccccaaaggctccaccgtagggacaagaaatggtaactcactagggcaagcaggggccacacagccagcagatgccaattcctatccagctctgactctgggccactagagccacttcaagctgttgcatttccccaacttgcggacactcatgcccgaggatgagaccacctgctaccgtaccttgtgcctattaacagacgacccccatcgctccctcgcattccttcaaaacgttagcgctgcgttcatcagcgctctcccaacacaattacttttctcatttgtggccacttcagtatcaacagataatccttctactccctggcctcacagtccatcacctcttccacaaacccactcctttccccagctcagtcccctcccatgaccctatccaggcctgtacaacagaaatataatgcaaaccacataagtattaaaaatattctactggccgcactaaaaaagtaaaaaacaggtgaaattaattttagaatatatgtatttaacctaatatccaaaacattacaatttcaacacggaatcaatgtaaaaagtgaggccgggagtggtggctcatgcctgtaatcccagcactttgggaggctgaggaggcagatcacttgaggtcaggagttcaagaccagcctggccaacatggtgaaaccgttctactaaaaaaaaaatacaaaaaagtagccagtttggtggcatgcgcctgtaatctcagtactcaggaggctgtgaggcaggagaatcgtttgaacctggaagcaggacatcacgccatgcactccagcctgggtgactgagacactctctcacaaaaagatgttttatattctttgttttgcttaagtcttcaaaagctgatgtgtatcttacatttatagcatgttcaaattcaactggccacatgtcaattagctagagacgaatttatcttggacagcgcagatctagacttgtcactaccagagagcacacccactatctcaatttccagcatcccagtccaggactacatcacctatctttttagctcattccaatcagtatctgtgatcctcagaaagtctcttacctataggacctccaatccattgactcaaccatccttccactctcctttaaaataactacttacctggcttggatttcttacaccctcaactctcttggcccttccccagtagtactgcaccctagtaaagcaccttcctgctttacaccagtactataacaaccctacttgaagagttcactttaaattcatggccaccaatttcaggaagaccagcaatcccaatacaatgcatagctattcacactcctctccttccagacaactatttcatcgttctcatcaaatctcaaaaacagaagaaactagagaatcaggggcacaagctgcacatctaccagtccacctgccccgcctctcctccagtcacacagacctagccatgtggttaccacagccaagcccccttcttggcaggcctcagctcccctcctctactcacaacaccactctagcaactcatttcctctctgcatcagcaattttcccctggctggatcactccaaaagggtgcttatcttccttatacctttatttaatccttacaagaatgtcattaggcaggtatgacattccccattttaaagatagtaaagttccttacaggaaaatattaataaatgtgtgtggaatgaattaattttaaaaaaatacttagaggccaggcacagtggctcacacctgtaatcccagcactttgggaggctagacgggcggatcacgaggccaagagatcaagaccatcctggccaacatactgaaactcgtctctactaaaacatacaaaatttagccaggcatggtgacatgcacctgtaatcccagtactcgggaggctgaggcaggagactcgcttgaacctgggaggtggaggttgcaatgagcgagatcgcgccactgcactccagcctggtgacagagcgagactctgactctgaataaaaaataaataggccaggcgtggtggctcaagcctgtaatcccagcactttgggaggccgagcgggcggatcacgaggtcaagagatcgagaccatcctggctaacacggtgaaaccccgctctactaaaaaaaaaaaaaaaaaaaaaaatagcctagcatggtggcgggcgcctgtagcccagctactcgggaggctgaggcaggagaatggcatgaacccagaaggcggagcttgcgcgagccgagatcgtgccactgcaccccagcctgggcgacagagcaagaccccgtctcaaaaataaataaataaataaatacatacatacatacatacatacatacatacacaggctggaccatcaatggataaatctgttagttcaaattctgacaagggacctgatgatggaagatctggctgccccacccccaacccactgaacaatgttacaacaaagtgggaagagcatgcttgcatttattgtgatggaacatgaagtacttatgaagaattcttgtcaaaaagttgaactgaattggatcaagctttagagctaacttctacttcacttacatgtaccaggaggtaagaagtaaaatgataccacagagatgacaaagctagaagggggcatcctacaagacagctgtctagtttctgttaaaagtcaatgtcatggggaatatgaggaggcagtgacaagaagatgctctggagtaaaaggaaaaagtatcaagtgactagtgttagttttattaactgtgatatggctctatgcatctgtatttgaggaagaagcatcaagatcacaaggtgtcttggactaggccaggaacaagggctctaccaccttggaatcattctttgagaaatttctttcaaggatatgcagtttctcctcttgctgcacagccctgaagaggctggctggaagtgattcccctttaacagatagttcagagaaaagctgaacaggaattaagccacctacttgactctgcaccccaaccttacaccaggtggcatgctgattttcccaacgcagggaaggtgcccgcggagggggaactgaccagttcagcatacttcttgcacagagcagccagcttctcctctggggactcagagtattcaatgtctgcatcagcaacgtgatctccttccctgaaaagcacaggacaaagacatgcaccctcttctccaggtgtcccctccaggcctgggctcacactcatgaggctgaagacagccctccccatcatactttatattttgcttgttgattagctgccttcctgccataaggaccaactcaatcctgccctcactatagccccagtactgtccatagtaccacacagaggatatgctcaacaaatgcttatcaaatgaacgactgtaccctagtgaaatctcttagtaggcaccattggcaggagaaaaaaactgcctgctctaccaatagaagaaaggttcccacttatgaattcagggctactgtttcatactgtttcaatgcaaggaaggcccacctcctgatagaggtaggatccaaaaaggaataggtatcttagcctccttgagaaatactaactcttgtcaacagagtagccaaacagtgaactttaaaatgaagatactttcggccaggaaggtggctcatgcctgtaatcccagcactttgggaggccgaggcaggcggatcacgagtcaagagatcgagaccatcctaacatggtgaaaccccatctctactaaagacatacacaaaaaattagcttggtgtggtggcacgcgcctgtagtcccagttactccggaggctgaggaggagaatcgcttgaacccaggaggcggaggttgcagtgagcccagatcgcgccactgcctccagcttggtgacagagcgagactctgtctaaaaaaattaattaattaaaaaaaaaagcagggtacagtggcttacgcctgtaatcccagcactttgggaggctgaggcgggcggacacgaggtcaggagatcaaaaccatcctggctaacacagtgaaaccccgtctctactaaaaaaatacaaaaaaattagccgggcatggtagcaggagcctgtagtcccagctactcggaggctgaggcaggagaatggcgtgaacccaggaggtggagcttgcagtgagccgagatccgccactgcactccaacctagggacagagcgaggctccatctcaaaaaaaaaaaaaaaaaaaaaggcagggtacggtggcccacgcctgtaatcccagcactttgggaggcccaggtggcggatcatgaggtcaggagatcgagactatcctggctaacacagtgaaaccctgtcacactaaaaaaatacaaaaattagccgggcatggtggcaggcgcctgtagtcccagctactgggaggctgaggcaggagaatggtgtgaacccgggaggcggagcttgcagggagctgagtcgcgccagtgcactccagcttgggtgacagagcaagactccatctcagttgggggtgggggtgaagaagatgatactttccatgtatgtgacgttaagattttttcctttttcttttttgagatggagtctcaccctgtcacccaggctggagtgcaatggcatgatctcagctcatgaaaactctgcctcacgggttcaagtgattctcctgcctcagcctcccgagtatctggattataggcacgtgccaccacgcccggctgattttttgtatctttagtagaactggggttcaccatgttggccaggctggtctcgaactcctgacctcataatctgcctgccttggcccccaaagtgctggagttacaggtgtgagccactctgcctagtcgtccctaagattttttaagttcctctttaaagtaagaggatacataaggggaaaagggaataggaataaaacatgatataatgacactcgacttagattctagattctttttttttttttttgagacagagtttactcttgtcacccaggctggatgtagtggcacaatctcagttcactgcaacctctgcctccgggttcaagccattctcctgcctcagcctcccaagtagctgggattacaggcgtgtgcagcatgtccagctaatttttgtatttttagtagagacgggatttcatcatgttggccagctgttctcgaactcctgaccctcaggtgatccacccgcctcggcctcccaaagtgctgaattacaggcgtgagccaccacacccggcctagactcttaaacatacataccctgctgtaaatgactgtcactgcctattccccattgcctgtgactgagtcagggagccttccctctcctccccagaagggcccaagagatcagcatggagactgcaattcgcaggcatgtgtgccaatccaacccacggatgggttttgtttggctcttaccattttagctgctaactatgaaaaatctagagttctcacataactctagatttctggcttttctttatttaaaaaaaaaaaaaaaaaaaaaagcctgactgcacccagcctgtagttttgcctgctctcagttggctagctagagcaactaatcaggaagcagtaaagcctccatcttcaggtggccccatggccagcccgcttatgcagatatttgggttttcaactctggcctagtctaattttcttactgtaaagaaaatataaactaagacccagagaggagaagggacacacccaaggtcacacagcaggtagactggctggcacaggagcctaccctagcctcccgtctccattttctcaaagagagaacagtcccatgccaagctccagttgctccaaaacccagaaggctttgtgctggtaactcctgatctctctatgccgtggcccccacatccctggctttgattagactagagtgacttgctgtctgagaagtaccgttttcctttgaatcctggcagaacagactggcccagagaacgtcagtccaaactccctctcctcaccagcttcacaaagagccgccctctgctcacccaaaccctggcttttttcttctcctgtggccttcgatggtctcggtctccgacctcgtcactctgcggatctcttctgtgtttggatcccccttggagggttccttctctccattgactactggattggttcaggctccccattccttgccacataggtccgggacttctctgcatcttcgggtcagccggctcaccctgtgccccatcctcgccggggcccccctggttattgtccacacagatgtgctcagtatgtcttccagttggcggctcagctcctcagagacatcacgaagggcccagactgagccgttctggcttgagcccctacagcaggagaggatgaggggtagagtgagaagaagacgattataccactggttgggatttttcaggcccagccaaactcatcagtttggttaaatgttgcctaacttttttttttatggaaactgagaagcaagaatggagtatcatcagcaaatctagttcctgtcagaatttagattcgaaacatcttttaaatcaagaaattaagtaatcgttgcctaacttctttaagtctgtttacttgtaaaatgacacaactatttctactaccacccgaacatatttgttagatcataaaagtatgtaaagcatcagcacacagggtggcacggagcaacttctagtccatctccttcccccccacaaaaccatttcttgccattagatcattctagaaatgcctcaaacaggaagggcagttagctgctggtggctgaggtgttctaacgggacctggatttcctgactgggtgcctcgtttggctgccacctgacttaatccgtcggagcttctctccagaactctgttcctgtgcttagagggggcagctccgccaactgccagagcgcaggggggaccgcggcccccagcactgtcctctcattctacatctcctcccccggacaacctggcctcggcctgtaagtccagaagcgaggccgaccccacagctcctcccctgcccgctggcaacgcagagctggcacacaccctccggcttccgaggagcctggctctgccgggaccttctgcttctactgcaggagccgcctggctgggccgctcctgggctcctcgggtcctgcttccggttgtcctgggctgctttttggattggattgtttggcagccccttctttttgtcttggttcttcattgtgatgagcgatgctgggtcaggagaagatcctttgaaacaaacacagttgctattttccagacttcgaaattcttcgcagcctggatcagaaaccccacagcaggcgcacaaagcttcttaaaataaacggaccggcaggcccgggcggaggcgccaacggctctctggtcttggcgggtcaggagagcccgacgtgccggggcaggctttggggcgcagctcccacagcgggtgagggaagaggcctcttctccctggagccacttcccgcacaaccggccccctcgcggcaggccgggcgcgggattggctcagggccggagactgagtggcgggactcccggcaccgcccccgcccctcaggccccacgtgcgccccccgcgcgccagccacccacgccccgcgcgccctcaagccgcgaggcacgcccgcgcatgcgcatatcccagacagcccccggcccacgcggggagttggcgtgatttccccacaggccgagaacatccggcccgcacactctcaaatagtctcgcccaccggccgccgctgcacgtacctcaccgcgacgtccgatggcttccccacctctggcctcgcaccggaaaccccgagtaactgctgcggccagccgcctgctcccgcctcagccaatcaatagccggcgccggcgcggagcttgctggaaggacgaagcgagggcggcctcggaggcgggcgccccggcagggcggggcagggaaagactacgcgtccctctttacgcaggggctagccgcagatcccaaggtgcataagggacgtagtcctgggagtccaaaaggagcccgtcattctgcacgagtgcccatgtcaaccttgttctatctcgcagaagctatgcttcaactcccaaagccttgcgcctggctgttgtttccgcaggcctccatcaaaccttcctccctggccgtgaacaaatgtgactccatccgggaacccgaggactcgggaagagggatagagtcctgggctgagactcaggagacccatactccatcccaacttcatcacggatttgctgtgtggctggacgttctgttctctctctgggcctcatgtccttcttccaaaggaggcttttaataacaatagcagttccttgaacgcttactgttgctttcccgctatctaatagcttggttctcataaccactcatagaaataactactatcgttatccccattttacggaaaaggacagtaagagaaaggttaggtaacttatccaaggtatatcgatagtgagtggttaaaacagggattcaaaactggtaagtctgagaccagcaccaggtaattacctggtctttcacccagaagaaacactaccacagcaggtttccctgaggcgtcaaggtaacttgtgaaagtaggtcatattttcccctctccattaccattttggcagtagttcctcagaaaggtgctgagttaggcttcaggcatattcatgagccttttctctacccacactctacaaagtctcactggggttaaagtagaaaaaacccccacagttccctacactgagatcacaattctgtatccccattgcttctggataatgaaatcaaacccaacaatcctgtgcctggaatttgaagcctaagagatttgacttttgccaaacccaaaattttttgagcccagttcaaaggtcacttcagagccttcccagtgctctgcaaaccgtacttgctccctggtctgcagagttgttacagcattagcagtgaggtgttgaaattactatttacttataatcagtgaattttgcaagaactgttggctaaatagtctagtcccagagcctcgcatcaggtgtgggtagagaagattgtaaactgttgtgctaattgagcgttggtttagggctgttagatgttaaatatttcccccaaaggctcagtgaaagacttcagagccgtgcatgttggattcagattttcagattggggaagctcaaccggtaaaatttgagaaaatcccaaattggaaaacttctggtcccaagcatgttggataagagatattcaatttttagtataatgatggaacgaggctcagaaaggttggaatctagatgtcctgaaaccaaggccctgattatttctagaaagcattctggaaatctcttgagaaggcaccatataaatcaggccttgatagatttccaataacaagggtgttctaggtgagataaagaacataaaaatgtatgcatggggtgagggaagaggatgtagtagaagggtcaacaatagcctagaggggccagttgggtaatgagaacagcaagaataattgacagaaacataggttaacaagttactttctcctttgctataaacaaatatagcaacaatattagcacctgccagagtgagggagaggtggtgattgcagtaaaatcagcagctcttgcacattgttagcaagcagaaactcaggccgggtagggccagattgtattttgttttttagacaggttttactcagctgctggggctggagtgcagtgatcataatactcactgcagactcgaccacctggactcaagtgatccccttgccccagcctcccaagtactaggattacaggtatgtgccaccacagccagctaacttttaaatttttttgtagagacgatctcactttgctgcccaggctggtcttgaactcctggcctcaagtgatcctcctacctggcctcccaaagggttgggattacaggcatgagccacagtgcttggcctctttttaaaatggagacttcaggacagtctttttcaagacagacatttgatttaaaaaaaaaatgttgcaactaattcaaacttaaacacgctctgccaagcaaaaccttcctgtgggttcaatcaatttctggctgcttgtctgtaatctctgctttaggaattatctaaactgaagggaggagttgtgaactatttgatcttaagaggttcaggctgggcacgatggctcatgcctgtaatccagcactttgggaggcggaggcaggcggatcacctgaggtcaagagttcaagaccagcctgccaacgtgaaaccccgtctctactaaaaatacaaaaattagctgggcgtggtggcgggacctgtaatcccagctatttgggaggctgaggcaggagaatcgcttgaacccaggaggcgaggttgcagtgaaccgagatcacgccattgtactccagcctggatgccaagaataaaaactccgtttcaaaaaaaaaaaaaaggttcaaagggctgtagagtggtgctgatgaaactagtcaaaatcatttagagaaactctagaaaatgcaaactaaactacagtgacagccacaatcagtggttgctggaggtggggcagaaaggagggattctcaagcgggaagcttacggctatgaaggtcatagatatattcactatcttgtggttgttttatgggtgcatatgtgtttaatttatcaacgtgtatatactttaaatatgtacagtttattgtatgtcaattatatttaataaagtcgatgaaaaaaactttagagcaggtgcaggttggtacaactcttatttccatgttaagctacaaatttaaacacctcctcattctcttcccccaaatccagtctagggtcctccaagccaaagaagacaatttagaactttgcaacaggtttttatttttgctttatattattacagtgtttgaaacctaaagaaatacattttctcttcaaatttggatgtgtatataataacatttgtctggactcagcacactcaatgccatgttttcttcgcctatgtctgcttgaaatcaagctgtgtctgtctacccaggggccctgagaacatggaaaatagagtttatgttattagaaaaataaaagcaaatgaatttgcaaagaaaaaccagtgagaaggattagatcatcttccaagggtccatagctggtaacccaagccattctcgggggatatccagtctctgagtggctgggactccattacccactttccttctttaataggtcaaaggcaattcccaaaaagctggctaaaaaagccgacacccaactccagagtctgagggttcatgaagatgtgacttttttttttgagacaagagcctcaccctgtcgcccaggctggcacaatcttggctcctgcaacctctgcctcctaggttcaagagattctcctgcctcagcctcccacgtagctggatcacaggtgcccaccaccacacctggcttattttttttatttttttatttttgtaggacggggttttactatgttggtcaggctggttttgaacccctaacctcaagtgatctgccgcctcagcctcccaaagtgctaggattacaggcatgagccaccgcgcccagctgaagattggattttttttttttttttttttttgagatggagtctcgcactgtcacccaagctggatgcagtggcatgatcttggctcactgcaacctccgcctcctgggttcaagtgattctccgtctcagcctcccaagtagctgggattacaggcgcctgccaccacgcccagctaatttttgtatttttattagagatggggtttcactatgttgccaggctggtctcaaactcctgactcgtgatccacccgcctcggcctcccaaagtgctgggattacaggcatgtgccaccgcgctggccagatgtggactctttaaagacatgctctgagtcagaggttcccagccagtgttggatctctgagagcttacttccttcaatgccccccaggccatggcgtatataatagttaaggagaacagggctggcattcagcaacagggttcaggtacgagctaatgtggacatcagagtcagcctggcccagaggcagctaggcaggccactaagatacactacataaaccttttccatggtgttctgggcctaacatgtaatactgcctcttctaactctcacagcctgcttagttctgcacatagcccagacctgaagcaaagcgcccttgcagagaaaaaaataacagcttaattcacagatttggttggtcttgacctcaagttcttcctttgccacggtctaaatcaggtgtggggctagaggacagataatgagagactgaatcatttatgaaggccttggccaagagcagctagtgcccactacatggatcccagcagggccaaattctcaacttgttggcttacaaaagaatgaaaaagctcaaacagaaaacatactggacaaggttggtccagaacatgaatcctaaatggctatggaataaatttattctgagcaatatctcagtctcacactcactaattctagggtagttctattgaagatgtttaccatggtttagcgcactgagccctgcaccttccccaggctgccagggaagcagagaggtacaaacattcctaatgccccagtcagccgttctccctatggggtccctggattacctgcagggacctgggggaaattggctccctgtttcagctgagagtctggaatctgaaccctagatgaatctactgaagaatgctcaagatgtggataccaagctgagtgagtctaggggagaagagaggcctgaacaaaagagctggggcttcaaagaggtgtatgagaggtgaggttagtagtgccaggctttcctatcttttccttcagtttgctagaaacaagtacaactttagggtgtggggggaaggcaggtagacatgaagaatggaaatacagttcattctgctagacattttaaactggtttggcttgagaaaaatagaagtctgtgcctgagaaccttcttttcctctcccttatttaagtacaatagcagctataactgtgcagttcagctccaaaaaacagggctcctggaagatggctttcatggcagagagtgatggggtagattaatgggctctaggtaaggagcaacaccaagggtccctgaaaactgagccaacacctgctccctgggggggggccatttgtattccctgacccatgtaacaagcctgccagctgtgggtggaatccatgtggttctatcagaaggctgcagccaacatcaaggccggcagtcaccagggtcagctgggatctgaagggaggcttctaagaccagacaccctgttgtactaaagatgatgatttgggggtgggatgcctggaggggctggcaccattcaaaaaatattggaaaacattagccaagaaaaaggctccttgtccctcctaatccatatccagataccccaaccagagatcttaaaaaggatagaccagccatatgccaacatgccaggattccaaagcatgcctcaactaattagggtattccctacagcagactggggtagaggggctccatctggcaataaccagagagccttacctcgcctaggccagggtatggaatctagatgaagatgtccacaaacagtggctctcaagcc

SEQ ID NO: 5096 - DNA, 47285 bp, Homo sapiens
ataaatattgtccactacagagccaagcaatgtgccattattacattttctttctcaaaaattttccatttttcctgtagtttttttcctttgcttatttttctatatactgtcttaattcccccccccaatataccattggatgtgacaaatgtccactgatattcttttccaaaactttatcagttggccgggcgcggtggctcacgcctgtaatcccagcactttgggaggccaggcgggtggatcacgaggtcaagagatcgagaccatcctggctaacatggtgaaacccgtctctactaaaaatattaaaaaaaaaaaaaattagctgggcgtggtggcgggcgcctgagtcccagctactcaggaggctgaagcaggagaatggcgtgaacccgggaggcgaagctgcagtgagccaagatcgcaccactgcactccagcctgggagacagagcgagactccgtccaaaaaaaaaaaaaaactttatcagtaaatgcattaattattccctcccccacaacccgggcctgcttcctagcaccctttgtctttctctccttcccactccgtgtctttttcttctatctggacaagttgccctctaattttgctgcacagctgtcaagctgagactcctctttgcgataatctgtattagattctctgtttcccaaaaaccatgtcttccccttttttgtgtaatatatatattatatatatataatatatatatatatatatataatatatatatatatattaatatatatatatatacacacacacatacatatatatacgcacatatatatgtgtataatatgtgtgtgtgtatatatatatatatatatatcatttttttttttttttttttttttttgagtctcgctctgccaccaaggctggagtgcagtggtgcaatctcggttcactgcaactccgcctcccgggttcacgccattctcctgcctcagcctcccgagtagctgggactatggcgcctgtcaccacgcctggctaattttttgtatttttagcagagacggggtttcacctattagccagaatggtctggatctcctgacctcgtgatccgccggcctcggcttccccaagtgctgggattgcaggcatgagccccggcacccgccttcccttttatattttaactccttgttttgctggattatatcctctagtaagtacccaagacaaggtgcatgagaagtaaaacgtttttagtccctgaatgtctgaaaatacctttaatttgtccccacattttattataaattgttagaaatacttttcccatagacatttcaaggccttgctgcactactttatgacgccagtgttgctcttgagaagtctgatgatctttgtgttgacctttttgaaaatctttcctctctctagaagctgttaggatcttccctttttctttagcattctgaaatttcacaattgtctcattggtacgggttttctaacttttgagcgtgcctttttgatctggagctactttcctttggtttgggaagtattattggattatttctttaattatttcttttgtttggtgtctcttcctctctcatataactcatattagtctgggtgcttcctggattggtcatctgatttcttttccttcccctacccactgccgcccgactgtccatctctttaatttgtgttctgttttctgggagaattctcaattctatctcctgacttttctgttagaatttttatttcaaaagtattatctaattctctgaatgttcctttttttcaaattgtccctttttcatagataaattcttctcatatcttcaagggcattgtgatttctttgaagatttttctgctttttgcttgtctctgttgcctgtgagcaatttttctctattttgggctttgcctttcatgtcacagctttgcccaagtgtttggtgatccttcagtatttagaaatgagacactaaaacatcaatgaaagttctgtgtgtggtgggtagtaaactgattggcctcaatggcaggtgatcaaatgggagtcagctgttttgttatggggcctctgaatgtcattagctgtagataatggtaataatggcagtaaacttacagtaaagttgcaaaactcccatacatgtcttacccagacactattgttaacactttgctgcatttgctttctaattcaatatctctgtgtgtgtgtgtataatatacacacacatatatacacacacatatacacacacacatatacacacacacatataatacatacacacatatatacacacacacacatatagttcctatatatgtgtacacactgaacattttaaatttcaaacatgattccttaaatattaggttggtgcaaaagtaattgtgtttttgccattgaaagtaatggcaaaaccgcaaatacctttgcaccaactgaatacttcgtgtacatttttttaagatcagtgacgttcacttaagaaacaattcagttttcaaactcagatatttaacattaatataatctattattgaatctacagaactccttcaaatttccccattgtcccaacaatattctttatataaattttttttctgggccaggatccaatatagaaagagagcactgcaatgaggtttcgcagctcttttgtcccccttaatcaggaagagcttccagtctttccatatctttcattacattgcccttttttcacactgacatttttgaaaagtcaagccagctattttgtagatttttttttttttttttcgagacggagtttcgctcttgcgcccaggctggagtgtgcaatggtgtgatctctgctcaccacaacctctgcttcctgggtcaagtgattctcctgtctcagccccccaagtagctgggattacaggcatgcaccaccagctgggttaattttgtatttttagtagagacggggttgctccatgttgttcaggctggttcaaactcctgacctcaggtgatccacctgcctcggcctcccaaagtgctgggattacagcctgagccaccgcacccagcctgtagaatgttaatgtcgggtttgtgcaatgtttcctatgattctatccatattgtgcatttttggcagaaacaatgttgtttcctttttgttgaacaggaattgatctacaatttttatccaagattgcctcccacacattatttcattctaccgatgtacctggaaactctccagatgtttatgcagaacaacagccttgctctgattttttcacaatataatttattctaaagagcacactgtacccattcttttgccccgtaaacctttaatggcttttagccaaaagcagtgaaaatctgtctaaattttgccctgctgagttggacctgatgcatttgtttctacactgcccatatgtagactgtacttagaaatatcttgcactttttagatttcgcagcccaacgctggatggatgattaaccaagtaggagggtattaggaacaagaggttgccattttaatgcagtttttgaaaaacaacagctttggccacacctggtgctcacgcctgtaatcccagtactttgggaggccagggcaggcaaatcacttgaggtcagagtttgagacccacctggccaacatggtgaaaccccatctctactaaaaatacaaaaatagctgggtgtggtggcaagtgcctgtaattccagcggcttgggaggctgaggcacgagatcacttgaacctgggaggcggaggttgcagtgagccgagattgtgccattgcgctccacctgggcaacagagtgagactgtatctcaaaaacaaacaaataaataaataaaataacactgtattgagacataattcacatacccataaaactcaccctttaagagtgtaaaatttccgggttttggtatatttacagacttgtagtgatgtaaccatcaccaatatctaattttaaagagttttgatgcagggcagctgagaccccagattgggtctcagcccagcagggttttagctttgtccaggaaagaattcaagagagagcccgtggtgtgagacagcaacttttatgaggtggcggtgtccagcagcagcagagggggcctgctcctgcagtgcagggctgccccaaggcagtgtgctgagagcagcagctctgggcgattctgcagtcatgttgatacccactttagttacatgcagattaaggggcagtttatgcagacatttctaggaaaagggtagtaactttgggtcctcgggtcattgccatggaaggggggtgataactccaggggcgtgccctggaaactgacatggcacactgatatgatgggcatatcttatgctcatcttccacccagtcctgttttagctagtcctcaatttggtcctcaatctggtgtccaagccccacctctggcgtaagtcctgactcctacctgtttcaccatcactgcagttttaagagtaacgaatttgggtccctggtgaagtggccagaggcagagcttctgtgtgaactatttggaggggaggggaaaaactctcccagactgcaggttctgaaaggaatacagagatgtcagagactgcagttgcagagaaagcttttataggagggtgtagaattaaaggacaagaggactctacatgtggatgaggagggcaccctgtccggcagtactgcaagagcaaaagtttggaggtgggagtgaggtagtgcgtctgccggccagaattcttgggccagggtgagcagaaaggttggaggccaaggaaggtgggtggtggtgaaccttatcctgaagtgtgcaaggtgacagtcagaagcttagactccagccacgggccctgcatgtggcctcctagctgtagtctgtccaccgagatcgtgagatgctggtggttgaaagaactgcacctctgagcaggtgaagagagaagctaaggagggtgatggcagaggcgatgggacaggctttctaacaatgaggggctggggatcaacgctctacggaagctaaaagagccccagcaaccacccgcctgggccctgagctccctccaaagcggaggggattcactaagaggttgctcccctagcattgaactcagcatcctatactggtcccaccatgaagacccccaagagtgcttcagaccattgcttctcacattctctgtataaagcactaatttgtttttagatttccaagcatgtcacggaccaatatgtttgttaaatatacaagaatgaattgctagaaagatgaaattaaaaagacatacaccgccaggtgcagtggctacgcccataatctcaccactttgggaggcggaggtaggtgcatcgcttgagcccaggagtcaagatcagcctaggcaacaaagtgagacccccgtatctacaaaacttaaaaaattagcaggtgtggtggcgcagtctgtagtcccagctattctggaggccgaagtgggaggatcgttgaggctgcagtgagccgagatcgcaccactgcactccagcctgggtgatagagtgagctctgtctccaaaaaaaaaaaggacatacatcatgcaagtttggatttttgtttttagatcaactgacgaagttacgggatcaaactgctgtaggagctgccaaacgcttctctccattctggccgcggggccgcggaccgccctttaagtagcccgttttatccccggcagaggtgagccttaggcaggcctagagactttcccgggtcctccaggccggggaacgccccgctcgaggccgggcttgggcggagactgcgccggggctgctgaaaactagccgaggagagccaggagccggagagatcgcgcgcctgccgccgccggagcctgcgagccgagaccgtaagcgccggggccggccgggcccgcactccccggacgcagacgcggttcgggctccgcgcgggctggccgccggggtgggcggcgggccggggcgccgaggggtcggggctgcggtcggcccgcggggtgcagagggacttgtagttggtccgcccccagctcctgccccggccaggagactggcgtgccgcctactgggggaaggagcctgcaggcgaccgcggacttctcgcagggaattcgcgtcccagactgtgggcggacgccgcagggagggaggctcgcgaccccgagagcgcacgcgtcccctggcctgggcgagctctgcttccagggccgtggctcgctcggcggtgaaagcacttaatttgtcacccaagtcggaacactgattttcatgcgcgtccgtgtgaagagacaccaaacaggctttgtgtgagcaacatggctgtttatttcacctgggtgcaggcgggcgagtccgaaaagagtcagccaagggagataggggtggggccgttttataggatttgggtggtaaaggaaaattacagtcaaaggggggttctctggcgggcagagtggggggggtcacaggtgctcagtaggggagcttttgagccaggatgagccaggagaaggaatttcacaagaaatgtcatcagttaaggcaggaacaggtcattttcacttttgtggtggaatgacatcagtaaggcaggaaccggccatctggatgtgtaggtgcaggccacaggggatatgatggcttgcttcggctcagaggcctgacactgatcacaccttttagttgaaatgcgctttcatctcatctgctgccgcagccgccgcccggcaccccctcgctctggtctcgggattgaaggccaccctctcctcttgtagaacaggaaacttgcccgggagttcaccttgtagttgaagccaggaatgtggtcaacctgagcaaaagcgccgcggagaccgagtggccgcctgcctccctcctggcagatgtcggttttctctgagcttctggctccttccttgccctggcggctcccgagtcttggaggtggggtgcctagcaatgttgtaatcctaattttgacttttttttcttaaattgaatgccccctccatagcccacctcccattgtttaaacttcaggttccgcaaagcctgatccgcccctacaggcaacactcgttgtcctggaagttctgtgagggctcagcttgtgctggaggtgggaggtgagggggacccatgcacttggcaggcccgcttccaggacagcccttgctgggattgatgagctgttggtggaaaattgttgaggaccttggggttggtggctgttcggtaccactgtgcagcctcctctgcatccagcataatttaaaataaacattttcagaagccacacttctccagaaagtaacattgttttctggtgtaacggttgcctccttcaggagctaggtttgggggataatagggggcctttcactggccccacttggtctgacttagcacaaaaactctgcgagtgctctccaagcagtttttctttcccaaatttccacacctaggagcgctgaggaggcatgggcggtacttaggaactgctcactgtggaactgaggcacagcgggagcatgccctcgtgggatttgcagttctaggggcagagggataataaacaaaatacattgtaaactataaagtatgttagaagatgatgtgtaatatggagataaataaaactttaagaggggagaggagtgccaggtggaaagggaaggcctcactgaagggtggcactggcatgacctgaagagttagggagcagccaagctgctgcctggggtgcaggtgcaaaggctggggcaggagtgtgcccagcttgaatggcctgatgtttgtgtttgcagagtgtgggtcaagcgatgagtgacctactggataaactgaactagctcagtctgtaagtgaggggactcctgactttctgcggccttcttcccaattccaggaaaggaaggaccttccacagaaaataactatcagcaagacagccagggtgaacctcagcaccatctgtgacaagccacatgctctctgctgatgcctcctgcctctcagctgtgcctgaagcacactagctggcatggacttacgcggtgggaacatcttcaggaagccctgaatgagggctctgtgggcagagggacctttgcagaagggcatcttgaccactgcaggaggtggagtgactctcctggggtgtcctggttcctgctgatgtcttaagcataactggcattttcagggagcccaggttcaccaatgcacagtgccctcctgtcgacctgatacccaggcttggtgattgctcacctggcaccttgattcccgtttggtatcttggcccaggcccagacatgtgaaagcaggggctaccgagattcatttctcattcttacgccaagaggttcaaccacatggatcacagctgggtgtaccaaataagggaggccaagcatgagctggtcacccctgctgaagaagtagctcgaagcccacccactcggggaagagtgggcacagatgggatagacagatagtgattcgaggggtgcctaggatctcatacgaaaacccacctctgctagggccataaatcccatcaacagcaattcattcctttgagagtaatacagtgatgtgggaagaggattgggctggaaaaaagacttggctcatgtcccagcctgccattaatgtgtcccctctctggacctcatctgtaaaatgaggttaggctcagcgactgcaggccttcttgcagctctgctatgtgatgattctgtggcaaagtctgaagggattcaggaaaggaatgtgtaggagggaaacagtaagttttgaagggactcagtgggccctgtgcctctgctgggtccagtgaagacacttcaactagagtgaaggccctggccacagggtagggaggcaaaatcttaagagttcaagggccctgagtcaaggcaggagggtcactgcccacccagctggccccctgggctgcctgtgtgtggttcttgacccagacctagtggcttagggcagagtctccaaggggctgtgggataaggtggggattgcaggagggagaaggcaccccgcagttcccccgttaggggaccaaagcgttgccaaggatccagccacacccctctcctgggagggaggagctggtgggcgctccaggaagagcttcctctcaacaaggagaaaactgccaatccaatcctccgttatataactgagcacacgattgtgcaaaccaagctcacactgacagcctcccctattgtcaaggtttatttactttcccaggggaagtcatagttcatccttctcagcagaaagcagccatttgactgccacagcctgacctacggcattccaggagatggttcagagacctggtgtggagtcctcatgcccacccgccctgctgtctgtgtctttccgttgttgcctggtgggtgggtgtggtttagtgcatggtccagcccccgcacagccacacccttaggctctccaaggcctaactgagcaagcttgcagaagaggggaaagtgttcttttcttgaggagttaaagagacttctggaaaattctccagctactccacaaactaggatcacagccttgttcttaggtcgggagcaggagtttttgctgcctttagcatttgggaagtttgataatagagactgaatttgaatgtctttttggtacttaagagctggattaactacttcacaatctgagcttcatttttaattctttttaaaacagaaaaagtggctgggcaagatggcgccacctgtaatcccagcattttgggaagctgaggtgggtggatcacttgagcccaggagtctgagaccagcctgggcaacaaagtgagacctcgtctctataaagaataaattagctggagtggtggagcacacctgtaatcccagcactttaggaagctgaggcaggaggatctcttagcccaagagttcaagaccaccctgggcaacatagcgagaccctgtctcaaataattttaaaaagaaaaactacctcttcttaagatggttgtagtatgggagatggtgtgtttaagtttcccaccccagtgtcacagctcagggcttctctagccttcctcacagcggttgggggtcccagacacatcctgaagtctaggccgtgttctgagtgtctctgccacgggcccgcctgctggctttagtccaggagcagcctggactgtgactcttgaaggctgtgggaggctggtgccgggagcaggaggtctcagtgcatccctgaagggtcagagagccatgccgtgagaggcaggagcaggcagccattggccctccagccctcaccaaaggccaccacctcagcttgtccctggcaactcagcctgggaatttgctttccctgtggaacgagagacactggccgcattgggggtgactttccggtcctacaaaattgtagccctctttctgctagaactggtgagactggctaatttcggagagactttaggaaagtaagagaaatacattggtcccagtgccaagcccaaggccatctttccaggtatgggtatatcctgcagtgataagagaagactgactcttccagctctttgggggaaatgaatatactttcccacgttccagtttttctggctgtggcagacctgtttgctgccaagttgttcctgtggggaaacagcagtgggcccagcaaatgtagcaccaggtcggggcacagccaccaggtggaagaagcaaccctgccctcttccggttccagtgtgcctcactgaggcaggacttccagaccctaccaggaaggctgctatccgggtcatgtgataccctgtcaggacatcgttgtttttgtcttgtttttttttgagacagggtctggtctgttgtccaggctggagtgcagtggcgccatctcagctgtctgcaaactccgccccacaggctcaagccatcctcagcctcccaagtagctgggattacaggcgtgcaccaccatgccagctaattttcttttttttttttttttttttttgtagagacaaggtttcactgtgttcccaggctggtcttgaactcctgggctcaagcgatccacctgcctcagcctcccaaagtctgggattacaggcgtgagccacggcacccggtcgagatggaacatcttaatttcagagtgccttcaggactgttgattgaaccccataaatatttttagtcttttgggacttttaaatcctttttgaaacctaagcattgccacaaacaaactaaccttcaccacgaccaaacaaccagaactcggaccctggtcctcgggctgccctacaggaagcacccctagtcctcttgctctctgctagatgagacggcaggctcaggttcctccatgaggcccggctttcagtgctctctgttacacactgcaaggaagcttccagatcgtggagcacattgttgaggaaaagacacttggggagaagggggaggtgcagagtgtggttaatggtgggaaggaactccggtaagtggttatatgatctgctcctattatcccctggaataggagcctctctccactcaagtagagatgccaaggactggcccggcatggtggctcatgcctgtaatcccggcactttgggaggcaaagcaggcggatcgcttaacaggagtttgagaccagcctggccaacatggcgaaaccctttcctactaaaaatacaaaaatcagccgggcatggtggtggcaggtgcctgtaatcccgctactcaggaggctgaggcatgagaattgcttgaatctgggaggtcgaggctgcagtggctgagattgcaccattgcactccagcctgggcaataaagcaaggctctgtctttaaaataaaagaaaaaacaagttattctaactttttttaattttaaaagattaaaaaaagagaagtcaaggactgaaattgcatagagggcaatgctttttctttataggtggtgaactgggtctgcttgagttttttctctggtaatttagaaccaatggaagcaactcaacagctctaatttaattggcagaatgtgagatggaatgggacctcaaatgaaactccaggccaagagctctgagccctgcagcatgtggggcatctctcggtcttcttgagttctgtaacttaaagttttgtggcctttaaagagtgtggaagtagccgtcccctctccgaaggtgcacaggatttggcagcccacccgcgtggccttccccttcccctctccagaccctccacagcagatggggcccggaggcctggagaagtggagtcactgacctgaggctacatggctggcaggcagcagggcaggcagcaaagcaggcagtgagggcctaactgcccgcgggctggctcggggctccctcaccacattggcatcccagtgccaatcccaaattgttttctttctatctctccagacatgagatagcatggaggtggagggaattccctcccacacagagggcgatatgccccagaacacactcctgcccccaagaaggctgtctcctgacactttttactgctcttttactctccccagctttttttttcctgcttgtaaactgcatttttcctttcccttggtttctggctctaactgttttcccagggcttggctccggcgcttgcacagagataaacacggccattggcctgtgcacaatcccagcttgcctgcatccggcctcttccatcctgagtctccaggggtccctgggttcagggacaatggctgagggagaagctgggagttccccccagggtttgcctccgtactcttgggccagccaagggagtggggctgggagcttcaggatggcttttgggaagccctgggagccccaaggcttgggtagctgctgacagggagttcacagcaggaacgctcccagctcccatcctgcgtccgcttggcaggcaggccaggaatgggagggaagccatccgttttccctttccactggatgttcccttcgccttccccagggaggagtgatgaggctggggtgcggggagggcagtatgggggcaggcttgggaccaggcctgcagaagcagcagaccctccagcccacctacctctctggcctggcatctgaggggcaggtcatgccatagtttttcccttccctctctgcccccacactttcctccccaaagtggcagacttcccccaggagaagcactgcttttcacgctgctgtgagtctcagtcactattagagaaacacagtcagagccaggccgcccaactgtcgcagggctgggtccacctcatggcctttgttctggaaaaatacttgggattctgccctgcaatgcacttagccaaggccgggcacatggcaagtgctgagtcatggcggctagcactttactgcgattttaggagcactttcttgtggtgaggttctgactgcttgttgggttgggggaggggagtctttgggcaggcggtagacctgccctttactttgtgtggcggatctgagtctgaccccatctttttagacccaaaaccctgatatttgtagtgcgcctggatactggttctccagtcttctttggggtcagggggcgttatagtgcctcatgccaccactcagccctcttcctgcatcttatggtctgtctctaccaactaggctaagtaggttattttattattcctcaaggggaattcagctcttcttgttcaaaagttctgattaattttcttgctctcattcaaagaatttttaaattcattcattcattcaacaaataattaagcttctctagaatgccaggcactgagagtccagatgggagccaaagcagacatggtcagtggcctcaggagcttccgtccagctgtcagtcacataatcaccctgacaaatgtgagctcgacgaggctaggactgagagatctgccttgctgggataggtcaggagaggctacccagaggaggacagtcagtctgaaatctgaaaggtggatagaagttagggaggtgggaaggggagggaaagcttttcgacagagggattcgccttcataaagccccacagtaagacagcatggtgagccaaaactgaaagatcggggggcagcgtgagatcccagccctaaaactctcacttagcttcaagtaaactgtttctccataatattgataccagtagcactctgaggggctaggggagtgtgagatcacacaggccttgaaggccacactaacccaaggacaatgggaagctctttaaggtttcgcaggggatgggatatacatgatcagatttgcatttccaaaagatcactctggctggctcatgcctgtaatccagctatttgggaggctaaagcaggaggatcacttgagccaggagtttgagaccagcctgggcaatatagtgagaacctgtctccattaaaaaaaaaaaaaaaaaaaggtttgtatggtggctcacgcctgtaatcccagcactttgggaggcggagggggcggatcacgaggtcaggagattgagaccatcctggccaatatggtgaaaccccatcctgctaaaaatacaaaaaattagccgggcgtagtggcgggcgcctgtagtcccagctactgggaggctgaggcaggagaatggcgtgaacccgggaggcggagcttgcagtgagccgaattgcgccactgcactccagcctgggcgacagagcgagactccgtctcaaaaaaaaaaaaaaaaaaaatacaaaaattatctgggcatggtggcatgcgcctgtagtccccgctactcggagactgaggcaggagacttgcttgaaccagggcggaggttgcagtgagccgagatcggccactgcactccagcctggggacagagagagactccatctaaaaaaaaaaaaaatgtttaaaaagattgctgtggcttcagagtggccattgtgttggaaggggtagagcagatgtggtggaccgggcagggtagtagtccaggggagagccacaggaacctgggctgggttggagtggatttgagatgtactttggaagttcagctgccagaacttactgatatctgtggcggatgaaggagaggggtttcaaggacgttgcctgggtttttggcttggcagtagcagggcggtaatgtcagttactgagggagggaacaccaagagaagacaaagtttagggggacaggatacagtgcgatttcagatgcactggagaaaattttgacacaaggtactgtctgggccccagtggctctgctctaatacatttataactctttgtccgcacttaatcactctgtcatactagctgccagggggccaagaaatgtcaagtgtttggctggtcttctccaactaaaattaaaatcctttgctaaggaagaaggagagaacattgctagcagtctgcctcaacatcccaattgatggcgtatttgccgcagccaccagctcatcaaggacagctgcggtgaacctttgagtctgagtaatctcctgtctgggccacctttcttcactcaaccacaaaatcctcacattccaagtatattttctttctttcttttttttgtttttttgagacagagtcttgctgtgttcccaggctggagtgcagtggtgtgatcttggctcactgcaacctccgcctcctgggttcagcaattctccctgcctcagcctcctgagtagctgggattacaggcatgcccggctaattttgtatttttagtagagacggagtttcaccatgttggccaggctggtcttgaactcctgcctcaggtgatctgcccaccttggcctccaaagtgctgggattacaagcatgagccacccgcctgtccccaagtatattttcttagctcactcttttcagcatgtaatttacagaaggtaatctgaattgtaaacacgatttctaagttaaaactcctgggtcagctcgtgatgaagagcaatttataaaagagatagtatagtaataaatgagacaactacactcggaaatgtggatcatcaactcttatgcgaaaatagcctatgagactcttgtgttttttcattcatgccagcgcttcctcacttccatcccattccattccacatgctcttctttctgcctggattattccattccaccattatttttctcctggtaaactcctattcatacttaaaaaccctgctcatgaccccttctctgtgaaaactttgtggcaaaacctaaccacttctgcttgtgcacactctcttccatctgtgtgcatatagtatgtgtctataactggaagggtgtttatctgttatcgtttgtctgccctgctaaagtgtgagctcctacagttacagggttgtgtgttagtcctgtgcctgcacagtacccagccagtagttacactcagtgttgctgaaccaacctctggtcaaaaacatgtttatacttgcttttccaaggcgccaatccaaatctcttatttactttaaaaacaaataacttcttggcactttaaaaaccacattcaaataacagaaaaagagttcattgaactttaagtatcaatcttaaaatgaattgtatgttttaaaacttgacttagtgacacacttaagagaatttttaaaaagcaaacttttatttttaccccagtgtaacaaatattagttccattaaattattaaactgatctaccttttcttttttttttgagatggagtcttgcctgttgcccaggctggagtctagtggggcaatctcggctcactgcaacctccgcctaccaggttcaagcgattcttctgcctcagcctcccgagtagctgggactacaagtgcacactccacacccagctaatttttgtgtttttagtagagacggggtttcaccatgttggccaggtggtcacgaactcctgacctaaagtgatctgctcgccttggcctcccaaagtgctgggatacaggtgtgagccaccatacccagcctgtttttcattttttggttctttttttttttttttttttttttgagacaggttcttcctctcaggctggagtgcagtgatcatagctcactcagcctcaaccacctgggctcaagcaatcttcccacttcagcctcccgagtagctgggactcaggcatgcaccaccatgcctggctaatttttttttattatttgtggagatggggtttgccatgttgcccaggctggtctcaaactcctgggctcaagtaatctacctgcgttggctcccaaagtgctgggattacaggtgatttaccttttaactgtgccaaagaacaaagcactactttatttgctctcctgtatttaaaatggtcctttatacctcagatccagaaagataacacaagtaaactaacaagtactctacttgtatcatttgttgttttctaacagtttacattagtccatctttgaagggtaaagaccattgattgctcatctaacttcttcaccttgaattagtgagattttcttccacctttcacaaatgcatgcccaaaatttgacttcagtgtagattggaattaaaatgtatgcaatcccatttcttacagtaggagccaaatgttcatcaagtcccctctgagctcagtatcttgtagctaaatgaccactatcttccagtcacgtttttaaaaaaatcatgctggtttgcaacaaaaattgtattttctttactaggcaagtgaaccatttgttgggaagagtaccttggcttcgagaaaaaaatgatttcattctgaaaggcttccctccaaccccctcctgcacaaactctcagcccagtaacttgtcagtattctggaaaagtgattacaaaacaaaaactcgaatcagataaaatatatctctggaacttttgaggcagatcatgaagctctgatttcaggtgctagcaaaataaagcaggcactctcattttgtattgtttacttctcagtttttcatggtgtctcctaaactttgatgttttgaagaagttctaatgttgctacatcagcaggagctgaccacagggaagagataaatatagctctccttggaaagggaaggcttagccaccagaattctgccccttgatgctgagaatgcaccttctccgaacagtggaaaagaggggtggagattaccccagggacatatcttgcaaaatgctgatacccgaaatgtacatagccttgtgctttggtcatcctcccaaatcatgtccttggtgaaggcacatgagaggagagcagatgctgccagaccacggtgcctgacgccatgcactccctcacgtccgcctgtttatgtgcacacggctgcagcgggaccttggggtgtgggctaaataacaagaaaggggctcctctggggtctgttacaaggcagagatgctccacggtaattagggatttagggaagaggaaggaacacacatgttgataataagtagttcaacattattatccccattttcagatgcagctactgagcttagagaggtttcataacttgcccagagcccctcaactagtaacagtggagccgagatttgaacgacccaaagaggaaagcaaacaagcagcccctttatactttttttttttttaagatgagggtcttgctatgttgcccaggctgatattgaattccggccacaagtgattcaccaccttggccccacgaagtactgggattacagtcatgagctacacactgggccaaagccctcgtattgtaacctccaagatgttttcatttctaaagtcaaggttgtcagagttgctgttttgcagggagccatgggatggggagtctccgggaaacccagctggctccttaaatggcatcacccaagttggccatcaagcttccccagactcagtcaccggccccctctttccctggctgtagagcaggggtttggactcgaggctgctgagttccttccagcttccatgcccagtggcagtgacttatcaactggcccacccggtggatgtagggtgatgcagccctgctctgtcctcttgagtgctgggtggccatgagagagggaggccatggagggaggggagggttctcatctgcttagtgccaccccctccccagcccaccccaggtctctgccgccttgggttcctgcgtgagcagtccttctcactctgggcgatgttcgctttcccagcccaaccccaagaagtccaccctggggaggacagagggagtctccacggctccaccccccatgctttgtcggagatctggccaggcagagtggtgccctcttgactgagcctcggcctttgctttccccttactccacataaagccgcagccctggcgagggagcccagaggctgaggacagcctgctgggtgcctggcactctctagatcctccctgcctgggcggtgggctctgcaattctccctgtctcgaactgcagcagaatgtgtgggcagggttaggcagataggagtgggtgcctggactcattggtcagactctaagaccgcccacccccgccgcccccgcgtccttcccaggactggctgacccaccagataggggagggtgttgtttcttattattacttttttgagaaaagctatgcaggcctgggagacgtctgtgccctaggagtcccttctggctgaagactcaaggctgcaaacaggtgctgagagggaacaagaaggggagttggggtgcacacacccagtgacagaccaggagtgagtgctgtggccacagattctaatcctcacaacgcagtgtgatttaggctaagccccttgcctactccgattcttgccttaaataagtgaaaggaaagtcaagtttgatgagttgtggctctttagtgggtggatttgcatgtaccatggatacatttaccagggtctaggaattgtcaagcgcccagcaggctgccatcaggcctccgactccttcgccaggcggctttatttggagtaagaggaaagcaaaggtttgaggctcagtcagagggcgccactctgcctggccagctctccgacaaagcagacgggggggtgtggagcctggtgaccccctccgtcctccccagggtgggctccttgggcttgggctggtggaagtgatattgcctgcagcaagaagaaggactgttcatgtgggagcgcaaggcggcagcggggttgaaacccacccccacacagtcaacacctgctgtcacaccaggctaatcaagaacaccttctttggtgcattaaccacctgctattaaataaagggctgttactaggtggcaaagtaaccactgcagtagagcctatttgtaatctgagatcagtggctgtaaggcaccatccttgagcaagcaagtactaatattcttgttatcttaattagaatgcaagagatcgtgtttttaaattctctttgaatctgtcactttgccctcctcttcctgggtgatacacctggtagtgctgtgggggccatcataatgccccttgtcccagattcccttcttttagatgggactcgagcatgatcatttcagccctgtatctctcaggtcagcgtggttcagtttgctgtgcagagtccggggagataaccacgctgtgcacacatgagattggctgacttggcaggactgtgcaatttcagaaggccgtggggagtgggggccagtgcctgcagcctgccctgcctctctcacaggccttagagcatcgccaggtgcagagctccacagctctctttcccaaggagtaatcagaggtgagaacgtggagcctggtggacaggtgaaagcactgggatctttctgcccagaaagggaaagttgcacatttatatcctagagggaagcgacagcagtgcttctccctgtgctgagtacaggtaaggagggtggtttgtaaagttcactggggagggtgatccctctttattgtttaatattatgctcgcagcctccttgacaacatcatgcaaaatgtgtcttactagcttctgtgcataaaatattggtggagctcttcgctgtgctgggccagtcaccagtgctgggcacgtgggtcaaggcagtgcccaggacgggcacagccctgccttcccaagctatggtttatttggtaggatctgcctgcccagtgaagtgtgttcagctgctcctgttgctgggggaagcttgctctctgccttcggctgcctcccacacgctcccatgtgtctcccagtccctaaccccagtcctgctttcaataccgcaggggcttttagctgacttttctccatcttcttaaagggaggatttcctggcagagacataacgtctttctggaaatgaaagaagctgatgcatgtttttcttttctgaattacttaaataagaggaactcatttccaggtattccctgccttgttttattgtgggagtgtggtcccagctgcccatctgatcagctgacatagggtccttggggccaggcactgttactgcttgggattgaaagatgaaagccacagggccaggcacagcagctgtgcctctaatctcatcactttggaaagccgaggtgggcggatcgctggaggtcaggagttgagaccagcctggccaacatggtgaaacgctgtctttactaaaaatacaaaaattagaggaggtggtggtatgcacctgtaatcacagctactcaggagtctgaggcacgagaatccttgaacccagggacagaagttgcagtgagccgagatcgcaccactgcactctttgagatctgtctcaaaaaaaaaaaaaaaaaaaaaaagggaaagcaatggcctggcttggctggaatggaacatgcatcaacgtgtcccacgtgtctccagcagggatagcgaaggcctgcccctggcacatggtagactgagtaaatgttgatcagtgagaccttgaggcactttagagtttacaatccagagagggagatagattggaagttcaagggtggacacctgggcatgattcccggacgaaggctgcagtcggttctaagaagtatgctggtgactatgagagaagaggttgtggtttcctctcttgaaagctgtctccataatcacatgtggggtgataagggctctggtcaggggagggggcgaggcacacagggggctgaatctgatggcatgaggacttggtgatggctgtggggaaagaattggagatgactctagggcctgagggtgggaagctgggagttcacgggatcactgatagaaacgcggaggtggggggtgccaagctgattttcctgattagattcctacagaactgcaggaataaggcgagagccatcgccctgggtggatttctgtttggagtctatcgctggaccactgtggacaagtatttcatagaacgacccccagtagcccaattcaggtttagaggggcagctcttgacaggagcaaactccagggcctctgcaaccccccagcgagtcccaaacatctgacatgtagccaatggaggacatgcaagtggtggggttcccagcgggaccacctcctgccttgggtttccaagacagagcgaggggtgctgctggggcgtggttgcaggggccttgtcagaactcgatgctttctcctccgtctgggtcctaactgcagtgctctagagaccctcctctgactcaggcataaggacggcccgcatattcatgcaggttacttgaacaagaacagtctgtgggttacttccctaggaatgaggaagatgaagagctagatacaatgctgggctggtatctgcctgatagtgctttgccaagactatggtttcttcctctttgatcaaaaaagacacaggagtcagacaaatggggattaaaagacaactgagttgatgtaaatgtaacaggcaacactatggacacagaaagtagattagaggctgcttaggacctaagtggagggcagtaggggagcgacagctgaagggtatggagtttctccgtgccgatgaaatgttctacagttgactgtggctatggctgcacatgtctgtgaatatcctagaaaccactgagggttcactttaaatgggcgaattgtatggtatatgaattatgtttcaataaagctctacacagctaagctgtgtggccatggctgggcttcctagcagtgtcccccaaccccaaatgaacttactctcccagcacttgggcctccccattaccccctgtctgccctgaggataacctctctccaagaaggacagagcaggggctgtgggccaccattcaggaaaggtgctccttcccctgggggagggaacccagaggtcatggacagaagccttctcagacatgcaaaaaaatgaggctgtcgggcgccgtggctcacacctgtaatcccagcactttgggaggccgagggggcggatcacgaggtcaagagattgagaccatcctggctaacatggtgaaaccccatcctactaaaaatacaaaaattagctgggtgtggtggcacgtgcctgtagtcccagctactgggaggctgaggcaggagaatggtgggaacctgggaggcaaaggttgcaatgagctgagttgtgccactgcactccagcctggtgacacagtgaaactccatctcaaaaaaaaaaacacatgaggcctcagaaatgtagctcccaaaaccccctacccagggctgtgcagaagccaaccaggttcctattttcccaggatgatgaacagttttcaaagcttagtaggattgtgggtattttgtctcattgtctgttgtttttccatttttctagatcatatatatataatatttaactatatataatatgtatatagtgtgtgtatatatatatataatatgtatatattaggtaagtgtaaataaaatcagggacagggttggagcgcagcaggaaagagcctgctggggatagagtctctgggctgtcagggccgggctgggcgggctccgttgttaatggcttcccctctcttgcaggagccatgtggctagaaatcctcctcacttcagtgctgggctttgccatctctggttcatctcccgggacaaagaggaaactttgccacttgaagatgggtggtgggggcaggcacgaggtccgcagccagggaggacgacagcatccgccctttcaaggtggaaacgtagatgaggagatccacgtaaggcaccttgggccgggccgggctgggcagtggagagggtgtgtgtcgaagacaggggttgggtcttaggccagatgcgggaggggacgggggcttgggatggtccatcctacttgggagtgtgtttcagtctgcttttcctctgctgggcaggtgcagttgctttggagagggatgcccagccctcccactttctctcttctcctttccctacccaggcccagcagtgctcaggcaggagatggggtaacctgtatcaaaggtcacagaaagcagtgtcatcacctcctctatgccctgcctgaagccttgggagtgaggttgtgggagaaagtagcaggttcccgtcagagacccaggaagcactgagaaggcagggatgctactggttaggaccggctgtgtgtcagccattcctggtcacattcaatccctacggtgatcccgcggggtaggattgttgttcccaaactgcagatgcagaagctgaagctcaggggcataaagcaactgttcaaggcggcctagctaacatgcggaaggatttgaagtccaatctaatcctgaagctctgcccctcctctgcacagggatagagtcaggaaggaggtgactgggcaggtggggtgactgagaatgcattctcggggaggagcaaggcttgagtgggggacaggacggtaggcaggctggcatggccctgccaatcctttctttcattccgtgggttttgagcacctactgtgtgaggcccagtgagtgcttgggagaagagacagccccttccgtccaacagcatacagtccatgaatgagaaaaggaatgtgcacaaagaaaagtagactaaaagataaataaagataggcaggtgcggtggctcacgcttttaatcccagcactttaggaggctgaggcggtggatcactgaggtcaggagttcaagaccagcctggccaacatcgtgaaaccccgtctctactaaaatacaaaaaattagccgggcatagtggcgggcacctataataatcccagctactcgggagctgaggcaggagaatcccttgaacccaggaggcagaggctgcagtgagccaagatcacacactgcactccagcctgggcaacaagagtgaaatgccatctcaaaaaaagaaacagatgataaggataaatgtcacaaaaagcatggataaaagtcatgagagttccaaggaggaagaatttaaaagcagaagctgggctaaacccaagagcaaccaggctgaggctccctgggtagacttgcttgctgcagccttgctatttagggccaaggctgagccctaaggaaagctccttagggaattagactcctaagggagtctgagatttccaaaatctgtttgggggtaactgaacacttgggaagaagcctgggaatggtgatgcttgagaggctctctaagctgacatgaactcctccctctggggctggccttttagcctaatacatgccaatgagacttgcaccctctccctggtctgtaaattttttagtttttggagacagggtcttgctctgtcaccaggctgggtgcagtggtgcgatcttggctcactgcaacctccgcctcctgggttcaagcgattctccgcctcagcctcccaagtagctggcattacaggcacctgtcaccatgcctggctaattttgtatttttagtagagatggggtttcgccatgttggccaggctggtctcgaactcctgactcaagtgatccacctgccttggcctcccaaagcactgggattacaggcgtgaaccaccggctgggcctggcctgtaatttttatcccaactcagttataatgtatcattcaatgttgttatcaggggtcaggaaaccaggcccatagaccaaatgtagcctgctacctgttttagcaagcgcccatgccaagaatagtgtttacctctttaaatagttagggggaaaaaaatcaaagaagaataatagtttgtgacgtgaaaattatatagcagtcagatttcagtgtccataaattttattggaacacagccacccccattcatctgtgcattggctatggctgtccataaataagttttattggaacacagccacccccattcatctgtgcattggctgtggctgctttcaactatgaagacagagtggagtcactgcagcctgcaaagcctagaatatttactatctggcctttacagaaaaagtttgccgactcccgctgtagagacgcctgggtaaattaaagatggtatcgtgtatacacttaaagagtaaaagatgagctgggcgcagtggcttacacctgtatcccaccactttgggaggccaaggcagacagatcacttgaagccaggagttcaagaccacctggccaacatggcaaaaccccgtctctactaaaaatgcaaaaattagccggacatggggctcacacctgtaatcccagctactctgggagctgaggcatgactggcttgaacctggaggtgggggttgcagtgggccgagatcacgccactgccctccagcctgggcaacagagtagaccctatctcaaaaaaaaaaaaagaaaaaagaaaaaagaaatgcgaagtctacagtgagaaggaagaagtgaagaacacatccgctttgggagtagccagtgatgtgggaaactgcttgccactcccagagggcagtatcttgtggctgcagggtttgctgtgttttctggaaacgactttgctcttgtgctctgtccttcccatccctctcaacttggggtcctgaattttgcccaggacttacaccagaggatcgataagttccgtttcaccccacctttggaggacagctcttccactatggcttcaactccaactacctgaagaaagtcatctcctactggcggaatgatttgactggaagaagcaggtggagattctcaacagataccctcacttcaagactaagatgaaggtatgtttgcaaaacgccagccagagagggatgtatgtcatgagaacagccttctccacaatgtgacttacagtcagataaagttggagagattcagaacccaattataggtcctgagatgtacttatacgttgtaaccttactaaatgcaaaaatattgcagtcacaacaatctgtccatctttagagctaggcaggaacacatacatgcaatttaaaaaccaaagaaatcaccatccagtccaatgatgtggcaatctttgagaggaaggatggagatgagatttagaccaggccaagtggggtggctcagaactgtaatcccagcactttgggaggctgaggtgggagatcacgaggtcaagagttcaagcagcctggccaagatggtgaaatcccatctctactgaaatacaaaaaatagccaggtgtgttggcaggcagctgtaatcccagctactctggagctgaagcagagaattgcttgaagccaggaggcggaggttgcagtgagccaagatcgcgcactgcactccagcctgggctccatctcaaagaaagaaaagactctgctctcagttctttggatctatactcagaagtggacttgttggatcatacggtaattctgcgtttaattttctaggaaccgccatactgcgttccgcagcagctgcaccattttactttcccacccaacaatcctcagaatcccgattctccaaatccttgccaatatttttttcctttctttttttcggtatggtcatcctaatgggtatgaaatggtatcacattgtggttttgagttgcattttcctatgattactgatgttgagcattttttatgcggtacttattggattctttgtaatttctcgaagaaatgtctgttcatgtcttttgtccattttttgggtgttttattagggtttaggattctctatatattctgaataaaatctcttatatttgcaaatgttttctcccactctgtggttgccatacaattaatctttttcagagacaaggtcttgctgtgttgctcaggctggaggcagcggctattcacaggcgtgatcatggctcaccacagcctcgaactcctgggctcaacaatcctctcgcctcagacctcctgaatagctggtactataggcgagcaccactgtgccagcttgttaattttttatattgaagaaattgtacatgttaggaatcttatttttaatgtttaagataatttggccttttcaaggaacagtgaagattttaatttgttaaaattctaggattacttaaagtgtatgaaagacatgttggtcagtcagataaactaaagttcctaaaaaaggaaattgaaattatagtgttaactgggtgtggtggcatgcacctgtagtcccagctatcaggaggctgaggcaggaggattgcttgagcccaggaattcaaggctgcagtgagctaaaggacaccactgcactgggtgacagatcaagaccccatctcttaaaaaaagagagagagctgggcacggtggcgcacgcctgtaatcccagcactttgggaggctgaggcaggtggacacgaggtcaggaggttgagaccatcgtagctaacacggtgaaatcctgtctctaataaaatacaaaaaattagccaggtgtggtggcgggtgcctgtagtcccagctactcgggaggtgaggcaggagaatggcgtgaacccaggagatggagcttgtggtgagctgagatcacacactgcactccagcctgggcgacagaatgagactctgtctttaaaaaaaaaaaaaaaaaaaggctgggcgccgtggctcacgcctgtaatcccagcactttgggaggtcaaggcgggcaatcacaaggtcaggagatcgagaccatcctggtctaacttggtgaaaccccgtctctacaaaaatacaaaaaattagccgggcgtggtggcaggcgcctgtggtcccagctacttgggggctgaggcagaagaatagcgtgaacccggaaggcggagcttgcagtgagcccagattggccactgcactccagcctgggtgacagggcaagactctgtctcaaaaaaaaaaaaaagaaaaaaaaaaaagccgggtgcggtggctcacacctgtaatcctagcactgtgggaggccgggcgggtggatcccaaggtcaagagatcgagaccatcctggccaacatggtgaaacccctctctactaaaaatacaaaaattagctgggcatggtggcacgtgcctgtagttccagctctcgggaggctgaggcaaaagaattgcttgaaccagggaggcggaggttgcagtgagccagatcgcgccactgcactccagcctggcaacagagcaagactccatctcaaaaaaaaaggagaaaggaaggatggacggaaacctcgacttggaggtgccagggcagcaaacatccttttctgatgcaagcaggccaggcctgtgggagaatgagccagagaaaagctaagtcaaatccagtggtgtgtgtcctggaactagagcccatcctggagctcagccaagaacactaaaaaaaaaaaaaaaaaaaaatctggaatgattttttggatcaaatttggacttctcttgagtttgctgtattctttacagtaatttgatatcttctattatgagcctaacaagaggatccagccacttaatcccagccaaactgctgtatgcaattaccataggttcctgtttggattccggcacgaaattgcctggcttccttgagtttgacttggatccctgtgttgtcccagctctcagtgtccatccagcagaaactaacagggcgcctgctgtacccaggcattctgctggggtggggacgcatagagaggacagggtccctccttcacagctcataggctcttcaggggcattccagcacatagtggcggtgttctgaaggaggaggctctgggagcttcatgagccccaaatcttcctttgaatgtgagggaaggcttcctggaggaggtggcatctaagctgaaatggtgggactttgccaggtgtgtggggaaggtggtccaagaaaggggaacagcatgttcaaggcccagaggcaggaggcagtaaagggccctttccatcctggcagctgccagccttacccactggaccctttcagggttcttcatgagactgggttttttttagagacagggtctcacctgtcagccaggctggagtgcagtggtgtgatcacagttcattgcagcctcaatttcctagctcaagcgatcctcccacctcagcctctcaagtagctgggaccacaggtatgcaccacacactaggcttttttttttttttttttttttcttgagacggagtctcgctctgtcaccaggctggagtgcagtgacgcaatctcgactcactgcaagctccgcctcccaggttcacgcattctcctgcctcagcctcccgagtagctgggactacaggcgcccgccaccatgcccactaattttttgtatttttagtagagacggggtttcaccgtgttagccaggatgatcttgtcgcctgacctcgtgatccacctgcctcagcctcccaaagtgctgggattacaggtatggccacggcacccggcctttgttttttctttcctttttttttttttttacatttttagtaagacaaggtctcaccatgtcacccaggctgatcgcaaactcctgggctcaagcaattctccaccttggcttcccaaagtatcaggattataggtgtgagccaccacacccagctgacatgggcatttatggtacaaaacctccctcaggtacaacggctccaaaagagccagtttccgcattgaattcatcgtggacttacccatgtgtggttctggcaccctgcccggggctggagcctgttcttggccttggtcctttagaataggagtaaatttggcaacataggaggacaccaggatacattgttaagttaaaaaaaaagagattctaaaatagaatgtatgtatggttcatttttgttaaaagttatgttctctaagtctttttaaaaagtttgaactgtcacagccagaagggtctaaagagacatgacagctcagtggtgtgtgagtcctggatgggatcctggacagaaaatggatatcaggggaaaaactgaggaaatctggctcatattttgttgtgtgtaataccagcattatccaggttttaaaaaggagaaaatcctggccgggtgtggtggctcacccagtaatcccaacactttgagaggccaaggtgggaggatggcttgagcccagtagtttagaccagcctgggcaacatagcgagaccccttctctacaaaaaaaaataacaaaaatagctagacatggtgttgcccacctgtagtcccagctacttgagaggctgaggtgggaggatacttgagcctgggaggttgaggctgcagtgagccgtgattgtgccactgcacttcagccgggcaacacagtgagacctcatctctaaaagaagaagaaaaaaaaaggaaatcctgcaagtgtgacaacatgaataaactctgaggaaataatgctaagtgaagtaagccagggacagacaaataccgcatgattccacctatagaaggaatctgaaatagtcaaactcagcagaagagagaggagaagggtggttgtcaggggctggggaataggggaaacggcattgctgatcgtgctgtgtaaagtttgagtcctgccagccgaatacatcctagagatgggctgtacagcaagcgccgtcagtgttggacacttacaatctgttaaaagggtaggacccatattaagtgtctcgccatataataaaaagtgtaaacactaaggaaatcaatggactttatagttaataaatctcagtctggttcgttaattgtaataaatgtaccatgctaacataaaatattaataaggaggaaacccggtgggtgtgaggtatatgggagttttctggactctttgcagtttttcgcaatctaaaactgttccaaaataaagtttagacagacaacaccatgttttctttagaggtgggattacatgtgagtcttccccctttggcttatctgtgttttctaagttttctacataaacatgtattatttgtataatatattaacgacagaacagaacattagctagaccatgtgactgcaccagccctggtggcagagagttccaagcatggcagccgccctcactgtgaagccgtaaggccccaggtgctgtccagggcactggcctgggaaggggctgccttcttttgtatgcagaggccccaagtcagtccagaggagacaagaatccattcacctgcccttggcttgatgatgttttcagcattgcacttaaaaaaaaatcttccactttattttattttaatttttgagatggagtcttgctctgttgcccaggctggagtgtggtggtgtgatctcggctcgtgcaacctctgcttcccaggttcaagcgattctcttgcctcagcctcccgagtagctgaattgcaggcgcctgtcagcatgcccgggtaatttttttgtatttttagtagagacgggtttcaccatgttggccaggctggtcttgagctcctgaccttaggtgatccacccgcctcgccttccaaagtgctgggattacaggcgtgagccaccacaccaggcccaaaaatcctccctttaaagaaaatatcatttggtaatcagaaaaaggtgacattttgtcaatgtgtatgaaaaaattatgcatttaatacctgttcattgtagaaaaattggaaagtacataaaactcaagagaaattaaaagcactggaatctactgctcaggagaactgctttttacattcttggatttatcctcccagacttttaaaattcaccaatacatggtataagtacagtataagcataatgactttttataaaaactgggtcacacaatggatatgacttgatcatttgcttttacccccagcaatatcttctgatcagttttctatgttaaataaatatacatctaccttgtcagttagatgactgtactggactccagtatactgtcaaactatacttgattaatcctgtattctggatacgtggggctttctccctaccctccagattttaaattattgaacaagtatttaggaggcctgctgtgagccaggagctgtcctgagccctggaaacccagcagtggctgtacgacctggcccagctgtcagggggcacctctaaggaaaccgggaggcaataatcgtagctccttgcagggaggttgtgaaggctgagtgaggacatctgtgcacctggagcacagtgtggtgtgaaaccagtgtcagcccttattactgtcaataccatgaagggggggcgggggcacaagggtggcaggactcaatatctaggctctggggggtgccagagcctgaccgtgcagggcttctctctccctccaccctgactgtgctctgtccccccagggctggacatccacttcaccacgtgaagcccccccagctgcccgcaggccataccccgaagcccttgctgatggtgccggctggcccggctctttctacgagttttataagatcatcccactcctgactgaccccagaaccatggcctgagcgatgagcacgtttttgaagtcatctgcccttccatccctggcttggcttctcagaggcatcctccaagaagggtacggggctgctagaggttccataactgcccgtcctcgccaagggtgggcccggtgttcccaccaggctctccttccggcggggtgagagggagttggcccgaggaagctgggaaaggaggggcctgagaggccggccccagacacacgccctccggggctggagatgccacccctatatttgggctccaggattccttcttgccttgtgagcttttctgacctccacctgggggtaggcgggcctgagaaatttcatagaacacagagggcccaaggagcaatctgcctgtgactccgtgactccatgcctttccccatcactccagggttcaactcggtggccaccgccaggatcttttacaagctgatgctgcggctgggttccaggaattctacattcaaggaggggactgggggtccctgatctgcactaatatggccagctggtgcccaggtgaggtcactgttggggtggtgtgtgtgtgtgtgtgtgtgtgtggtgtgtgtgtcctctaagaagtggacctgtgtgcagggtgggccaaggaccccccagggagaggagggagtgtgacctgtcactcagcagtgcctgaggcacgttgacttggatcctctgtctgtaacccagggttgcggctctgggtcaggttcccaggcagagaaggcctgtgatggaggggaaggtcaggcattagacctctctgctggaccaagctctgggacagccctgagagaactccccagaaactgtatttttcccccaacctcccttctccaactcccatggcctcccagtggggccagtgctgaaagaggctggctctgtgctcgctcctcagccctgaggcctttcctccgccatctctcctctctccctgtccttgacaccagcccagcctcaccccggccctctctctgccttcagccacgtgaaaggcctgcacttgaacatggctttggttttaagcacttctctaccctgaccctcctcctgggacagcgtttcgggaggtttcttggcctcactagagggatgtggagctgctgtaccccgtcaaggagaaggtattctacagcctgatgaggagagcggctacatgcacatccagtgcaccaagcctgacaccgtaggtgagtgtgctcagggtcctcgcccactgccggctccactggggcagggagacacccgcggggtaacctcaccccccaccccaatgctgcccacagaaggaagcctcttgtaaggacctcccagctctttagtctttaaactgcattttcccatagaatcaagaggatggaccctcagcagattcccaggcaatttagcaactctgtttagccgactcagtattcatagtggctttcacccctgatctccacccctgagtctatatcctacactgagaagcagagggatggagggggtgaggtaggaggatcctgggagtgggcagctctggggctgcaggggagaggggagagggtgccctggggcctggggaagaggttcccaggcagtgagggagggcccagcaaccatgtctgccaccagggtctgttaaaggacaatactttttcaaaaaggtaaatttataaaggaaccagtaaaattttaaaagaaacaattcaaagacaaataagaacactgaaattaatttgctaacagacacaaacttgtcaacatccacagagtaatatcaattaaatctccatgggacaaaattcatttgccctatgaacaagagtcattcgcattaccctcagttctttacaattcacagaactgtaaaaagctcaatgacaaggaaagatgggacccctgtagcatcacgtcagtccggaaggtctgcaggtaactccctagatcttgtccagaagacacccaggaattgtcttgcccatctcaaagtcttcatagttttcatggcaaacccatgcccacacacacgaggcagctcataatcataaaatggcactttataaaagtcagcatttttctctgattataaaatacatgttgtcaaaaacttaaaaatgcaaaaagtacaaaacattaaagacaatctcatataacctcttctccctcccacatcccctctccttcaaaagaacttgtgaacattttggtgagaattttcacaagtgagtacgtccatatcaccaacatggccccaacactccagatgcccctcggggttctctccaggtaccacgctctgacttctgactgagatggttttgattgtgcctgtttaagtcctataatagaatcacagagtatatacccttgagtctggcttcttttgctcaatattatgtttggagattcatttatgccattgtcccagctttatttatttattttttctcaagacccagtcggctctgttgcccagggtagagtgcagtggtgtgatctcagctcactgcaacctccgcccccaggttcaagcaattctcctgcctcagcctcccaagtagctgggattacaggcacctccaccatgcctggctaatgttttgtatttttagtagagacggggttttaccatgttggcaggctggtctcgaactcctgacctcaggtgatccacccgcctcggcctcccaaagtgctggattacaggtgtgagccaccgcacccagcctgtcccactgtcccagcctttttttttttttttttgagacagagtcttgctctgttgcccaggctagagtgcagtggtacgatctcgctcactgcaacctccacctcccgggttcaagcaatttgcctgcctcagcctcccaagtactgggattacaggcatgcaccaccatgccctgctaatttttttgtatttttaatagagaggggtttcaccatgtcagccaggatagtctcgaactccttaccgcaggtgatccaccttctcaccctcccaaagtgctgggattacaggcatgagccaatgcccccagcctgttccagcatttttaatgactgtacagtattttggcttatgagtatatcaatatttgtaactgatccctattttagacttttttaggtggcttctcatttttcatgaatcagagcacatagactgaaaaccccgcctttttaaaaacagcacttctcattgggaccccaccaaatgcagaggcgaggcccttcagtttgaaggaagctgagcaggcagtgtgccaggccctgggagacagtggaaggtatcgtccctgtttatcagatgaggatgccgaggcagagttaaggaagcgaggcagtgagcacccaggagttaaggcaggcctgtgctcgaacgtggcttcctgcacacagcccgccctctgcggccagtgccacacatcacacctgaagctccagctctctggtccccaggctgagtctctcccttgctccccgctccccgccaggctctgctctgaatgactctcctgtggtctggctgcctatattctagagaagttttccacctggaccaatacggaattccgatactggaggatggaggcctggaaaggtgaggccctggtttgcccctgcagtcatgaccctggcccagcagccaacctcctcaccctcttcatccccttgtctggttgctctgcatggggcatcagcaaattctattgttggctttcttacaaatcctcaccctgtgaccaacgtagctgcttttttgggtgaggtggcctggtgggttgttcccagcctcacagtgcatggtcaagactggatgcaggctcacctgcttgtgctccttttgctgaacaggcccctctggggattaggggcccacagggcagcaggcaccacattattgtcaagagcacctgggcttttcctcctgatccctggagagcctggcatcagggtcacgtgactgcgtgttccaggagggtggtcgcagaagacaggaggctgttaatctctcagagccttagaggctgtatcctctacatgcctgactccagctctgtggcctgactcaggcttcaccaaggtcagctctgacccaccctttccaggcccatccctttattccttcagtgacacacaggaccagacagtgctggggatgggaaagaagtaaaatgagactgaatcctgccttgggggtagggactctgtcttggccatgctgtagcccatcacctagaacaatgccgggtgaacagtgggagagcccagtacatagatgttgaagaatgcgcaaaggactgtgagagtccagtggaaggaggattctttgtctaagcggcagaaggggaaatgaccaggagaatgtatctgatttgggccttggaggataagtaggagtttgtggatggaggagagaaacttaggcaaagagaaaagcaataaaaatgcaaggaaagggtgttggaaagggtggcttgtccagaggctgaagcaggtacactggggccagatcaaaagcaactcattcctgcaggcaggtcctcacctcctccaagagcctcagcagggccttcgtctggatctgtttcccctgccctacattcagcaggacacaggggttgatggagcttctgcaagccaccttggcagggggtctggcctgctccttgcacacggatacctggagcaagatgtgagccccaccagactatcccactaggccactcctgcagctctggccccgggttacagggagaccaaatccctgagcaggaggtagacaggatcagatctgtgttctagaaagaacaggaaacactagggtggaaatggtggtcgtggtcgttttcaagctgcgggcagagccgaaaggggatggaagcacttggccaacttgcagaaatccagttcacagaggtgatgtgtatactggactagttttcattgaccagttttcattttgccaccaaaatcacattgaaaaggctgttcctttatctctgtccctgctccctgctgctgttgctagagattcagggtttgagtgaggaggtagggttgggagggcgtgctctggggaaagtggaaggtggggtgggggctgtggagttgcatcctggacccaagctggctaggtttggattctccacttaataagtaaaatggagaaatagtacctatgtcccataggctgttgagaggaaaacatgaattaaaagaaggtaagggcttagaacatgctgcctggtatgtggtcaccacagtagctggtgccctgagcagtttccggtgcaggggttgaggggagggaggagaggtcagtggcaggagagaggggacaggtgttagaggcaaggtgggtggggggaggaccttggggtgataagagacacttcaactaaatcatgcgctccagtctagtgccctgggcgcagcctgcctgtgacacgaggataccacacacttgcatgaggtctgaggagggaagccgcatgggcagggcctggcatttgtaggactttcggctgccctttgtcacacaactgcatgtggcactgagagtggggctttgtgttctgcgtcccaggaagttctccctggacgacctgctgaccaacgtcatgctctactggacaacaggaccatcatctcctcccagcgcttctacaaggagaacctgggacagggctggatgacccaaagcatgagcggtgagcctggctgagccgagaacaggggcctctgaggctggaggcaggggacggccagtcttgggctccacgaagggcacttggtggtgggataagtatagccttgctgcaggtgccccaggggcccttggatgggaacactaaaggtcgaggtgtttggagaaagcctcatggagggaccaggtgcctggctcccgggcggccctcagtaccgctccccagtctggatgctggtctggagtggcactgatggttctgggatttccaagtctcacatggaaacctcaaaggtggggatttagaggctgtcccatgcccctgcctgggtggccctcccagaaaaagaaggccctcagtgaggggagagcggttgagaccctggatttgtccttttctttatggtccttgtgggtgggccagctgatctcacccccaggcgctttaaccccctgctgtgcaggcggaggggcgcagggccacagcctcacccctccgtcggctctttcacttccaggatgaagtctatgtgcccactggcttctctgccttcccttttgagctattgcacacgcctgaaaatgggtgaggttcaagtacccaaagctcatctcctattcctacatggttcgtgggggccatttgcggcctttgaggagccggagctgctcgcccaggacatccgcaagttcctgtcggtctggagcggcaatgacccacccctctccccccgcctgccacctccccccacaagtgcccccaggcttttcttggggaagataccccttttctgaggaatgagtttgcctccgtcccctcccatgctgggagcccacgctcaccccctcacccctccaagctcactccccaacccccactccgtgtggtaagcaacatggctttgatgataaacgactttactctaaaagcggctggactcagtgacatgagcgtgcgctgaccccacatggggccccctgtgcaagcagagctggcggcccctccttgctggcagaggcacgggaggcctgctggggatgaggccactggccaggctatgctgcaccagaccaatggcaccgcccccacccctcccagcgcaggggcagcttgagcagaggcagcactggccaccactgcgggggcaagtcagcgtcaagagagtccctgaggagaaggcccagataagcccaggccccccaggccagcggacaggcacaggcagggcctaagaggtgccaaggccccaggccagttgtgctaggagcctggacctgctcttccacaccccatcccgcccctactgcacaggcttgtgccttggtgccccctggaggcagcagggaggagcttctcaggcagaagtcttaagttgcatcccattccccagaatccccaggagggagaaagggatgggctgcccctccttcctgccagagccacagctcaagggcagtgggatggcccgcacccagcccaggtaccccttcctctgtgccgaccatgctgtcctttggctccgaggagccctgagcactgcccacccccacaccttggagggagcagacggagggggtgagtactgacagagcctgcctggaggtgcagactcatgcactcagccctgaagaggtgagagaggctgatcttaactgtggtccaatgggcatattatgagtggtccttgtccctgcctgctatgggtaaccctgacccagctagcgtccctgacaacatgatacaaaaacacagaactctagcggatacagagatgtgtgcacagctggcaggagcactggccacctcccaacctgttccccaagcttactcctggatgtagcctggagggactgctgggctggggagggactggccatggacagggagctggatgccagcgggacctcagacctggactgcagcatctctttggttatcgttgtgtgtgtgctcagaagggaggaggccttccccttgttacatctctctctccatatatctcccggactcatcagtttggggggcgaaaagtccaccacatggtcttggcgacaaacactggggatgtcaccccagctgcagagctggaagcttgtgccggaggggaaactgggtggcaagggaggggcgaggcctgcctgtgctctcctcaccactgctgggaccagaaaagatggcacctgatagctcagctgggcagtcccaacgcattcccactcagccaagggcctgagcccaggccattctggttgtgtcttttcagagcagtgagacctaaaacagatgggaagaatcatgaacttgggagtcaggccgcttcacctgtcttctcaccccacaggctcccctgagctggcccagccagcagctcacccagcctcaggcctcctggggggcagcagccacactgccgtggcgctctgcgccaagcactgtccagggatagtcccgctgatgttgtggatggcacataggtctgctgctgctgctgctgcggagacagtgctgtcctctccgaggccaagccgtcagaatccgaggcacgtagggctgtcagcaaatggatttgtgcttggcctggacaggcagagcttccacactgcatccctcccctcctgcccttctcccaacaggacacagacagtggcataaaggacatatgaagaaacaccgacatccatttaggacattaagaccgaaaatatgcacctgcagaatttcctagcagccagggcaaaagagaaagcacagttatacagttctcagatcacagaaggaagcacaagagagcagttctcagaggaaactaaacttcctagccctgatcctaggaggatttctcactttgtagaagaaacaagtctacctatataggggggcttaaacgctgccctgggacccctgggatgctcaacatatctgtgtgagtctcattttgagtccatttcctcccaatcccaggctccagccactgaccccaggcacagagccctgccatactctcctgagaccctggctgtgagggcttgacatcatccacctgtcctgcatgttccctgctggccagcatagccacaggtgtgtcgctgggtaatgagtccttctgaggccctcccttgttggaacttgtccaaggacagacaccgataagagagcctgacacctgggaggcagccacagaaagaaccctgcagatgaggtcggctctgtcctggccacggctgtcaggaaggctgggactacagctctggaaccctggggctctgctttcccttcccagccccaccctaggagcagaccctggaggctgtgtgcagagagaactaggaaggcaaggagccctgtgtctctctacatggggtcttcctctgaagcaggtgcaatgttcatttcttgaattcaaagggaagtctgctgacaccctcttggagcctagtggaggacctcgcacaggcaggtgcatcgctgatgacaacctttgtcaaaccctagcgccttaccatgtgccttcactaaagccccaaactcaccagcattaaatatgcagagaaggaaagagagcagggaactgaaaccaagggggatggccataatcgagacaagactctatctcctcaacagtttcaaatatgcaggttaaaatacccaggggaccaggattccttctctgccattaattcacaaacttgcctgccatgtgatcttagcagagatgatcaaagatttgccggggcccatctggttgggactgttacaaccaaagcaaaaaaagggcgacaagctcagaggctgaggggcacagcttactgtgaacggtgggggcatgtggcctctgcctcacttcctttgtcacttgcaggctcttctgtctgcagataacagcaaaacttgcgatgataaacaaaactgatctctgtgaacgaacaccctccaaacacacagactttaacacccggaataatagtaccagctggcaccaagctccccagcagcccgagagaggaggggtgggggagtgcagggatgaggggaggaagggaagctacacatggcacccaaccaccacgcctttcccatggagaagcagaatctggagaaggctgctgctgtgttgatacagacagggtgggcggggttgacagcgagcccgtcccaccatctgttcctcccagggcttgaccggcagtggggtcgggggcctttactttgtagttcagagggctgaggtgcttgaagcatcaaagcaggtgtgagccaggcagaccaggatggtgagcagcagcaccaggaaggtgaacaagtggcgggggccttcatacctggtgatagagggtggctagccttggggtgggcagggagggccaccacctaccctcaccctgctgaggaaggggccgcacctggtgtggaaactgccgtgacttctccctcaggcagaaaataaaggcaaggcctaaccccccacccccacccctcactccagcagcaaggatggtgtcttcacagccaggaacacacagagggacccactgaatactggcatcatccctggtcagatttcaggcactggggtgccaagtcaatggcaattcttagcctccttgctggtccgttccctccagtctccagtgccctgggctagagaggatggacctcccacacccccagtctgaccggggcagacgtgtctttcccccaggagtgtcagtttttctcctccacgtccccacctcttccatgccaggaggtacaaggagctgggcccaaccacagcctcaaagggcaaatctggatcagcttccccatttcctctggttcagtccctgcacactgataaaggcactatcttctctccagggatgtatgggacaattgaccaggccttcacagggttacacctgcactcgggctagcttaggagccaggctgtcaacaccacacccaaccacccctcaccctgggtatcatgttttgattggacacctaaccagtcctcactctgggcacacattctgactagacatgtaaccaaccctcattctgggtaccacgttctgatgggacactaaccagccctcactctgggcaccacattctgactggatgccatgctgatgctgtgaaacaatgagggatctgactggctggtggggatgcagggctgggaggccaagggctggccccggtcagaagggctgctcacccaggcgcaggaaggaaaagaagtagagccagaagaggcaaggatgggggctgccaaggcctggttcacagcggcaaagtggatccccttctccagcttgctgggaggtagacgaagtagaggttgtgccggtccaccatgtgcttgagcaggatgtaatgaggcctgcaggggatggggctgtgagctggagacctcgcagggccacacagacaccctgtcctcttcctctccggggcggctattttggcaaggagccagggctggggctgctgcctactgcctgaacacaaaatgaggcatcctgcacctctggctactagttttttttcacttctctctcctacccacttcctcacttatctgtgaccccaaggtgtaggggatcggtcaggtggtgggagaaaatttaagataaagttataggaaatagacacaaaccttcttggaaagcgagaggtttgcatagcttcagtaaagggtttggctgaaggcagctgaattctcttaaagcttagggtgcagatacataggaatgtgggggagtttacctaaatagcttgtttactcagtggtcctaagaccaacctttgatcatccactggtgcatgattgctcgctattcaggggtcggcaatgttaattaccctctagtggtgtttactcgagacctttgtcatttagtctgtctaaataaatgcgaacttcgcctggcattgaggactacactgcagactcaggctgcagaccccttagccgcactgacaggcaaaatatctgtcagtgtatgtctgtctgtctgttttttgagacagagtctctgttgcccaggctggagtgcagtggtgcgatctcggctcactgcagctccgcctcctgggttcatgccattcttctgcctcagcctctcaagtagctgggactagggcgcctgacaccatgcccggctaattttttatatttttagtagagatagggtttcacatgttaaccaggatggtctcgatctcctgacctcgtgatccgcccacctttgcctcccaagtgctgggattacaggcgagagccaccgcacccggcagtgtatgtctttcatccgtcgtgggtcagggtctgtgggacagaccctgcaccaagggagtcacagtgtctgtgatcctgccccacagaacactaacattccagaatcatcttggaaagaggctgtttcacagttggatcctggcctcaattcctccccagcccttcccatgctgagcccctgtatgtcagtgctccccacccctggccttctcccacccggctgatccctgccctcatcacagtcaacagagaatgggcccaagggtcttaccccaggggtggcacaggagcacacaggggaccaacagaaagtggtgctgccttttctattatgccaggttcttttgtttttttattttttattttttttgagtggagtctcgctcattggtcaggctggagtgcactggtgcaatcttggctcactgcaactctgcctcctgagttcaagtgattctcctacctcagcctcccgagtagctgggattacagcgcctgccaccatgcccagttaatttttgtatttttagtagggacagggtttcatcatttggccaggttgttcttgaacttttgacctcaggtgatgcactgcctaggcctcccaaatgctgggattacaggcataagccatcgtgcccagccccaggttcttttttaaaaaataattttgttttgaaagtgtaaatactgtagatttttaaaactacacaagaaagtatacaggaaaactaaaacaacttttccccctaaaactcagctatcactgccagcagtctcttgggtttttgtttccttctagagcctttcattaatctgccagttgcagatgttttatttcagtgccaggaccttggtctttaaacagtcctgagttcaaaggctggttctcctgcttactaacacatacgaagttattttgtgtgaagggggaatagaaacaggaactgccttgtaggatgagtgagaaatgtggtaatccacgtggaggcaggcatctgccagagtgaaagcagcacgaggctttgattgtgactctggcactgtcttacttgctgctaaagaaatcaaccatgaacgaatagtcagtgggcagagaacctcagaccagaaatactaagagaggtcctagctgagggcagtgggaggaattcatttaaaaatga
